United States Patent 11,801,313 (MATERIALS AND METHODS FOR TREATMENT OF PAIN RELATED DISORDERS) - sequence listing, part 5

SEQ ID NO: 58902 - DNA, 20 bp, Artificial Sequence
  Description of Artificial Sequence: Synthetic oligonucleotide
  Target: SCN10A; (+) strand; PAM type: YTN; PAM sequence: CTA
cagctacaccccgacatgaa

SEQ ID NO: 58903 - DNA, 20 bp, Artificial Sequence
  Description of Artificial Sequence: Synthetic oligonucleotide
  Target: SCN10A; (+) strand; PAM type: YTN; PAM sequence: CTA
caccccgacatgaaaagtaa

SEQ ID NO: 58904 - DNA, 20 bp, Artificial Sequence
  Description of Artificial Sequence: Synthetic oligonucleotide
  Target: SCN10A; (+) strand; PAM type: YTN; PAM sequence: TTT
ataatgccaggtgaagctgg

SEQ ID NO: 58905 - DNA, 20 bp, Artificial Sequence
  Description of Artificial Sequence: Synthetic oligonucleotide
  Target: SCN10A; (+) strand; PAM type: YTN; PAM sequence: TTA
taatgccaggtgaagctggt

SEQ ID NO: 58906 - DNA, 20 bp, Artificial Sequence
  Description of Artificial Sequence: Synthetic oligonucleotide
  Target: SCN10A; (+) strand; PAM type: YTN; PAM sequence: CTG
gtgagcatgatttggccttt

SEQ ID NO: 58907 - DNA, 20 bp, Artificial Sequence
  Description of Artificial Sequence: Synthetic oligonucleotide
  Target: SCN10A; (+) strand; PAM type: YTN; PAM sequence: TTT
ggcctttatagggtcaaact

SEQ ID NO: 58908 - DNA, 20 bp, Artificial Sequence
  Description of Artificial Sequence: Synthetic oligonucleotide
  Target: SCN10A; (+) strand; PAM type: YTN; PAM sequence: TTG
gcctttatagggtcaaactt

SEQ ID NO: 58909 - DNA, 20 bp, Artificial Sequence
  Description of Artificial Sequence: Synthetic oligonucleotide
  Target: SCN10A; (+) strand; PAM type: YTN; PAM sequence: CTT
tatagggtcaaacttcagct

SEQ ID NO: 58910 - DNA, 20 bp, Artificial Sequence
  Description of Artificial Sequence: Synthetic oligonucleotide
  Target: SCN10A; (+) strand; PAM type: YTN; PAM sequence: TTT
atagggtcaaacttcagcta

SEQ ID NO: 58911 - DNA, 20 bp, Artificial Sequence
  Description of Artificial Sequence: Synthetic oligonucleotide
  Target: SCN10A; (+) strand; PAM type: YTN; PAM sequence: TTA
tagggtcaaacttcagctaa

SEQ ID NO: 58912 - DNA, 20 bp, Artificial Sequence
  Description of Artificial Sequence: Synthetic oligonucleotide
  Target: SCN10A; (+) strand; PAM type: YTN; PAM sequence: CTT
cagctaacccataagcccag

SEQ ID NO: 58913 - DNA, 20 bp, Artificial Sequence
  Description of Artificial Sequence: Synthetic oligonucleotide
  Target: SCN10A; (+) strand; PAM type: YTN; PAM sequence: TTC
agctaacccataagcccagg

SEQ ID NO: 58914 - DNA, 20 bp, Artificial Sequence
  Description of Artificial Sequence: Synthetic oligonucleotide
  Target: SCN10A; (+) strand; PAM type: YTN; PAM sequence: CTA
acccataagcccagggacag

SEQ ID NO: 58915 - DNA, 20 bp, Artificial Sequence
  Description of Artificial Sequence: Synthetic oligonucleotide
  Target: SCN10A; (+) strand; PAM type: YTN; PAM sequence: CTC
ttggctgttggtgacaggca

SEQ ID NO: 58916 - DNA, 20 bp, Artificial Sequence
  Description of Artificial Sequence: Synthetic oligonucleotide
  Target: SCN10A; (+) strand; PAM type: YTN; PAM sequence: CTT
ggctgttggtgacaggcagc

SEQ ID NO: 58917 - DNA, 20 bp, Artificial Sequence
  Description of Artificial Sequence: Synthetic oligonucleotide
  Target: SCN10A; (+) strand; PAM type: YTN; PAM sequence: TTG
gctgttggtgacaggcagca

SEQ ID NO: 58918 - DNA, 20 bp, Artificial Sequence
  Description of Artificial Sequence: Synthetic oligonucleotide
  Target: SCN10A; (+) strand; PAM type: YTN; PAM sequence: CTG
ttggtgacaggcagcaagtt

SEQ ID NO: 58919 - DNA, 20 bp, Artificial Sequence
  Description of Artificial Sequence: Synthetic oligonucleotide
  Target: SCN10A; (+) strand; PAM type: YTN; PAM sequence: TTG
gtgacaggcagcaagttcat

SEQ ID NO: 58920 - DNA, 20 bp, Artificial Sequence
  Description of Artificial Sequence: Synthetic oligonucleotide
  Target: SCN10A; (+) strand; PAM type: YTN; PAM sequence: TTC
attagaagattggagcctgt

SEQ ID NO: 58921 - DNA, 20 bp, Artificial Sequence
  Description of Artificial Sequence: Synthetic oligonucleotide
  Target: SCN10A; (+) strand; PAM type: YTN; PAM sequence: TTA
gaagattggagcctgttcta

SEQ ID NO: 58922 - DNA, 20 bp, Artificial Sequence
  Description of Artificial Sequence: Synthetic oligonucleotide
  Target: SCN10A; (+) strand; PAM type: YTN; PAM sequence: TTG
gagcctgttctaaactcagc

SEQ ID NO: 58923 - DNA, 20 bp, Artificial Sequence
  Description of Artificial Sequence: Synthetic oligonucleotide
  Target: SCN10A; (+) strand; PAM type: YTN; PAM sequence: CTG
ttctaaactcagcttcaacc

SEQ ID NO: 58924 - DNA, 20 bp, Artificial Sequence
  Description of Artificial Sequence: Synthetic oligonucleotide
  Target: SCN10A; (+) strand; PAM type: YTN; PAM sequence: TTC
taaactcagcttcaaccctt

SEQ ID NO: 58925 - DNA, 20 bp, Artificial Sequence
  Description of Artificial Sequence: Synthetic oligonucleotide
  Target: SCN10A; (+) strand; PAM type: YTN; PAM sequence: CTA
aactcagcttcaacccttgg

SEQ ID NO: 58926 - DNA, 20 bp, Artificial Sequence
  Description of Artificial Sequence: Synthetic oligonucleotide
  Target: SCN10A; (+) strand; PAM type: YTN; PAM sequence: CTC
agcttcaacccttggaaact

SEQ ID NO: 58927 - DNA, 20 bp, Artificial Sequence
  Description of Artificial Sequence: Synthetic oligonucleotide
  Target: SCN10A; (+) strand; PAM type: YTN; PAM sequence: CTT
caacccttggaaactctgtg

SEQ ID NO: 58928 - DNA, 20 bp, Artificial Sequence
  Description of Artificial Sequence: Synthetic oligonucleotide
  Target: SCN10A; (+) strand; PAM type: YTN; PAM sequence: TTC
aacccttggaaactctgtga

SEQ ID NO: 58929 - DNA, 20 bp, Artificial Sequence
  Description of Artificial Sequence: Synthetic oligonucleotide
  Target: SCN10A; (+) strand; PAM type: YTN; PAM sequence: CTT
ggaaactctgtgaccctgca

SEQ ID NO: 58930 - DNA, 20 bp, Artificial Sequence
  Description of Artificial Sequence: Synthetic oligonucleotide
  Target: SCN10A; (+) strand; PAM type: YTN; PAM sequence: TTG
gaaactctgtgaccctgcat

SEQ ID NO: 58931 - DNA, 20 bp, Artificial Sequence
  Description of Artificial Sequence: Synthetic oligonucleotide
  Target: SCN10A; (+) strand; PAM type: YTN; PAM sequence: CTC
tgtgaccctgcataatattc

SEQ ID NO: 58932 - DNA, 20 bp, Artificial Sequence
  Description of Artificial Sequence: Synthetic oligonucleotide
  Target: SCN10A; (+) strand; PAM type: YTN; PAM sequence: CTG
tgaccctgcataatattctt

SEQ ID NO: 58933 - DNA, 20 bp, Artificial Sequence
  Description of Artificial Sequence: Synthetic oligonucleotide
  Target: SCN10A; (+) strand; PAM type: YTN; PAM sequence: CTG
cataatattcttgatctctg

SEQ ID NO: 58934 - DNA, 20 bp, Artificial Sequence
  Description of Artificial Sequence: Synthetic oligonucleotide
  Target: SCN10A; (+) strand; PAM type: YTN; PAM sequence: TTC
ttgatctctgagtctcaatt

SEQ ID NO: 58935 - DNA, 20 bp, Artificial Sequence
  Description of Artificial Sequence: Synthetic oligonucleotide
  Target: SCN10A; (+) strand; PAM type: YTN; PAM sequence: CTT
gatctctgagtctcaatttt

SEQ ID NO: 58936 - DNA, 20 bp, Artificial Sequence
  Description of Artificial Sequence: Synthetic oligonucleotide
  Target: SCN10A; (+) strand; PAM type: YTN; PAM sequence: TTG
atctctgagtctcaatttta

SEQ ID NO: 58937 - DNA, 20 bp, Artificial Sequence
  Description of Artificial Sequence: Synthetic oligonucleotide
  Target: SCN10A; (+) strand; PAM type: YTN; PAM sequence: CTC
tgagtctcaattttaaatgt

SEQ ID NO: 58938 - DNA, 20 bp, Artificial Sequence
  Description of Artificial Sequence: Synthetic oligonucleotide
  Target: SCN10A; (+) strand; PAM type: YTN; PAM sequence: CTG
agtctcaattttaaatgtat

SEQ ID NO: 58939 - DNA, 20 bp, Artificial Sequence
  Description of Artificial Sequence: Synthetic oligonucleotide
  Target: SCN10A; (+) strand; PAM type: YTN; PAM sequence: CTC
aattttaaatgtataaaata

SEQ ID NO: 58940 - DNA, 20 bp, Artificial Sequence
  Description of Artificial Sequence: Synthetic oligonucleotide
  Target: SCN10A; (+) strand; PAM type: YTN; PAM sequence: TTT
taaatgtataaaataaggat

SEQ ID NO: 58941 - DNA, 20 bp, Artificial Sequence
  Description of Artificial Sequence: Synthetic oligonucleotide
  Target: SCN10A; (+) strand; PAM type: YTN; PAM sequence: TTT
aaatgtataaaataaggata

SEQ ID NO: 58942 - DNA, 20 bp, Artificial Sequence
  Description of Artificial Sequence: Synthetic oligonucleotide
  Target: SCN10A; (+) strand; PAM type: YTN; PAM sequence: TTA
aatgtataaaataaggataa

SEQ ID NO: 58943 - DNA, 20 bp, Artificial Sequence
  Description of Artificial Sequence: Synthetic oligonucleotide
  Target: SCN10A; (+) strand; PAM type: YTN; PAM sequence: CTG
cttgacagggctgctgtgaa

SEQ ID NO: 58944 - DNA, 20 bp, Artificial Sequence
  Description of Artificial Sequence: Synthetic oligonucleotide
  Target: SCN10A; (+) strand; PAM type: YTN; PAM sequence: CTT
gacagggctgctgtgaacat

SEQ ID NO: 58945 - DNA, 20 bp, Artificial Sequence
  Description of Artificial Sequence: Synthetic oligonucleotide
  Target: SCN10A; (+) strand; PAM type: YTN; PAM sequence: TTG
acagggctgctgtgaacatt

SEQ ID NO: 58946 - DNA, 20 bp, Artificial Sequence
  Description of Artificial Sequence: Synthetic oligonucleotide
  Target: SCN10A; (+) strand; PAM type: YTN; PAM sequence: CTG
ctgtgaacattcatggagcc

SEQ ID NO: 58947 - DNA, 20 bp, Artificial Sequence
  Description of Artificial Sequence: Synthetic oligonucleotide
  Target: SCN10A; (+) strand; PAM type: YTN; PAM sequence: CTG
tgaacattcatggagcccag

SEQ ID NO: 58948 - DNA, 20 bp, Artificial Sequence
  Description of Artificial Sequence: Synthetic oligonucleotide
  Target: SCN10A; (+) strand; PAM type: YTN; PAM sequence: TTC
atggagcccagctcagtgct

SEQ ID NO: 58949 - DNA, 20 bp, Artificial Sequence
  Description of Artificial Sequence: Synthetic oligonucleotide
  Target: SCN10A; (+) strand; PAM type: YTN; PAM sequence: CTC
agtgctcagaacttaggaag

SEQ ID NO: 58950 - DNA, 20 bp, Artificial Sequence
  Description of Artificial Sequence: Synthetic oligonucleotide
  Target: SCN10A; (+) strand; PAM type: YTN; PAM sequence: CTC
agaacttaggaagtattcag

SEQ ID NO: 58951 - DNA, 20 bp, Artificial Sequence
  Description of Artificial Sequence: Synthetic oligonucleotide
  Target: SCN10A; (+) strand; PAM type: YTN; PAM sequence: CTT
aggaagtattcagtcaaggc

SEQ ID NO: 58952 - DNA, 20 bp, Artificial Sequence
  Description of Artificial Sequence: Synthetic oligonucleotide
  Target: SCN10A; (+) strand; PAM type: YTN; PAM sequence: TTA
ggaagtattcagtcaaggca

SEQ ID NO: 58953 - DNA, 20 bp, Artificial Sequence
  Description of Artificial Sequence: Synthetic oligonucleotide
  Target: SCN10A; (+) strand; PAM type: YTN; PAM sequence: TTC
agtcaaggcagctccatttc

SEQ ID NO: 58954 - DNA, 20 bp, Artificial Sequence
  Description of Artificial Sequence: Synthetic oligonucleotide
  Target: SCN10A; (+) strand; PAM type: YTN; PAM sequence: CTC
catttccccatgttagcctc

SEQ ID NO: 58955 - DNA, 20 bp, Artificial Sequence
  Description of Artificial Sequence: Synthetic oligonucleotide
  Target: SCN10A; (+) strand; PAM type: YTN; PAM sequence: TTT
ccccatgttagcctctaact

SEQ ID NO: 58956 - DNA, 20 bp, Artificial Sequence
  Description of Artificial Sequence: Synthetic oligonucleotide
  Target: SCN10A; (+) strand; PAM type: YTN; PAM sequence: TTC
cccatgttagcctctaactc

SEQ ID NO: 58957 - DNA, 20 bp, Artificial Sequence
  Description of Artificial Sequence: Synthetic oligonucleotide
  Target: SCN10A; (+) strand; PAM type: YTN; PAM sequence: TTA
gcctctaactctagtaattt

SEQ ID NO: 58958 - DNA, 20 bp, Artificial Sequence
  Description of Artificial Sequence: Synthetic oligonucleotide
  Target: SCN10A; (+) strand; PAM type: YTN; PAM sequence: CTC
taactctagtaattttctct

SEQ ID NO: 58959 - DNA, 20 bp, Artificial Sequence
  Description of Artificial Sequence: Synthetic oligonucleotide
  Target: SCN10A; (+) strand; PAM type: YTN; PAM sequence: CTA
actctagtaattttctctga

SEQ ID NO: 58960 - DNA, 20 bp, Artificial Sequence
  Description of Artificial Sequence: Synthetic oligonucleotide
  Target: SCN10A; (+) strand; PAM type: YTN; PAM sequence: CTC
tagtaattttctctgaacac

SEQ ID NO: 58961 - DNA, 20 bp, Artificial Sequence
  Description of Artificial Sequence: Synthetic oligonucleotide
  Target: SCN10A; (+) strand; PAM type: YTN; PAM sequence: CTA
gtaattttctctgaacacca

SEQ ID NO: 58962 - DNA, 20 bp, Artificial Sequence
  Description of Artificial Sequence: Synthetic oligonucleotide
  Target: SCN10A; (+) strand; PAM type: YTN; PAM sequence: TTT
tctctgaacaccactggacc

SEQ ID NO: 58963 - DNA, 20 bp, Artificial Sequence
  Description of Artificial Sequence: Synthetic oligonucleotide
  Target: SCN10A; (+) strand; PAM type: YTN; PAM sequence: TTT
ctctgaacaccactggaccc

SEQ ID NO: 58964 - DNA, 20 bp, Artificial Sequence
  Description of Artificial Sequence: Synthetic oligonucleotide
  Target: SCN10A; (+) strand; PAM type: YTN; PAM sequence: TTC
tctgaacaccactggaccca

SEQ ID NO: 58965 - DNA, 20 bp, Artificial Sequence
  Description of Artificial Sequence: Synthetic oligonucleotide
  Target: SCN10A; (+) strand; PAM type: YTN; PAM sequence: CTC
tgaacaccactggacccaaa

SEQ ID NO: 58966 - DNA, 20 bp, Artificial Sequence
  Description of Artificial Sequence: Synthetic oligonucleotide
  Target: SCN10A; (+) strand; PAM type: YTN; PAM sequence: CTG
aacaccactggacccaaaat

SEQ ID NO: 58967 - DNA, 20 bp, Artificial Sequence
  Description of Artificial Sequence: Synthetic oligonucleotide
  Target: SCN10A; (+) strand; PAM type: YTN; PAM sequence: CTG
gacccaaaatactgggcctg

SEQ ID NO: 58968 - DNA, 20 bp, Artificial Sequence
  Description of Artificial Sequence: Synthetic oligonucleotide
  Target: SCN10A; (+) strand; PAM type: YTN; PAM sequence: CTG
ggcctgtcattcaacaacac

SEQ ID NO: 58969 - DNA, 20 bp, Artificial Sequence
  Description of Artificial Sequence: Synthetic oligonucleotide
  Target: SCN10A; (+) strand; PAM type: YTN; PAM sequence: CTG
tcattcaacaacacccagac

SEQ ID NO: 58970 - DNA, 20 bp, Artificial Sequence
  Description of Artificial Sequence: Synthetic oligonucleotide
  Target: SCN10A; (+) strand; PAM type: YTN; PAM sequence: TTC
aacaacacccagactgggcc

SEQ ID NO: 58971 - DNA, 20 bp, Artificial Sequence
  Description of Artificial Sequence: Synthetic oligonucleotide
  Target: SCN10A; (+) strand; PAM type: YTN; PAM sequence: CTG
ggccttaacagtattaattt

SEQ ID NO: 58972 - DNA, 20 bp, Artificial Sequence
  Description of Artificial Sequence: Synthetic oligonucleotide
  Target: SCN10A; (+) strand; PAM type: YTN; PAM sequence: CTT
aacagtattaatttcttggc

SEQ ID NO: 58973 - DNA, 20 bp, Artificial Sequence
  Description of Artificial Sequence: Synthetic oligonucleotide
  Target: SCN10A; (+) strand; PAM type: YTN; PAM sequence: TTA
acagtattaatttcttggca

SEQ ID NO: 58974 - DNA, 20 bp, Artificial Sequence
  Description of Artificial Sequence: Synthetic oligonucleotide
  Target: SCN10A; (+) strand; PAM type: YTN; PAM sequence: TTA
atttcttggcattgatatct

SEQ ID NO: 58975 - DNA, 20 bp, Artificial Sequence
  Description of Artificial Sequence: Synthetic oligonucleotide
  Target: SCN10A; (+) strand; PAM type: YTN; PAM sequence: TTT
cttggcattgatatcttgac

SEQ ID NO: 58976 - DNA, 20 bp, Artificial Sequence
  Description of Artificial Sequence: Synthetic oligonucleotide
  Target: SCN10A; (+) strand; PAM type: YTN; PAM sequence: TTC
ttggcattgatatcttgact

SEQ ID NO: 58977 - DNA, 20 bp, Artificial Sequence
  Description of Artificial Sequence: Synthetic oligonucleotide
  Target: SCN10A; (+) strand; PAM type: YTN; PAM sequence: CTT
ggcattgatatcttgacttt

SEQ ID NO: 58978 - DNA, 20 bp, Artificial Sequence
  Description of Artificial Sequence: Synthetic oligonucleotide
  Target: SCN10A; (+) strand; PAM type: YTN; PAM sequence: TTG
gcattgatatcttgactttt

SEQ ID NO: 58979 - DNA, 20 bp, Artificial Sequence
  Description of Artificial Sequence: Synthetic oligonucleotide
  Target: SCN10A; (+) strand; PAM type: YTN; PAM sequence: TTG
atatcttgacttttctatca

SEQ ID NO: 58980 - DNA, 20 bp, Artificial Sequence
  Description of Artificial Sequence: Synthetic oligonucleotide
  Target: SCN10A; (+) strand; PAM type: YTN; PAM sequence: CTT
gacttttctatcactcatgt

SEQ ID NO: 58981 - DNA, 20 bp, Artificial Sequence
  Description of Artificial Sequence: Synthetic oligonucleotide
  Target: SCN10A; (+) strand; PAM type: YTN; PAM sequence: TTG
acttttctatcactcatgtt

SEQ ID NO: 58982 - DNA, 20 bp, Artificial Sequence
  Description of Artificial Sequence: Synthetic oligonucleotide
  Target: SCN10A; (+) strand; PAM type: YTN; PAM sequence: CTT
ttctatcactcatgttccct

SEQ ID NO: 58983 - DNA, 20 bp, Artificial Sequence
  Description of Artificial Sequence: Synthetic oligonucleotide
  Target: SCN10A; (+) strand; PAM type: YTN; PAM sequence: TTT
tctatcactcatgttcccta

SEQ ID NO: 58984 - DNA, 20 bp, Artificial Sequence
  Description of Artificial Sequence: Synthetic oligonucleotide
  Target: SCN10A; (+) strand; PAM type: YTN; PAM sequence: TTT
ctatcactcatgttccctaa

SEQ ID NO: 58985 - DNA, 20 bp, Artificial Sequence
  Description of Artificial Sequence: Synthetic oligonucleotide
  Target: SCN10A; (+) strand; PAM type: YTN; PAM sequence: TTC
tatcactcatgttccctaat

SEQ ID NO: 58986 - DNA, 20 bp, Artificial Sequence
  Description of Artificial Sequence: Synthetic oligonucleotide
  Target: SCN10A; (+) strand; PAM type: YTN; PAM sequence: CTA
tcactcatgttccctaatag

SEQ ID NO: 58987 - DNA, 20 bp, Artificial Sequence
  Description of Artificial Sequence: Synthetic oligonucleotide
  Target: SCN10A; (+) strand; PAM type: YTN; PAM sequence: CTC
atgttccctaatagaacagt

SEQ ID NO: 58988 - DNA, 20 bp, Artificial Sequence
  Description of Artificial Sequence: Synthetic oligonucleotide
  Target: SCN10A; (+) strand; PAM type: YTN; PAM sequence: TTC
cctaatagaacagttgtgta

SEQ ID NO: 58989 - DNA, 20 bp, Artificial Sequence
  Description of Artificial Sequence: Synthetic oligonucleotide
  Target: SCN10A; (+) strand; PAM type: YTN; PAM sequence: CTA
atagaacagttgtgtagaga

SEQ ID NO: 58990 - DNA, 20 bp, Artificial Sequence
  Description of Artificial Sequence: Synthetic oligonucleotide
  Target: SCN10A; (+) strand; PAM type: YTN; PAM sequence: TTG
tgtagagatttaattccaga

SEQ ID NO: 58991 - DNA, 20 bp, Artificial Sequence
  Description of Artificial Sequence: Synthetic oligonucleotide
  Target: SCN10A; (+) strand; PAM type: YTN; PAM sequence: TTT
aattccagaccctagacttg

SEQ ID NO: 58992 - DNA, 20 bp, Artificial Sequence
  Description of Artificial Sequence: Synthetic oligonucleotide
  Target: SCN10A; (+) strand; PAM type: YTN; PAM sequence: TTA
attccagaccctagacttga

SEQ ID NO: 58993 - DNA, 20 bp, Artificial Sequence
  Description of Artificial Sequence: Synthetic oligonucleotide
  Target: SCN10A; (+) strand; PAM type: YTN; PAM sequence: TTC
cagaccctagacttgagaat

SEQ ID NO: 58994 - DNA, 20 bp, Artificial Sequence
  Description of Artificial Sequence: Synthetic oligonucleotide
  Target: SCN10A; (+) strand; PAM type: YTN; PAM sequence: CTA
gacttgagaatctcctttga

SEQ ID NO: 58995 - DNA, 20 bp, Artificial Sequence
  Description of Artificial Sequence: Synthetic oligonucleotide
  Target: SCN10A; (+) strand; PAM type: YTN; PAM sequence: CTT
gagaatctcctttgaacaat

SEQ ID NO: 58996 - DNA, 20 bp, Artificial Sequence
  Description of Artificial Sequence: Synthetic oligonucleotide
  Target: SCN10A; (+) strand; PAM type: YTN; PAM sequence: TTG
agaatctcctttgaacaatc

SEQ ID NO: 58997 - DNA, 20 bp, Artificial Sequence
  Description of Artificial Sequence: Synthetic oligonucleotide
  Target: SCN10A; (+) strand; PAM type: YTN; PAM sequence: CTC
ctttgaacaatctcctccca

SEQ ID NO: 58998 - DNA, 20 bp, Artificial Sequence
  Description of Artificial Sequence: Synthetic oligonucleotide
  Target: SCN10A; (+) strand; PAM type: YTN; PAM sequence: CTT
tgaacaatctcctcccagtc

SEQ ID NO: 58999 - DNA, 20 bp, Artificial Sequence
  Description of Artificial Sequence: Synthetic oligonucleotide
  Target: SCN10A; (+) strand; PAM type: YTN; PAM sequence: TTT
gaacaatctcctcccagtct

SEQ ID NO: 59000 - DNA, 20 bp, Artificial Sequence
  Description of Artificial Sequence: Synthetic oligonucleotide
  Target: SCN10A; (+) strand; PAM type: YTN; PAM sequence: TTG
aacaatctcctcccagtctt

SEQ ID NO: 59001 - DNA, 20 bp, Artificial Sequence
  Description of Artificial Sequence: Synthetic oligonucleotide
  Target: SCN10A; (+) strand; PAM type: YTN; PAM sequence: CTC
ctcccagtctttcctcactt

SEQ ID NO: 59002 - DNA, 20 bp, Artificial Sequence
  Description of Artificial Sequence: Synthetic oligonucleotide
  Target: SCN10A; (+) strand; PAM type: YTN; PAM sequence: CTC
ccagtctttcctcactttga

SEQ ID NO: 59003 - DNA, 20 bp, Artificial Sequence
  Description of Artificial Sequence: Synthetic oligonucleotide
  Target: SCN10A; (+) strand; PAM type: YTN; PAM sequence: CTT
tcctcactttgatggcaatc

SEQ ID NO: 59004 - DNA, 20 bp, Artificial Sequence
  Description of Artificial Sequence: Synthetic oligonucleotide
  Target: SCN10A; (+) strand; PAM type: YTN; PAM sequence: TTT
cctcactttgatggcaatcc

SEQ ID NO: 59005 - DNA, 20 bp, Artificial Sequence
  Description of Artificial Sequence: Synthetic oligonucleotide
  Target: SCN10A; (+) strand; PAM type: YTN; PAM sequence: TTC
ctcactttgatggcaatcca

SEQ ID NO: 59006 - DNA, 20 bp, Artificial Sequence
  Description of Artificial Sequence: Synthetic oligonucleotide
  Target: SCN10A; (+) strand; PAM type: YTN; PAM sequence: CTC
actttgatggcaatccatct

SEQ ID NO: 59007 - DNA, 20 bp, Artificial Sequence
  Description of Artificial Sequence: Synthetic oligonucleotide
  Target: SCN10A; (+) strand; PAM type: YTN; PAM sequence: CTT
tgatggcaatccatctcctt

SEQ ID NO: 59008 - DNA, 20 bp, Artificial Sequence
  Description of Artificial Sequence: Synthetic oligonucleotide
  Target: SCN10A; (+) strand; PAM type: YTN; PAM sequence: TTT
gatggcaatccatctccttt

SEQ ID NO: 59009 - DNA, 20 bp, Artificial Sequence
  Description of Artificial Sequence: Synthetic oligonucleotide
  Target: SCN10A; (+) strand; PAM type: YTN; PAM sequence: TTG
atggcaatccatctcctttt

SEQ ID NO: 59010 - DNA, 20 bp, Artificial Sequence
  Description of Artificial Sequence: Synthetic oligonucleotide
  Target: SCN10A; (+) strand; PAM type: YTN; PAM sequence: CTC
cttttccagaacagatttta

SEQ ID NO: 59011 - DNA, 20 bp, Artificial Sequence
  Description of Artificial Sequence: Synthetic oligonucleotide
  Target: SCN10A; (+) strand; PAM type: YTN; PAM sequence: CTT
ttccagaacagattttaaga

SEQ ID NO: 59012 - DNA, 20 bp, Artificial Sequence
  Description of Artificial Sequence: Synthetic oligonucleotide
  Target: SCN10A; (+) strand; PAM type: YTN; PAM sequence: TTT
tccagaacagattttaagac

SEQ ID NO: 59013 - DNA, 20 bp, Artificial Sequence
  Description of Artificial Sequence: Synthetic oligonucleotide
  Target: SCN10A; (+) strand; PAM type: YTN; PAM sequence: TTT
ccagaacagattttaagact

SEQ ID NO: 59014 - DNA, 20 bp, Artificial Sequence
  Description of Artificial Sequence: Synthetic oligonucleotide
  Target: SCN10A; (+) strand; PAM type: YTN; PAM sequence: TTC
cagaacagattttaagactc

SEQ ID NO: 59015 - DNA, 20 bp, Artificial Sequence
  Description of Artificial Sequence: Synthetic oligonucleotide
  Target: SCN10A; (+) strand; PAM type: YTN; PAM sequence: TTT
taagactcatctcacattac

SEQ ID NO: 59016 - DNA, 20 bp, Artificial Sequence
  Description of Artificial Sequence: Synthetic oligonucleotide
  Target: SCN10A; (+) strand; PAM type: YTN; PAM sequence: TTT
aagactcatctcacattaca

SEQ ID NO: 59017 - DNA, 20 bp, Artificial Sequence
  Description of Artificial Sequence: Synthetic oligonucleotide
  Target: SCN10A; (+) strand; PAM type: YTN; PAM sequence: TTA
agactcatctcacattacac

SEQ ID NO: 59018 - DNA, 20 bp, Artificial Sequence
  Description of Artificial Sequence: Synthetic oligonucleotide
  Target: SCN10A; (+) strand; PAM type: YTN; PAM sequence: CTC
atctcacattacaccacctg

SEQ ID NO: 59019 - DNA, 20 bp, Artificial Sequence
  Description of Artificial Sequence: Synthetic oligonucleotide
  Target: SCN10A; (+) strand; PAM type: YTN; PAM sequence: CTC
acattacaccacctgccccc

SEQ ID NO: 59020 - DNA, 20 bp, Artificial Sequence
  Description of Artificial Sequence: Synthetic oligonucleotide
  Target: SCN10A; (+) strand; PAM type: YTN; PAM sequence: TTA
caccacctgccccctgcttt

SEQ ID NO: 59021 - DNA, 20 bp, Artificial Sequence
  Description of Artificial Sequence: Synthetic oligonucleotide
  Target: SCN10A; (+) strand; PAM type: YTN; PAM sequence: CTG
ccccctgctttcaagaccat

SEQ ID NO: 59022 - DNA, 20 bp, Artificial Sequence
  Description of Artificial Sequence: Synthetic oligonucleotide
  Target: SCN10A; (+) strand; PAM type: YTN; PAM sequence: CTG
ctttcaagaccataaaagta

SEQ ID NO: 59023 - DNA, 20 bp, Artificial Sequence
  Description of Artificial Sequence: Synthetic oligonucleotide
  Target: SCN10A; (+) strand; PAM type: YTN; PAM sequence: CTT
tcaagaccataaaagtaagg

SEQ ID NO: 59024 - DNA, 20 bp, Artificial Sequence
  Description of Artificial Sequence: Synthetic oligonucleotide
  Target: SCN10A; (+) strand; PAM type: YTN; PAM sequence: TTT
caagaccataaaagtaaggt

SEQ ID NO: 59025 - DNA, 20 bp, Artificial Sequence
  Description of Artificial Sequence: Synthetic oligonucleotide
  Target: SCN10A; (+) strand; PAM type: YTN; PAM sequence: TTC
aagaccataaaagtaaggtc

SEQ ID NO: 59026 - DNA, 20 bp, Artificial Sequence
  Description of Artificial Sequence: Synthetic oligonucleotide
  Target: SCN10A; (+) strand; PAM type: YTN; PAM sequence: CTG
ctggagactccatcatctta

SEQ ID NO: 59027 - DNA, 20 bp, Artificial Sequence
  Description of Artificial Sequence: Synthetic oligonucleotide
  Target: SCN10A; (+) strand; PAM type: YTN; PAM sequence: CTG
gagactccatcatcttacgg

SEQ ID NO: 59028 - DNA, 20 bp, Artificial Sequence
  Description of Artificial Sequence: Synthetic oligonucleotide
  Target: SCN10A; (+) strand; PAM type: YTN; PAM sequence: CTC
catcatcttacggtctgagg

SEQ ID NO: 59029 - DNA, 20 bp, Artificial Sequence
  Description of Artificial Sequence: Synthetic oligonucleotide
  Target: SCN10A; (+) strand; PAM type: YTN; PAM sequence: CTT
acggtctgaggttctcagga

SEQ ID NO: 59030 - DNA, 20 bp, Artificial Sequence
  Description of Artificial Sequence: Synthetic oligonucleotide
  Target: SCN10A; (+) strand; PAM type: YTN; PAM sequence: TTA
cggtctgaggttctcaggag

SEQ ID NO: 59031 - DNA, 20 bp, Artificial Sequence
  Description of Artificial Sequence: Synthetic oligonucleotide
  Target: SCN10A; (+) strand; PAM type: YTN; PAM sequence: CTG
aggttctcaggaggagtgat

SEQ ID NO: 59032 - DNA, 20 bp, Artificial Sequence
  Description of Artificial Sequence: Synthetic oligonucleotide
  Target: SCN10A; (+) strand; PAM type: YTN; PAM sequence: TTC
tcaggaggagtgattattcc

SEQ ID NO: 59033 - DNA, 20 bp, Artificial Sequence
  Description of Artificial Sequence: Synthetic oligonucleotide
  Target: SCN10A; (+) strand; PAM type: YTN; PAM sequence: CTC
aggaggagtgattattccct

SEQ ID NO: 59034 - DNA, 20 bp, Artificial Sequence
  Description of Artificial Sequence: Synthetic oligonucleotide
  Target: SCN10A; (+) strand; PAM type: YTN; PAM sequence: TTA
ttccctgtcagcccctgagg

SEQ ID NO: 59035 - DNA, 20 bp, Artificial Sequence
  Description of Artificial Sequence: Synthetic oligonucleotide
  Target: SCN10A; (+) strand; PAM type: YTN; PAM sequence: TTC
cctgtcagcccctgaggttc

SEQ ID NO: 59036 - DNA, 20 bp, Artificial Sequence
  Description of Artificial Sequence: Synthetic oligonucleotide
  Target: SCN10A; (+) strand; PAM type: YTN; PAM sequence: CTG
tcagcccctgaggttctagc

SEQ ID NO: 59037 - DNA, 20 bp, Artificial Sequence
  Description of Artificial Sequence: Synthetic oligonucleotide
  Target: SCN10A; (+) strand; PAM type: YTN; PAM sequence: CTG
aggttctagccatgggctgt

SEQ ID NO: 59038 - DNA, 20 bp, Artificial Sequence
  Description of Artificial Sequence: Synthetic oligonucleotide
  Target: SCN10A; (+) strand; PAM type: YTN; PAM sequence: TTC
tagccatgggctgtgcacac

SEQ ID NO: 59039 - DNA, 20 bp, Artificial Sequence
  Description of Artificial Sequence: Synthetic oligonucleotide
  Target: SCN10A; (+) strand; PAM type: YTN; PAM sequence: CTA
gccatgggctgtgcacacag

SEQ ID NO: 59040 - DNA, 20 bp, Artificial Sequence
  Description of Artificial Sequence: Synthetic oligonucleotide
  Target: SCN10A; (+) strand; PAM type: YTN; PAM sequence: CTG
tgcacacagtaggtgcctga

SEQ ID NO: 59041 - DNA, 20 bp, Artificial Sequence
  Description of Artificial Sequence: Synthetic oligonucleotide
  Target: SCN10A; (+) strand; PAM type: YTN; PAM sequence: CTG
aaaacacttcgtgtgagcat

SEQ ID NO: 59042 - DNA, 20 bp, Artificial Sequence
  Description of Artificial Sequence: Synthetic oligonucleotide
  Target: SCN10A; (+) strand; PAM type: YTN; PAM sequence: CTT
cgtgtgagcatggagaaggc

SEQ ID NO: 59043 - DNA, 20 bp, Artificial Sequence
  Description of Artificial Sequence: Synthetic oligonucleotide
  Target: SCN10A; (+) strand; PAM type: YTN; PAM sequence: TTC
gtgtgagcatggagaaggcc

SEQ ID NO: 59044 - DNA, 20 bp, Artificial Sequence
  Description of Artificial Sequence: Synthetic oligonucleotide
  Target: SCN10A; (+) strand; PAM type: YTN; PAM sequence: CTC
ttcatttcactgagagagca

SEQ ID NO: 59045 - DNA, 20 bp, Artificial Sequence
  Description of Artificial Sequence: Synthetic oligonucleotide
  Target: SCN10A; (+) strand; PAM type: YTN; PAM sequence: CTT
catttcactgagagagcagc

SEQ ID NO: 59046 - DNA, 20 bp, Artificial Sequence
  Description of Artificial Sequence: Synthetic oligonucleotide
  Target: SCN10A; (+) strand; PAM type: YTN; PAM sequence: TTC
atttcactgagagagcagcc

SEQ ID NO: 59047 - DNA, 20 bp, Artificial Sequence
  Description of Artificial Sequence: Synthetic oligonucleotide
  Target: SCN10A; (+) strand; PAM type: YTN; PAM sequence: TTT
cactgagagagcagcccaag

SEQ ID NO: 59048 - DNA, 20 bp, Artificial Sequence
  Description of Artificial Sequence: Synthetic oligonucleotide
  Target: SCN10A; (+) strand; PAM type: YTN; PAM sequence: TTC
actgagagagcagcccaagg

SEQ ID NO: 59049 - DNA, 20 bp, Artificial Sequence
  Description of Artificial Sequence: Synthetic oligonucleotide
  Target: SCN10A; (+) strand; PAM type: YTN; PAM sequence: CTG
agagagcagcccaaggcatt

SEQ ID NO: 59050 - DNA, 20 bp, Artificial Sequence
  Description of Artificial Sequence: Synthetic oligonucleotide
  Target: SCN10A; (+) strand; PAM type: YTN; PAM sequence: TTT
aaaacttgctactcttggaa

SEQ ID NO: 59051 - DNA, 20 bp, Artificial Sequence
  Description of Artificial Sequence: Synthetic oligonucleotide
  Target: SCN10A; (+) strand; PAM type: YTN; PAM sequence: TTA
aaacttgctactcttggaaa

SEQ ID NO: 59052 - DNA, 20 bp, Artificial Sequence
  Description of Artificial Sequence: Synthetic oligonucleotide
  Target: SCN10A; (+) strand; PAM type: YTN; PAM sequence: CTT
gctactcttggaaagctgca

SEQ ID NO: 59053 - DNA, 20 bp, Artificial Sequence
  Description of Artificial Sequence: Synthetic oligonucleotide
  Target: SCN10A; (+) strand; PAM type: YTN; PAM sequence: TTG
ctactcttggaaagctgcaa

SEQ ID NO: 59054 - DNA, 20 bp, Artificial Sequence
  Description of Artificial Sequence: Synthetic oligonucleotide
  Target: SCN10A; (+) strand; PAM type: YTN; PAM sequence: CTA
ctcttggaaagctgcaaata

SEQ ID NO: 59055 - DNA, 20 bp, Artificial Sequence
  Description of Artificial Sequence: Synthetic oligonucleotide
  Target: SCN10A; (+) strand; PAM type: YTN; PAM sequence: CTC
ttggaaagctgcaaatacag

SEQ ID NO: 59056 - DNA, 20 bp, Artificial Sequence
  Description of Artificial Sequence: Synthetic oligonucleotide
  Target: SCN10A; (+) strand; PAM type: YTN; PAM sequence: CTT
ggaaagctgcaaatacaggg

SEQ ID NO: 59057 - DNA, 20 bp, Artificial Sequence
  Description of Artificial Sequence: Synthetic oligonucleotide
  Target: SCN10A; (+) strand; PAM type: YTN; PAM sequence: TTG
gaaagctgcaaatacagggt

SEQ ID NO: 59058 - DNA, 20 bp, Artificial Sequence
  Description of Artificial Sequence: Synthetic oligonucleotide
  Target: SCN10A; (+) strand; PAM type: YTN; PAM sequence: CTG
caaatacagggttcttctaa

SEQ ID NO: 59059 - DNA, 20 bp, Artificial Sequence
  Description of Artificial Sequence: Synthetic oligonucleotide
  Target: SCN10A; (+) strand; PAM type: YTN; PAM sequence: TTC
ttctaacataaacacgtatt

SEQ ID NO: 59060 - DNA, 20 bp, Artificial Sequence
  Description of Artificial Sequence: Synthetic oligonucleotide
  Target: SCN10A; (+) strand; PAM type: YTN; PAM sequence: CTT
ctaacataaacacgtatttc

SEQ ID NO: 59061 - DNA, 20 bp, Artificial Sequence
  Description of Artificial Sequence: Synthetic oligonucleotide
  Target: SCN10A; (+) strand; PAM type: YTN; PAM sequence: TTC
taacataaacacgtatttca

SEQ ID NO: 59062 - DNA, 20 bp, Artificial Sequence
  Description of Artificial Sequence: Synthetic oligonucleotide
  Target: SCN10A; (+) strand; PAM type: YTN; PAM sequence: CTA
acataaacacgtatttcaaa

SEQ ID NO: 59063 - DNA, 20 bp, Artificial Sequence
  Description of Artificial Sequence: Synthetic oligonucleotide
  Target: SCN10A; (+) strand; PAM type: YTN; PAM sequence: TTT
caaaaagttggttggttatt

SEQ ID NO: 59064 - DNA, 20 bp, Artificial Sequence
  Description of Artificial Sequence: Synthetic oligonucleotide
  Target: SCN10A; (+) strand; PAM type: YTN; PAM sequence: TTC
aaaaagttggttggttattt

SEQ ID NO: 59065 - DNA, 20 bp, Artificial Sequence
  Description of Artificial Sequence: Synthetic oligonucleotide
  Target: SCN10A; (+) strand; PAM type: YTN; PAM sequence: TTG
gttggttatttccttggttt

SEQ ID NO: 59066 - DNA, 20 bp, Artificial Sequence
  Description of Artificial Sequence: Synthetic oligonucleotide
  Target: SCN10A; (+) strand; PAM type: YTN; PAM sequence: TTG
gttatttccttggttttaga

SEQ ID NO: 59067 - DNA, 20 bp, Artificial Sequence
  Description of Artificial Sequence: Synthetic oligonucleotide
  Target: SCN10A; (+) strand; PAM type: YTN; PAM sequence: TTA
tttccttggttttagaagag

SEQ ID NO: 59068 - DNA, 20 bp, Artificial Sequence
  Description of Artificial Sequence: Synthetic oligonucleotide
  Target: SCN10A; (+) strand; PAM type: YTN; PAM sequence: TTT
ccttggttttagaagagcat

SEQ ID NO: 59069 - DNA, 20 bp, Artificial Sequence
  Description of Artificial Sequence: Synthetic oligonucleotide
  Target: SCN10A; (+) strand; PAM type: YTN; PAM sequence: TTC
cttggttttagaagagcatc

SEQ ID NO: 59070 - DNA, 20 bp, Artificial Sequence
  Description of Artificial Sequence: Synthetic oligonucleotide
  Target: SCN10A; (+) strand; PAM type: YTN; PAM sequence: CTT
ggttttagaagagcatccca

SEQ ID NO: 59071 - DNA, 20 bp, Artificial Sequence
  Description of Artificial Sequence: Synthetic oligonucleotide
  Target: SCN10A; (+) strand; PAM type: YTN; PAM sequence: TTG
gttttagaagagcatcccaa

SEQ ID NO: 59072 - DNA, 20 bp, Artificial Sequence
  Description of Artificial Sequence: Synthetic oligonucleotide
  Target: SCN10A; (+) strand; PAM type: YTN; PAM sequence: TTT
tagaagagcatcccaaagac

SEQ ID NO: 59073 - DNA, 20 bp, Artificial Sequence
  Description of Artificial Sequence: Synthetic oligonucleotide
  Target: SCN10A; (+) strand; PAM type: YTN; PAM sequence: TTT
agaagagcatcccaaagacc

SEQ ID NO: 59074 - DNA, 20 bp, Artificial Sequence
  Description of Artificial Sequence: Synthetic oligonucleotide
  Target: SCN10A; (+) strand; PAM type: YTN; PAM sequence: TTA
gaagagcatcccaaagaccc

SEQ ID NO: 59075 - DNA, 20 bp, Artificial Sequence
  Description of Artificial Sequence: Synthetic oligonucleotide
  Target: SCN10A; (+) strand; PAM type: YTN; PAM sequence: CTT
ccccaccacgtggctgccca

SEQ ID NO: 59076 - DNA, 20 bp, Artificial Sequence
  Description of Artificial Sequence: Synthetic oligonucleotide
  Target: SCN10A; (+) strand; PAM type: YTN; PAM sequence: TTC
cccaccacgtggctgcccac

SEQ ID NO: 59077 - DNA, 20 bp, Artificial Sequence
  Description of Artificial Sequence: Synthetic oligonucleotide
  Target: SCN10A; (+) strand; PAM type: YTN; PAM sequence: CTG
cccacttactcgcaatggag

SEQ ID NO: 59078 - DNA, 20 bp, Artificial Sequence
  Description of Artificial Sequence: Synthetic oligonucleotide
  Target: SCN10A; (+) strand; PAM type: YTN; PAM sequence: CTT
actcgcaatggagagaacca

SEQ ID NO: 59079 - DNA, 20 bp, Artificial Sequence
  Description of Artificial Sequence: Synthetic oligonucleotide
  Target: SCN10A; (+) strand; PAM type: YTN; PAM sequence: TTA
ctcgcaatggagagaaccac

SEQ ID NO: 59080 - DNA, 20 bp, Artificial Sequence
  Description of Artificial Sequence: Synthetic oligonucleotide
  Target: SCN10A; (+) strand; PAM type: YTN; PAM sequence: CTC
gcaatggagagaaccaccac

SEQ ID NO: 59081 - DNA, 20 bp, Artificial Sequence
  Description of Artificial Sequence: Synthetic oligonucleotide
  Target: SCN10A; (+) strand; PAM type: YTN; PAM sequence: TTC
cagccatttgtgaagtagta

SEQ ID NO: 59082 - DNA, 20 bp, Artificial Sequence
  Description of Artificial Sequence: Synthetic oligonucleotide
  Target: SCN10A; (+) strand; PAM type: YTN; PAM sequence: TTT
gtgaagtagtactgcctcaa

SEQ ID NO: 59083 - DNA, 20 bp, Artificial Sequence
  Description of Artificial Sequence: Synthetic oligonucleotide
  Target: SCN10A; (+) strand; PAM type: YTN; PAM sequence: TTG
tgaagtagtactgcctcaaa

SEQ ID NO: 59084 - DNA, 20 bp, Artificial Sequence
  Description of Artificial Sequence: Synthetic oligonucleotide
  Target: SCN10A; (+) strand; PAM type: YTN; PAM sequence: CTG
cctcaaagcgaacatcttca

SEQ ID NO: 59085 - DNA, 20 bp, Artificial Sequence
  Description of Artificial Sequence: Synthetic oligonucleotide
  Target: SCN10A; (+) strand; PAM type: YTN; PAM sequence: CTC
aaagcgaacatcttcatgac

SEQ ID NO: 59086 - DNA, 20 bp, Artificial Sequence
  Description of Artificial Sequence: Synthetic oligonucleotide
  Target: SCN10A; (+) strand; PAM type: YTN; PAM sequence: CTT
catgacacattcgcctgtga

SEQ ID NO: 59087 - DNA, 20 bp, Artificial Sequence
  Description of Artificial Sequence: Synthetic oligonucleotide
  Target: SCN10A; (+) strand; PAM type: YTN; PAM sequence: TTC
atgacacattcgcctgtgaa

SEQ ID NO: 59088 - DNA, 20 bp, Artificial Sequence
  Description of Artificial Sequence: Synthetic oligonucleotide
  Target: SCN10A; (+) strand; PAM type: YTN; PAM sequence: TTC
gcctgtgaagacggccacaa

SEQ ID NO: 59089 - DNA, 20 bp, Artificial Sequence
  Description of Artificial Sequence: Synthetic oligonucleotide
  Target: SCN10A; (+) strand; PAM type: YTN; PAM sequence: CTG
tgaagacggccacaaagaac

SEQ ID NO: 59090 - DNA, 20 bp, Artificial Sequence
  Description of Artificial Sequence: Synthetic oligonucleotide
  Target: SCN10A; (+) strand; PAM type: YTN; PAM sequence: CTG
gttgattttgcccagaattt

SEQ ID NO: 59091 - DNA, 20 bp, Artificial Sequence
  Description of Artificial Sequence: Synthetic oligonucleotide
  Target: SCN10A; (+) strand; PAM type: YTN; PAM sequence: TTG
attttgcccagaattttcgt

SEQ ID NO: 59092 - DNA, 20 bp, Artificial Sequence
  Description of Artificial Sequence: Synthetic oligonucleotide
  Target: SCN10A; (+) strand; PAM type: YTN; PAM sequence: TTT
tgcccagaattttcgtcttt

SEQ ID NO: 59093 - DNA, 20 bp, Artificial Sequence
  Description of Artificial Sequence: Synthetic oligonucleotide
  Target: SCN10A; (+) strand; PAM type: YTN; PAM sequence: TTT
gcccagaattttcgtctttt

SEQ ID NO: 59094 - DNA, 20 bp, Artificial Sequence
  Description of Artificial Sequence: Synthetic oligonucleotide
  Target: SCN10A; (+) strand; PAM type: YTN; PAM sequence: TTG
cccagaattttcgtcttttc

SEQ ID NO: 59095 - DNA, 20 bp, Artificial Sequence
  Description of Artificial Sequence: Synthetic oligonucleotide
  Target: SCN10A; (+) strand; PAM type: YTN; PAM sequence: TTT
tcgtcttttcttcactttgg

SEQ ID NO: 59096 - DNA, 20 bp, Artificial Sequence
  Description of Artificial Sequence: Synthetic oligonucleotide
  Target: SCN10A; (+) strand; PAM type: YTN; PAM sequence: TTT
cgtcttttcttcactttggt

SEQ ID NO: 59097 - DNA, 20 bp, Artificial Sequence
  Description of Artificial Sequence: Synthetic oligonucleotide
  Target: SCN10A; (+) strand; PAM type: YTN; PAM sequence: TTC
gtcttttcttcactttggtc

SEQ ID NO: 59098 - DNA, 20 bp, Artificial Sequence
  Description of Artificial Sequence: Synthetic oligonucleotide
  Target: SCN10A; (+) strand; PAM type: YTN; PAM sequence: CTT
ttcttcactttggtcatcag

SEQ ID NO: 59099 - DNA, 20 bp, Artificial Sequence
  Description of Artificial Sequence: Synthetic oligonucleotide
  Target: SCN10A; (+) strand; PAM type: YTN; PAM sequence: TTT
tcttcactttggtcatcagt

SEQ ID NO: 59100 - DNA, 20 bp, Artificial Sequence
  Description of Artificial Sequence: Synthetic oligonucleotide
  Target: SCN10A; (+) strand; PAM type: YTN; PAM sequence: TTT
cttcactttggtcatcagtc

SEQ ID NO: 59101 - DNA, 20 bp, Artificial Sequence
  Description of Artificial Sequence: Synthetic oligonucleotide
  Target: SCN10A; (+) strand; PAM type: YTN; PAM sequence: TTC
ttcactttggtcatcagtct

SEQ ID NO: 59102 - DNA, 20 bp, Artificial Sequence
  Description of Artificial Sequence: Synthetic oligonucleotide
  Target: SCN10A; (+) strand; PAM type: YTN; PAM sequence: CTT
cactttggtcatcagtctcc

SEQ ID NO: 59103 - DNA, 20 bp, Artificial Sequence
  Description of Artificial Sequence: Synthetic oligonucleotide
  Target: SCN10A; (+) strand; PAM type: YTN; PAM sequence: TTC
actttggtcatcagtctcca

SEQ ID NO: 59104 - DNA, 20 bp, Artificial Sequence
  Description of Artificial Sequence: Synthetic oligonucleotide
  Target: SCN10A; (+) strand; PAM type: YTN; PAM sequence: CTT
tggtcatcagtctccaccat

SEQ ID NO: 59105 - DNA, 20 bp, Artificial Sequence
  Description of Artificial Sequence: Synthetic oligonucleotide
  Target: SCN10A; (+) strand; PAM type: YTN; PAM sequence: TTT
ggtcatcagtctccaccatc

SEQ ID NO: 59106 - DNA, 20 bp, Artificial Sequence
  Description of Artificial Sequence: Synthetic oligonucleotide
  Target: SCN10A; (+) strand; PAM type: YTN; PAM sequence: TTG
gtcatcagtctccaccatca

SEQ ID NO: 59107 - DNA, 20 bp, Artificial Sequence
  Description of Artificial Sequence: Synthetic oligonucleotide
  Target: SCN10A; (+) strand; PAM type: YTN; PAM sequence: CTC
caccatcatggtgatcatgt

SEQ ID NO: 59108 - DNA, 20 bp, Artificial Sequence
  Description of Artificial Sequence: Synthetic oligonucleotide
  Target: SCN10A; (+) strand; PAM type: YTN; PAM sequence: TTG
aggcagatgaggaccatgat

SEQ ID NO: 59109 - DNA, 20 bp, Artificial Sequence
  Description of Artificial Sequence: Synthetic oligonucleotide
  Target: SCN10A; (+) strand; PAM type: YTN; PAM sequence: CTT
gtctggtcacgatgtcaaag

SEQ ID NO: 59110 - DNA, 20 bp, Artificial Sequence
  Description of Artificial Sequence: Synthetic oligonucleotide
  Target: SCN10A; (+) strand; PAM type: YTN; PAM sequence: TTG
tctggtcacgatgtcaaaga

SEQ ID NO: 59111 - DNA, 20 bp, Artificial Sequence
  Description of Artificial Sequence: Synthetic oligonucleotide
  Target: SCN10A; (+) strand; PAM type: YTN; PAM sequence: CTG
gtcacgatgtcaaagacaaa

SEQ ID NO: 59112 - DNA, 20 bp, Artificial Sequence
  Description of Artificial Sequence: Synthetic oligonucleotide
  Target: SCN10A; (+) strand; PAM type: YTN; PAM sequence: CTG
gaacttgttctgagaaaaca

SEQ ID NO: 59113 - DNA, 20 bp, Artificial Sequence
  Description of Artificial Sequence: Synthetic oligonucleotide
  Target: SCN10A; (+) strand; PAM type: YTN; PAM sequence: CTT
gttctgagaaaacaagagat

SEQ ID NO: 59114 - DNA, 20 bp, Artificial Sequence
  Description of Artificial Sequence: Synthetic oligonucleotide
  Target: SCN10A; (+) strand; PAM type: YTN; PAM sequence: TTG
ttctgagaaaacaagagata

SEQ ID NO: 59115 - DNA, 20 bp, Artificial Sequence
  Description of Artificial Sequence: Synthetic oligonucleotide
  Target: SCN10A; (+) strand; PAM type: YTN; PAM sequence: TTC
tgagaaaacaagagatagtg

SEQ ID NO: 59116 - DNA, 20 bp, Artificial Sequence
  Description of Artificial Sequence: Synthetic oligonucleotide
  Target: SCN10A; (+) strand; PAM type: YTN; PAM sequence: CTG
agaaaacaagagatagtggc

SEQ ID NO: 59117 - DNA, 20 bp, Artificial Sequence
  Description of Artificial Sequence: Synthetic oligonucleotide
  Target: SCN10A; (+) strand; PAM type: YTN; PAM sequence: CTT
tgggccagcacaaaccaggc

SEQ ID NO: 59118 - DNA, 20 bp, Artificial Sequence
  Description of Artificial Sequence: Synthetic oligonucleotide
  Target: SCN10A; (+) strand; PAM type: YTN; PAM sequence: TTT
gggccagcacaaaccaggca

SEQ ID NO: 59119 - DNA, 20 bp, Artificial Sequence
  Description of Artificial Sequence: Synthetic oligonucleotide
  Target: SCN10A; (+) strand; PAM type: YTN; PAM sequence: TTG
ggccagcacaaaccaggcat

SEQ ID NO: 59120 - DNA, 20 bp, Artificial Sequence
  Description of Artificial Sequence: Synthetic oligonucleotide
  Target: SCN10A; (+) strand; PAM type: YTN; PAM sequence: CTG
tgttatctgtagatgagttt

SEQ ID NO: 59121 - DNA, 20 bp, Artificial Sequence
  Description of Artificial Sequence: Synthetic oligonucleotide
  Target: SCN10A; (+) strand; PAM type: YTN; PAM sequence: TTA
tctgtagatgagttttgtct

SEQ ID NO: 59122 - DNA, 20 bp, Artificial Sequence
  Description of Artificial Sequence: Synthetic oligonucleotide
  Target: SCN10A; (+) strand; PAM type: YTN; PAM sequence: CTG
tagatgagttttgtctccat

SEQ ID NO: 59123 - DNA, 20 bp, Artificial Sequence
  Description of Artificial Sequence: Synthetic oligonucleotide
  Target: SCN10A; (+) strand; PAM type: YTN; PAM sequence: TTT
tgtctccatcacactccaca

SEQ ID NO: 59124 - DNA, 20 bp, Artificial Sequence
  Description of Artificial Sequence: Synthetic oligonucleotide
  Target: SCN10A; (+) strand; PAM type: YTN; PAM sequence: TTT
gtctccatcacactccacat

SEQ ID NO: 59125 - DNA, 20 bp, Artificial Sequence
  Description of Artificial Sequence: Synthetic oligonucleotide
  Target: SCN10A; (+) strand; PAM type: YTN; PAM sequence: TTG
tctccatcacactccacatc

SEQ ID NO: 59126 - DNA, 20 bp, Artificial Sequence
  Description of Artificial Sequence: Synthetic oligonucleotide
  Target: SCN10A; (+) strand; PAM type: YTN; PAM sequence: CTC
catcacactccacatcttaa

SEQ ID NO: 59127 - DNA, 20 bp, Artificial Sequence
  Description of Artificial Sequence: Synthetic oligonucleotide
  Target: SCN10A; (+) strand; PAM type: YTN; PAM sequence: CTC
cacatcttaacagaagcgaa

SEQ ID NO: 59128 - DNA, 20 bp, Artificial Sequence
  Description of Artificial Sequence: Synthetic oligonucleotide
  Target: SCN10A; (+) strand; PAM type: YTN; PAM sequence: CTT
aacagaagcgaaatactatc

SEQ ID NO: 59129 - DNA, 20 bp, Artificial Sequence
  Description of Artificial Sequence: Synthetic oligonucleotide
  Target: SCN10A; (+) strand; PAM type: YTN; PAM sequence: TTA
acagaagcgaaatactatcc

SEQ ID NO: 59130 - DNA, 20 bp, Artificial Sequence
  Description of Artificial Sequence: Synthetic oligonucleotide
  Target: SCN10A; (+) strand; PAM type: YTN; PAM sequence: CTA
tccttacctcttccaaaatt

SEQ ID NO: 59131 - DNA, 20 bp, Artificial Sequence
  Description of Artificial Sequence: Synthetic oligonucleotide
  Target: SCN10A; (+) strand; PAM type: YTN; PAM sequence: CTT
acctcttccaaaatttcact

SEQ ID NO: 59132 - DNA, 20 bp, Artificial Sequence
  Description of Artificial Sequence: Synthetic oligonucleotide
  Target: SCN10A; (+) strand; PAM type: YTN; PAM sequence: TTA
cctcttccaaaatttcactt

SEQ ID NO: 59133 - DNA, 20 bp, Artificial Sequence
  Description of Artificial Sequence: Synthetic oligonucleotide
  Target: SCN10A; (+) strand; PAM type: YTN; PAM sequence: CTC
ttccaaaatttcacttttag

SEQ ID NO: 59134 - DNA, 20 bp, Artificial Sequence
  Description of Artificial Sequence: Synthetic oligonucleotide
  Target: SCN10A; (+) strand; PAM type: YTN; PAM sequence: CTT
ccaaaatttcacttttagtt

SEQ ID NO: 59135 - DNA, 20 bp, Artificial Sequence
  Description of Artificial Sequence: Synthetic oligonucleotide
  Target: SCN10A; (+) strand; PAM type: YTN; PAM sequence: TTC
caaaatttcacttttagttg

SEQ ID NO: 59136 - DNA, 20 bp, Artificial Sequence
  Description of Artificial Sequence: Synthetic oligonucleotide
  Target: SCN10A; (+) strand; PAM type: YTN; PAM sequence: TTT
cacttttagttgactctacc

SEQ ID NO: 59137 - DNA, 20 bp, Artificial Sequence
  Description of Artificial Sequence: Synthetic oligonucleotide
  Target: SCN10A; (+) strand; PAM type: YTN; PAM sequence: TTC
acttttagttgactctacct

SEQ ID NO: 59138 - DNA, 20 bp, Artificial Sequence
  Description of Artificial Sequence: Synthetic oligonucleotide
  Target: SCN10A; (+) strand; PAM type: YTN; PAM sequence: CTT
ttagttgactctacctcatt

SEQ ID NO: 59139 - DNA, 20 bp, Artificial Sequence
  Description of Artificial Sequence: Synthetic oligonucleotide
  Target: SCN10A; (+) strand; PAM type: YTN; PAM sequence: TTT
tagttgactctacctcattg

SEQ ID NO: 59140 - DNA, 20 bp, Artificial Sequence
  Description of Artificial Sequence: Synthetic oligonucleotide
  Target: SCN10A; (+) strand; PAM type: YTN; PAM sequence: TTT
agttgactctacctcattgc

SEQ ID NO: 59141 - DNA, 20 bp, Artificial Sequence
  Description of Artificial Sequence: Synthetic oligonucleotide
  Target: SCN10A; (+) strand; PAM type: YTN; PAM sequence: TTA
gttgactctacctcattgcc

SEQ ID NO: 59142 - DNA, 20 bp, Artificial Sequence
  Description of Artificial Sequence: Synthetic oligonucleotide
  Target: SCN10A; (+) strand; PAM type: YTN; PAM sequence: TTG
actctacctcattgccccag

SEQ ID NO: 59143 - DNA, 20 bp, Artificial Sequence
  Description of Artificial Sequence: Synthetic oligonucleotide
  Target: SCN10A; (+) strand; PAM type: YTN; PAM sequence: CTC
tacctcattgccccagttca

SEQ ID NO: 59144 - DNA, 20 bp, Artificial Sequence
  Description of Artificial Sequence: Synthetic oligonucleotide
  Target: SCN10A; (+) strand; PAM type: YTN; PAM sequence: CTA
cctcattgccccagttcaag

SEQ ID NO: 59145 - DNA, 20 bp, Artificial Sequence
  Description of Artificial Sequence: Synthetic oligonucleotide
  Target: SCN10A; (+) strand; PAM type: YTN; PAM sequence: CTC
attgccccagttcaagtcct

SEQ ID NO: 59146 - DNA, 20 bp, Artificial Sequence
  Description of Artificial Sequence: Synthetic oligonucleotide
  Target: SCN10A; (+) strand; PAM type: YTN; PAM sequence: TTG
ccccagttcaagtccttaat

SEQ ID NO: 59147 - DNA, 20 bp, Artificial Sequence
  Description of Artificial Sequence: Synthetic oligonucleotide
  Target: SCN10A; (+) strand; PAM type: YTN; PAM sequence: TTC
aagtccttaatacctctcct

SEQ ID NO: 59148 - DNA, 20 bp, Artificial Sequence
  Description of Artificial Sequence: Synthetic oligonucleotide
  Target: SCN10A; (+) strand; PAM type: YTN; PAM sequence: CTT
aatacctctcctggcccttt

SEQ ID NO: 59149 - DNA, 20 bp, Artificial Sequence
  Description of Artificial Sequence: Synthetic oligonucleotide
  Target: SCN10A; (+) strand; PAM type: YTN; PAM sequence: TTA
atacctctcctggccctttg

SEQ ID NO: 59150 - DNA, 20 bp, Artificial Sequence
  Description of Artificial Sequence: Synthetic oligonucleotide
  Target: SCN10A; (+) strand; PAM type: YTN; PAM sequence: CTC
tcctggccctttgatgccac

SEQ ID NO: 59151 - DNA, 20 bp, Artificial Sequence
  Description of Artificial Sequence: Synthetic oligonucleotide
  Target: SCN10A; (+) strand; PAM type: YTN; PAM sequence: CTC
ctggccctttgatgccacca

SEQ ID NO: 59152 - DNA, 20 bp, Artificial Sequence
  Description of Artificial Sequence: Synthetic oligonucleotide
  Target: SCN10A; (+) strand; PAM type: YTN; PAM sequence: CTG
gccctttgatgccaccaggc

SEQ ID NO: 59153 - DNA, 20 bp, Artificial Sequence
  Description of Artificial Sequence: Synthetic oligonucleotide
  Target: SCN10A; (+) strand; PAM type: YTN; PAM sequence: CTT
tgatgccaccaggcccttct

SEQ ID NO: 59154 - DNA, 20 bp, Artificial Sequence
  Description of Artificial Sequence: Synthetic oligonucleotide
  Target: SCN10A; (+) strand; PAM type: YTN; PAM sequence: TTT
gatgccaccaggcccttctt

SEQ ID NO: 59155 - DNA, 20 bp, Artificial Sequence
  Description of Artificial Sequence: Synthetic oligonucleotide
  Target: SCN10A; (+) strand; PAM type: YTN; PAM sequence: TTG
atgccaccaggcccttcttt

SEQ ID NO: 59156 - DNA, 20 bp, Artificial Sequence
  Description of Artificial Sequence: Synthetic oligonucleotide
  Target: SCN10A; (+) strand; PAM type: YTN; PAM sequence: CTT
cttttgtcctggtctgtgcc

SEQ ID NO: 59157 - DNA, 20 bp, Artificial Sequence
  Description of Artificial Sequence: Synthetic oligonucleotide
  Target: SCN10A; (+) strand; PAM type: YTN; PAM sequence: TTC
ttttgtcctggtctgtgccc

SEQ ID NO: 59158 - DNA, 20 bp, Artificial Sequence
  Description of Artificial Sequence: Synthetic oligonucleotide
  Target: SCN10A; (+) strand; PAM type: YTN; PAM sequence: CTT
ttgtcctggtctgtgccctt

SEQ ID NO: 59159 - DNA, 20 bp, Artificial Sequence
  Description of Artificial Sequence: Synthetic oligonucleotide
  Target: SCN10A; (+) strand; PAM type: YTN; PAM sequence: TTT
tgtcctggtctgtgcccttg

SEQ ID NO: 59160 - DNA, 20 bp, Artificial Sequence
  Description of Artificial Sequence: Synthetic oligonucleotide
  Target: SCN10A; (+) strand; PAM type: YTN; PAM sequence: TTT
gtcctggtctgtgcccttgc

SEQ ID NO: 59161 - DNA, 20 bp, Artificial Sequence
  Description of Artificial Sequence: Synthetic oligonucleotide
  Target: SCN10A; (+) strand; PAM type: YTN; PAM sequence: TTG
tcctggtctgtgcccttgcc

SEQ ID NO: 59162 - DNA, 20 bp, Artificial Sequence
  Description of Artificial Sequence: Synthetic oligonucleotide
  Target: SCN10A; (+) strand; PAM type: YTN; PAM sequence: CTG
gtctgtgcccttgcctctat

SEQ ID NO: 59163 - DNA, 20 bp, Artificial Sequence
  Description of Artificial Sequence: Synthetic oligonucleotide
  Target: SCN10A; (+) strand; PAM type: YTN; PAM sequence: CTG
tgcccttgcctctattcaca

SEQ ID NO: 59164 - DNA, 20 bp, Artificial Sequence
  Description of Artificial Sequence: Synthetic oligonucleotide
  Target: SCN10A; (+) strand; PAM type: YTN; PAM sequence: CTT
gcctctattcacaatgccct

SEQ ID NO: 59165 - DNA, 20 bp, Artificial Sequence
  Description of Artificial Sequence: Synthetic oligonucleotide
  Target: SCN10A; (+) strand; PAM type: YTN; PAM sequence: TTG
cctctattcacaatgccctc

SEQ ID NO: 59166 - DNA, 20 bp, Artificial Sequence
  Description of Artificial Sequence: Synthetic oligonucleotide
  Target: SCN10A; (+) strand; PAM type: YTN; PAM sequence: CTC
tattcacaatgccctcctat

SEQ ID NO: 59167 - DNA, 20 bp, Artificial Sequence
  Description of Artificial Sequence: Synthetic oligonucleotide
  Target: SCN10A; (+) strand; PAM type: YTN; PAM sequence: CTA
ttcacaatgccctcctatct

SEQ ID NO: 59168 - DNA, 20 bp, Artificial Sequence
  Description of Artificial Sequence: Synthetic oligonucleotide
  Target: SCN10A; (+) strand; PAM type: YTN; PAM sequence: TTC
acaatgccctcctatctcct

SEQ ID NO: 59169 - DNA, 20 bp, Artificial Sequence
  Description of Artificial Sequence: Synthetic oligonucleotide
  Target: SCN10A; (+) strand; PAM type: YTN; PAM sequence: CTC
ctatctcctctcttggctgt

SEQ ID NO: 59170 - DNA, 20 bp, Artificial Sequence
  Description of Artificial Sequence: Synthetic oligonucleotide
  Target: SCN10A; (+) strand; PAM type: YTN; PAM sequence: CTA
tctcctctcttggctgtcta

SEQ ID NO: 59171 - DNA, 20 bp, Artificial Sequence
  Description of Artificial Sequence: Synthetic oligonucleotide
  Target: SCN10A; (+) strand; PAM type: YTN; PAM sequence: CTC
ctctcttggctgtctaaatt

SEQ ID NO: 59172 - DNA, 20 bp, Artificial Sequence
  Description of Artificial Sequence: Synthetic oligonucleotide
  Target: SCN10A; (+) strand; PAM type: YTN; PAM sequence: CTC
tcttggctgtctaaattcca

SEQ ID NO: 59173 - DNA, 20 bp, Artificial Sequence
  Description of Artificial Sequence: Synthetic oligonucleotide
  Target: SCN10A; (+) strand; PAM type: YTN; PAM sequence: CTC
ttggctgtctaaattccaac

SEQ ID NO: 59174 - DNA, 20 bp, Artificial Sequence
  Description of Artificial Sequence: Synthetic oligonucleotide
  Target: SCN10A; (+) strand; PAM type: YTN; PAM sequence: CTT
ggctgtctaaattccaacag

SEQ ID NO: 59175 - DNA, 20 bp, Artificial Sequence
  Description of Artificial Sequence: Synthetic oligonucleotide
  Target: SCN10A; (+) strand; PAM type: YTN; PAM sequence: TTG
gctgtctaaattccaacagt

SEQ ID NO: 59176 - DNA, 20 bp, Artificial Sequence
  Description of Artificial Sequence: Synthetic oligonucleotide
  Target: SCN10A; (+) strand; PAM type: YTN; PAM sequence: CTG
tctaaattccaacagtcttg

SEQ ID NO: 59177 - DNA, 20 bp, Artificial Sequence
  Description of Artificial Sequence: Synthetic oligonucleotide
  Target: SCN10A; (+) strand; PAM type: YTN; PAM sequence: CTA
aattccaacagtcttgagta

SEQ ID NO: 59178 - DNA, 20 bp, Artificial Sequence
  Description of Artificial Sequence: Synthetic oligonucleotide
  Target: SCN10A; (+) strand; PAM type: YTN; PAM sequence: TTC
caacagtcttgagtaatcca

SEQ ID NO: 59179 - DNA, 20 bp, Artificial Sequence
  Description of Artificial Sequence: Synthetic oligonucleotide
  Target: SCN10A; (+) strand; PAM type: YTN; PAM sequence: CTT
gagtaatccatctcttttaa

SEQ ID NO: 59180 - DNA, 20 bp, Artificial Sequence
  Description of Artificial Sequence: Synthetic oligonucleotide
  Target: SCN10A; (+) strand; PAM type: YTN; PAM sequence: TTG
agtaatccatctcttttaag

SEQ ID NO: 59181 - DNA, 20 bp, Artificial Sequence
  Description of Artificial Sequence: Synthetic oligonucleotide
  Target: SCN10A; (+) strand; PAM type: YTN; PAM sequence: CTC
ttttaagctccacttactgc

SEQ ID NO: 59182 - DNA, 20 bp, Artificial Sequence
  Description of Artificial Sequence: Synthetic oligonucleotide
  Target: SCN10A; (+) strand; PAM type: YTN; PAM sequence: CTT
ttaagctccacttactgcat

SEQ ID NO: 59183 - DNA, 20 bp, Artificial Sequence
  Description of Artificial Sequence: Synthetic oligonucleotide
  Target: SCN10A; (+) strand; PAM type: YTN; PAM sequence: TTT
taagctccacttactgcatg

SEQ ID NO: 59184 - DNA, 20 bp, Artificial Sequence
  Description of Artificial Sequence: Synthetic oligonucleotide
  Target: SCN10A; (+) strand; PAM type: YTN; PAM sequence: TTT
aagctccacttactgcatgg

SEQ ID NO: 59185 - DNA, 20 bp, Artificial Sequence
  Description of Artificial Sequence: Synthetic oligonucleotide
  Target: SCN10A; (+) strand; PAM type: YTN; PAM sequence: TTA
agctccacttactgcatgga

SEQ ID NO: 59186 - DNA, 20 bp, Artificial Sequence
  Description of Artificial Sequence: Synthetic oligonucleotide
  Target: SCN10A; (+) strand; PAM type: YTN; PAM sequence: CTC
cacttactgcatggagtgtc

SEQ ID NO: 59187 - DNA, 20 bp, Artificial Sequence
  Description of Artificial Sequence: Synthetic oligonucleotide
  Target: SCN10A; (+) strand; PAM type: YTN; PAM sequence: CTT
actgcatggagtgtccctta

SEQ ID NO: 59188 - DNA, 20 bp, Artificial Sequence
  Description of Artificial Sequence: Synthetic oligonucleotide
  Target: SCN10A; (+) strand; PAM type: YTN; PAM sequence: TTA
ctgcatggagtgtcccttag

SEQ ID NO: 59189 - DNA, 20 bp, Artificial Sequence
  Description of Artificial Sequence: Synthetic oligonucleotide
  Target: SCN10A; (+) strand; PAM type: YTN; PAM sequence: CTG
catggagtgtcccttagtca

SEQ ID NO: 59190 - DNA, 20 bp, Artificial Sequence
  Description of Artificial Sequence: Synthetic oligonucleotide
  Target: SCN10A; (+) strand; PAM type: YTN; PAM sequence: CTT
agtcacgtgacaacacacta

SEQ ID NO: 59191 - DNA, 20 bp, Artificial Sequence
  Description of Artificial Sequence: Synthetic oligonucleotide
  Target: SCN10A; (+) strand; PAM type: YTN; PAM sequence: TTA
gtcacgtgacaacacactac

SEQ ID NO: 59192 - DNA, 20 bp, Artificial Sequence
  Description of Artificial Sequence: Synthetic oligonucleotide
  Target: SCN10A; (+) strand; PAM type: YTN; PAM sequence: CTA
ccctgtccctttggggatcc

SEQ ID NO: 59193 - DNA, 20 bp, Artificial Sequence
  Description of Artificial Sequence: Synthetic oligonucleotide
  Target: SCN10A; (+) strand; PAM type: YTN; PAM sequence: CTG
tccctttggggatcccactt

SEQ ID NO: 59194 - DNA, 20 bp, Artificial Sequence
  Description of Artificial Sequence: Synthetic oligonucleotide
  Target: SCN10A; (+) strand; PAM type: YTN; PAM sequence: CTT
tggggatcccacttttcagt

SEQ ID NO: 59195 - DNA, 20 bp, Artificial Sequence
  Description of Artificial Sequence: Synthetic oligonucleotide
  Target: SCN10A; (+) strand; PAM type: YTN; PAM sequence: TTT
ggggatcccacttttcagtc

SEQ ID NO: 59196 - DNA, 20 bp, Artificial Sequence
  Description of Artificial Sequence: Synthetic oligonucleotide
  Target: SCN10A; (+) strand; PAM type: YTN; PAM sequence: TTG
gggatcccacttttcagtca

SEQ ID NO: 59197 - DNA, 20 bp, Artificial Sequence
  Description of Artificial Sequence: Synthetic oligonucleotide
  Target: SCN10A; (+) strand; PAM type: YTN; PAM sequence: CTT
ttcagtcagcctcgagttct

SEQ ID NO: 59198 - DNA, 20 bp, Artificial Sequence
  Description of Artificial Sequence: Synthetic oligonucleotide
  Target: SCN10A; (+) strand; PAM type: YTN; PAM sequence: TTT
tcagtcagcctcgagttcta

SEQ ID NO: 59199 - DNA, 20 bp, Artificial Sequence
  Description of Artificial Sequence: Synthetic oligonucleotide
  Target: SCN10A; (+) strand; PAM type: YTN; PAM sequence: TTT
cagtcagcctcgagttctag

SEQ ID NO: 59200 - DNA, 20 bp, Artificial Sequence
  Description of Artificial Sequence: Synthetic oligonucleotide
  Target: SCN10A; (+) strand; PAM type: YTN; PAM sequence: TTC
agtcagcctcgagttctagc

SEQ ID NO: 59201 - DNA, 20 bp, Artificial Sequence
  Description of Artificial Sequence: Synthetic oligonucleotide
  Target: SCN10A; (+) strand; PAM type: YTN; PAM sequence: CTC
gagttctagcattttgtata

SEQ ID NO: 59202 - DNA, 20 bp, Artificial Sequence
  Description of Artificial Sequence: Synthetic oligonucleotide
  Target: SCN10A; (+) strand; PAM type: YTN; PAM sequence: TTC
tagcattttgtatatgcgtc

SEQ ID NO: 59203 - DNA, 20 bp, Artificial Sequence
  Description of Artificial Sequence: Synthetic oligonucleotide
  Target: SCN10A; (+) strand; PAM type: YTN; PAM sequence: CTA
gcattttgtatatgcgtctt

SEQ ID NO: 59204 - DNA, 20 bp, Artificial Sequence
  Description of Artificial Sequence: Synthetic oligonucleotide
  Target: SCN10A; (+) strand; PAM type: YTN; PAM sequence: TTT
tgtatatgcgtcttctctac

SEQ ID NO: 59205 - DNA, 20 bp, Artificial Sequence
  Description of Artificial Sequence: Synthetic oligonucleotide
  Target: SCN10A; (+) strand; PAM type: YTN; PAM sequence: TTT
gtatatgcgtcttctctact

SEQ ID NO: 59206 - DNA, 20 bp, Artificial Sequence
  Description of Artificial Sequence: Synthetic oligonucleotide
  Target: SCN10A; (+) strand; PAM type: YTN; PAM sequence: TTG
tatatgcgtcttctctacta

SEQ ID NO: 59207 - DNA, 20 bp, Artificial Sequence
  Description of Artificial Sequence: Synthetic oligonucleotide
  Target: SCN10A; (+) strand; PAM type: YTN; PAM sequence: CTT
ctctactagacaatgagctg

SEQ ID NO: 59208 - DNA, 20 bp, Artificial Sequence
  Description of Artificial Sequence: Synthetic oligonucleotide
  Target: SCN10A; (+) strand; PAM type: YTN; PAM sequence: TTC
tctactagacaatgagctgt

SEQ ID NO: 59209 - DNA, 20 bp, Artificial Sequence
  Description of Artificial Sequence: Synthetic oligonucleotide
  Target: SCN10A; (+) strand; PAM type: YTN; PAM sequence: CTC
tactagacaatgagctgttt

SEQ ID NO: 59210 - DNA, 20 bp, Artificial Sequence
  Description of Artificial Sequence: Synthetic oligonucleotide
  Target: SCN10A; (+) strand; PAM type: YTN; PAM sequence: CTA
ctagacaatgagctgtttga

SEQ ID NO: 59211 - DNA, 20 bp, Artificial Sequence
  Description of Artificial Sequence: Synthetic oligonucleotide
  Target: SCN10A; (+) strand; PAM type: YTN; PAM sequence: CTA
gacaatgagctgtttgagga

SEQ ID NO: 59212 - DNA, 20 bp, Artificial Sequence
  Description of Artificial Sequence: Synthetic oligonucleotide
  Target: SCN10A; (+) strand; PAM type: YTN; PAM sequence: CTG
tttgaggacaagggctatac

SEQ ID NO: 59213 - DNA, 20 bp, Artificial Sequence
  Description of Artificial Sequence: Synthetic oligonucleotide
  Target: SCN10A; (+) strand; PAM type: YTN; PAM sequence: TTT
gaggacaagggctatacctt

SEQ ID NO: 59214 - DNA, 20 bp, Artificial Sequence
  Description of Artificial Sequence: Synthetic oligonucleotide
  Target: SCN10A; (+) strand; PAM type: YTN; PAM sequence: TTG
aggacaagggctataccttc

SEQ ID NO: 59215 - DNA, 20 bp, Artificial Sequence
  Description of Artificial Sequence: Synthetic oligonucleotide
  Target: SCN10A; (+) strand; PAM type: YTN; PAM sequence: CTA
taccttccttaactttgttt

SEQ ID NO: 59216 - DNA, 20 bp, Artificial Sequence
  Description of Artificial Sequence: Synthetic oligonucleotide
  Target: SCN10A; (+) strand; PAM type: YTN; PAM sequence: CTT
ccttaactttgtttccctgc

SEQ ID NO: 59217 - DNA, 20 bp, Artificial Sequence
  Description of Artificial Sequence: Synthetic oligonucleotide
  Target: SCN10A; (+) strand; PAM type: YTN; PAM sequence: TTC
cttaactttgtttccctgca

SEQ ID NO: 59218 - DNA, 20 bp, Artificial Sequence
  Description of Artificial Sequence: Synthetic oligonucleotide
  Target: SCN10A; (+) strand; PAM type: YTN; PAM sequence: CTT
aactttgtttccctgcagtg

SEQ ID NO: 59219 - DNA, 20 bp, Artificial Sequence
  Description of Artificial Sequence: Synthetic oligonucleotide
  Target: SCN10A; (+) strand; PAM type: YTN; PAM sequence: TTA
actttgtttccctgcagtgc

SEQ ID NO: 59220 - DNA, 20 bp, Artificial Sequence
  Description of Artificial Sequence: Synthetic oligonucleotide
  Target: SCN10A; (+) strand; PAM type: YTN; PAM sequence: CTT
tgtttccctgcagtgccctg

SEQ ID NO: 59221 - DNA, 20 bp, Artificial Sequence
  Description of Artificial Sequence: Synthetic oligonucleotide
  Target: SCN10A; (+) strand; PAM type: YTN; PAM sequence: TTT
gtttccctgcagtgccctgc

SEQ ID NO: 59222 - DNA, 20 bp, Artificial Sequence
  Description of Artificial Sequence: Synthetic oligonucleotide
  Target: SCN10A; (+) strand; PAM type: YTN; PAM sequence: TTG
tttccctgcagtgccctgca

SEQ ID NO: 59223 - DNA, 20 bp, Artificial Sequence
  Description of Artificial Sequence: Synthetic oligonucleotide
  Target: SCN10A; (+) strand; PAM type: YTN; PAM sequence: TTT
ccctgcagtgccctgcacat

SEQ ID NO: 59224 - DNA, 20 bp, Artificial Sequence
  Description of Artificial Sequence: Synthetic oligonucleotide
  Target: SCN10A; (+) strand; PAM type: YTN; PAM sequence: TTC
cctgcagtgccctgcacatt

SEQ ID NO: 59225 - DNA, 20 bp, Artificial Sequence
  Description of Artificial Sequence: Synthetic oligonucleotide
  Target: SCN10A; (+) strand; PAM type: YTN; PAM sequence: CTG
cagtgccctgcacattgcaa

SEQ ID NO: 59226 - DNA, 20 bp, Artificial Sequence
  Description of Artificial Sequence: Synthetic oligonucleotide
  Target: SCN10A; (+) strand; PAM type: YTN; PAM sequence: CTG
cacattgcaagagttcaaga

SEQ ID NO: 59227 - DNA, 20 bp, Artificial Sequence
  Description of Artificial Sequence: Synthetic oligonucleotide
  Target: SCN10A; (+) strand; PAM type: YTN; PAM sequence: TTG
caagagttcaagagctgctt

SEQ ID NO: 59228 - DNA, 20 bp, Artificial Sequence
  Description of Artificial Sequence: Synthetic oligonucleotide
  Target: SCN10A; (+) strand; PAM type: YTN; PAM sequence: TTC
aagagctgcttgaaatatta

SEQ ID NO: 59229 - DNA, 20 bp, Artificial Sequence
  Description of Artificial Sequence: Synthetic oligonucleotide
  Target: SCN10A; (+) strand; PAM type: YTN; PAM sequence: CTG
cttgaaatattaatttgagc

SEQ ID NO: 59230 - DNA, 20 bp, Artificial Sequence
  Description of Artificial Sequence: Synthetic oligonucleotide
  Target: SCN10A; (+) strand; PAM type: YTN; PAM sequence: CTT
gaaatattaatttgagctac

SEQ ID NO: 59231 - DNA, 20 bp, Artificial Sequence
  Description of Artificial Sequence: Synthetic oligonucleotide
  Target: SCN10A; (+) strand; PAM type: YTN; PAM sequence: TTG
aaatattaatttgagctact

SEQ ID NO: 59232 - DNA, 20 bp, Artificial Sequence
  Description of Artificial Sequence: Synthetic oligonucleotide
  Target: SCN10A; (+) strand; PAM type: YTN; PAM sequence: TTA
atttgagctactttgctgag

SEQ ID NO: 59233 - DNA, 20 bp, Artificial Sequence
  Description of Artificial Sequence: Synthetic oligonucleotide
  Target: SCN10A; (+) strand; PAM type: YTN; PAM sequence: TTT
gagctactttgctgagagta

SEQ ID NO: 59234 - DNA, 20 bp, Artificial Sequence
  Description of Artificial Sequence: Synthetic oligonucleotide
  Target: SCN10A; (+) strand; PAM type: YTN; PAM sequence: TTG
agctactttgctgagagtaa

SEQ ID NO: 59235 - DNA, 20 bp, Artificial Sequence
  Description of Artificial Sequence: Synthetic oligonucleotide
  Target: SCN10A; (+) strand; PAM type: YTN; PAM sequence: CTA
ctttgctgagagtaaagtca

SEQ ID NO: 59236 - DNA, 20 bp, Artificial Sequence
  Description of Artificial Sequence: Synthetic oligonucleotide
  Target: SCN10A; (+) strand; PAM type: YTN; PAM sequence: CTT
tgctgagagtaaagtcaagt

SEQ ID NO: 59237 - DNA, 20 bp, Artificial Sequence
  Description of Artificial Sequence: Synthetic oligonucleotide
  Target: SCN10A; (+) strand; PAM type: YTN; PAM sequence: TTT
gctgagagtaaagtcaagtg

SEQ ID NO: 59238 - DNA, 20 bp, Artificial Sequence
  Description of Artificial Sequence: Synthetic oligonucleotide
  Target: SCN10A; (+) strand; PAM type: YTN; PAM sequence: TTG
ctgagagtaaagtcaagtgc

SEQ ID NO: 59239 - DNA, 20 bp, Artificial Sequence
  Description of Artificial Sequence: Synthetic oligonucleotide
  Target: SCN10A; (+) strand; PAM type: YTN; PAM sequence: CTG
agagtaaagtcaagtgcaaa

SEQ ID NO: 59240 - DNA, 20 bp, Artificial Sequence
  Description of Artificial Sequence: Synthetic oligonucleotide
  Target: SCN10A; (+) strand; PAM type: YTN; PAM sequence: CTT
attcttggaaatgttccctc

SEQ ID NO: 59241 - DNA, 20 bp, Artificial Sequence
  Description of Artificial Sequence: Synthetic oligonucleotide
  Target: SCN10A; (+) strand; PAM type: YTN; PAM sequence: TTA
ttcttggaaatgttccctct

SEQ ID NO: 59242 - DNA, 20 bp, Artificial Sequence
  Description of Artificial Sequence: Synthetic oligonucleotide
  Target: SCN10A; (+) strand; PAM type: YTN; PAM sequence: TTC
ttggaaatgttccctctgtt

SEQ ID NO: 59243 - DNA, 20 bp, Artificial Sequence
  Description of Artificial Sequence: Synthetic oligonucleotide
  Target: SCN10A; (+) strand; PAM type: YTN; PAM sequence: CTT
ggaaatgttccctctgttcc

SEQ ID NO: 59244 - DNA, 20 bp, Artificial Sequence
  Description of Artificial Sequence: Synthetic oligonucleotide
  Target: SCN10A; (+) strand; PAM type: YTN; PAM sequence: TTG
gaaatgttccctctgttcct

SEQ ID NO: 59245 - DNA, 20 bp, Artificial Sequence
  Description of Artificial Sequence: Synthetic oligonucleotide
  Target: SCN10A; (+) strand; PAM type: YTN; PAM sequence: TTC
cctctgttcctggtgctgtg

SEQ ID NO: 59246 - DNA, 20 bp, Artificial Sequence
  Description of Artificial Sequence: Synthetic oligonucleotide
  Target: SCN10A; (+) strand; PAM type: YTN; PAM sequence: CTC
tgttcctggtgctgtgcaaa

SEQ ID NO: 59247 - DNA, 20 bp, Artificial Sequence
  Description of Artificial Sequence: Synthetic oligonucleotide
  Target: SCN10A; (+) strand; PAM type: YTN; PAM sequence: CTG
ttcctggtgctgtgcaaatg

SEQ ID NO: 59248 - DNA, 20 bp, Artificial Sequence
  Description of Artificial Sequence: Synthetic oligonucleotide
  Target: SCN10A; (+) strand; PAM type: YTN; PAM sequence: TTC
ctggtgctgtgcaaatgcct

SEQ ID NO: 59249 - DNA, 20 bp, Artificial Sequence
  Description of Artificial Sequence: Synthetic oligonucleotide
  Target: SCN10A; (+) strand; PAM type: YTN; PAM sequence: CTG
gtgctgtgcaaatgcctaag

SEQ ID NO: 59250 - DNA, 20 bp, Artificial Sequence
  Description of Artificial Sequence: Synthetic oligonucleotide
  Target: SCN10A; (+) strand; PAM type: YTN; PAM sequence: CTG
tgcaaatgcctaagcaaatg

SEQ ID NO: 59251 - DNA, 20 bp, Artificial Sequence
  Description of Artificial Sequence: Synthetic oligonucleotide
  Target: SCN10A; (+) strand; PAM type: YTN; PAM sequence: CTA
agcaaatgcaggtatagggc

SEQ ID NO: 59252 - DNA, 20 bp, Artificial Sequence
  Description of Artificial Sequence: Synthetic oligonucleotide
  Target: SCN10A; (+) strand; PAM type: YTN; PAM sequence: CTT
ggttgtttgcatcttggaag

SEQ ID NO: 59253 - DNA, 20 bp, Artificial Sequence
  Description of Artificial Sequence: Synthetic oligonucleotide
  Target: SCN10A; (+) strand; PAM type: YTN; PAM sequence: TTG
gttgtttgcatcttggaagg

SEQ ID NO: 59254 - DNA, 20 bp, Artificial Sequence
  Description of Artificial Sequence: Synthetic oligonucleotide
  Target: SCN10A; (+) strand; PAM type: YTN; PAM sequence: TTG
tttgcatcttggaaggaggc

SEQ ID NO: 59255 - DNA, 20 bp, Artificial Sequence
  Description of Artificial Sequence: Synthetic oligonucleotide
  Target: SCN10A; (+) strand; PAM type: YTN; PAM sequence: TTT
gcatcttggaaggaggcaga

SEQ ID NO: 59256 - DNA, 20 bp, Artificial Sequence
  Description of Artificial Sequence: Synthetic oligonucleotide
  Target: SCN10A; (+) strand; PAM type: YTN; PAM sequence: TTG
catcttggaaggaggcagag

SEQ ID NO: 59257 - DNA, 20 bp, Artificial Sequence
  Description of Artificial Sequence: Synthetic oligonucleotide
  Target: SCN10A; (+) strand; PAM type: YTN; PAM sequence: CTT
ggaaggaggcagagtggcct

SEQ ID NO: 59258 - DNA, 20 bp, Artificial Sequence
  Description of Artificial Sequence: Synthetic oligonucleotide
  Target: SCN10A; (+) strand; PAM type: YTN; PAM sequence: TTG
gaaggaggcagagtggcctg

SEQ ID NO: 59259 - DNA, 20 bp, Artificial Sequence
  Description of Artificial Sequence: Synthetic oligonucleotide
  Target: SCN10A; (+) strand; PAM type: YTN; PAM sequence: CTG
gataaccaagagatcattta

SEQ ID NO: 59260 - DNA, 20 bp, Artificial Sequence
  Description of Artificial Sequence: Synthetic oligonucleotide
  Target: SCN10A; (+) strand; PAM type: YTN; PAM sequence: TTT
atatctggttatttttatgg

SEQ ID NO: 59261 - DNA, 20 bp, Artificial Sequence
  Description of Artificial Sequence: Synthetic oligonucleotide
  Target: SCN10A; (+) strand; PAM type: YTN; PAM sequence: TTA
tatctggttatttttatggt

SEQ ID NO: 59262 - DNA, 20 bp, Artificial Sequence
  Description of Artificial Sequence: Synthetic oligonucleotide
  Target: SCN10A; (+) strand; PAM type: YTN; PAM sequence: CTG
gttatttttatggtgtcttt

SEQ ID NO: 59263 - DNA, 20 bp, Artificial Sequence
  Description of Artificial Sequence: Synthetic oligonucleotide
  Target: SCN10A; (+) strand; PAM type: YTN; PAM sequence: TTA
tttttatggtgtctttaaaa

SEQ ID NO: 59264 - DNA, 20 bp, Artificial Sequence
  Description of Artificial Sequence: Synthetic oligonucleotide
  Target: SCN10A; (+) strand; PAM type: YTN; PAM sequence: TTT
ttatggtgtctttaaaaagc

SEQ ID NO: 59265 - DNA, 20 bp, Artificial Sequence
  Description of Artificial Sequence: Synthetic oligonucleotide
  Target: SCN10A; (+) strand; PAM type: YTN; PAM sequence: TTT
tatggtgtctttaaaaagct

SEQ ID NO: 59266 - DNA, 20 bp, Artificial Sequence
  Description of Artificial Sequence: Synthetic oligonucleotide
  Target: SCN10A; (+) strand; PAM type: YTN; PAM sequence: TTT
atggtgtctttaaaaagctc

SEQ ID NO: 59267 - DNA, 20 bp, Artificial Sequence
  Description of Artificial Sequence: Synthetic oligonucleotide
  Target: SCN10A; (+) strand; PAM type: YTN; PAM sequence: TTA
tggtgtctttaaaaagctcc

SEQ ID NO: 59268 - DNA, 20 bp, Artificial Sequence
  Description of Artificial Sequence: Synthetic oligonucleotide
  Target: SCN10A; (+) strand; PAM type: YTN; PAM sequence: CTT
taaaaagctcctactgtgat

SEQ ID NO: 59269 - DNA, 20 bp, Artificial Sequence
  Description of Artificial Sequence: Synthetic oligonucleotide
  Target: SCN10A; (+) strand; PAM type: YTN; PAM sequence: TTT
aaaaagctcctactgtgatc

SEQ ID NO: 59270 - DNA, 20 bp, Artificial Sequence
  Description of Artificial Sequence: Synthetic oligonucleotide
  Target: SCN10A; (+) strand; PAM type: YTN; PAM sequence: TTA
aaaagctcctactgtgatct

SEQ ID NO: 59271 - DNA, 20 bp, Artificial Sequence
  Description of Artificial Sequence: Synthetic oligonucleotide
  Target: SCN10A; (+) strand; PAM type: YTN; PAM sequence: CTC
ctactgtgatcttctcttct

SEQ ID NO: 59272 - DNA, 20 bp, Artificial Sequence
  Description of Artificial Sequence: Synthetic oligonucleotide
  Target: SCN10A; (+) strand; PAM type: YTN; PAM sequence: CTA
ctgtgatcttctcttctttt

SEQ ID NO: 59273 - DNA, 20 bp, Artificial Sequence
  Description of Artificial Sequence: Synthetic oligonucleotide
  Target: SCN10A; (+) strand; PAM type: YTN; PAM sequence: CTG
tgatcttctcttcttttagt

SEQ ID NO: 59274 - DNA, 20 bp, Artificial Sequence
  Description of Artificial Sequence: Synthetic oligonucleotide
  Target: SCN10A; (+) strand; PAM type: YTN; PAM sequence: CTT
ctcttcttttagtgctgtga

SEQ ID NO: 59275 - DNA, 20 bp, Artificial Sequence
  Description of Artificial Sequence: Synthetic oligonucleotide
  Target: SCN10A; (+) strand; PAM type: YTN; PAM sequence: TTC
tcttcttttagtgctgtgaa

SEQ ID NO: 59276 - DNA, 20 bp, Artificial Sequence
  Description of Artificial Sequence: Synthetic oligonucleotide
  Target: SCN10A; (+) strand; PAM type: YTN; PAM sequence: CTC
ttcttttagtgctgtgaaca

SEQ ID NO: 59277 - DNA, 20 bp, Artificial Sequence
  Description of Artificial Sequence: Synthetic oligonucleotide
  Target: SCN10A; (+) strand; PAM type: YTN; PAM sequence: CTT
cttttagtgctgtgaacatc

SEQ ID NO: 59278 - DNA, 20 bp, Artificial Sequence
  Description of Artificial Sequence: Synthetic oligonucleotide
  Target: SCN10A; (+) strand; PAM type: YTN; PAM sequence: TTC
ttttagtgctgtgaacatct

SEQ ID NO: 59279 - DNA, 20 bp, Artificial Sequence
  Description of Artificial Sequence: Synthetic oligonucleotide
  Target: SCN10A; (+) strand; PAM type: YTN; PAM sequence: CTT
ttagtgctgtgaacatctta

SEQ ID NO: 59280 - DNA, 20 bp, Artificial Sequence
  Description of Artificial Sequence: Synthetic oligonucleotide
  Target: SCN10A; (+) strand; PAM type: YTN; PAM sequence: TTT
tagtgctgtgaacatcttac

SEQ ID NO: 59281 - DNA, 20 bp, Artificial Sequence
  Description of Artificial Sequence: Synthetic oligonucleotide
  Target: SCN10A; (+) strand; PAM type: YTN; PAM sequence: TTT
agtgctgtgaacatcttact

SEQ ID NO: 59282 - DNA, 20 bp, Artificial Sequence
  Description of Artificial Sequence: Synthetic oligonucleotide
  Target: SCN10A; (+) strand; PAM type: YTN; PAM sequence: TTA
gtgctgtgaacatcttactg

SEQ ID NO: 59283 - DNA, 20 bp, Artificial Sequence
  Description of Artificial Sequence: Synthetic oligonucleotide
  Target: SCN10A; (+) strand; PAM type: YTN; PAM sequence: CTG
tgaacatcttactgctctgt

SEQ ID NO: 59284 - DNA, 20 bp, Artificial Sequence
  Description of Artificial Sequence: Synthetic oligonucleotide
  Target: SCN10A; (+) strand; PAM type: YTN; PAM sequence: CTT
actgctctgtgagtccttga

SEQ ID NO: 59285 - DNA, 20 bp, Artificial Sequence
  Description of Artificial Sequence: Synthetic oligonucleotide
  Target: SCN10A; (+) strand; PAM type: YTN; PAM sequence: TTA
ctgctctgtgagtccttgat

SEQ ID NO: 59286 - DNA, 20 bp, Artificial Sequence
  Description of Artificial Sequence: Synthetic oligonucleotide
  Target: SCN10A; (+) strand; PAM type: YTN; PAM sequence: CTG
ctctgtgagtccttgatccc

SEQ ID NO: 59287 - DNA, 20 bp, Artificial Sequence
  Description of Artificial Sequence: Synthetic oligonucleotide
  Target: SCN10A; (+) strand; PAM type: YTN; PAM sequence: CTC
tgtgagtccttgatcccaac

SEQ ID NO: 59288 - DNA, 20 bp, Artificial Sequence
  Description of Artificial Sequence: Synthetic oligonucleotide
  Target: SCN10A; (+) strand; PAM type: YTN; PAM sequence: CTG
tgagtccttgatcccaaccc

SEQ ID NO: 59289 - DNA, 20 bp, Artificial Sequence
  Description of Artificial Sequence: Synthetic oligonucleotide
  Target: SCN10A; (+) strand; PAM type: YTN; PAM sequence: CTT
gatcccaaccccattcccca

SEQ ID NO: 59290 - DNA, 20 bp, Artificial Sequence
  Description of Artificial Sequence: Synthetic oligonucleotide
  Target: SCN10A; (+) strand; PAM type: YTN; PAM sequence: TTG
atcccaaccccattccccac

SEQ ID NO: 59291 - DNA, 20 bp, Artificial Sequence
  Description of Artificial Sequence: Synthetic oligonucleotide
  Target: SCN10A; (+) strand; PAM type: YTN; PAM sequence: TTC
cccacgctttgaccttctcc

SEQ ID NO: 59292 - DNA, 20 bp, Artificial Sequence
  Description of Artificial Sequence: Synthetic oligonucleotide
  Target: SCN10A; (+) strand; PAM type: YTN; PAM sequence: CTT
tgaccttctcccaaaacttc

SEQ ID NO: 59293 - DNA, 20 bp, Artificial Sequence
  Description of Artificial Sequence: Synthetic oligonucleotide
  Target: SCN10A; (+) strand; PAM type: YTN; PAM sequence: TTT
gaccttctcccaaaacttct

SEQ ID NO: 59294 - DNA, 20 bp, Artificial Sequence
  Description of Artificial Sequence: Synthetic oligonucleotide
  Target: SCN10A; (+) strand; PAM type: YTN; PAM sequence: TTG
accttctcccaaaacttctc

SEQ ID NO: 59295 - DNA, 20 bp, Artificial Sequence
  Description of Artificial Sequence: Synthetic oligonucleotide
  Target: SCN10A; (+) strand; PAM type: YTN; PAM sequence: CTT
ctcccaaaacttctcctgac

SEQ ID NO: 59296 - DNA, 20 bp, Artificial Sequence
  Description of Artificial Sequence: Synthetic oligonucleotide
  Target: SCN10A; (+) strand; PAM type: YTN; PAM sequence: TTC
tcccaaaacttctcctgacc

SEQ ID NO: 59297 - DNA, 20 bp, Artificial Sequence
  Description of Artificial Sequence: Synthetic oligonucleotide
  Target: SCN10A; (+) strand; PAM type: YTN; PAM sequence: CTC
ccaaaacttctcctgacctc

SEQ ID NO: 59298 - DNA, 20 bp, Artificial Sequence
  Description of Artificial Sequence: Synthetic oligonucleotide
  Target: SCN10A; (+) strand; PAM type: YTN; PAM sequence: CTT
ctcctgacctctatggagct

SEQ ID NO: 59299 - DNA, 20 bp, Artificial Sequence
  Description of Artificial Sequence: Synthetic oligonucleotide
  Target: SCN10A; (+) strand; PAM type: YTN; PAM sequence: TTC
tcctgacctctatggagctc

SEQ ID NO: 59300 - DNA, 20 bp, Artificial Sequence
  Description of Artificial Sequence: Synthetic oligonucleotide
  Target: SCN10A; (+) strand; PAM type: YTN; PAM sequence: CTC
ctgacctctatggagctcac

SEQ ID NO: 59301 - DNA, 20 bp, Artificial Sequence
  Description of Artificial Sequence: Synthetic oligonucleotide
  Target: SCN10A; (+) strand; PAM type: YTN; PAM sequence: CTG
acctctatggagctcacctg

SEQ ID NO: 59302 - DNA, 20 bp, Artificial Sequence
  Description of Artificial Sequence: Synthetic oligonucleotide
  Target: SCN10A; (+) strand; PAM type: YTN; PAM sequence: CTC
tatggagctcacctgccttg

SEQ ID NO: 59303 - DNA, 20 bp, Artificial Sequence
  Description of Artificial Sequence: Synthetic oligonucleotide
  Target: SCN10A; (+) strand; PAM type: YTN; PAM sequence: CTA
tggagctcacctgccttgat

SEQ ID NO: 59304 - DNA, 20 bp, Artificial Sequence
  Description of Artificial Sequence: Synthetic oligonucleotide
  Target: SCN10A; (+) strand; PAM type: YTN; PAM sequence: CTC
acctgccttgatctgcacat

SEQ ID NO: 59305 - DNA, 20 bp, Artificial Sequence
  Description of Artificial Sequence: Synthetic oligonucleotide
  Target: SCN10A; (+) strand; PAM type: YTN; PAM sequence: CTG
ccttgatctgcacatatctc

SEQ ID NO: 59306 - DNA, 20 bp, Artificial Sequence
  Description of Artificial Sequence: Synthetic oligonucleotide
  Target: SCN10A; (+) strand; PAM type: YTN; PAM sequence: CTT
gatctgcacatatctccccc

SEQ ID NO: 59307 - DNA, 20 bp, Artificial Sequence
  Description of Artificial Sequence: Synthetic oligonucleotide
  Target: SCN10A; (+) strand; PAM type: YTN; PAM sequence: TTG
atctgcacatatctccccct

SEQ ID NO: 59308 - DNA, 20 bp, Artificial Sequence
  Description of Artificial Sequence: Synthetic oligonucleotide
  Target: SCN10A; (+) strand; PAM type: YTN; PAM sequence: CTG
cacatatctccccctattca

SEQ ID NO: 59309 - DNA, 20 bp, Artificial Sequence
  Description of Artificial Sequence: Synthetic oligonucleotide
  Target: SCN10A; (+) strand; PAM type: YTN; PAM sequence: CTC
cccctattcaaaggctgcca

SEQ ID NO: 59310 - DNA, 20 bp, Artificial Sequence
  Description of Artificial Sequence: Synthetic oligonucleotide
  Target: SCN10A; (+) strand; PAM type: YTN; PAM sequence: CTA
ttcaaaggctgccattctcc

SEQ ID NO: 59311 - DNA, 20 bp, Artificial Sequence
  Description of Artificial Sequence: Synthetic oligonucleotide
  Target: SCN10A; (+) strand; PAM type: YTN; PAM sequence: TTC
aaaggctgccattctcccct

SEQ ID NO: 59312 - DNA, 20 bp, Artificial Sequence
  Description of Artificial Sequence: Synthetic oligonucleotide
  Target: SCN10A; (+) strand; PAM type: YTN; PAM sequence: CTG
ccattctcccctaccccatg

SEQ ID NO: 59313 - DNA, 20 bp, Artificial Sequence
  Description of Artificial Sequence: Synthetic oligonucleotide
  Target: SCN10A; (+) strand; PAM type: YTN; PAM sequence: TTC
tcccctaccccatgtacctc

SEQ ID NO: 59314 - DNA, 20 bp, Artificial Sequence
  Description of Artificial Sequence: Synthetic oligonucleotide
  Target: SCN10A; (+) strand; PAM type: YTN; PAM sequence: CTC
ccctaccccatgtacctcag

SEQ ID NO: 59315 - DNA, 20 bp, Artificial Sequence
  Description of Artificial Sequence: Synthetic oligonucleotide
  Target: SCN10A; (+) strand; PAM type: YTN; PAM sequence: CTA
ccccatgtacctcaggggtt

SEQ ID NO: 59316 - DNA, 20 bp, Artificial Sequence
  Description of Artificial Sequence: Synthetic oligonucleotide
  Target: SCN10A; (+) strand; PAM type: YTN; PAM sequence: CTC
aggggttaggcctggcgttc

SEQ ID NO: 59317 - DNA, 20 bp, Artificial Sequence
  Description of Artificial Sequence: Synthetic oligonucleotide
  Target: SCN10A; (+) strand; PAM type: YTN; PAM sequence: TTA
ggcctggcgttctccttgtt

SEQ ID NO: 59318 - DNA, 20 bp, Artificial Sequence
  Description of Artificial Sequence: Synthetic oligonucleotide
  Target: SCN10A; (+) strand; PAM type: YTN; PAM sequence: CTG
gcgttctccttgttcaccac

SEQ ID NO: 59319 - DNA, 20 bp, Artificial Sequence
  Description of Artificial Sequence: Synthetic oligonucleotide
  Target: SCN10A; (+) strand; PAM type: YTN; PAM sequence: TTC
tccttgttcaccactgaccc

SEQ ID NO: 59320 - DNA, 20 bp, Artificial Sequence
  Description of Artificial Sequence: Synthetic oligonucleotide
  Target: SCN10A; (+) strand; PAM type: YTN; PAM sequence: CTC
cttgttcaccactgaccctt

SEQ ID NO: 59321 - DNA, 20 bp, Artificial Sequence
  Description of Artificial Sequence: Synthetic oligonucleotide
  Target: SCN10A; (+) strand; PAM type: YTN; PAM sequence: CTT
gttcaccactgacccttcca

SEQ ID NO: 59322 - DNA, 20 bp, Artificial Sequence
  Description of Artificial Sequence: Synthetic oligonucleotide
  Target: SCN10A; (+) strand; PAM type: YTN; PAM sequence: TTG
ttcaccactgacccttccac

SEQ ID NO: 59323 - DNA, 20 bp, Artificial Sequence
  Description of Artificial Sequence: Synthetic oligonucleotide
  Target: SCN10A; (+) strand; PAM type: YTN; PAM sequence: TTC
accactgacccttccacacc

SEQ ID NO: 59324 - DNA, 20 bp, Artificial Sequence
  Description of Artificial Sequence: Synthetic oligonucleotide
  Target: SCN10A; (+) strand; PAM type: YTN; PAM sequence: CTG
acccttccacaccactgctc

SEQ ID NO: 59325 - DNA, 20 bp, Artificial Sequence
  Description of Artificial Sequence: Synthetic oligonucleotide
  Target: SCN10A; (+) strand; PAM type: YTN; PAM sequence: CTT
ccacaccactgctcttcctg

SEQ ID NO: 59326 - DNA, 20 bp, Artificial Sequence
  Description of Artificial Sequence: Synthetic oligonucleotide
  Target: SCN10A; (+) strand; PAM type: YTN; PAM sequence: TTC
cacaccactgctcttcctgt

SEQ ID NO: 59327 - DNA, 20 bp, Artificial Sequence
  Description of Artificial Sequence: Synthetic oligonucleotide
  Target: SCN10A; (+) strand; PAM type: YTN; PAM sequence: CTG
ctcttcctgtgtcttgtaaa

SEQ ID NO: 59328 - DNA, 20 bp, Artificial Sequence
  Description of Artificial Sequence: Synthetic oligonucleotide
  Target: SCN10A; (+) strand; PAM type: YTN; PAM sequence: CTC
ttcctgtgtcttgtaaaacc

SEQ ID NO: 59329 - DNA, 20 bp, Artificial Sequence
  Description of Artificial Sequence: Synthetic oligonucleotide
  Target: SCN10A; (+) strand; PAM type: YTN; PAM sequence: CTT
cctgtgtcttgtaaaacccc

SEQ ID NO: 59330 - DNA, 20 bp, Artificial Sequence
  Description of Artificial Sequence: Synthetic oligonucleotide
  Target: SCN10A; (+) strand; PAM type: YTN; PAM sequence: TTC
ctgtgtcttgtaaaacccct

SEQ ID NO: 59331 - DNA, 20 bp, Artificial Sequence
  Description of Artificial Sequence: Synthetic oligonucleotide
  Target: SCN10A; (+) strand; PAM type: YTN; PAM sequence: CTG
tgtcttgtaaaaccccttct

SEQ ID NO: 59332 - DNA, 20 bp, Artificial Sequence
  Description of Artificial Sequence: Synthetic oligonucleotide
  Target: SCN10A; (+) strand; PAM type: YTN; PAM sequence: CTT
gtaaaaccccttcttgcttt

SEQ ID NO: 59333 - DNA, 20 bp, Artificial Sequence
  Description of Artificial Sequence: Synthetic oligonucleotide
  Target: SCN10A; (+) strand; PAM type: YTN; PAM sequence: TTG
taaaaccccttcttgctttg

SEQ ID NO: 59334 - DNA, 20 bp, Artificial Sequence
  Description of Artificial Sequence: Synthetic oligonucleotide
  Target: SCN10A; (+) strand; PAM type: YTN; PAM sequence: CTT
cttgctttgaagctttgcca

SEQ ID NO: 59335 - DNA, 20 bp, Artificial Sequence
  Description of Artificial Sequence: Synthetic oligonucleotide
  Target: SCN10A; (+) strand; PAM type: YTN; PAM sequence: TTC
ttgctttgaagctttgccac

SEQ ID NO: 59336 - DNA, 20 bp, Artificial Sequence
  Description of Artificial Sequence: Synthetic oligonucleotide
  Target: SCN10A; (+) strand; PAM type: YTN; PAM sequence: CTT
gctttgaagctttgccacct

SEQ ID NO: 59337 - DNA, 20 bp, Artificial Sequence
  Description of Artificial Sequence: Synthetic oligonucleotide
  Target: SCN10A; (+) strand; PAM type: YTN; PAM sequence: TTG
ctttgaagctttgccaccta

SEQ ID NO: 59338 - DNA, 20 bp, Artificial Sequence
  Description of Artificial Sequence: Synthetic oligonucleotide
  Target: SCN10A; (+) strand; PAM type: YTN; PAM sequence: CTT
tgaagctttgccacctagtt

SEQ ID NO: 59339 - DNA, 20 bp, Artificial Sequence
  Description of Artificial Sequence: Synthetic oligonucleotide
  Target: SCN10A; (+) strand; PAM type: YTN; PAM sequence: TTT
gaagctttgccacctagttt

SEQ ID NO: 59340 - DNA, 20 bp, Artificial Sequence
  Description of Artificial Sequence: Synthetic oligonucleotide
  Target: SCN10A; (+) strand; PAM type: YTN; PAM sequence: TTG
aagctttgccacctagtttt

SEQ ID NO: 59341 - DNA, 20 bp, Artificial Sequence
  Description of Artificial Sequence: Synthetic oligonucleotide
  Target: SCN10A; (+) strand; PAM type: YTN; PAM sequence: CTT
tgccacctagttttgtcact

SEQ ID NO: 59342 - DNA, 20 bp, Artificial Sequence
  Description of Artificial Sequence: Synthetic oligonucleotide
  Target: SCN10A; (+) strand; PAM type: YTN; PAM sequence: TTT
gccacctagttttgtcactt

SEQ ID NO: 59343 - DNA, 20 bp, Artificial Sequence
  Description of Artificial Sequence: Synthetic oligonucleotide
  Target: SCN10A; (+) strand; PAM type: YTN; PAM sequence: TTG
ccacctagttttgtcacttc

SEQ ID NO: 59344 - DNA, 20 bp, Artificial Sequence
  Description of Artificial Sequence: Synthetic oligonucleotide
  Target: SCN10A; (+) strand; PAM type: YTN; PAM sequence: CTA
gttttgtcacttcttcatta

SEQ ID NO: 59345 - DNA, 20 bp, Artificial Sequence
  Description of Artificial Sequence: Synthetic oligonucleotide
  Target: SCN10A; (+) strand; PAM type: YTN; PAM sequence: TTT
tgtcacttcttcattactgc

SEQ ID NO: 59346 - DNA, 20 bp, Artificial Sequence
  Description of Artificial Sequence: Synthetic oligonucleotide
  Target: SCN10A; (+) strand; PAM type: YTN; PAM sequence: TTT
gtcacttcttcattactgcc

SEQ ID NO: 59347 - DNA, 20 bp, Artificial Sequence
  Description of Artificial Sequence: Synthetic oligonucleotide
  Target: SCN10A; (+) strand; PAM type: YTN; PAM sequence: TTG
tcacttcttcattactgccg

SEQ ID NO: 59348 - DNA, 20 bp, Artificial Sequence
  Description of Artificial Sequence: Synthetic oligonucleotide
  Target: SCN10A; (+) strand; PAM type: YTN; PAM sequence: CTT
cttcattactgccgcttgcc

SEQ ID NO: 59349 - DNA, 20 bp, Artificial Sequence
  Description of Artificial Sequence: Synthetic oligonucleotide
  Target: SCN10A; (+) strand; PAM type: YTN; PAM sequence: TTC
ttcattactgccgcttgcca

SEQ ID NO: 59350 - DNA, 20 bp, Artificial Sequence
  Description of Artificial Sequence: Synthetic oligonucleotide
  Target: SCN10A; (+) strand; PAM type: YTN; PAM sequence: CTT
cattactgccgcttgccaaa

SEQ ID NO: 59351 - DNA, 20 bp, Artificial Sequence
  Description of Artificial Sequence: Synthetic oligonucleotide
  Target: SCN10A; (+) strand; PAM type: YTN; PAM sequence: TTC
attactgccgcttgccaaac

SEQ ID NO: 59352 - DNA, 20 bp, Artificial Sequence
  Description of Artificial Sequence: Synthetic oligonucleotide
  Target: SCN10A; (+) strand; PAM type: YTN; PAM sequence: TTA
ctgccgcttgccaaactctt

SEQ ID NO: 59353 - DNA, 20 bp, Artificial Sequence
  Description of Artificial Sequence: Synthetic oligonucleotide
  Target: SCN10A; (+) strand; PAM type: YTN; PAM sequence: CTG
ccgcttgccaaactcttggt

SEQ ID NO: 59354 - DNA, 20 bp, Artificial Sequence
  Description of Artificial Sequence: Synthetic oligonucleotide
  Target: SCN10A; (+) strand; PAM type: YTN; PAM sequence: CTT
gccaaactcttggtccctct

SEQ ID NO: 59355 - DNA, 20 bp, Artificial Sequence
  Description of Artificial Sequence: Synthetic oligonucleotide
  Target: SCN10A; (+) strand; PAM type: YTN; PAM sequence: TTG
ccaaactcttggtccctctg

SEQ ID NO: 59356 - DNA, 20 bp, Artificial Sequence
  Description of Artificial Sequence: Synthetic oligonucleotide
  Target: SCN10A; (+) strand; PAM type: YTN; PAM sequence: CTC
ttggtccctctgcctcagta

SEQ ID NO: 59357 - DNA, 20 bp, Artificial Sequence
  Description of Artificial Sequence: Synthetic oligonucleotide
  Target: SCN10A; (+) strand; PAM type: YTN; PAM sequence: CTT
ggtccctctgcctcagtaat

SEQ ID NO: 59358 - DNA, 20 bp, Artificial Sequence
  Description of Artificial Sequence: Synthetic oligonucleotide
  Target: SCN10A; (+) strand; PAM type: YTN; PAM sequence: TTG
gtccctctgcctcagtaatg

SEQ ID NO: 59359 - DNA, 20 bp, Artificial Sequence
  Description of Artificial Sequence: Synthetic oligonucleotide
  Target: SCN10A; (+) strand; PAM type: YTN; PAM sequence: CTC
tgcctcagtaatgatgggtg

SEQ ID NO: 59360 - DNA, 20 bp, Artificial Sequence
  Description of Artificial Sequence: Synthetic oligonucleotide
  Target: SCN10A; (+) strand; PAM type: YTN; PAM sequence: CTG
cctcagtaatgatgggtgag

SEQ ID NO: 59361 - DNA, 20 bp, Artificial Sequence
  Description of Artificial Sequence: Synthetic oligonucleotide
  Target: SCN10A; (+) strand; PAM type: YTN; PAM sequence: CTC
agtaatgatgggtgaggctc

SEQ ID NO: 59362 - DNA, 20 bp, Artificial Sequence
  Description of Artificial Sequence: Synthetic oligonucleotide
  Target: SCN10A; (+) strand; PAM type: YTN; PAM sequence: CTC
ttggccatatttgcccactc

SEQ ID NO: 59363 - DNA, 20 bp, Artificial Sequence
  Description of Artificial Sequence: Synthetic oligonucleotide
  Target: SCN10A; (+) strand; PAM type: YTN; PAM sequence: CTT
ggccatatttgcccactctt

SEQ ID NO: 59364 - DNA, 20 bp, Artificial Sequence
  Description of Artificial Sequence: Synthetic oligonucleotide
  Target: SCN10A; (+) strand; PAM type: YTN; PAM sequence: TTG
gccatatttgcccactcttg

SEQ ID NO: 59365 - DNA, 20 bp, Artificial Sequence
  Description of Artificial Sequence: Synthetic oligonucleotide
  Target: SCN10A; (+) strand; PAM type: YTN; PAM sequence: TTT
gcccactcttggctattatc

SEQ ID NO: 59366 - DNA, 20 bp, Artificial Sequence
  Description of Artificial Sequence: Synthetic oligonucleotide
  Target: SCN10A; (+) strand; PAM type: YTN; PAM sequence: TTG
cccactcttggctattatcc

SEQ ID NO: 59367 - DNA, 20 bp, Artificial Sequence
  Description of Artificial Sequence: Synthetic oligonucleotide
  Target: SCN10A; (+) strand; PAM type: YTN; PAM sequence: CTC
ttggctattatcctaggcaa

SEQ ID NO: 59368 - DNA, 20 bp, Artificial Sequence
  Description of Artificial Sequence: Synthetic oligonucleotide
  Target: SCN10A; (+) strand; PAM type: YTN; PAM sequence: CTT
ggctattatcctaggcaaca

SEQ ID NO: 59369 - DNA, 20 bp, Artificial Sequence
  Description of Artificial Sequence: Synthetic oligonucleotide
  Target: SCN10A; (+) strand; PAM type: YTN; PAM sequence: TTG
gctattatcctaggcaacat

SEQ ID NO: 59370 - DNA, 20 bp, Artificial Sequence
  Description of Artificial Sequence: Synthetic oligonucleotide
  Target: SCN10A; (+) strand; PAM type: YTN; PAM sequence: CTA
ttatcctaggcaacattaat

SEQ ID NO: 59371 - DNA, 20 bp, Artificial Sequence
  Description of Artificial Sequence: Synthetic oligonucleotide
  Target: SCN10A; (+) strand; PAM type: YTN; PAM sequence: TTA
tcctaggcaacattaatgtc

SEQ ID NO: 59372 - DNA, 20 bp, Artificial Sequence
  Description of Artificial Sequence: Synthetic oligonucleotide
  Target: SCN10A; (+) strand; PAM type: YTN; PAM sequence: CTA
ggcaacattaatgtccatgt

SEQ ID NO: 59373 - DNA, 20 bp, Artificial Sequence
  Description of Artificial Sequence: Synthetic oligonucleotide
  Target: SCN10A; (+) strand; PAM type: YTN; PAM sequence: TTA
atgtccatgtgcattactct

SEQ ID NO: 59374 - DNA, 20 bp, Artificial Sequence
  Description of Artificial Sequence: Synthetic oligonucleotide
  Target: SCN10A; (+) strand; PAM type: YTN; PAM sequence: TTA
ctctttgtctcttggtttat

SEQ ID NO: 59375 - DNA, 20 bp, Artificial Sequence
  Description of Artificial Sequence: Synthetic oligonucleotide
  Target: SCN10A; (+) strand; PAM type: YTN; PAM sequence: CTC
tttgtctcttggtttattgc

SEQ ID NO: 59376 - DNA, 20 bp, Artificial Sequence
  Description of Artificial Sequence: Synthetic oligonucleotide
  Target: SCN10A; (+) strand; PAM type: YTN; PAM sequence: CTT
tgtctcttggtttattgcac

SEQ ID NO: 59377 - DNA, 20 bp, Artificial Sequence
  Description of Artificial Sequence: Synthetic oligonucleotide
  Target: SCN10A; (+) strand; PAM type: YTN; PAM sequence: TTT
gtctcttggtttattgcaca

SEQ ID NO: 59378 - DNA, 20 bp, Artificial Sequence
  Description of Artificial Sequence: Synthetic oligonucleotide
  Target: SCN10A; (+) strand; PAM type: YTN; PAM sequence: TTG
tctcttggtttattgcacaa

SEQ ID NO: 59379 - DNA, 20 bp, Artificial Sequence
  Description of Artificial Sequence: Synthetic oligonucleotide
  Target: SCN10A; (+) strand; PAM type: YTN; PAM sequence: CTC
ttggtttattgcacaaatct

SEQ ID NO: 59380 - DNA, 20 bp, Artificial Sequence
  Description of Artificial Sequence: Synthetic oligonucleotide
  Target: SCN10A; (+) strand; PAM type: YTN; PAM sequence: CTT
ggtttattgcacaaatctct

SEQ ID NO: 59381 - DNA, 20 bp, Artificial Sequence
  Description of Artificial Sequence: Synthetic oligonucleotide
  Target: SCN10A; (+) strand; PAM type: YTN; PAM sequence: TTG
gtttattgcacaaatctcta

SEQ ID NO: 59382 - DNA, 20 bp, Artificial Sequence
  Description of Artificial Sequence: Synthetic oligonucleotide
  Target: SCN10A; (+) strand; PAM type: YTN; PAM sequence: TTT
attgcacaaatctctaatga

SEQ ID NO: 59383 - DNA, 20 bp, Artificial Sequence
  Description of Artificial Sequence: Synthetic oligonucleotide
  Target: SCN10A; (+) strand; PAM type: YTN; PAM sequence: TTA
ttgcacaaatctctaatgac

SEQ ID NO: 59384 - DNA, 20 bp, Artificial Sequence
  Description of Artificial Sequence: Synthetic oligonucleotide
  Target: SCN10A; (+) strand; PAM type: YTN; PAM sequence: TTG
cacaaatctctaatgaccta

SEQ ID NO: 59385 - DNA, 20 bp, Artificial Sequence
  Description of Artificial Sequence: Synthetic oligonucleotide
  Target: SCN10A; (+) strand; PAM type: YTN; PAM sequence: CTC
taatgacctagtttctccta

SEQ ID NO: 59386 - DNA, 20 bp, Artificial Sequence
  Description of Artificial Sequence: Synthetic oligonucleotide
  Target: SCN10A; (+) strand; PAM type: YTN; PAM sequence: CTA
atgacctagtttctcctaac

SEQ ID NO: 59387 - DNA, 20 bp, Artificial Sequence
  Description of Artificial Sequence: Synthetic oligonucleotide
  Target: SCN10A; (+) strand; PAM type: YTN; PAM sequence: CTA
gtttctcctaacttaaagca

SEQ ID NO: 59388 - DNA, 20 bp, Artificial Sequence
  Description of Artificial Sequence: Synthetic oligonucleotide
  Target: SCN10A; (+) strand; PAM type: YTN; PAM sequence: TTT
ctcctaacttaaagcagaat

SEQ ID NO: 59389 - DNA, 20 bp, Artificial Sequence
  Description of Artificial Sequence: Synthetic oligonucleotide
  Target: SCN10A; (+) strand; PAM type: YTN; PAM sequence: TTC
tcctaacttaaagcagaata

SEQ ID NO: 59390 - DNA, 20 bp, Artificial Sequence
  Description of Artificial Sequence: Synthetic oligonucleotide
  Target: SCN10A; (+) strand; PAM type: YTN; PAM sequence: CTC
ctaacttaaagcagaatatt

SEQ ID NO: 59391 - DNA, 20 bp, Artificial Sequence
  Description of Artificial Sequence: Synthetic oligonucleotide
  Target: SCN10A; (+) strand; PAM type: YTN; PAM sequence: CTA
acttaaagcagaatatttca

SEQ ID NO: 59392 - DNA, 20 bp, Artificial Sequence
  Description of Artificial Sequence: Synthetic oligonucleotide
  Target: SCN10A; (+) strand; PAM type: YTN; PAM sequence: CTT
aaagcagaatatttcagaaa

SEQ ID NO: 59393 - DNA, 20 bp, Artificial Sequence
  Description of Artificial Sequence: Synthetic oligonucleotide
  Target: SCN10A; (+) strand; PAM type: YTN; PAM sequence: TTA
aagcagaatatttcagaaac

SEQ ID NO: 59394 - DNA, 20 bp, Artificial Sequence
  Description of Artificial Sequence: Synthetic oligonucleotide
  Target: SCN10A; (+) strand; PAM type: YTN; PAM sequence: TTT
cagaaacttacatctccctc

SEQ ID NO: 59395 - DNA, 20 bp, Artificial Sequence
  Description of Artificial Sequence: Synthetic oligonucleotide
  Target: SCN10A; (+) strand; PAM type: YTN; PAM sequence: TTC
agaaacttacatctccctcc

SEQ ID NO: 59396 - DNA, 20 bp, Artificial Sequence
  Description of Artificial Sequence: Synthetic oligonucleotide
  Target: SCN10A; (+) strand; PAM type: YTN; PAM sequence: CTT
acatctccctccagctacca

SEQ ID NO: 59397 - DNA, 20 bp, Artificial Sequence
  Description of Artificial Sequence: Synthetic oligonucleotide
  Target: SCN10A; (+) strand; PAM type: YTN; PAM sequence: TTA
catctccctccagctaccat

SEQ ID NO: 59398 - DNA, 20 bp, Artificial Sequence
  Description of Artificial Sequence: Synthetic oligonucleotide
  Target: SCN10A; (+) strand; PAM type: YTN; PAM sequence: CTC
cctccagctaccatcttaga

SEQ ID NO: 59399 - DNA, 20 bp, Artificial Sequence
  Description of Artificial Sequence: Synthetic oligonucleotide
  Target: SCN10A; (+) strand; PAM type: YTN; PAM sequence: CTC
cagctaccatcttagatctc

SEQ ID NO: 59400 - DNA, 20 bp, Artificial Sequence
  Description of Artificial Sequence: Synthetic oligonucleotide
  Target: SCN10A; (+) strand; PAM type: YTN; PAM sequence: CTA
ccatcttagatctcttccca

SEQ ID NO: 59401 - DNA, 20 bp, Artificial Sequence
  Description of Artificial Sequence: Synthetic oligonucleotide
  Target: SCN10A; (+) strand; PAM type: YTN; PAM sequence: CTT
agatctcttcccaccttcaa

SEQ ID NO: 59402 - DNA, 20 bp, Artificial Sequence
  Description of Artificial Sequence: Synthetic oligonucleotide
  Target: SCN10A; (+) strand; PAM type: YTN; PAM sequence: TTA
gatctcttcccaccttcaaa

SEQ ID NO: 59403 - DNA, 20 bp, Artificial Sequence
  Description of Artificial Sequence: Synthetic oligonucleotide
  Target: SCN10A; (+) strand; PAM type: YTN; PAM sequence: CTC
ttcccaccttcaaagcaaaa

SEQ ID NO: 59404 - DNA, 20 bp, Artificial Sequence
  Description of Artificial Sequence: Synthetic oligonucleotide
  Target: SCN10A; (+) strand; PAM type: YTN; PAM sequence: CTT
cccaccttcaaagcaaaatt

SEQ ID NO: 59405 - DNA, 20 bp, Artificial Sequence
  Description of Artificial Sequence: Synthetic oligonucleotide
  Target: SCN10A; (+) strand; PAM type: YTN; PAM sequence: TTC
ccaccttcaaagcaaaattt

SEQ ID NO: 59406 - DNA, 20 bp, Artificial Sequence
  Description of Artificial Sequence: Synthetic oligonucleotide
  Target: SCN10A; (+) strand; PAM type: YTN; PAM sequence: CTT
caaagcaaaatttcttgaaa

SEQ ID NO: 59407 - DNA, 20 bp, Artificial Sequence
  Description of Artificial Sequence: Synthetic oligonucleotide
  Target: SCN10A; (+) strand; PAM type: YTN; PAM sequence: TTC
aaagcaaaatttcttgaaag

SEQ ID NO: 59408 - DNA, 20 bp, Artificial Sequence
  Description of Artificial Sequence: Synthetic oligonucleotide
  Target: SCN10A; (+) strand; PAM type: YTN; PAM sequence: TTT
cttgaaagagttgtgtacaa

SEQ ID NO: 59409 - DNA, 20 bp, Artificial Sequence
  Description of Artificial Sequence: Synthetic oligonucleotide
  Target: SCN10A; (+) strand; PAM type: YTN; PAM sequence: TTC
ttgaaagagttgtgtacaat

SEQ ID NO: 59410 - DNA, 20 bp, Artificial Sequence
  Description of Artificial Sequence: Synthetic oligonucleotide
  Target: SCN10A; (+) strand; PAM type: YTN; PAM sequence: CTT
gaaagagttgtgtacaatca

SEQ ID NO: 59411 - DNA, 20 bp, Artificial Sequence
  Description of Artificial Sequence: Synthetic oligonucleotide
  Target: SCN10A; (+) strand; PAM type: YTN; PAM sequence: TTG
aaagagttgtgtacaatcag

SEQ ID NO: 59412 - DNA, 20 bp, Artificial Sequence
  Description of Artificial Sequence: Synthetic oligonucleotide
  Target: SCN10A; (+) strand; PAM type: YTN; PAM sequence: TTG
tgtacaatcagtgtccctca

SEQ ID NO: 59413 - DNA, 20 bp, Artificial Sequence
  Description of Artificial Sequence: Synthetic oligonucleotide
  Target: SCN10A; (+) strand; PAM type: YTN; PAM sequence: CTC
attcactcctcagcccacat

SEQ ID NO: 59414 - DNA, 20 bp, Artificial Sequence
  Description of Artificial Sequence: Synthetic oligonucleotide
  Target: SCN10A; (+) strand; PAM type: YTN; PAM sequence: TTC
actcctcagcccacatcaac

SEQ ID NO: 59415 - DNA, 20 bp, Artificial Sequence
  Description of Artificial Sequence: Synthetic oligonucleotide
  Target: SCN10A; (+) strand; PAM type: YTN; PAM sequence: CTC
ctcagcccacatcaacagag

SEQ ID NO: 59416 - DNA, 20 bp, Artificial Sequence
  Description of Artificial Sequence: Synthetic oligonucleotide
  Target: SCN10A; (+) strand; PAM type: YTN; PAM sequence: CTC
agcccacatcaacagagctt

SEQ ID NO: 59417 - DNA, 20 bp, Artificial Sequence
  Description of Artificial Sequence: Synthetic oligonucleotide
  Target: SCN10A; (+) strand; PAM type: YTN; PAM sequence: CTT
ttgcctctatcctgacagag

SEQ ID NO: 59418 - DNA, 20 bp, Artificial Sequence
  Description of Artificial Sequence: Synthetic oligonucleotide
  Target: SCN10A; (+) strand; PAM type: YTN; PAM sequence: TTT
tgcctctatcctgacagaga

SEQ ID NO: 59419 - DNA, 20 bp, Artificial Sequence
  Description of Artificial Sequence: Synthetic oligonucleotide
  Target: SCN10A; (+) strand; PAM type: YTN; PAM sequence: TTT
gcctctatcctgacagagat

SEQ ID NO: 59420 - DNA, 20 bp, Artificial Sequence
  Description of Artificial Sequence: Synthetic oligonucleotide
  Target: SCN10A; (+) strand; PAM type: YTN; PAM sequence: TTG
cctctatcctgacagagatt

SEQ ID NO: 59421 - DNA, 20 bp, Artificial Sequence
  Description of Artificial Sequence: Synthetic oligonucleotide
  Target: SCN10A; (+) strand; PAM type: YTN; PAM sequence: CTC
tatcctgacagagattgttc

SEQ ID NO: 59422 - DNA, 20 bp, Artificial Sequence
  Description of Artificial Sequence: Synthetic oligonucleotide
  Target: SCN10A; (+) strand; PAM type: YTN; PAM sequence: CTA
tcctgacagagattgttctc

SEQ ID NO: 59423 - DNA, 20 bp, Artificial Sequence
  Description of Artificial Sequence: Synthetic oligonucleotide
  Target: SCN10A; (+) strand; PAM type: YTN; PAM sequence: CTG
acagagattgttctcactaa

SEQ ID NO: 59424 - DNA, 20 bp, Artificial Sequence
  Description of Artificial Sequence: Synthetic oligonucleotide
  Target: SCN10A; (+) strand; PAM type: YTN; PAM sequence: TTG
ttctcactaagatcatgaat

SEQ ID NO: 59425 - DNA, 20 bp, Artificial Sequence
  Description of Artificial Sequence: Synthetic oligonucleotide
  Target: SCN10A; (+) strand; PAM type: YTN; PAM sequence: TTC
tcactaagatcatgaatgac

SEQ ID NO: 59426 - DNA, 20 bp, Artificial Sequence
  Description of Artificial Sequence: Synthetic oligonucleotide
  Target: SCN10A; (+) strand; PAM type: YTN; PAM sequence: CTC
actaagatcatgaatgactt

SEQ ID NO: 59427 - DNA, 20 bp, Artificial Sequence
  Description of Artificial Sequence: Synthetic oligonucleotide
  Target: SCN10A; (+) strand; PAM type: YTN; PAM sequence: CTA
agatcatgaatgacttccca

SEQ ID NO: 59428 - DNA, 20 bp, Artificial Sequence
  Description of Artificial Sequence: Synthetic oligonucleotide
  Target: SCN10A; (+) strand; PAM type: YTN; PAM sequence: CTT
cccataatattagatccaag

SEQ ID NO: 59429 - DNA, 20 bp, Artificial Sequence
  Description of Artificial Sequence: Synthetic oligonucleotide
  Target: SCN10A; (+) strand; PAM type: YTN; PAM sequence: TTC
ccataatattagatccaagg

SEQ ID NO: 59430 - DNA, 20 bp, Artificial Sequence
  Description of Artificial Sequence: Synthetic oligonucleotide
  Target: SCN10A; (+) strand; PAM type: YTN; PAM sequence: TTA
gatccaaggacgcttgtctg

SEQ ID NO: 59431 - DNA, 20 bp, Artificial Sequence
  Description of Artificial Sequence: Synthetic oligonucleotide
  Target: SCN10A; (+) strand; PAM type: YTN; PAM sequence: CTT
gtctgatattgcctagtacc

SEQ ID NO: 59432 - DNA, 20 bp, Artificial Sequence
  Description of Artificial Sequence: Synthetic oligonucleotide
  Target: SCN10A; (+) strand; PAM type: YTN; PAM sequence: TTG
tctgatattgcctagtaccc

SEQ ID NO: 59433 - DNA, 20 bp, Artificial Sequence
  Description of Artificial Sequence: Synthetic oligonucleotide
  Target: SCN10A; (+) strand; PAM type: YTN; PAM sequence: CTG
atattgcctagtacccttct

SEQ ID NO: 59434 - DNA, 20 bp, Artificial Sequence
  Description of Artificial Sequence: Synthetic oligonucleotide
  Target: SCN10A; (+) strand; PAM type: YTN; PAM sequence: TTG
cctagtacccttctaccttg

SEQ ID NO: 59435 - DNA, 20 bp, Artificial Sequence
  Description of Artificial Sequence: Synthetic oligonucleotide
  Target: SCN10A; (+) strand; PAM type: YTN; PAM sequence: CTA
gtacccttctaccttgaaat

SEQ ID NO: 59436 - DNA, 20 bp, Artificial Sequence
  Description of Artificial Sequence: Synthetic oligonucleotide
  Target: SCN10A; (+) strand; PAM type: YTN; PAM sequence: CTT
ctaccttgaaatgttgcttt

SEQ ID NO: 59437 - DNA, 20 bp, Artificial Sequence
  Description of Artificial Sequence: Synthetic oligonucleotide
  Target: SCN10A; (+) strand; PAM type: YTN; PAM sequence: TTC
taccttgaaatgttgctttc

SEQ ID NO: 59438 - DNA, 20 bp, Artificial Sequence
  Description of Artificial Sequence: Synthetic oligonucleotide
  Target: SCN10A; (+) strand; PAM type: YTN; PAM sequence: CTA
ccttgaaatgttgctttctt

SEQ ID NO: 59439 - DNA, 20 bp, Artificial Sequence
  Description of Artificial Sequence: Synthetic oligonucleotide
  Target: SCN10A; (+) strand; PAM type: YTN; PAM sequence: CTT
gaaatgttgctttcttggtc

SEQ ID NO: 59440 - DNA, 20 bp, Artificial Sequence
  Description of Artificial Sequence: Synthetic oligonucleotide
  Target: SCN10A; (+) strand; PAM type: YTN; PAM sequence: TTG
aaatgttgctttcttggtct

SEQ ID NO: 59441 - DNA, 20 bp, Artificial Sequence
  Description of Artificial Sequence: Synthetic oligonucleotide
  Target: SCN10A; (+) strand; PAM type: YTN; PAM sequence: TTG
ctttcttggtctccaccatg

SEQ ID NO: 59442 - DNA, 20 bp, Artificial Sequence
  Description of Artificial Sequence: Synthetic oligonucleotide
  Target: SCN10A; (+) strand; PAM type: YTN; PAM sequence: CTT
tcttggtctccaccatgcct

SEQ ID NO: 59443 - DNA, 20 bp, Artificial Sequence
  Description of Artificial Sequence: Synthetic oligonucleotide
  Target: SCN10A; (+) strand; PAM type: YTN; PAM sequence: TTT
cttggtctccaccatgcctt

SEQ ID NO: 59444 - DNA, 20 bp, Artificial Sequence
  Description of Artificial Sequence: Synthetic oligonucleotide
  Target: SCN10A; (+) strand; PAM type: YTN; PAM sequence: TTC
ttggtctccaccatgcctta

SEQ ID NO: 59445 - DNA, 20 bp, Artificial Sequence
  Description of Artificial Sequence: Synthetic oligonucleotide
  Target: SCN10A; (+) strand; PAM type: YTN; PAM sequence: CTT
ggtctccaccatgccttaca

SEQ ID NO: 59446 - DNA, 20 bp, Artificial Sequence
  Description of Artificial Sequence: Synthetic oligonucleotide
  Target: SCN10A; (+) strand; PAM type: YTN; PAM sequence: TTG
gtctccaccatgccttacat

SEQ ID NO: 59447 - DNA, 20 bp, Artificial Sequence
  Description of Artificial Sequence: Synthetic oligonucleotide
  Target: SCN10A; (+) strand; PAM type: YTN; PAM sequence: CTC
caccatgccttacatttctg

SEQ ID NO: 59448 - DNA, 20 bp, Artificial Sequence
  Description of Artificial Sequence: Synthetic oligonucleotide
  Target: SCN10A; (+) strand; PAM type: YTN; PAM sequence: CTT
acatttctgcttcttttctt

SEQ ID NO: 59449 - DNA, 20 bp, Artificial Sequence
  Description of Artificial Sequence: Synthetic oligonucleotide
  Target: SCN10A; (+) strand; PAM type: YTN; PAM sequence: TTA
catttctgcttcttttcttg

SEQ ID NO: 59450 - DNA, 20 bp, Artificial Sequence
  Description of Artificial Sequence: Synthetic oligonucleotide
  Target: SCN10A; (+) strand; PAM type: YTN; PAM sequence: TTT
ctgcttcttttcttgccatt

SEQ ID NO: 59451 - DNA, 20 bp, Artificial Sequence
  Description of Artificial Sequence: Synthetic oligonucleotide
  Target: SCN10A; (+) strand; PAM type: YTN; PAM sequence: TTC
tgcttcttttcttgccattt

SEQ ID NO: 59452 - DNA, 20 bp, Artificial Sequence
  Description of Artificial Sequence: Synthetic oligonucleotide
  Target: SCN10A; (+) strand; PAM type: YTN; PAM sequence: CTG
cttcttttcttgccatttgt

SEQ ID NO: 59453 - DNA, 20 bp, Artificial Sequence
  Description of Artificial Sequence: Synthetic oligonucleotide
  Target: SCN10A; (+) strand; PAM type: YTN; PAM sequence: CTT
cttttcttgccatttgtgat

SEQ ID NO: 59454 - DNA, 20 bp, Artificial Sequence
  Description of Artificial Sequence: Synthetic oligonucleotide
  Target: SCN10A; (+) strand; PAM type: YTN; PAM sequence: TTC
ttttcttgccatttgtgatg

SEQ ID NO: 59455 - DNA, 20 bp, Artificial Sequence
  Description of Artificial Sequence: Synthetic oligonucleotide
  Target: SCN10A; (+) strand; PAM type: YTN; PAM sequence: CTT
ttcttgccatttgtgatgct

SEQ ID NO: 59456 - DNA, 20 bp, Artificial Sequence
  Description of Artificial Sequence: Synthetic oligonucleotide
  Target: SCN10A; (+) strand; PAM type: YTN; PAM sequence: TTT
tcttgccatttgtgatgctc

SEQ ID NO: 59457 - DNA, 20 bp, Artificial Sequence
  Description of Artificial Sequence: Synthetic oligonucleotide
  Target: SCN10A; (+) strand; PAM type: YTN; PAM sequence: TTT
cttgccatttgtgatgctct

SEQ ID NO: 59458 - DNA, 20 bp, Artificial Sequence
  Description of Artificial Sequence: Synthetic oligonucleotide
  Target: SCN10A; (+) strand; PAM type: YTN; PAM sequence: TTC
ttgccatttgtgatgctctt

SEQ ID NO: 59459 - DNA, 20 bp, Artificial Sequence
  Description of Artificial Sequence: Synthetic oligonucleotide
  Target: SCN10A; (+) strand; PAM type: YTN; PAM sequence: CTT
gccatttgtgatgctctttt

SEQ ID NO: 59460 - DNA, 20 bp, Artificial Sequence
  Description of Artificial Sequence: Synthetic oligonucleotide
  Target: SCN10A; (+) strand; PAM type: YTN; PAM sequence: TTG
ccatttgtgatgctctttta

SEQ ID NO: 59461 - DNA, 20 bp, Artificial Sequence
  Description of Artificial Sequence: Synthetic oligonucleotide
  Target: SCN10A; (+) strand; PAM type: YTN; PAM sequence: TTT
gtgatgctcttttatagtct

SEQ ID NO: 59462 - DNA, 20 bp, Artificial Sequence
  Description of Artificial Sequence: Synthetic oligonucleotide
  Target: SCN10A; (+) strand; PAM type: YTN; PAM sequence: TTG
tgatgctcttttatagtctc

SEQ ID NO: 59463 - DNA, 20 bp, Artificial Sequence
  Description of Artificial Sequence: Synthetic oligonucleotide
  Target: SCN10A; (+) strand; PAM type: YTN; PAM sequence: CTC
ttttatagtctcctttaccc

SEQ ID NO: 59464 - DNA, 20 bp, Artificial Sequence
  Description of Artificial Sequence: Synthetic oligonucleotide
  Target: SCN10A; (+) strand; PAM type: YTN; PAM sequence: CTT
ttatagtctcctttacccaa

SEQ ID NO: 59465 - DNA, 20 bp, Artificial Sequence
  Description of Artificial Sequence: Synthetic oligonucleotide
  Target: SCN10A; (+) strand; PAM type: YTN; PAM sequence: TTT
tatagtctcctttacccaac

SEQ ID NO: 59466 - DNA, 20 bp, Artificial Sequence
  Description of Artificial Sequence: Synthetic oligonucleotide
  Target: SCN10A; (+) strand; PAM type: YTN; PAM sequence: TTT
atagtctcctttacccaact

SEQ ID NO: 59467 - DNA, 20 bp, Artificial Sequence
  Description of Artificial Sequence: Synthetic oligonucleotide
  Target: SCN10A; (+) strand; PAM type: YTN; PAM sequence: TTA
tagtctcctttacccaactt

SEQ ID NO: 59468 - DNA, 20 bp, Artificial Sequence
  Description of Artificial Sequence: Synthetic oligonucleotide
  Target: SCN10A; (+) strand; PAM type: YTN; PAM sequence: CTC
ctttacccaacttttagaca

SEQ ID NO: 59469 - DNA, 20 bp, Artificial Sequence
  Description of Artificial Sequence: Synthetic oligonucleotide
  Target: SCN10A; (+) strand; PAM type: YTN; PAM sequence: CTT
tacccaacttttagacatca

SEQ ID NO: 59470 - DNA, 20 bp, Artificial Sequence
  Description of Artificial Sequence: Synthetic oligonucleotide
  Target: SCN10A; (+) strand; PAM type: YTN; PAM sequence: TTT
acccaacttttagacatcag

SEQ ID NO: 59471 - DNA, 20 bp, Artificial Sequence
  Description of Artificial Sequence: Synthetic oligonucleotide
  Target: SCN10A; (+) strand; PAM type: YTN; PAM sequence: TTA
cccaacttttagacatcaga

SEQ ID NO: 59472 - DNA, 20 bp, Artificial Sequence
  Description of Artificial Sequence: Synthetic oligonucleotide
  Target: SCN10A; (+) strand; PAM type: YTN; PAM sequence: CTT
ttagacatcagagttcttcg

SEQ ID NO: 59473 - DNA, 20 bp, Artificial Sequence
  Description of Artificial Sequence: Synthetic oligonucleotide
  Target: SCN10A; (+) strand; PAM type: YTN; PAM sequence: TTT
tagacatcagagttcttcga

SEQ ID NO: 59474 - DNA, 20 bp, Artificial Sequence
  Description of Artificial Sequence: Synthetic oligonucleotide
  Target: SCN10A; (+) strand; PAM type: YTN; PAM sequence: TTT
agacatcagagttcttcgag

SEQ ID NO: 59475 - DNA, 20 bp, Artificial Sequence
  Description of Artificial Sequence: Synthetic oligonucleotide
  Target: SCN10A; (+) strand; PAM type: YTN; PAM sequence: TTA
gacatcagagttcttcgagg

SEQ ID NO: 59476 - DNA, 20 bp, Artificial Sequence
  Description of Artificial Sequence: Synthetic oligonucleotide
  Target: SCN10A; (+) strand; PAM type: YTN; PAM sequence: TTC
ttcgaggctcagtcttgagc

SEQ ID NO: 59477 - DNA, 20 bp, Artificial Sequence
  Description of Artificial Sequence: Synthetic oligonucleotide
  Target: SCN10A; (+) strand; PAM type: YTN; PAM sequence: CTT
cgaggctcagtcttgagcat

SEQ ID NO: 59478 - DNA, 20 bp, Artificial Sequence
  Description of Artificial Sequence: Synthetic oligonucleotide
  Target: SCN10A; (+) strand; PAM type: YTN; PAM sequence: TTC
gaggctcagtcttgagcatc

SEQ ID NO: 59479 - DNA, 20 bp, Artificial Sequence
  Description of Artificial Sequence: Synthetic oligonucleotide
  Target: SCN10A; (+) strand; PAM type: YTN; PAM sequence: CTC
agtcttgagcatcctttgct

SEQ ID NO: 59480 - DNA, 20 bp, Artificial Sequence
  Description of Artificial Sequence: Synthetic oligonucleotide
  Target: SCN10A; (+) strand; PAM type: YTN; PAM sequence: CTT
gagcatcctttgctcttcac

SEQ ID NO: 59481 - DNA, 20 bp, Artificial Sequence
  Description of Artificial Sequence: Synthetic oligonucleotide
  Target: SCN10A; (+) strand; PAM type: YTN; PAM sequence: TTG
agcatcctttgctcttcacc

SEQ ID NO: 59482 - DNA, 20 bp, Artificial Sequence
  Description of Artificial Sequence: Synthetic oligonucleotide
  Target: SCN10A; (+) strand; PAM type: YTN; PAM sequence: CTT
tgctcttcaccccatttttt

SEQ ID NO: 59483 - DNA, 20 bp, Artificial Sequence
  Description of Artificial Sequence: Synthetic oligonucleotide
  Target: SCN10A; (+) strand; PAM type: YTN; PAM sequence: TTT
gctcttcaccccattttttc

SEQ ID NO: 59484 - DNA, 20 bp, Artificial Sequence
  Description of Artificial Sequence: Synthetic oligonucleotide
  Target: SCN10A; (+) strand; PAM type: YTN; PAM sequence: TTG
ctcttcaccccattttttct

SEQ ID NO: 59485 - DNA, 20 bp, Artificial Sequence
  Description of Artificial Sequence: Synthetic oligonucleotide
  Target: SCN10A; (+) strand; PAM type: YTN; PAM sequence: CTC
ttcaccccattttttctccc

SEQ ID NO: 59486 - DNA, 20 bp, Artificial Sequence
  Description of Artificial Sequence: Synthetic oligonucleotide
  Target: SCN10A; (+) strand; PAM type: YTN; PAM sequence: CTT
caccccattttttctccctt

SEQ ID NO: 59487 - DNA, 20 bp, Artificial Sequence
  Description of Artificial Sequence: Synthetic oligonucleotide
  Target: SCN10A; (+) strand; PAM type: YTN; PAM sequence: TTC
accccattttttctcccttg

SEQ ID NO: 59488 - DNA, 20 bp, Artificial Sequence
  Description of Artificial Sequence: Synthetic oligonucleotide
  Target: SCN10A; (+) strand; PAM type: YTN; PAM sequence: TTT
tttctcccttgacaatttat

SEQ ID NO: 59489 - DNA, 20 bp, Artificial Sequence
  Description of Artificial Sequence: Synthetic oligonucleotide
  Target: SCN10A; (+) strand; PAM type: YTN; PAM sequence: TTT
ttctcccttgacaatttatc

SEQ ID NO: 59490 - DNA, 20 bp, Artificial Sequence
  Description of Artificial Sequence: Synthetic oligonucleotide
  Target: SCN10A; (+) strand; PAM type: YTN; PAM sequence: TTT
tctcccttgacaatttatcc

SEQ ID NO: 59491 - DNA, 20 bp, Artificial Sequence
  Description of Artificial Sequence: Synthetic oligonucleotide
  Target: SCN10A; (+) strand; PAM type: YTN; PAM sequence: TTT
ctcccttgacaatttatcca

SEQ ID NO: 59492 - DNA, 20 bp, Artificial Sequence
  Description of Artificial Sequence: Synthetic oligonucleotide
  Target: SCN10A; (+) strand; PAM type: YTN; PAM sequence: TTC
tcccttgacaatttatccag

SEQ ID NO: 59493 - DNA, 20 bp, Artificial Sequence
  Description of Artificial Sequence: Synthetic oligonucleotide
  Target: SCN10A; (+) strand; PAM type: YTN; PAM sequence: CTC
ccttgacaatttatccagcc

SEQ ID NO: 59494 - DNA, 20 bp, Artificial Sequence
  Description of Artificial Sequence: Synthetic oligonucleotide
  Target: SCN10A; (+) strand; PAM type: YTN; PAM sequence: CTT
gacaatttatccagccagga

SEQ ID NO: 59495 - DNA, 20 bp, Artificial Sequence
  Description of Artificial Sequence: Synthetic oligonucleotide
  Target: SCN10A; (+) strand; PAM type: YTN; PAM sequence: TTG
acaatttatccagccaggaa

SEQ ID NO: 59496 - DNA, 20 bp, Artificial Sequence
  Description of Artificial Sequence: Synthetic oligonucleotide
  Target: SCN10A; (+) strand; PAM type: YTN; PAM sequence: TTT
atccagccaggaattaacat

SEQ ID NO: 59497 - DNA, 20 bp, Artificial Sequence
  Description of Artificial Sequence: Synthetic oligonucleotide
  Target: SCN10A; (+) strand; PAM type: YTN; PAM sequence: TTA
tccagccaggaattaacata

SEQ ID NO: 59498 - DNA, 20 bp, Artificial Sequence
  Description of Artificial Sequence: Synthetic oligonucleotide
  Target: SCN10A; (+) strand; PAM type: YTN; PAM sequence: TTA
acatatatgtgcaacttttg

SEQ ID NO: 59499 - DNA, 20 bp, Artificial Sequence
  Description of Artificial Sequence: Synthetic oligonucleotide
  Target: SCN10A; (+) strand; PAM type: YTN; PAM sequence: CTT
ttggccaactgtttgcctct

SEQ ID NO: 59500 - DNA, 20 bp, Artificial Sequence
  Description of Artificial Sequence: Synthetic oligonucleotide
  Target: SCN10A; (+) strand; PAM type: YTN; PAM sequence: TTT
tggccaactgtttgcctctg

SEQ ID NO: 59501 - DNA, 20 bp, Artificial Sequence
  Description of Artificial Sequence: Synthetic oligonucleotide
  Target: SCN10A; (+) strand; PAM type: YTN; PAM sequence: TTT
ggccaactgtttgcctctgt

SEQ ID NO: 59502 - DNA, 20 bp, Artificial Sequence
  Description of Artificial Sequence: Synthetic oligonucleotide
  Target: SCN10A; (+) strand; PAM type: YTN; PAM sequence: TTG
gccaactgtttgcctctgtc

SEQ ID NO: 59503 - DNA, 20 bp, Artificial Sequence
  Description of Artificial Sequence: Synthetic oligonucleotide
  Target: SCN10A; (+) strand; PAM type: YTN; PAM sequence: CTG
tttgcctctgtcactggact

SEQ ID NO: 59504 - DNA, 20 bp, Artificial Sequence
  Description of Artificial Sequence: Synthetic oligonucleotide
  Target: SCN10A; (+) strand; PAM type: YTN; PAM sequence: TTT
gcctctgtcactggactgta

SEQ ID NO: 59505 - DNA, 20 bp, Artificial Sequence
  Description of Artificial Sequence: Synthetic oligonucleotide
  Target: SCN10A; (+) strand; PAM type: YTN; PAM sequence: TTG
cctctgtcactggactgtaa

SEQ ID NO: 59506 - DNA, 20 bp, Artificial Sequence
  Description of Artificial Sequence: Synthetic oligonucleotide
  Target: SCN10A; (+) strand; PAM type: YTN; PAM sequence: CTC
tgtcactggactgtaaactg

SEQ ID NO: 59507 - DNA, 20 bp, Artificial Sequence
  Description of Artificial Sequence: Synthetic oligonucleotide
  Target: SCN10A; (+) strand; PAM type: YTN; PAM sequence: CTG
tcactggactgtaaactgta

SEQ ID NO: 59508 - DNA, 20 bp, Artificial Sequence
  Description of Artificial Sequence: Synthetic oligonucleotide
  Target: SCN10A; (+) strand; PAM type: YTN; PAM sequence: CTG
gactgtaaactgtaagagta

SEQ ID NO: 59509 - DNA, 20 bp, Artificial Sequence
  Description of Artificial Sequence: Synthetic oligonucleotide
  Target: SCN10A; (+) strand; PAM type: YTN; PAM sequence: CTG
taaactgtaagagtaggaac

SEQ ID NO: 59510 - DNA, 20 bp, Artificial Sequence
  Description of Artificial Sequence: Synthetic oligonucleotide
  Target: SCN10A; (+) strand; PAM type: YTN; PAM sequence: CTG
taagagtaggaactttgtct

SEQ ID NO: 59511 - DNA, 20 bp, Artificial Sequence
  Description of Artificial Sequence: Synthetic oligonucleotide
  Target: SCN10A; (+) strand; PAM type: YTN; PAM sequence: CTT
tgtctgtcttgctcactgct

SEQ ID NO: 59512 - DNA, 20 bp, Artificial Sequence
  Description of Artificial Sequence: Synthetic oligonucleotide
  Target: SCN10A; (+) strand; PAM type: YTN; PAM sequence: TTT
gtctgtcttgctcactgctc

SEQ ID NO: 59513 - DNA, 20 bp, Artificial Sequence
  Description of Artificial Sequence: Synthetic oligonucleotide
  Target: SCN10A; (+) strand; PAM type: YTN; PAM sequence: TTG
tctgtcttgctcactgctct

SEQ ID NO: 59514 - DNA, 20 bp, Artificial Sequence
  Description of Artificial Sequence: Synthetic oligonucleotide
  Target: SCN10A; (+) strand; PAM type: YTN; PAM sequence: CTG
tcttgctcactgctctaacc

SEQ ID NO: 59515 - DNA, 20 bp, Artificial Sequence
  Description of Artificial Sequence: Synthetic oligonucleotide
  Target: SCN10A; (+) strand; PAM type: YTN; PAM sequence: CTT
gctcactgctctaaccctgg

SEQ ID NO: 59516 - DNA, 20 bp, Artificial Sequence
  Description of Artificial Sequence: Synthetic oligonucleotide
  Target: SCN10A; (+) strand; PAM type: YTN; PAM sequence: TTG
ctcactgctctaaccctggt

SEQ ID NO: 59517 - DNA, 20 bp, Artificial Sequence
  Description of Artificial Sequence: Synthetic oligonucleotide
  Target: SCN10A; (+) strand; PAM type: YTN; PAM sequence: CTC
actgctctaaccctggtgtc

SEQ ID NO: 59518 - DNA, 20 bp, Artificial Sequence
  Description of Artificial Sequence: Synthetic oligonucleotide
  Target: SCN10A; (+) strand; PAM type: YTN; PAM sequence: CTG
ctctaaccctggtgtctgca

SEQ ID NO: 59519 - DNA, 20 bp, Artificial Sequence
  Description of Artificial Sequence: Synthetic oligonucleotide
  Target: SCN10A; (+) strand; PAM type: YTN; PAM sequence: CTC
taaccctggtgtctgcatag

SEQ ID NO: 59520 - DNA, 20 bp, Artificial Sequence
  Description of Artificial Sequence: Synthetic oligonucleotide
  Target: SCN10A; (+) strand; PAM type: YTN; PAM sequence: CTA
accctggtgtctgcatagtg

SEQ ID NO: 59521 - DNA, 20 bp, Artificial Sequence
  Description of Artificial Sequence: Synthetic oligonucleotide
  Target: SCN10A; (+) strand; PAM type: YTN; PAM sequence: CTG
gtgtctgcatagtgcctggc

SEQ ID NO: 59522 - DNA, 20 bp, Artificial Sequence
  Description of Artificial Sequence: Synthetic oligonucleotide
  Target: SCN10A; (+) strand; PAM type: YTN; PAM sequence: CTG
catagtgcctggctgcaaca

SEQ ID NO: 59523 - DNA, 20 bp, Artificial Sequence
  Description of Artificial Sequence: Synthetic oligonucleotide
  Target: SCN10A; (+) strand; PAM type: YTN; PAM sequence: CTG
gctgcaacagatgctctgca

SEQ ID NO: 59524 - DNA, 20 bp, Artificial Sequence
  Description of Artificial Sequence: Synthetic oligonucleotide
  Target: SCN10A; (+) strand; PAM type: YTN; PAM sequence: CTG
caacagatgctctgcaaatt

SEQ ID NO: 59525 - DNA, 20 bp, Artificial Sequence
  Description of Artificial Sequence: Synthetic oligonucleotide
  Target: SCN10A; (+) strand; PAM type: YTN; PAM sequence: CTC
tgcaaatttgtaaatgaatg

SEQ ID NO: 59526 - DNA, 20 bp, Artificial Sequence
  Description of Artificial Sequence: Synthetic oligonucleotide
  Target: SCN10A; (+) strand; PAM type: YTN; PAM sequence: CTG
caaatttgtaaatgaatgga

SEQ ID NO: 59527 - DNA, 20 bp, Artificial Sequence
  Description of Artificial Sequence: Synthetic oligonucleotide
  Target: SCN10A; (+) strand; PAM type: YTN; PAM sequence: TTT
gtaaatgaatggaagacaga

SEQ ID NO: 59528 - DNA, 20 bp, Artificial Sequence
  Description of Artificial Sequence: Synthetic oligonucleotide
  Target: SCN10A; (+) strand; PAM type: YTN; PAM sequence: TTG
taaatgaatggaagacagaa

SEQ ID NO: 59529 - DNA, 20 bp, Artificial Sequence
  Description of Artificial Sequence: Synthetic oligonucleotide
  Target: SCN10A; (+) strand; PAM type: YTN; PAM sequence: CTC
tgagttaaccatagctcaaa

SEQ ID NO: 59530 - DNA, 20 bp, Artificial Sequence
  Description of Artificial Sequence: Synthetic oligonucleotide
  Target: SCN10A; (+) strand; PAM type: YTN; PAM sequence: CTG
agttaaccatagctcaaatg

SEQ ID NO: 59531 - DNA, 20 bp, Artificial Sequence
  Description of Artificial Sequence: Synthetic oligonucleotide
  Target: SCN10A; (+) strand; PAM type: YTN; PAM sequence: TTA
accatagctcaaatgaaaat

SEQ ID NO: 59532 - DNA, 20 bp, Artificial Sequence
  Description of Artificial Sequence: Synthetic oligonucleotide
  Target: SCN10A; (+) strand; PAM type: YTN; PAM sequence: CTC
aaatgaaaatttaaagtcac

SEQ ID NO: 59533 - DNA, 20 bp, Artificial Sequence
  Description of Artificial Sequence: Synthetic oligonucleotide
  Target: SCN10A; (+) strand; PAM type: YTN; PAM sequence: TTT
aaagtcaccctttatttgac

SEQ ID NO: 59534 - DNA, 20 bp, Artificial Sequence
  Description of Artificial Sequence: Synthetic oligonucleotide
  Target: SCN10A; (+) strand; PAM type: YTN; PAM sequence: TTA
aagtcaccctttatttgact

SEQ ID NO: 59535 - DNA, 20 bp, Artificial Sequence
  Description of Artificial Sequence: Synthetic oligonucleotide
  Target: SCN10A; (+) strand; PAM type: YTN; PAM sequence: CTT
tatttgactaaattcaattc

SEQ ID NO: 59536 - DNA, 20 bp, Artificial Sequence
  Description of Artificial Sequence: Synthetic oligonucleotide
  Target: SCN10A; (+) strand; PAM type: YTN; PAM sequence: TTT
atttgactaaattcaattct

SEQ ID NO: 59537 - DNA, 20 bp, Artificial Sequence
  Description of Artificial Sequence: Synthetic oligonucleotide
  Target: SCN10A; (+) strand; PAM type: YTN; PAM sequence: TTA
tttgactaaattcaattctg

SEQ ID NO: 59538 - DNA, 20 bp, Artificial Sequence
  Description of Artificial Sequence: Synthetic oligonucleotide
  Target: SCN10A; (+) strand; PAM type: YTN; PAM sequence: TTT
gactaaattcaattctgtac

SEQ ID NO: 59539 - DNA, 20 bp, Artificial Sequence
  Description of Artificial Sequence: Synthetic oligonucleotide
  Target: SCN10A; (+) strand; PAM type: YTN; PAM sequence: TTG
actaaattcaattctgtacc

SEQ ID NO: 59540 - DNA, 20 bp, Artificial Sequence
  Description of Artificial Sequence: Synthetic oligonucleotide
  Target: SCN10A; (+) strand; PAM type: YTN; PAM sequence: CTA
aattcaattctgtaccaagg

SEQ ID NO: 59541 - DNA, 20 bp, Artificial Sequence
  Description of Artificial Sequence: Synthetic oligonucleotide
  Target: SCN10A; (+) strand; PAM type: YTN; PAM sequence: TTC
aattctgtaccaagggtaca

SEQ ID NO: 59542 - DNA, 20 bp, Artificial Sequence
  Description of Artificial Sequence: Synthetic oligonucleotide
  Target: SCN10A; (+) strand; PAM type: YTN; PAM sequence: TTC
tgtaccaagggtacatactg

SEQ ID NO: 59543 - DNA, 20 bp, Artificial Sequence
  Description of Artificial Sequence: Synthetic oligonucleotide
  Target: SCN10A; (+) strand; PAM type: YTN; PAM sequence: CTG
taccaagggtacatactgaa

SEQ ID NO: 59544 - DNA, 20 bp, Artificial Sequence
  Description of Artificial Sequence: Synthetic oligonucleotide
  Target: SCN10A; (+) strand; PAM type: YTN; PAM sequence: CTG
aatgtatgggatgtgcaagc

SEQ ID NO: 59545 - DNA, 20 bp, Artificial Sequence
  Description of Artificial Sequence: Synthetic oligonucleotide
  Target: SCN10A; (+) strand; PAM type: YTN; PAM sequence: CTC
tgcatgagtggctatgaggg

SEQ ID NO: 59546 - DNA, 20 bp, Artificial Sequence
  Description of Artificial Sequence: Synthetic oligonucleotide
  Target: SCN10A; (+) strand; PAM type: YTN; PAM sequence: CTG
catgagtggctatgagggag

SEQ ID NO: 59547 - DNA, 20 bp, Artificial Sequence
  Description of Artificial Sequence: Synthetic oligonucleotide
  Target: SCN10A; (+) strand; PAM type: YTN; PAM sequence: CTA
tgagggaggaagagaagaac

SEQ ID NO: 59548 - DNA, 20 bp, Artificial Sequence
  Description of Artificial Sequence: Synthetic oligonucleotide
  Target: SCN10A; (+) strand; PAM type: YTN; PAM sequence: CTG
tctgatcccttccagggagc

SEQ ID NO: 59549 - DNA, 20 bp, Artificial Sequence
  Description of Artificial Sequence: Synthetic oligonucleotide
  Target: SCN10A; (+) strand; PAM type: YTN; PAM sequence: CTG
atcccttccagggagcccac

SEQ ID NO: 59550 - DNA, 20 bp, Artificial Sequence
  Description of Artificial Sequence: Synthetic oligonucleotide
  Target: SCN10A; (+) strand; PAM type: YTN; PAM sequence: CTT
ccagggagcccacgggagct

SEQ ID NO: 59551 - DNA, 20 bp, Artificial Sequence
  Description of Artificial Sequence: Synthetic oligonucleotide
  Target: SCN10A; (+) strand; PAM type: YTN; PAM sequence: TTC
cagggagcccacgggagctg

SEQ ID NO: 59552 - DNA, 20 bp, Artificial Sequence
  Description of Artificial Sequence: Synthetic oligonucleotide
  Target: SCN10A; (+) strand; PAM type: YTN; PAM sequence: CTG
cacagcaagcagagggggaa

SEQ ID NO: 59553 - DNA, 20 bp, Artificial Sequence
  Description of Artificial Sequence: Synthetic oligonucleotide
  Target: SCN10A; (+) strand; PAM type: YTN; PAM sequence: CTG
tgatgaggctgatccttgcc

SEQ ID NO: 59554 - DNA, 20 bp, Artificial Sequence
  Description of Artificial Sequence: Synthetic oligonucleotide
  Target: SCN10A; (+) strand; PAM type: YTN; PAM sequence: CTG
atccttgccttctgcttcat

SEQ ID NO: 59555 - DNA, 20 bp, Artificial Sequence
  Description of Artificial Sequence: Synthetic oligonucleotide
  Target: SCN10A; (+) strand; PAM type: YTN; PAM sequence: CTT
gccttctgcttcatggtggg

SEQ ID NO: 59556 - DNA, 20 bp, Artificial Sequence
  Description of Artificial Sequence: Synthetic oligonucleotide
  Target: SCN10A; (+) strand; PAM type: YTN; PAM sequence: TTG
ccttctgcttcatggtgggg

SEQ ID NO: 59557 - DNA, 20 bp, Artificial Sequence
  Description of Artificial Sequence: Synthetic oligonucleotide
  Target: SCN10A; (+) strand; PAM type: YTN; PAM sequence: CTT
ctgcttcatggtggggatgg

SEQ ID NO: 59558 - DNA, 20 bp, Artificial Sequence
  Description of Artificial Sequence: Synthetic oligonucleotide
  Target: SCN10A; (+) strand; PAM type: YTN; PAM sequence: TTC
tgcttcatggtggggatggg

SEQ ID NO: 59559 - DNA, 20 bp, Artificial Sequence
  Description of Artificial Sequence: Synthetic oligonucleotide
  Target: SCN10A; (+) strand; PAM type: YTN; PAM sequence: CTG
cttcatggtggggatgggtt

SEQ ID NO: 59560 - DNA, 20 bp, Artificial Sequence
  Description of Artificial Sequence: Synthetic oligonucleotide
  Target: SCN10A; (+) strand; PAM type: YTN; PAM sequence: CTT
catggtggggatgggttgct

SEQ ID NO: 59561 - DNA, 20 bp, Artificial Sequence
  Description of Artificial Sequence: Synthetic oligonucleotide
  Target: SCN10A; (+) strand; PAM type: YTN; PAM sequence: TTC
atggtggggatgggttgcta

SEQ ID NO: 59562 - DNA, 20 bp, Artificial Sequence
  Description of Artificial Sequence: Synthetic oligonucleotide
  Target: SCN10A; (+) strand; PAM type: YTN; PAM sequence: TTG
ctatcctgttgggttagagc

SEQ ID NO: 59563 - DNA, 20 bp, Artificial Sequence
  Description of Artificial Sequence: Synthetic oligonucleotide
  Target: SCN10A; (+) strand; PAM type: YTN; PAM sequence: CTA
tcctgttgggttagagcaaa

SEQ ID NO: 59564 - DNA, 20 bp, Artificial Sequence
  Description of Artificial Sequence: Synthetic oligonucleotide
  Target: SCN10A; (+) strand; PAM type: YTN; PAM sequence: CTG
ttgggttagagcaaagaatc

SEQ ID NO: 59565 - DNA, 20 bp, Artificial Sequence
  Description of Artificial Sequence: Synthetic oligonucleotide
  Target: SCN10A; (+) strand; PAM type: YTN; PAM sequence: TTG
ggttagagcaaagaatcaga

SEQ ID NO: 59566 - DNA, 20 bp, Artificial Sequence
  Description of Artificial Sequence: Synthetic oligonucleotide
  Target: SCN10A; (+) strand; PAM type: YTN; PAM sequence: TTA
gagcaaagaatcagaccaaa

SEQ ID NO: 59567 - DNA, 20 bp, Artificial Sequence
  Description of Artificial Sequence: Synthetic oligonucleotide
  Target: SCN10A; (+) strand; PAM type: YTN; PAM sequence: CTT
tgctcatggcagaactgctg

SEQ ID NO: 59568 - DNA, 20 bp, Artificial Sequence
  Description of Artificial Sequence: Synthetic oligonucleotide
  Target: SCN10A; (+) strand; PAM type: YTN; PAM sequence: TTT
gctcatggcagaactgctgg

SEQ ID NO: 59569 - DNA, 20 bp, Artificial Sequence
  Description of Artificial Sequence: Synthetic oligonucleotide
  Target: SCN10A; (+) strand; PAM type: YTN; PAM sequence: TTG
ctcatggcagaactgctggc

SEQ ID NO: 59570 - DNA, 20 bp, Artificial Sequence
  Description of Artificial Sequence: Synthetic oligonucleotide
  Target: SCN10A; (+) strand; PAM type: YTN; PAM sequence: CTC
atggcagaactgctggctca

SEQ ID NO: 59571 - DNA, 20 bp, Artificial Sequence
  Description of Artificial Sequence: Synthetic oligonucleotide
  Target: SCN10A; (+) strand; PAM type: YTN; PAM sequence: CTG
ctggctcacatctttcctgg

SEQ ID NO: 59572 - DNA, 20 bp, Artificial Sequence
  Description of Artificial Sequence: Synthetic oligonucleotide
  Target: SCN10A; (+) strand; PAM type: YTN; PAM sequence: CTG
gctcacatctttcctggggc

SEQ ID NO: 59573 - DNA, 20 bp, Artificial Sequence
  Description of Artificial Sequence: Synthetic oligonucleotide
  Target: SCN10A; (+) strand; PAM type: YTN; PAM sequence: CTC
acatctttcctggggcagga

SEQ ID NO: 59574 - DNA, 20 bp, Artificial Sequence
  Description of Artificial Sequence: Synthetic oligonucleotide
  Target: SCN10A; (+) strand; PAM type: YTN; PAM sequence: CTT
tcctggggcaggagggggat

SEQ ID NO: 59575 - DNA, 20 bp, Artificial Sequence
  Description of Artificial Sequence: Synthetic oligonucleotide
  Target: SCN10A; (+) strand; PAM type: YTN; PAM sequence: TTT
cctggggcaggagggggatt

SEQ ID NO: 59576 - DNA, 20 bp, Artificial Sequence
  Description of Artificial Sequence: Synthetic oligonucleotide
  Target: SCN10A; (+) strand; PAM type: YTN; PAM sequence: TTC
ctggggcaggagggggattg

SEQ ID NO: 59577 - DNA, 20 bp, Artificial Sequence
  Description of Artificial Sequence: Synthetic oligonucleotide
  Target: SCN10A; (+) strand; PAM type: YTN; PAM sequence: CTG
gggcaggagggggattgctg

SEQ ID NO: 59578 - DNA, 20 bp, Artificial Sequence
  Description of Artificial Sequence: Synthetic oligonucleotide
  Target: SCN10A; (+) strand; PAM type: YTN; PAM sequence: TTG
ctgagccactaatcccttcc

SEQ ID NO: 59579 - DNA, 20 bp, Artificial Sequence
  Description of Artificial Sequence: Synthetic oligonucleotide
  Target: SCN10A; (+) strand; PAM type: YTN; PAM sequence: CTG
agccactaatcccttccatt

SEQ ID NO: 59580 - DNA, 20 bp, Artificial Sequence
  Description of Artificial Sequence: Synthetic oligonucleotide
  Target: SCN10A; (+) strand; PAM type: YTN; PAM sequence: CTA
atcccttccatttcatcact

SEQ ID NO: 59581 - DNA, 20 bp, Artificial Sequence
  Description of Artificial Sequence: Synthetic oligonucleotide
  Target: SCN10A; (+) strand; PAM type: YTN; PAM sequence: CTT
ccatttcatcactgaaaatg

SEQ ID NO: 59582 - DNA, 20 bp, Artificial Sequence
  Description of Artificial Sequence: Synthetic oligonucleotide
  Target: SCN10A; (+) strand; PAM type: YTN; PAM sequence: TTC
catttcatcactgaaaatgg

SEQ ID NO: 59583 - DNA, 20 bp, Artificial Sequence
  Description of Artificial Sequence: Synthetic oligonucleotide
  Target: SCN10A; (+) strand; PAM type: YTN; PAM sequence: TTT
catcactgaaaatggtgaaa

SEQ ID NO: 59584 - DNA, 20 bp, Artificial Sequence
  Description of Artificial Sequence: Synthetic oligonucleotide
  Target: SCN10A; (+) strand; PAM type: YTN; PAM sequence: TTC
atcactgaaaatggtgaaaa

SEQ ID NO: 59585 - DNA, 20 bp, Artificial Sequence
  Description of Artificial Sequence: Synthetic oligonucleotide
  Target: SCN10A; (+) strand; PAM type: YTN; PAM sequence: CTG
aaaatggtgaaaaaatacag

SEQ ID NO: 59586 - DNA, 20 bp, Artificial Sequence
  Description of Artificial Sequence: Synthetic oligonucleotide
  Target: SCN10A; (+) strand; PAM type: YTN; PAM sequence: TTC
atggtcacatgacttctaat

SEQ ID NO: 59587 - DNA, 20 bp, Artificial Sequence
  Description of Artificial Sequence: Synthetic oligonucleotide
  Target: SCN10A; (+) strand; PAM type: YTN; PAM sequence: CTT
ctaattaaacagagcaggca

SEQ ID NO: 59588 - DNA, 20 bp, Artificial Sequence
  Description of Artificial Sequence: Synthetic oligonucleotide
  Target: SCN10A; (+) strand; PAM type: YTN; PAM sequence: TTC
taattaaacagagcaggcaa

SEQ ID NO: 59589 - DNA, 20 bp, Artificial Sequence
  Description of Artificial Sequence: Synthetic oligonucleotide
  Target: SCN10A; (+) strand; PAM type: YTN; PAM sequence: CTA
attaaacagagcaggcaacg

SEQ ID NO: 59590 - DNA, 20 bp, Artificial Sequence
  Description of Artificial Sequence: Synthetic oligonucleotide
  Target: SCN10A; (+) strand; PAM type: YTN; PAM sequence: TTA
aacagagcaggcaacggcat

SEQ ID NO: 59591 - DNA, 20 bp, Artificial Sequence
  Description of Artificial Sequence: Synthetic oligonucleotide
  Target: SCN10A; (+) strand; PAM type: YTN; PAM sequence: TTA
agtggctgggtgtgaagttt

SEQ ID NO: 59592 - DNA, 20 bp, Artificial Sequence
  Description of Artificial Sequence: Synthetic oligonucleotide
  Target: SCN10A; (+) strand; PAM type: YTN; PAM sequence: CTG
ggtgtgaagtttgccctgga

SEQ ID NO: 59593 - DNA, 20 bp, Artificial Sequence
  Description of Artificial Sequence: Synthetic oligonucleotide
  Target: SCN10A; (+) strand; PAM type: YTN; PAM sequence: TTT
gccctggatattctgacttt

SEQ ID NO: 59594 - DNA, 20 bp, Artificial Sequence
  Description of Artificial Sequence: Synthetic oligonucleotide
  Target: SCN10A; (+) strand; PAM type: YTN; PAM sequence: TTG
ccctggatattctgacttta

SEQ ID NO: 59595 - DNA, 20 bp, Artificial Sequence
  Description of Artificial Sequence: Synthetic oligonucleotide
  Target: SCN10A; (+) strand; PAM type: YTN; PAM sequence: CTG
gatattctgactttagggaa

SEQ ID NO: 59596 - DNA, 20 bp, Artificial Sequence
  Description of Artificial Sequence: Synthetic oligonucleotide
  Target: SCN10A; (+) strand; PAM type: YTN; PAM sequence: TTC
tgactttagggaatggagta

SEQ ID NO: 59597 - DNA, 20 bp, Artificial Sequence
  Description of Artificial Sequence: Synthetic oligonucleotide
  Target: SCN10A; (+) strand; PAM type: YTN; PAM sequence: CTG
actttagggaatggagtagc

SEQ ID NO: 59598 - DNA, 20 bp, Artificial Sequence
  Description of Artificial Sequence: Synthetic oligonucleotide
  Target: SCN10A; (+) strand; PAM type: YTN; PAM sequence: CTT
tagggaatggagtagcttgc

SEQ ID NO: 59599 - DNA, 20 bp, Artificial Sequence
  Description of Artificial Sequence: Synthetic oligonucleotide
  Target: SCN10A; (+) strand; PAM type: YTN; PAM sequence: TTT
agggaatggagtagcttgct

SEQ ID NO: 59600 - DNA, 20 bp, Artificial Sequence
  Description of Artificial Sequence: Synthetic oligonucleotide
  Target: SCN10A; (+) strand; PAM type: YTN; PAM sequence: TTA
gggaatggagtagcttgcta

SEQ ID NO: 59601 - DNA, 20 bp, Artificial Sequence
  Description of Artificial Sequence: Synthetic oligonucleotide
  Target: SCN10A; (+) strand; PAM type: YTN; PAM sequence: CTT
gctagctgctcttggattag

SEQ ID NO: 59602 - DNA, 20 bp, Artificial Sequence
  Description of Artificial Sequence: Synthetic oligonucleotide
  Target: SCN10A; (+) strand; PAM type: YTN; PAM sequence: TTG
ctagctgctcttggattagc

SEQ ID NO: 59603 - DNA, 20 bp, Artificial Sequence
  Description of Artificial Sequence: Synthetic oligonucleotide
  Target: SCN10A; (+) strand; PAM type: YTN; PAM sequence: CTA
gctgctcttggattagccca

SEQ ID NO: 59604 - DNA, 20 bp, Artificial Sequence
  Description of Artificial Sequence: Synthetic oligonucleotide
  Target: SCN10A; (+) strand; PAM type: YTN; PAM sequence: CTG
ctcttggattagcccacggt

SEQ ID NO: 59605 - DNA, 20 bp, Artificial Sequence
  Description of Artificial Sequence: Synthetic oligonucleotide
  Target: SCN10A; (+) strand; PAM type: YTN; PAM sequence: CTC
ttggattagcccacggtcag

SEQ ID NO: 59606 - DNA, 20 bp, Artificial Sequence
  Description of Artificial Sequence: Synthetic oligonucleotide
  Target: SCN10A; (+) strand; PAM type: YTN; PAM sequence: CTT
ggattagcccacggtcaggg

SEQ ID NO: 59607 - DNA, 20 bp, Artificial Sequence
  Description of Artificial Sequence: Synthetic oligonucleotide
  Target: SCN10A; (+) strand; PAM type: YTN; PAM sequence: TTG
gattagcccacggtcaggga

SEQ ID NO: 59608 - DNA, 20 bp, Artificial Sequence
  Description of Artificial Sequence: Synthetic oligonucleotide
  Target: SCN10A; (+) strand; PAM type: YTN; PAM sequence: TTA
gcccacggtcagggatcata

SEQ ID NO: 59609 - DNA, 20 bp, Artificial Sequence
  Description of Artificial Sequence: Synthetic oligonucleotide
  Target: SCN10A; (+) strand; PAM type: YTN; PAM sequence: CTT
tgcaacccttggtgctctca

SEQ ID NO: 59610 - DNA, 20 bp, Artificial Sequence
  Description of Artificial Sequence: Synthetic oligonucleotide
  Target: SCN10A; (+) strand; PAM type: YTN; PAM sequence: TTT
gcaacccttggtgctctcag

SEQ ID NO: 59611 - DNA, 20 bp, Artificial Sequence
  Description of Artificial Sequence: Synthetic oligonucleotide
  Target: SCN10A; (+) strand; PAM type: YTN; PAM sequence: TTG
caacccttggtgctctcaga

SEQ ID NO: 59612 - DNA, 20 bp, Artificial Sequence
  Description of Artificial Sequence: Synthetic oligonucleotide
  Target: SCN10A; (+) strand; PAM type: YTN; PAM sequence: CTT
ggtgctctcagagacgatga

SEQ ID NO: 59613 - DNA, 20 bp, Artificial Sequence
  Description of Artificial Sequence: Synthetic oligonucleotide
  Target: SCN10A; (+) strand; PAM type: YTN; PAM sequence: TTG
gtgctctcagagacgatgaa

SEQ ID NO: 59614 - DNA, 20 bp, Artificial Sequence
  Description of Artificial Sequence: Synthetic oligonucleotide
  Target: SCN10A; (+) strand; PAM type: YTN; PAM sequence: CTC
tcagagacgatgaagtgggt

SEQ ID NO: 59615 - DNA, 20 bp, Artificial Sequence
  Description of Artificial Sequence: Synthetic oligonucleotide
  Target: SCN10A; (+) strand; PAM type: YTN; PAM sequence: CTC
agagacgatgaagtgggtga

SEQ ID NO: 59616 - DNA, 20 bp, Artificial Sequence
  Description of Artificial Sequence: Synthetic oligonucleotide
  Target: SCN10A; (+) strand; PAM type: YTN; PAM sequence: TTG
attatgtgatattctctaga

SEQ ID NO: 59617 - DNA, 20 bp, Artificial Sequence
  Description of Artificial Sequence: Synthetic oligonucleotide
  Target: SCN10A; (+) strand; PAM type: YTN; PAM sequence: TTA
tgtgatattctctagagcct

SEQ ID NO: 59618 - DNA, 20 bp, Artificial Sequence
  Description of Artificial Sequence: Synthetic oligonucleotide
  Target: SCN10A; (+) strand; PAM type: YTN; PAM sequence: TTC
tctagagcctattatatttc

SEQ ID NO: 59619 - DNA, 20 bp, Artificial Sequence
  Description of Artificial Sequence: Synthetic oligonucleotide
  Target: SCN10A; (+) strand; PAM type: YTN; PAM sequence: CTC
tagagcctattatatttcta

SEQ ID NO: 59620 - DNA, 20 bp, Artificial Sequence
  Description of Artificial Sequence: Synthetic oligonucleotide
  Target: SCN10A; (+) strand; PAM type: YTN; PAM sequence: CTA
gagcctattatatttctata

SEQ ID NO: 59621 - DNA, 20 bp, Artificial Sequence
  Description of Artificial Sequence: Synthetic oligonucleotide
  Target: SCN10A; (+) strand; PAM type: YTN; PAM sequence: CTA
ttatatttctataaagtgga

SEQ ID NO: 59622 - DNA, 20 bp, Artificial Sequence
  Description of Artificial Sequence: Synthetic oligonucleotide
  Target: SCN10A; (+) strand; PAM type: YTN; PAM sequence: TTA
tatttctataaagtggagta

SEQ ID NO: 59623 - DNA, 20 bp, Artificial Sequence
  Description of Artificial Sequence: Synthetic oligonucleotide
  Target: SCN10A; (+) strand; PAM type: YTN; PAM sequence: TTT
ctataaagtggagtatgtga

SEQ ID NO: 59624 - DNA, 20 bp, Artificial Sequence
  Description of Artificial Sequence: Synthetic oligonucleotide
  Target: SCN10A; (+) strand; PAM type: YTN; PAM sequence: TTC
tataaagtggagtatgtgag

SEQ ID NO: 59625 - DNA, 20 bp, Artificial Sequence
  Description of Artificial Sequence: Synthetic oligonucleotide
  Target: SCN10A; (+) strand; PAM type: YTN; PAM sequence: CTA
taaagtggagtatgtgagag

SEQ ID NO: 59626 - DNA, 20 bp, Artificial Sequence
  Description of Artificial Sequence: Synthetic oligonucleotide
  Target: SCN10A; (+) strand; PAM type: YTN; PAM sequence: CTG
cttttattgatttctgtagc

SEQ ID NO: 59627 - DNA, 20 bp, Artificial Sequence
  Description of Artificial Sequence: Synthetic oligonucleotide
  Target: SCN10A; (+) strand; PAM type: YTN; PAM sequence: CTT
ttattgatttctgtagcagg

SEQ ID NO: 59628 - DNA, 20 bp, Artificial Sequence
  Description of Artificial Sequence: Synthetic oligonucleotide
  Target: SCN10A; (+) strand; PAM type: YTN; PAM sequence: TTT
tattgatttctgtagcaggg

SEQ ID NO: 59629 - DNA, 20 bp, Artificial Sequence
  Description of Artificial Sequence: Synthetic oligonucleotide
  Target: SCN10A; (+) strand; PAM type: YTN; PAM sequence: TTT
attgatttctgtagcaggga

SEQ ID NO: 59630 - DNA, 20 bp, Artificial Sequence
  Description of Artificial Sequence: Synthetic oligonucleotide
  Target: SCN10A; (+) strand; PAM type: YTN; PAM sequence: TTA
ttgatttctgtagcagggaa

SEQ ID NO: 59631 - DNA, 20 bp, Artificial Sequence
  Description of Artificial Sequence: Synthetic oligonucleotide
  Target: SCN10A; (+) strand; PAM type: YTN; PAM sequence: TTG
atttctgtagcagggaatgt

SEQ ID NO: 59632 - DNA, 20 bp, Artificial Sequence
  Description of Artificial Sequence: Synthetic oligonucleotide
  Target: SCN10A; (+) strand; PAM type: YTN; PAM sequence: TTT
ctgtagcagggaatgttaaa

SEQ ID NO: 59633 - DNA, 20 bp, Artificial Sequence
  Description of Artificial Sequence: Synthetic oligonucleotide
  Target: SCN10A; (+) strand; PAM type: YTN; PAM sequence: TTC
tgtagcagggaatgttaaag

SEQ ID NO: 59634 - DNA, 20 bp, Artificial Sequence
  Description of Artificial Sequence: Synthetic oligonucleotide
  Target: SCN10A; (+) strand; PAM type: YTN; PAM sequence: CTG
tagcagggaatgttaaagaa

SEQ ID NO: 59635 - DNA, 20 bp, Artificial Sequence
  Description of Artificial Sequence: Synthetic oligonucleotide
  Target: SCN10A; (+) strand; PAM type: YTN; PAM sequence: TTA
aagaataaaatttcccagtc

SEQ ID NO: 59636 - DNA, 20 bp, Artificial Sequence
  Description of Artificial Sequence: Synthetic oligonucleotide
  Target: SCN10A; (+) strand; PAM type: YTN; PAM sequence: TTT
cccagtcttgtggaatcctt

SEQ ID NO: 59637 - DNA, 20 bp, Artificial Sequence
  Description of Artificial Sequence: Synthetic oligonucleotide
  Target: SCN10A; (+) strand; PAM type: YTN; PAM sequence: TTC
ccagtcttgtggaatcctta

SEQ ID NO: 59638 - DNA, 20 bp, Artificial Sequence
  Description of Artificial Sequence: Synthetic oligonucleotide
  Target: SCN10A; (+) strand; PAM type: YTN; PAM sequence: CTT
gtggaatccttaacttttcc

SEQ ID NO: 59639 - DNA, 20 bp, Artificial Sequence
  Description of Artificial Sequence: Synthetic oligonucleotide
  Target: SCN10A; (+) strand; PAM type: YTN; PAM sequence: TTG
tggaatccttaacttttcct

SEQ ID NO: 59640 - DNA, 20 bp, Artificial Sequence
  Description of Artificial Sequence: Synthetic oligonucleotide
  Target: SCN10A; (+) strand; PAM type: YTN; PAM sequence: CTT
aacttttcctatggaagaaa

SEQ ID NO: 59641 - DNA, 20 bp, Artificial Sequence
  Description of Artificial Sequence: Synthetic oligonucleotide
  Target: SCN10A; (+) strand; PAM type: YTN; PAM sequence: TTA
acttttcctatggaagaaac

SEQ ID NO: 59642 - DNA, 20 bp, Artificial Sequence
  Description of Artificial Sequence: Synthetic oligonucleotide
  Target: SCN10A; (+) strand; PAM type: YTN; PAM sequence: CTT
ttcctatggaagaaacaaga

SEQ ID NO: 59643 - DNA, 20 bp, Artificial Sequence
  Description of Artificial Sequence: Synthetic oligonucleotide
  Target: SCN10A; (+) strand; PAM type: YTN; PAM sequence: TTT
tcctatggaagaaacaagat

SEQ ID NO: 59644 - DNA, 20 bp, Artificial Sequence
  Description of Artificial Sequence: Synthetic oligonucleotide
  Target: SCN10A; (+) strand; PAM type: YTN; PAM sequence: TTT
cctatggaagaaacaagatt

SEQ ID NO: 59645 - DNA, 20 bp, Artificial Sequence
  Description of Artificial Sequence: Synthetic oligonucleotide
  Target: SCN10A; (+) strand; PAM type: YTN; PAM sequence: TTC
ctatggaagaaacaagattt

SEQ ID NO: 59646 - DNA, 20 bp, Artificial Sequence
  Description of Artificial Sequence: Synthetic oligonucleotide
  Target: SCN10A; (+) strand; PAM type: YTN; PAM sequence: CTA
tggaagaaacaagatttaga

SEQ ID NO: 59647 - DNA, 20 bp, Artificial Sequence
  Description of Artificial Sequence: Synthetic oligonucleotide
  Target: SCN10A; (+) strand; PAM type: YTN; PAM sequence: TTT
agagcctgagcatcatcaga

SEQ ID NO: 59648 - DNA, 20 bp, Artificial Sequence
  Description of Artificial Sequence: Synthetic oligonucleotide
  Target: SCN10A; (+) strand; PAM type: YTN; PAM sequence: TTA
gagcctgagcatcatcagag

SEQ ID NO: 59649 - DNA, 20 bp, Artificial Sequence
  Description of Artificial Sequence: Synthetic oligonucleotide
  Target: SCN10A; (+) strand; PAM type: YTN; PAM sequence: CTG
agcatcatcagaggtgagag

SEQ ID NO: 59650 - DNA, 20 bp, Artificial Sequence
  Description of Artificial Sequence: Synthetic oligonucleotide
  Target: SCN10A; (+) strand; PAM type: YTN; PAM sequence: CTC
ctatgtggtcccaggtaagc

SEQ ID NO: 59651 - DNA, 20 bp, Artificial Sequence
  Description of Artificial Sequence: Synthetic oligonucleotide
  Target: SCN10A; (+) strand; PAM type: YTN; PAM sequence: CTA
tgtggtcccaggtaagctct

SEQ ID NO: 59652 - DNA, 20 bp, Artificial Sequence
  Description of Artificial Sequence: Synthetic oligonucleotide
  Target: SCN10A; (+) strand; PAM type: YTN; PAM sequence: CTC
tgtcatgaaatggcacccat

SEQ ID NO: 59653 - DNA, 20 bp, Artificial Sequence
  Description of Artificial Sequence: Synthetic oligonucleotide
  Target: SCN10A; (+) strand; PAM type: YTN; PAM sequence: CTG
tcatgaaatggcacccatgc

SEQ ID NO: 59654 - DNA, 20 bp, Artificial Sequence
  Description of Artificial Sequence: Synthetic oligonucleotide
  Target: SCN10A; (+) strand; PAM type: YTN; PAM sequence: CTG
atggggcagaaatcctgtgt

SEQ ID NO: 59655 - DNA, 20 bp, Artificial Sequence
  Description of Artificial Sequence: Synthetic oligonucleotide
  Target: SCN10A; (+) strand; PAM type: YTN; PAM sequence: CTG
tgtcagtgctttgctggtat

SEQ ID NO: 59656 - DNA, 20 bp, Artificial Sequence
  Description of Artificial Sequence: Synthetic oligonucleotide
  Target: SCN10A; (+) strand; PAM type: YTN; PAM sequence: CTT
tgctggtatgaccagcttga

SEQ ID NO: 59657 - DNA, 20 bp, Artificial Sequence
  Description of Artificial Sequence: Synthetic oligonucleotide
  Target: SCN10A; (+) strand; PAM type: YTN; PAM sequence: TTT
gctggtatgaccagcttgac

SEQ ID NO: 59658 - DNA, 20 bp, Artificial Sequence
  Description of Artificial Sequence: Synthetic oligonucleotide
  Target: SCN10A; (+) strand; PAM type: YTN; PAM sequence: TTG
ctggtatgaccagcttgacc

SEQ ID NO: 59659 - DNA, 20 bp, Artificial Sequence
  Description of Artificial Sequence: Synthetic oligonucleotide
  Target: SCN10A; (+) strand; PAM type: YTN; PAM sequence: CTG
gtatgaccagcttgaccttt

SEQ ID NO: 59660 - DNA, 20 bp, Artificial Sequence
  Description of Artificial Sequence: Synthetic oligonucleotide
  Target: SCN10A; (+) strand; PAM type: YTN; PAM sequence: CTT
gacctttggggctcctaagg

SEQ ID NO: 59661 - DNA, 20 bp, Artificial Sequence
  Description of Artificial Sequence: Synthetic oligonucleotide
  Target: SCN10A; (+) strand; PAM type: YTN; PAM sequence: TTG
acctttggggctcctaaggg

SEQ ID NO: 59662 - DNA, 20 bp, Artificial Sequence
  Description of Artificial Sequence: Synthetic oligonucleotide
  Target: SCN10A; (+) strand; PAM type: YTN; PAM sequence: CTT
tggggctcctaaggggagaa

SEQ ID NO: 59663 - DNA, 20 bp, Artificial Sequence
  Description of Artificial Sequence: Synthetic oligonucleotide
  Target: SCN10A; (+) strand; PAM type: YTN; PAM sequence: TTT
ggggctcctaaggggagaag

SEQ ID NO: 59664 - DNA, 20 bp, Artificial Sequence
  Description of Artificial Sequence: Synthetic oligonucleotide
  Target: SCN10A; (+) strand; PAM type: YTN; PAM sequence: TTG
gggctcctaaggggagaagg

SEQ ID NO: 59665 - DNA, 20 bp, Artificial Sequence
  Description of Artificial Sequence: Synthetic oligonucleotide
  Target: SCN10A; (+) strand; PAM type: YTN; PAM sequence: CTC
ctaaggggagaaggtggaca

SEQ ID NO: 59666 - DNA, 20 bp, Artificial Sequence
  Description of Artificial Sequence: Synthetic oligonucleotide
  Target: SCN10A; (+) strand; PAM type: YTN; PAM sequence: CTA
aggggagaaggtggacattc

SEQ ID NO: 59667 - DNA, 20 bp, Artificial Sequence
  Description of Artificial Sequence: Synthetic oligonucleotide
  Target: SCN10A; (+) strand; PAM type: YTN; PAM sequence: TTC
cagggccaataatctggcca

SEQ ID NO: 59668 - DNA, 20 bp, Artificial Sequence
  Description of Artificial Sequence: Synthetic oligonucleotide
  Target: SCN10A; (+) strand; PAM type: YTN; PAM sequence: CTG
gccaaaagcaagctgggcct

SEQ ID NO: 59669 - DNA, 20 bp, Artificial Sequence
  Description of Artificial Sequence: Synthetic oligonucleotide
  Target: SCN10A; (+) strand; PAM type: YTN; PAM sequence: CTG
ggcctgggaagaagggtctt

SEQ ID NO: 59670 - DNA, 20 bp, Artificial Sequence
  Description of Artificial Sequence: Synthetic oligonucleotide
  Target: SCN10A; (+) strand; PAM type: YTN; PAM sequence: CTG
ggaagaagggtcttagttgg

SEQ ID NO: 59671 - DNA, 20 bp, Artificial Sequence
  Description of Artificial Sequence: Synthetic oligonucleotide
  Target: SCN10A; (+) strand; PAM type: YTN; PAM sequence: CTT
agttgggagtgggaatttcc

SEQ ID NO: 59672 - DNA, 20 bp, Artificial Sequence
  Description of Artificial Sequence: Synthetic oligonucleotide
  Target: SCN10A; (+) strand; PAM type: YTN; PAM sequence: TTA
gttgggagtgggaatttcct

SEQ ID NO: 59673 - DNA, 20 bp, Artificial Sequence
  Description of Artificial Sequence: Synthetic oligonucleotide
  Target: SCN10A; (+) strand; PAM type: YTN; PAM sequence: TTG
ggagtgggaatttccttttg

SEQ ID NO: 59674 - DNA, 20 bp, Artificial Sequence
  Description of Artificial Sequence: Synthetic oligonucleotide
  Target: SCN10A; (+) strand; PAM type: YTN; PAM sequence: TTT
ccttttgccttggatttctt

SEQ ID NO: 59675 - DNA, 20 bp, Artificial Sequence
  Description of Artificial Sequence: Synthetic oligonucleotide
  Target: SCN10A; (+) strand; PAM type: YTN; PAM sequence: TTC
cttttgccttggatttcttt

SEQ ID NO: 59676 - DNA, 20 bp, Artificial Sequence
  Description of Artificial Sequence: Synthetic oligonucleotide
  Target: SCN10A; (+) strand; PAM type: YTN; PAM sequence: CTT
ttgccttggatttctttctt

SEQ ID NO: 59677 - DNA, 20 bp, Artificial Sequence
  Description of Artificial Sequence: Synthetic oligonucleotide
  Target: SCN10A; (+) strand; PAM type: YTN; PAM sequence: TTT
tgccttggatttctttcttg

SEQ ID NO: 59678 - DNA, 20 bp, Artificial Sequence
  Description of Artificial Sequence: Synthetic oligonucleotide
  Target: SCN10A; (+) strand; PAM type: YTN; PAM sequence: TTT
gccttggatttctttcttgg

SEQ ID NO: 59679 - DNA, 20 bp, Artificial Sequence
  Description of Artificial Sequence: Synthetic oligonucleotide
  Target: SCN10A; (+) strand; PAM type: YTN; PAM sequence: TTG
ccttggatttctttcttggt

SEQ ID NO: 59680 - DNA, 20 bp, Artificial Sequence
  Description of Artificial Sequence: Synthetic oligonucleotide
  Target: SCN10A; (+) strand; PAM type: YTN; PAM sequence: CTT
ggatttctttcttggttcta

SEQ ID NO: 59681 - DNA, 20 bp, Artificial Sequence
  Description of Artificial Sequence: Synthetic oligonucleotide
  Target: SCN10A; (+) strand; PAM type: YTN; PAM sequence: TTG
gatttctttcttggttctag

SEQ ID NO: 59682 - DNA, 20 bp, Artificial Sequence
  Description of Artificial Sequence: Synthetic oligonucleotide
  Target: SCN10A; (+) strand; PAM type: YTN; PAM sequence: TTT
ctttcttggttctagacttt

SEQ ID NO: 59683 - DNA, 20 bp, Artificial Sequence
  Description of Artificial Sequence: Synthetic oligonucleotide
  Target: SCN10A; (+) strand; PAM type: YTN; PAM sequence: TTC
tttcttggttctagactttg

SEQ ID NO: 59684 - DNA, 20 bp, Artificial Sequence
  Description of Artificial Sequence: Synthetic oligonucleotide
  Target: SCN10A; (+) strand; PAM type: YTN; PAM sequence: CTT
tcttggttctagactttgaa

SEQ ID NO: 59685 - DNA, 20 bp, Artificial Sequence
  Description of Artificial Sequence: Synthetic oligonucleotide
  Target: SCN10A; (+) strand; PAM type: YTN; PAM sequence: TTT
cttggttctagactttgaag

SEQ ID NO: 59686 - DNA, 20 bp, Artificial Sequence
  Description of Artificial Sequence: Synthetic oligonucleotide
  Target: SCN10A; (+) strand; PAM type: YTN; PAM sequence: TTC
ttggttctagactttgaaga

SEQ ID NO: 59687 - DNA, 20 bp, Artificial Sequence
  Description of Artificial Sequence: Synthetic oligonucleotide
  Target: SCN10A; (+) strand; PAM type: YTN; PAM sequence: CTT
ggttctagactttgaagagg

SEQ ID NO: 59688 - DNA, 20 bp, Artificial Sequence
  Description of Artificial Sequence: Synthetic oligonucleotide
  Target: SCN10A; (+) strand; PAM type: YTN; PAM sequence: TTG
gttctagactttgaagaggg

SEQ ID NO: 59689 - DNA, 20 bp, Artificial Sequence
  Description of Artificial Sequence: Synthetic oligonucleotide
  Target: SCN10A; (+) strand; PAM type: YTN; PAM sequence: TTC
tagactttgaagagggaaga

SEQ ID NO: 59690 - DNA, 20 bp, Artificial Sequence
  Description of Artificial Sequence: Synthetic oligonucleotide
  Target: SCN10A; (+) strand; PAM type: YTN; PAM sequence: CTA
gactttgaagagggaagatg

SEQ ID NO: 59691 - DNA, 20 bp, Artificial Sequence
  Description of Artificial Sequence: Synthetic oligonucleotide
  Target: SCN10A; (+) strand; PAM type: YTN; PAM sequence: CTT
tgaagagggaagatgatccg

SEQ ID NO: 59692 - DNA, 20 bp, Artificial Sequence
  Description of Artificial Sequence: Synthetic oligonucleotide
  Target: SCN10A; (+) strand; PAM type: YTN; PAM sequence: TTT
gaagagggaagatgatccgg

SEQ ID NO: 59693 - DNA, 20 bp, Artificial Sequence
  Description of Artificial Sequence: Synthetic oligonucleotide
  Target: SCN10A; (+) strand; PAM type: YTN; PAM sequence: TTG
aagagggaagatgatccggc

SEQ ID NO: 59694 - DNA, 20 bp, Artificial Sequence
  Description of Artificial Sequence: Synthetic oligonucleotide
  Target: SCN10A; (+) strand; PAM type: YTN; PAM sequence: CTT
gtgccactgggcatgtgggt

SEQ ID NO: 59695 - DNA, 20 bp, Artificial Sequence
  Description of Artificial Sequence: Synthetic oligonucleotide
  Target: SCN10A; (+) strand; PAM type: YTN; PAM sequence: TTG
tgccactgggcatgtgggtg

SEQ ID NO: 59696 - DNA, 20 bp, Artificial Sequence
  Description of Artificial Sequence: Synthetic oligonucleotide
  Target: SCN10A; (+) strand; PAM type: YTN; PAM sequence: CTG
ggcatgtgggtgtcaaagat

SEQ ID NO: 59697 - DNA, 20 bp, Artificial Sequence
  Description of Artificial Sequence: Synthetic oligonucleotide
  Target: SCN10A; (+) strand; PAM type: YTN; PAM sequence: TTG
cctgccatttggatgctggt

SEQ ID NO: 59698 - DNA, 20 bp, Artificial Sequence
  Description of Artificial Sequence: Synthetic oligonucleotide
  Target: SCN10A; (+) strand; PAM type: YTN; PAM sequence: CTG
ccatttggatgctggtcagg

SEQ ID NO: 59699 - DNA, 20 bp, Artificial Sequence
  Description of Artificial Sequence: Synthetic oligonucleotide
  Target: SCN10A; (+) strand; PAM type: YTN; PAM sequence: TTT
ggatgctggtcaggagctag

SEQ ID NO: 59700 - DNA, 20 bp, Artificial Sequence
  Description of Artificial Sequence: Synthetic oligonucleotide
  Target: SCN10A; (+) strand; PAM type: YTN; PAM sequence: TTG
gatgctggtcaggagctagg

SEQ ID NO: 59701 - DNA, 20 bp, Artificial Sequence
  Description of Artificial Sequence: Synthetic oligonucleotide
  Target: SCN10A; (+) strand; PAM type: YTN; PAM sequence: CTG
gtcaggagctaggatggtcc

SEQ ID NO: 59702 - DNA, 20 bp, Artificial Sequence
  Description of Artificial Sequence: Synthetic oligonucleotide
  Target: SCN10A; (+) strand; PAM type: YTN; PAM sequence: CTA
ggatggtccaagacctatgg

SEQ ID NO: 59703 - DNA, 20 bp, Artificial Sequence
  Description of Artificial Sequence: Synthetic oligonucleotide
  Target: SCN10A; (+) strand; PAM type: YTN; PAM sequence: CTA
tgggtcctggagtgcagcca

SEQ ID NO: 59704 - DNA, 20 bp, Artificial Sequence
  Description of Artificial Sequence: Synthetic oligonucleotide
  Target: SCN10A; (+) strand; PAM type: YTN; PAM sequence: CTG
gagtgcagccatctgcaggt

SEQ ID NO: 59705 - DNA, 20 bp, Artificial Sequence
  Description of Artificial Sequence: Synthetic oligonucleotide
  Target: SCN10A; (+) strand; PAM type: YTN; PAM sequence: CTG
caggtgctgcttggactctg

SEQ ID NO: 59706 - DNA, 20 bp, Artificial Sequence
  Description of Artificial Sequence: Synthetic oligonucleotide
  Target: SCN10A; (+) strand; PAM type: YTN; PAM sequence: CTG
cttggactctgctttgtgct

SEQ ID NO: 59707 - DNA, 20 bp, Artificial Sequence
  Description of Artificial Sequence: Synthetic oligonucleotide
  Target: SCN10A; (+) strand; PAM type: YTN; PAM sequence: CTT
ggactctgctttgtgctgat

SEQ ID NO: 59708 - DNA, 20 bp, Artificial Sequence
  Description of Artificial Sequence: Synthetic oligonucleotide
  Target: SCN10A; (+) strand; PAM type: YTN; PAM sequence: TTG
gactctgctttgtgctgatt

SEQ ID NO: 59709 - DNA, 20 bp, Artificial Sequence
  Description of Artificial Sequence: Synthetic oligonucleotide
  Target: SCN10A; (+) strand; PAM type: YTN; PAM sequence: CTC
tgctttgtgctgatttctct

SEQ ID NO: 59710 - DNA, 20 bp, Artificial Sequence
  Description of Artificial Sequence: Synthetic oligonucleotide
  Target: SCN10A; (+) strand; PAM type: YTN; PAM sequence: CTG
ctttgtgctgatttctctgt

SEQ ID NO: 59711 - DNA, 20 bp, Artificial Sequence
  Description of Artificial Sequence: Synthetic oligonucleotide
  Target: SCN10A; (+) strand; PAM type: YTN; PAM sequence: CTT
tgtgctgatttctctgttgg

SEQ ID NO: 59712 - DNA, 20 bp, Artificial Sequence
  Description of Artificial Sequence: Synthetic oligonucleotide
  Target: SCN10A; (+) strand; PAM type: YTN; PAM sequence: TTT
gtgctgatttctctgttggc

SEQ ID NO: 59713 - DNA, 20 bp, Artificial Sequence
  Description of Artificial Sequence: Synthetic oligonucleotide
  Target: SCN10A; (+) strand; PAM type: YTN; PAM sequence: TTG
tgctgatttctctgttggca

SEQ ID NO: 59714 - DNA, 20 bp, Artificial Sequence
  Description of Artificial Sequence: Synthetic oligonucleotide
  Target: SCN10A; (+) strand; PAM type: YTN; PAM sequence: CTG
atttctctgttggcatccct

SEQ ID NO: 59715 - DNA, 20 bp, Artificial Sequence
  Description of Artificial Sequence: Synthetic oligonucleotide
  Target: SCN10A; (+) strand; PAM type: YTN; PAM sequence: TTT
ctctgttggcatccctgcca

SEQ ID NO: 59716 - DNA, 20 bp, Artificial Sequence
  Description of Artificial Sequence: Synthetic oligonucleotide
  Target: SCN10A; (+) strand; PAM type: YTN; PAM sequence: TTC
tctgttggcatccctgccac

SEQ ID NO: 59717 - DNA, 20 bp, Artificial Sequence
  Description of Artificial Sequence: Synthetic oligonucleotide
  Target: SCN10A; (+) strand; PAM type: YTN; PAM sequence: CTC
tgttggcatccctgccactt

SEQ ID NO: 59718 - DNA, 20 bp, Artificial Sequence
  Description of Artificial Sequence: Synthetic oligonucleotide
  Target: SCN10A; (+) strand; PAM type: YTN; PAM sequence: CTG
ttggcatccctgccacttca

SEQ ID NO: 59719 - DNA, 20 bp, Artificial Sequence
  Description of Artificial Sequence: Synthetic oligonucleotide
  Target: SCN10A; (+) strand; PAM type: YTN; PAM sequence: TTG
gcatccctgccacttcaaag

SEQ ID NO: 59720 - DNA, 20 bp, Artificial Sequence
  Description of Artificial Sequence: Synthetic oligonucleotide
  Target: SCN10A; (+) strand; PAM type: YTN; PAM sequence: CTG
ccacttcaaagttttgttta

SEQ ID NO: 59721 - DNA, 20 bp, Artificial Sequence
  Description of Artificial Sequence: Synthetic oligonucleotide
  Target: SCN10A; (+) strand; PAM type: YTN; PAM sequence: CTT
caaagttttgtttaaatgtt

SEQ ID NO: 59722 - DNA, 20 bp, Artificial Sequence
  Description of Artificial Sequence: Synthetic oligonucleotide
  Target: SCN10A; (+) strand; PAM type: YTN; PAM sequence: TTC
aaagttttgtttaaatgttc

SEQ ID NO: 59723 - DNA, 20 bp, Artificial Sequence
  Description of Artificial Sequence: Synthetic oligonucleotide
  Target: SCN10A; (+) strand; PAM type: YTN; PAM sequence: TTT
tgtttaaatgttctagcctt

SEQ ID NO: 59724 - DNA, 20 bp, Artificial Sequence
  Description of Artificial Sequence: Synthetic oligonucleotide
  Target: SCN10A; (+) strand; PAM type: YTN; PAM sequence: TTT
gtttaaatgttctagccttg

SEQ ID NO: 59725 - DNA, 20 bp, Artificial Sequence
  Description of Artificial Sequence: Synthetic oligonucleotide
  Target: SCN10A; (+) strand; PAM type: YTN; PAM sequence: TTG
tttaaatgttctagccttgc

SEQ ID NO: 59726 - DNA, 20 bp, Artificial Sequence
  Description of Artificial Sequence: Synthetic oligonucleotide
  Target: SCN10A; (+) strand; PAM type: YTN; PAM sequence: TTT
aaatgttctagccttgcctc

SEQ ID NO: 59727 - DNA, 20 bp, Artificial Sequence
  Description of Artificial Sequence: Synthetic oligonucleotide
  Target: SCN10A; (+) strand; PAM type: YTN; PAM sequence: TTA
aatgttctagccttgcctca

SEQ ID NO: 59728 - DNA, 20 bp, Artificial Sequence
  Description of Artificial Sequence: Synthetic oligonucleotide
  Target: SCN10A; (+) strand; PAM type: YTN; PAM sequence: TTC
tagccttgcctcagctatgc

SEQ ID NO: 59729 - DNA, 20 bp, Artificial Sequence
  Description of Artificial Sequence: Synthetic oligonucleotide
  Target: SCN10A; (+) strand; PAM type: YTN; PAM sequence: CTA
gccttgcctcagctatgcga

SEQ ID NO: 59730 - DNA, 20 bp, Artificial Sequence
  Description of Artificial Sequence: Synthetic oligonucleotide
  Target: SCN10A; (+) strand; PAM type: YTN; PAM sequence: CTT
gcctcagctatgcgaaatta

SEQ ID NO: 59731 - DNA, 20 bp, Artificial Sequence
  Description of Artificial Sequence: Synthetic oligonucleotide
  Target: SCN10A; (+) strand; PAM type: YTN; PAM sequence: TTG
cctcagctatgcgaaattag

SEQ ID NO: 59732 - DNA, 20 bp, Artificial Sequence
  Description of Artificial Sequence: Synthetic oligonucleotide
  Target: SCN10A; (+) strand; PAM type: YTN; PAM sequence: CTC
agctatgcgaaattagggaa

SEQ ID NO: 59733 - DNA, 20 bp, Artificial Sequence
  Description of Artificial Sequence: Synthetic oligonucleotide
  Target: SCN10A; (+) strand; PAM type: YTN; PAM sequence: CTA
tgcgaaattagggaacaaag

SEQ ID NO: 59734 - DNA, 20 bp, Artificial Sequence
  Description of Artificial Sequence: Synthetic oligonucleotide
  Target: SCN10A; (+) strand; PAM type: YTN; PAM sequence: TTA
gggaacaaaggaaagagtgt

SEQ ID NO: 59735 - DNA, 20 bp, Artificial Sequence
  Description of Artificial Sequence: Synthetic oligonucleotide
  Target: SCN10A; (+) strand; PAM type: YTN; PAM sequence: TTT
accttgcttgggccagaata

SEQ ID NO: 59736 - DNA, 20 bp, Artificial Sequence
  Description of Artificial Sequence: Synthetic oligonucleotide
  Target: SCN10A; (+) strand; PAM type: YTN; PAM sequence: TTA
ccttgcttgggccagaatat

SEQ ID NO: 59737 - DNA, 20 bp, Artificial Sequence
  Description of Artificial Sequence: Synthetic oligonucleotide
  Target: SCN10A; (+) strand; PAM type: YTN; PAM sequence: CTT
gcttgggccagaatattaag

SEQ ID NO: 59738 - DNA, 20 bp, Artificial Sequence
  Description of Artificial Sequence: Synthetic oligonucleotide
  Target: SCN10A; (+) strand; PAM type: YTN; PAM sequence: TTG
cttgggccagaatattaagg

SEQ ID NO: 59739 - DNA, 20 bp, Artificial Sequence
  Description of Artificial Sequence: Synthetic oligonucleotide
  Target: SCN10A; (+) strand; PAM type: YTN; PAM sequence: CTT
gggccagaatattaagggga

SEQ ID NO: 59740 - DNA, 20 bp, Artificial Sequence
  Description of Artificial Sequence: Synthetic oligonucleotide
  Target: SCN10A; (+) strand; PAM type: YTN; PAM sequence: TTG
ggccagaatattaaggggag

SEQ ID NO: 59741 - DNA, 20 bp, Artificial Sequence
  Description of Artificial Sequence: Synthetic oligonucleotide
  Target: SCN10A; (+) strand; PAM type: YTN; PAM sequence: TTA
aggggagagccacgttcctc

SEQ ID NO: 59742 - DNA, 20 bp, Artificial Sequence
  Description of Artificial Sequence: Synthetic oligonucleotide
  Target: SCN10A; (+) strand; PAM type: YTN; PAM sequence: TTC
ctccactaaggctagcaaaa

SEQ ID NO: 59743 - DNA, 20 bp, Artificial Sequence
  Description of Artificial Sequence: Synthetic oligonucleotide
  Target: SCN10A; (+) strand; PAM type: YTN; PAM sequence: CTC
cactaaggctagcaaaaggt

SEQ ID NO: 59744 - DNA, 20 bp, Artificial Sequence
  Description of Artificial Sequence: Synthetic oligonucleotide
  Target: SCN10A; (+) strand; PAM type: YTN; PAM sequence: CTA
aggctagcaaaaggttgaga

SEQ ID NO: 59745 - DNA, 20 bp, Artificial Sequence
  Description of Artificial Sequence: Synthetic oligonucleotide
  Target: SCN10A; (+) strand; PAM type: YTN; PAM sequence: CTA
gcaaaaggttgagagtgaat

SEQ ID NO: 59746 - DNA, 20 bp, Artificial Sequence
  Description of Artificial Sequence: Synthetic oligonucleotide
  Target: SCN10A; (+) strand; PAM type: YTN; PAM sequence: TTG
agagtgaattactaatccac

SEQ ID NO: 59747 - DNA, 20 bp, Artificial Sequence
  Description of Artificial Sequence: Synthetic oligonucleotide
  Target: SCN10A; (+) strand; PAM type: YTN; PAM sequence: TTA
ctaatccactcttcttccat

SEQ ID NO: 59748 - DNA, 20 bp, Artificial Sequence
  Description of Artificial Sequence: Synthetic oligonucleotide
  Target: SCN10A; (+) strand; PAM type: YTN; PAM sequence: CTA
atccactcttcttccattca

SEQ ID NO: 59749 - DNA, 20 bp, Artificial Sequence
  Description of Artificial Sequence: Synthetic oligonucleotide
  Target: SCN10A; (+) strand; PAM type: YTN; PAM sequence: CTC
ttcttccattcaaaggatgg

SEQ ID NO: 59750 - DNA, 20 bp, Artificial Sequence
  Description of Artificial Sequence: Synthetic oligonucleotide
  Target: SCN10A; (+) strand; PAM type: YTN; PAM sequence: CTT
cttccattcaaaggatggag

SEQ ID NO: 59751 - DNA, 20 bp, Artificial Sequence
  Description of Artificial Sequence: Synthetic oligonucleotide
  Target: SCN10A; (+) strand; PAM type: YTN; PAM sequence: TTC
ttccattcaaaggatggaga

SEQ ID NO: 59752 - DNA, 20 bp, Artificial Sequence
  Description of Artificial Sequence: Synthetic oligonucleotide
  Target: SCN10A; (+) strand; PAM type: YTN; PAM sequence: CTT
ccattcaaaggatggagaat

SEQ ID NO: 59753 - DNA, 20 bp, Artificial Sequence
  Description of Artificial Sequence: Synthetic oligonucleotide
  Target: SCN10A; (+) strand; PAM type: YTN; PAM sequence: TTC
cattcaaaggatggagaatc

SEQ ID NO: 59754 - DNA, 20 bp, Artificial Sequence
  Description of Artificial Sequence: Synthetic oligonucleotide
  Target: SCN10A; (+) strand; PAM type: YTN; PAM sequence: TTC
aaaggatggagaatctcagg

SEQ ID NO: 59755 - DNA, 20 bp, Artificial Sequence
  Description of Artificial Sequence: Synthetic oligonucleotide
  Target: SCN10A; (+) strand; PAM type: YTN; PAM sequence: CTC
aggaacagaattggttatga

SEQ ID NO: 59756 - DNA, 20 bp, Artificial Sequence
  Description of Artificial Sequence: Synthetic oligonucleotide
  Target: SCN10A; (+) strand; PAM type: YTN; PAM sequence: TTG
gttatgaggtttcacttccc

SEQ ID NO: 59757 - DNA, 20 bp, Artificial Sequence
  Description of Artificial Sequence: Synthetic oligonucleotide
  Target: SCN10A; (+) strand; PAM type: YTN; PAM sequence: TTA
tgaggtttcacttcccctcc

SEQ ID NO: 59758 - DNA, 20 bp, Artificial Sequence
  Description of Artificial Sequence: Synthetic oligonucleotide
  Target: SCN10A; (+) strand; PAM type: YTN; PAM sequence: TTT
cacttcccctccacatgtgg

SEQ ID NO: 59759 - DNA, 20 bp, Artificial Sequence
  Description of Artificial Sequence: Synthetic oligonucleotide
  Target: SCN10A; (+) strand; PAM type: YTN; PAM sequence: TTC
acttcccctccacatgtgga

SEQ ID NO: 59760 - DNA, 20 bp, Artificial Sequence
  Description of Artificial Sequence: Synthetic oligonucleotide
  Target: SCN10A; (+) strand; PAM type: YTN; PAM sequence: CTT
cccctccacatgtggaggtc

SEQ ID NO: 59761 - DNA, 20 bp, Artificial Sequence
  Description of Artificial Sequence: Synthetic oligonucleotide
  Target: SCN10A; (+) strand; PAM type: YTN; PAM sequence: TTC
ccctccacatgtggaggtct

SEQ ID NO: 59762 - DNA, 20 bp, Artificial Sequence
  Description of Artificial Sequence: Synthetic oligonucleotide
  Target: SCN10A; (+) strand; PAM type: YTN; PAM sequence: CTC
cacatgtggaggtctccccc

SEQ ID NO: 59763 - DNA, 20 bp, Artificial Sequence
  Description of Artificial Sequence: Synthetic oligonucleotide
  Target: SCN10A; (+) strand; PAM type: YTN; PAM sequence: CTC
cccctgtgccatcctcggag

SEQ ID NO: 59764 - DNA, 20 bp, Artificial Sequence
  Description of Artificial Sequence: Synthetic oligonucleotide
  Target: SCN10A; (+) strand; PAM type: YTN; PAM sequence: CTG
tgccatcctcggaggatctt

SEQ ID NO: 59765 - DNA, 20 bp, Artificial Sequence
  Description of Artificial Sequence: Synthetic oligonucleotide
  Target: SCN10A; (+) strand; PAM type: YTN; PAM sequence: CTC
ggaggatcttagttgcagct

SEQ ID NO: 59766 - DNA, 20 bp, Artificial Sequence
  Description of Artificial Sequence: Synthetic oligonucleotide
  Target: SCN10A; (+) strand; PAM type: YTN; PAM sequence: CTT
agttgcagcttaattaggag

SEQ ID NO: 59767 - DNA, 20 bp, Artificial Sequence
  Description of Artificial Sequence: Synthetic oligonucleotide
  Target: SCN10A; (+) strand; PAM type: YTN; PAM sequence: TTA
gttgcagcttaattaggaga

SEQ ID NO: 59768 - DNA, 20 bp, Artificial Sequence
  Description of Artificial Sequence: Synthetic oligonucleotide
  Target: SCN10A; (+) strand; PAM type: YTN; PAM sequence: TTG
cagcttaattaggagaaatg

SEQ ID NO: 59769 - DNA, 20 bp, Artificial Sequence
  Description of Artificial Sequence: Synthetic oligonucleotide
  Target: SCN10A; (+) strand; PAM type: YTN; PAM sequence: CTT
aattaggagaaatggtgatt

SEQ ID NO: 59770 - DNA, 20 bp, Artificial Sequence
  Description of Artificial Sequence: Synthetic oligonucleotide
  Target: SCN10A; (+) strand; PAM type: YTN; PAM sequence: TTA
attaggagaaatggtgattt

SEQ ID NO: 59771 - DNA, 20 bp, Artificial Sequence
  Description of Artificial Sequence: Synthetic oligonucleotide
  Target: SCN10A; (+) strand; PAM type: YTN; PAM sequence: TTA
ggagaaatggtgattttgtt

SEQ ID NO: 59772 - DNA, 20 bp, Artificial Sequence
  Description of Artificial Sequence: Synthetic oligonucleotide
  Target: SCN10A; (+) strand; PAM type: YTN; PAM sequence: TTT
tgttgcaggtcttcctgcct

SEQ ID NO: 59773 - DNA, 20 bp, Artificial Sequence
  Description of Artificial Sequence: Synthetic oligonucleotide
  Target: SCN10A; (+) strand; PAM type: YTN; PAM sequence: TTT
gttgcaggtcttcctgcctg

SEQ ID NO: 59774 - DNA, 20 bp, Artificial Sequence
  Description of Artificial Sequence: Synthetic oligonucleotide
  Target: SCN10A; (+) strand; PAM type: YTN; PAM sequence: TTG
ttgcaggtcttcctgcctga

SEQ ID NO: 59775 - DNA, 20 bp, Artificial Sequence
  Description of Artificial Sequence: Synthetic oligonucleotide
  Target: SCN10A; (+) strand; PAM type: YTN; PAM sequence: TTG
caggtcttcctgcctgacca

SEQ ID NO: 59776 - DNA, 20 bp, Artificial Sequence
  Description of Artificial Sequence: Synthetic oligonucleotide
  Target: SCN10A; (+) strand; PAM type: YTN; PAM sequence: CTT
cctgcctgaccatcaactcc

SEQ ID NO: 59777 - DNA, 20 bp, Artificial Sequence
  Description of Artificial Sequence: Synthetic oligonucleotide
  Target: SCN10A; (+) strand; PAM type: YTN; PAM sequence: TTC
ctgcctgaccatcaactccg

SEQ ID NO: 59778 - DNA, 20 bp, Artificial Sequence
  Description of Artificial Sequence: Synthetic oligonucleotide
  Target: SCN10A; (+) strand; PAM type: YTN; PAM sequence: CTG
cctgaccatcaactccgtct

SEQ ID NO: 59779 - DNA, 20 bp, Artificial Sequence
  Description of Artificial Sequence: Synthetic oligonucleotide
  Target: SCN10A; (+) strand; PAM type: YTN; PAM sequence: CTG
accatcaactccgtctccca

SEQ ID NO: 59780 - DNA, 20 bp, Artificial Sequence
  Description of Artificial Sequence: Synthetic oligonucleotide
  Target: SCN10A; (+) strand; PAM type: YTN; PAM sequence: CTC
cgtctcccactcctatttac

SEQ ID NO: 59781 - DNA, 20 bp, Artificial Sequence
  Description of Artificial Sequence: Synthetic oligonucleotide
  Target: SCN10A; (+) strand; PAM type: YTN; PAM sequence: CTC
ccactcctatttactgcctg

SEQ ID NO: 59782 - DNA, 20 bp, Artificial Sequence
  Description of Artificial Sequence: Synthetic oligonucleotide
  Target: SCN10A; (+) strand; PAM type: YTN; PAM sequence: CTC
ctatttactgcctggaattt

SEQ ID NO: 59783 - DNA, 20 bp, Artificial Sequence
  Description of Artificial Sequence: Synthetic oligonucleotide
  Target: SCN10A; (+) strand; PAM type: YTN; PAM sequence: CTA
tttactgcctggaatttcaa

SEQ ID NO: 59784 - DNA, 20 bp, Artificial Sequence
  Description of Artificial Sequence: Synthetic oligonucleotide
  Target: SCN10A; (+) strand; PAM type: YTN; PAM sequence: TTT
actgcctggaatttcaacat

SEQ ID NO: 59785 - DNA, 20 bp, Artificial Sequence
  Description of Artificial Sequence: Synthetic oligonucleotide
  Target: SCN10A; (+) strand; PAM type: YTN; PAM sequence: TTA
ctgcctggaatttcaacatt

SEQ ID NO: 59786 - DNA, 20 bp, Artificial Sequence
  Description of Artificial Sequence: Synthetic oligonucleotide
  Target: SCN10A; (+) strand; PAM type: YTN; PAM sequence: CTG
cctggaatttcaacattagg

SEQ ID NO: 59787 - DNA, 20 bp, Artificial Sequence
  Description of Artificial Sequence: Synthetic oligonucleotide
  Target: SCN10A; (+) strand; PAM type: YTN; PAM sequence: CTG
gaatttcaacattagggtca

SEQ ID NO: 59788 - DNA, 20 bp, Artificial Sequence
  Description of Artificial Sequence: Synthetic oligonucleotide
  Target: SCN10A; (+) strand; PAM type: YTN; PAM sequence: TTT
caacattagggtcatgcctt

SEQ ID NO: 59789 - DNA, 20 bp, Artificial Sequence
  Description of Artificial Sequence: Synthetic oligonucleotide
  Target: SCN10A; (+) strand; PAM type: YTN; PAM sequence: TTC
aacattagggtcatgccttt

SEQ ID NO: 59790 - DNA, 20 bp, Artificial Sequence
  Description of Artificial Sequence: Synthetic oligonucleotide
  Target: SCN10A; (+) strand; PAM type: YTN; PAM sequence: TTA
gggtcatgcctttgtaggta

SEQ ID NO: 59791 - DNA, 20 bp, Artificial Sequence
  Description of Artificial Sequence: Synthetic oligonucleotide
  Target: SCN10A; (+) strand; PAM type: YTN; PAM sequence: CTT
tgtaggtagatgccctctcc

SEQ ID NO: 59792 - DNA, 20 bp, Artificial Sequence
  Description of Artificial Sequence: Synthetic oligonucleotide
  Target: SCN10A; (+) strand; PAM type: YTN; PAM sequence: TTT
gtaggtagatgccctctcca

SEQ ID NO: 59793 - DNA, 20 bp, Artificial Sequence
  Description of Artificial Sequence: Synthetic oligonucleotide
  Target: SCN10A; (+) strand; PAM type: YTN; PAM sequence: TTG
taggtagatgccctctccag

SEQ ID NO: 59794 - DNA, 20 bp, Artificial Sequence
  Description of Artificial Sequence: Synthetic oligonucleotide
  Target: SCN10A; (+) strand; PAM type: YTN; PAM sequence: CTC
tccagggtccctttttgaaa

SEQ ID NO: 59795 - DNA, 20 bp, Artificial Sequence
  Description of Artificial Sequence: Synthetic oligonucleotide
  Target: SCN10A; (+) strand; PAM type: YTN; PAM sequence: CTC
cagggtccctttttgaaata

SEQ ID NO: 59796 - DNA, 20 bp, Artificial Sequence
  Description of Artificial Sequence: Synthetic oligonucleotide
  Target: SCN10A; (+) strand; PAM type: YTN; PAM sequence: CTT
tttgaaatatgatttatctt

SEQ ID NO: 59797 - DNA, 20 bp, Artificial Sequence
  Description of Artificial Sequence: Synthetic oligonucleotide
  Target: SCN10A; (+) strand; PAM type: YTN; PAM sequence: TTT
ttgaaatatgatttatcttg

SEQ ID NO: 59798 - DNA, 20 bp, Artificial Sequence
  Description of Artificial Sequence: Synthetic oligonucleotide
  Target: SCN10A; (+) strand; PAM type: YTN; PAM sequence: TTT
tgaaatatgatttatcttgt

SEQ ID NO: 59799 - DNA, 20 bp, Artificial Sequence
  Description of Artificial Sequence: Synthetic oligonucleotide
  Target: SCN10A; (+) strand; PAM type: YTN; PAM sequence: TTT
gaaatatgatttatcttgtc

SEQ ID NO: 59800 - DNA, 20 bp, Artificial Sequence
  Description of Artificial Sequence: Synthetic oligonucleotide
  Target: SCN10A; (+) strand; PAM type: YTN; PAM sequence: TTG
aaatatgatttatcttgtcc

SEQ ID NO: 59801 - DNA, 20 bp, Artificial Sequence
  Description of Artificial Sequence: Synthetic oligonucleotide
  Target: SCN10A; (+) strand; PAM type: YTN; PAM sequence: TTT
atcttgtcctaagaatgttg

SEQ ID NO: 59802 - DNA, 20 bp, Artificial Sequence
  Description of Artificial Sequence: Synthetic oligonucleotide
  Target: SCN10A; (+) strand; PAM type: YTN; PAM sequence: TTA
tcttgtcctaagaatgttgt

SEQ ID NO: 59803 - DNA, 20 bp, Artificial Sequence
  Description of Artificial Sequence: Synthetic oligonucleotide
  Target: SCN10A; (+) strand; PAM type: YTN; PAM sequence: CTT
gtcctaagaatgttgtcttc

SEQ ID NO: 59804 - DNA, 20 bp, Artificial Sequence
  Description of Artificial Sequence: Synthetic oligonucleotide
  Target: SCN10A; (+) strand; PAM type: YTN; PAM sequence: TTG
tcctaagaatgttgtcttcc

SEQ ID NO: 59805 - DNA, 20 bp, Artificial Sequence
  Description of Artificial Sequence: Synthetic oligonucleotide
  Target: SCN10A; (+) strand; PAM type: YTN; PAM sequence: CTA
agaatgttgtcttccttgag

SEQ ID NO: 59806 - DNA, 20 bp, Artificial Sequence
  Description of Artificial Sequence: Synthetic oligonucleotide
  Target: SCN10A; (+) strand; PAM type: YTN; PAM sequence: TTG
tcttccttgaggggaggaag

SEQ ID NO: 59807 - DNA, 20 bp, Artificial Sequence
  Description of Artificial Sequence: Synthetic oligonucleotide
  Target: SCN10A; (+) strand; PAM type: YTN; PAM sequence: CTT
ccttgaggggaggaagcttt

SEQ ID NO: 59808 - DNA, 20 bp, Artificial Sequence
  Description of Artificial Sequence: Synthetic oligonucleotide
  Target: SCN10A; (+) strand; PAM type: YTN; PAM sequence: TTC
cttgaggggaggaagctttc

SEQ ID NO: 59809 - DNA, 20 bp, Artificial Sequence
  Description of Artificial Sequence: Synthetic oligonucleotide
  Target: SCN10A; (+) strand; PAM type: YTN; PAM sequence: CTT
gaggggaggaagctttcttt

SEQ ID NO: 59810 - DNA, 20 bp, Artificial Sequence
  Description of Artificial Sequence: Synthetic oligonucleotide
  Target: SCN10A; (+) strand; PAM type: YTN; PAM sequence: TTG
aggggaggaagctttctttg

SEQ ID NO: 59811 - DNA, 20 bp, Artificial Sequence
  Description of Artificial Sequence: Synthetic oligonucleotide
  Target: SCN10A; (+) strand; PAM type: YTN; PAM sequence: CTT
tctttggcagcctatggggt

SEQ ID NO: 59812 - DNA, 20 bp, Artificial Sequence
  Description of Artificial Sequence: Synthetic oligonucleotide
  Target: SCN10A; (+) strand; PAM type: YTN; PAM sequence: TTT
ctttggcagcctatggggtt

SEQ ID NO: 59813 - DNA, 20 bp, Artificial Sequence
  Description of Artificial Sequence: Synthetic oligonucleotide
  Target: SCN10A; (+) strand; PAM type: YTN; PAM sequence: TTC
tttggcagcctatggggttg

SEQ ID NO: 59814 - DNA, 20 bp, Artificial Sequence
  Description of Artificial Sequence: Synthetic oligonucleotide
  Target: SCN10A; (+) strand; PAM type: YTN; PAM sequence: CTT
tggcagcctatggggttggg

SEQ ID NO: 59815 - DNA, 20 bp, Artificial Sequence
  Description of Artificial Sequence: Synthetic oligonucleotide
  Target: SCN10A; (+) strand; PAM type: YTN; PAM sequence: TTT
ggcagcctatggggttgggt

SEQ ID NO: 59816 - DNA, 20 bp, Artificial Sequence
  Description of Artificial Sequence: Synthetic oligonucleotide
  Target: SCN10A; (+) strand; PAM type: YTN; PAM sequence: TTG
gcagcctatggggttgggtg

SEQ ID NO: 59817 - DNA, 20 bp, Artificial Sequence
  Description of Artificial Sequence: Synthetic oligonucleotide
  Target: SCN10A; (+) strand; PAM type: YTN; PAM sequence: CTA
tggggttgggtgatgacagg

SEQ ID NO: 59818 - DNA, 20 bp, Artificial Sequence
  Description of Artificial Sequence: Synthetic oligonucleotide
  Target: SCN10A; (+) strand; PAM type: YTN; PAM sequence: TTG
ggtgatgacagggaagaagc

SEQ ID NO: 59819 - DNA, 20 bp, Artificial Sequence
  Description of Artificial Sequence: Synthetic oligonucleotide
  Target: SCN10A; (+) strand; PAM type: YTN; PAM sequence: CTG
ggatgtcaaagagagattga

SEQ ID NO: 59820 - DNA, 20 bp, Artificial Sequence
  Description of Artificial Sequence: Synthetic oligonucleotide
  Target: SCN10A; (+) strand; PAM type: YTN; PAM sequence: TTG
agtagtatgtgggggaaggt

SEQ ID NO: 59821 - DNA, 20 bp, Artificial Sequence
  Description of Artificial Sequence: Synthetic oligonucleotide
  Target: SCN10A; (+) strand; PAM type: YTN; PAM sequence: CTT
tcatgtttttgccaagggtt

SEQ ID NO: 59822 - DNA, 20 bp, Artificial Sequence
  Description of Artificial Sequence: Synthetic oligonucleotide
  Target: SCN10A; (+) strand; PAM type: YTN; PAM sequence: TTT
catgtttttgccaagggttg

SEQ ID NO: 59823 - DNA, 20 bp, Artificial Sequence
  Description of Artificial Sequence: Synthetic oligonucleotide
  Target: SCN10A; (+) strand; PAM type: YTN; PAM sequence: TTC
atgtttttgccaagggttgt

SEQ ID NO: 59824 - DNA, 20 bp, Artificial Sequence
  Description of Artificial Sequence: Synthetic oligonucleotide
  Target: SCN10A; (+) strand; PAM type: YTN; PAM sequence: TTT
ttgccaagggttgtccctag

SEQ ID NO: 59825 - DNA, 20 bp, Artificial Sequence
  Description of Artificial Sequence: Synthetic oligonucleotide
  Target: SCN10A; (+) strand; PAM type: YTN; PAM sequence: TTT
tgccaagggttgtccctagc

SEQ ID NO: 59826 - DNA, 20 bp, Artificial Sequence
  Description of Artificial Sequence: Synthetic oligonucleotide
  Target: SCN10A; (+) strand; PAM type: YTN; PAM sequence: TTT
gccaagggttgtccctagca

SEQ ID NO: 59827 - DNA, 20 bp, Artificial Sequence
  Description of Artificial Sequence: Synthetic oligonucleotide
  Target: SCN10A; (+) strand; PAM type: YTN; PAM sequence: TTG
ccaagggttgtccctagcac

SEQ ID NO: 59828 - DNA, 20 bp, Artificial Sequence
  Description of Artificial Sequence: Synthetic oligonucleotide
  Target: SCN10A; (+) strand; PAM type: YTN; PAM sequence: TTG
tccctagcacacacctcctt

SEQ ID NO: 59829 - DNA, 20 bp, Artificial Sequence
  Description of Artificial Sequence: Synthetic oligonucleotide
  Target: SCN10A; (+) strand; PAM type: YTN; PAM sequence: CTA
gcacacacctccttggcatc

SEQ ID NO: 59830 - DNA, 20 bp, Artificial Sequence
  Description of Artificial Sequence: Synthetic oligonucleotide
  Target: SCN10A; (+) strand; PAM type: YTN; PAM sequence: CTC
cttggcatctggctcaaatg

SEQ ID NO: 59831 - DNA, 20 bp, Artificial Sequence
  Description of Artificial Sequence: Synthetic oligonucleotide
  Target: SCN10A; (+) strand; PAM type: YTN; PAM sequence: CTT
ggcatctggctcaaatgtgg

SEQ ID NO: 59832 - DNA, 20 bp, Artificial Sequence
  Description of Artificial Sequence: Synthetic oligonucleotide
  Target: SCN10A; (+) strand; PAM type: YTN; PAM sequence: TTG
gcatctggctcaaatgtgga

SEQ ID NO: 59833 - DNA, 20 bp, Artificial Sequence
  Description of Artificial Sequence: Synthetic oligonucleotide
  Target: SCN10A; (+) strand; PAM type: YTN; PAM sequence: CTG
gctcaaatgtggattcaatc

SEQ ID NO: 59834 - DNA, 20 bp, Artificial Sequence
  Description of Artificial Sequence: Synthetic oligonucleotide
  Target: SCN10A; (+) strand; PAM type: YTN; PAM sequence: CTC
aaatgtggattcaatcttac

SEQ ID NO: 59835 - DNA, 20 bp, Artificial Sequence
  Description of Artificial Sequence: Synthetic oligonucleotide
  Target: SCN10A; (+) strand; PAM type: YTN; PAM sequence: TTC
aatcttactccagccacaag

SEQ ID NO: 59836 - DNA, 20 bp, Artificial Sequence
  Description of Artificial Sequence: Synthetic oligonucleotide
  Target: SCN10A; (+) strand; PAM type: YTN; PAM sequence: CTT
actccagccacaagtaaagg

SEQ ID NO: 59837 - DNA, 20 bp, Artificial Sequence
  Description of Artificial Sequence: Synthetic oligonucleotide
  Target: SCN10A; (+) strand; PAM type: YTN; PAM sequence: TTA
ctccagccacaagtaaaggc

SEQ ID NO: 59838 - DNA, 20 bp, Artificial Sequence
  Description of Artificial Sequence: Synthetic oligonucleotide
  Target: SCN10A; (+) strand; PAM type: YTN; PAM sequence: CTC
cagccacaagtaaaggccag

SEQ ID NO: 59839 - DNA, 20 bp, Artificial Sequence
  Description of Artificial Sequence: Synthetic oligonucleotide
  Target: SCN10A; (+) strand; PAM type: YTN; PAM sequence: CTC
agctgcttgcttctcagtaa

SEQ ID NO: 59840 - DNA, 20 bp, Artificial Sequence
  Description of Artificial Sequence: Synthetic oligonucleotide
  Target: SCN10A; (+) strand; PAM type: YTN; PAM sequence: CTG
cttgcttctcagtaagtctt

SEQ ID NO: 59841 - DNA, 20 bp, Artificial Sequence
  Description of Artificial Sequence: Synthetic oligonucleotide
  Target: SCN10A; (+) strand; PAM type: YTN; PAM sequence: CTT
gcttctcagtaagtcttagg

SEQ ID NO: 59842 - DNA, 20 bp, Artificial Sequence
  Description of Artificial Sequence: Synthetic oligonucleotide
  Target: SCN10A; (+) strand; PAM type: YTN; PAM sequence: TTG
cttctcagtaagtcttaggg

SEQ ID NO: 59843 - DNA, 20 bp, Artificial Sequence
  Description of Artificial Sequence: Synthetic oligonucleotide
  Target: SCN10A; (+) strand; PAM type: YTN; PAM sequence: CTT
ctcagtaagtcttagggtcc

SEQ ID NO: 59844 - DNA, 20 bp, Artificial Sequence
  Description of Artificial Sequence: Synthetic oligonucleotide
  Target: SCN10A; (+) strand; PAM type: YTN; PAM sequence: TTC
tcagtaagtcttagggtcct

SEQ ID NO: 59845 - DNA, 20 bp, Artificial Sequence
  Description of Artificial Sequence: Synthetic oligonucleotide
  Target: SCN10A; (+) strand; PAM type: YTN; PAM sequence: CTC
agtaagtcttagggtcctcc

SEQ ID NO: 59846 - DNA, 20 bp, Artificial Sequence
  Description of Artificial Sequence: Synthetic oligonucleotide
  Target: SCN10A; (+) strand; PAM type: YTN; PAM sequence: CTT
agggtcctcctctcattacc

SEQ ID NO: 59847 - DNA, 20 bp, Artificial Sequence
  Description of Artificial Sequence: Synthetic oligonucleotide
  Target: SCN10A; (+) strand; PAM type: YTN; PAM sequence: TTA
gggtcctcctctcattaccc

SEQ ID NO: 59848 - DNA, 20 bp, Artificial Sequence
  Description of Artificial Sequence: Synthetic oligonucleotide
  Target: SCN10A; (+) strand; PAM type: YTN; PAM sequence: CTC
ctctcattacccatgacttg

SEQ ID NO: 59849 - DNA, 20 bp, Artificial Sequence
  Description of Artificial Sequence: Synthetic oligonucleotide
  Target: SCN10A; (+) strand; PAM type: YTN; PAM sequence: CTC
tcattacccatgacttgaat

SEQ ID NO: 59850 - DNA, 20 bp, Artificial Sequence
  Description of Artificial Sequence: Synthetic oligonucleotide
  Target: SCN10A; (+) strand; PAM type: YTN; PAM sequence: CTC
attacccatgacttgaatgt

SEQ ID NO: 59851 - DNA, 20 bp, Artificial Sequence
  Description of Artificial Sequence: Synthetic oligonucleotide
  Target: SCN10A; (+) strand; PAM type: YTN; PAM sequence: TTA
cccatgacttgaatgtggtt

SEQ ID NO: 59852 - DNA, 20 bp, Artificial Sequence
  Description of Artificial Sequence: Synthetic oligonucleotide
  Target: SCN10A; (+) strand; PAM type: YTN; PAM sequence: CTT
gaatgtggttgggactcagc

SEQ ID NO: 59853 - DNA, 20 bp, Artificial Sequence
  Description of Artificial Sequence: Synthetic oligonucleotide
  Target: SCN10A; (+) strand; PAM type: YTN; PAM sequence: TTG
aatgtggttgggactcagcc

SEQ ID NO: 59854 - DNA, 20 bp, Artificial Sequence
  Description of Artificial Sequence: Synthetic oligonucleotide
  Target: SCN10A; (+) strand; PAM type: YTN; PAM sequence: TTG
ggactcagcctttcacctaa

SEQ ID NO: 59855 - DNA, 20 bp, Artificial Sequence
  Description of Artificial Sequence: Synthetic oligonucleotide
  Target: SCN10A; (+) strand; PAM type: YTN; PAM sequence: CTC
agcctttcacctaattttaa

SEQ ID NO: 59856 - DNA, 20 bp, Artificial Sequence
  Description of Artificial Sequence: Synthetic oligonucleotide
  Target: SCN10A; (+) strand; PAM type: YTN; PAM sequence: CTT
tcacctaattttaattttga

SEQ ID NO: 59857 - DNA, 20 bp, Artificial Sequence
  Description of Artificial Sequence: Synthetic oligonucleotide
  Target: SCN10A; (+) strand; PAM type: YTN; PAM sequence: TTT
cacctaattttaattttgag

SEQ ID NO: 59858 - DNA, 20 bp, Artificial Sequence
  Description of Artificial Sequence: Synthetic oligonucleotide
  Target: SCN10A; (+) strand; PAM type: YTN; PAM sequence: TTC
acctaattttaattttgagc

SEQ ID NO: 59859 - DNA, 20 bp, Artificial Sequence
  Description of Artificial Sequence: Synthetic oligonucleotide
  Target: SCN10A; (+) strand; PAM type: YTN; PAM sequence: CTA
attttaattttgagcctgct

SEQ ID NO: 59860 - DNA, 20 bp, Artificial Sequence
  Description of Artificial Sequence: Synthetic oligonucleotide
  Target: SCN10A; (+) strand; PAM type: YTN; PAM sequence: TTT
taattttgagcctgctcctc

SEQ ID NO: 59861 - DNA, 20 bp, Artificial Sequence
  Description of Artificial Sequence: Synthetic oligonucleotide
  Target: SCN10A; (+) strand; PAM type: YTN; PAM sequence: TTT
aattttgagcctgctcctct

SEQ ID NO: 59862 - DNA, 20 bp, Artificial Sequence
  Description of Artificial Sequence: Synthetic oligonucleotide
  Target: SCN10A; (+) strand; PAM type: YTN; PAM sequence: TTA
attttgagcctgctcctctc

SEQ ID NO: 59863 - DNA, 20 bp, Artificial Sequence
  Description of Artificial Sequence: Synthetic oligonucleotide
  Target: SCN10A; (+) strand; PAM type: YTN; PAM sequence: TTT
tgagcctgctcctctccact

SEQ ID NO: 59864 - DNA, 20 bp, Artificial Sequence
  Description of Artificial Sequence: Synthetic oligonucleotide
  Target: SCN10A; (+) strand; PAM type: YTN; PAM sequence: TTT
gagcctgctcctctccactg

SEQ ID NO: 59865 - DNA, 20 bp, Artificial Sequence
  Description of Artificial Sequence: Synthetic oligonucleotide
  Target: SCN10A; (+) strand; PAM type: YTN; PAM sequence: TTG
agcctgctcctctccactga

SEQ ID NO: 59866 - DNA, 20 bp, Artificial Sequence
  Description of Artificial Sequence: Synthetic oligonucleotide
  Target: SCN10A; (+) strand; PAM type: YTN; PAM sequence: CTG
ctcctctccactgaacttgt

SEQ ID NO: 59867 - DNA, 20 bp, Artificial Sequence
  Description of Artificial Sequence: Synthetic oligonucleotide
  Target: SCN10A; (+) strand; PAM type: YTN; PAM sequence: CTC
ctctccactgaacttgttga

SEQ ID NO: 59868 - DNA, 20 bp, Artificial Sequence
  Description of Artificial Sequence: Synthetic oligonucleotide
  Target: SCN10A; (+) strand; PAM type: YTN; PAM sequence: CTC
tccactgaacttgttgatgg

SEQ ID NO: 59869 - DNA, 20 bp, Artificial Sequence
  Description of Artificial Sequence: Synthetic oligonucleotide
  Target: SCN10A; (+) strand; PAM type: YTN; PAM sequence: CTC
cactgaacttgttgatggag

SEQ ID NO: 59870 - DNA, 20 bp, Artificial Sequence
  Description of Artificial Sequence: Synthetic oligonucleotide
  Target: SCN10A; (+) strand; PAM type: YTN; PAM sequence: CTG
aacttgttgatggagggata

SEQ ID NO: 59871 - DNA, 20 bp, Artificial Sequence
  Description of Artificial Sequence: Synthetic oligonucleotide
  Target: SCN10A; (+) strand; PAM type: YTN; PAM sequence: CTT
gttgatggagggatactcaa

SEQ ID NO: 59872 - DNA, 20 bp, Artificial Sequence
  Description of Artificial Sequence: Synthetic oligonucleotide
  Target: SCN10A; (+) strand; PAM type: YTN; PAM sequence: TTG
ttgatggagggatactcaat

SEQ ID NO: 59873 - DNA, 20 bp, Artificial Sequence
  Description of Artificial Sequence: Synthetic oligonucleotide
  Target: SCN10A; (+) strand; PAM type: YTN; PAM sequence: TTG
atggagggatactcaatgag

SEQ ID NO: 59874 - DNA, 20 bp, Artificial Sequence
  Description of Artificial Sequence: Synthetic oligonucleotide
  Target: SCN10A; (+) strand; PAM type: YTN; PAM sequence: CTC
aatgagcctaaggacttttg

SEQ ID NO: 59875 - DNA, 20 bp, Artificial Sequence
  Description of Artificial Sequence: Synthetic oligonucleotide
  Target: SCN10A; (+) strand; PAM type: YTN; PAM sequence: CTA
aggacttttgctcaggttca

SEQ ID NO: 59876 - DNA, 20 bp, Artificial Sequence
  Description of Artificial Sequence: Synthetic oligonucleotide
  Target: SCN10A; (+) strand; PAM type: YTN; PAM sequence: CTT
ttgctcaggttcactcaaat

SEQ ID NO: 59877 - DNA, 20 bp, Artificial Sequence
  Description of Artificial Sequence: Synthetic oligonucleotide
  Target: SCN10A; (+) strand; PAM type: YTN; PAM sequence: TTT
tgctcaggttcactcaaatc

SEQ ID NO: 59878 - DNA, 20 bp, Artificial Sequence
  Description of Artificial Sequence: Synthetic oligonucleotide
  Target: SCN10A; (+) strand; PAM type: YTN; PAM sequence: TTT
gctcaggttcactcaaatcc

SEQ ID NO: 59879 - DNA, 20 bp, Artificial Sequence
  Description of Artificial Sequence: Synthetic oligonucleotide
  Target: SCN10A; (+) strand; PAM type: YTN; PAM sequence: TTG
ctcaggttcactcaaatcca

SEQ ID NO: 59880 - DNA, 20 bp, Artificial Sequence
  Description of Artificial Sequence: Synthetic oligonucleotide
  Target: SCN10A; (+) strand; PAM type: YTN; PAM sequence: CTC
aggttcactcaaatccagtt

SEQ ID NO: 59881 - DNA, 20 bp, Artificial Sequence
  Description of Artificial Sequence: Synthetic oligonucleotide
  Target: SCN10A; (+) strand; PAM type: YTN; PAM sequence: TTC
actcaaatccagttatcttg

SEQ ID NO: 59882 - DNA, 20 bp, Artificial Sequence
  Description of Artificial Sequence: Synthetic oligonucleotide
  Target: SCN10A; (+) strand; PAM type: YTN; PAM sequence: CTC
aaatccagttatcttgattg

SEQ ID NO: 59883 - DNA, 20 bp, Artificial Sequence
  Description of Artificial Sequence: Synthetic oligonucleotide
  Target: SCN10A; (+) strand; PAM type: YTN; PAM sequence: TTA
tcttgattgtatgggtgatt

SEQ ID NO: 59884 - DNA, 20 bp, Artificial Sequence
  Description of Artificial Sequence: Synthetic oligonucleotide
  Target: SCN10A; (+) strand; PAM type: YTN; PAM sequence: CTT
gattgtatgggtgatttagg

SEQ ID NO: 59885 - DNA, 20 bp, Artificial Sequence
  Description of Artificial Sequence: Synthetic oligonucleotide
  Target: SCN10A; (+) strand; PAM type: YTN; PAM sequence: TTG
attgtatgggtgatttagga

SEQ ID NO: 59886 - DNA, 20 bp, Artificial Sequence
  Description of Artificial Sequence: Synthetic oligonucleotide
  Target: SCN10A; (+) strand; PAM type: YTN; PAM sequence: TTG
tatgggtgatttaggaagaa

SEQ ID NO: 59887 - DNA, 20 bp, Artificial Sequence
  Description of Artificial Sequence: Synthetic oligonucleotide
  Target: SCN10A; (+) strand; PAM type: YTN; PAM sequence: TTT
aggaagaaagctgtgcccct

SEQ ID NO: 59888 - DNA, 20 bp, Artificial Sequence
  Description of Artificial Sequence: Synthetic oligonucleotide
  Target: SCN10A; (+) strand; PAM type: YTN; PAM sequence: TTA
ggaagaaagctgtgccccta

SEQ ID NO: 59889 - DNA, 20 bp, Artificial Sequence
  Description of Artificial Sequence: Synthetic oligonucleotide
  Target: SCN10A; (+) strand; PAM type: YTN; PAM sequence: CTG
tgcccctacagaggtctgaa

SEQ ID NO: 59890 - DNA, 20 bp, Artificial Sequence
  Description of Artificial Sequence: Synthetic oligonucleotide
  Target: SCN10A; (+) strand; PAM type: YTN; PAM sequence: CTA
cagaggtctgaacctcctat

SEQ ID NO: 59891 - DNA, 20 bp, Artificial Sequence
  Description of Artificial Sequence: Synthetic oligonucleotide
  Target: SCN10A; (+) strand; PAM type: YTN; PAM sequence: CTG
aacctcctatcactccccac

SEQ ID NO: 59892 - DNA, 20 bp, Artificial Sequence
  Description of Artificial Sequence: Synthetic oligonucleotide
  Target: SCN10A; (+) strand; PAM type: YTN; PAM sequence: CTC
ctatcactccccactcccca

SEQ ID NO: 59893 - DNA, 20 bp, Artificial Sequence
  Description of Artificial Sequence: Synthetic oligonucleotide
  Target: SCN10A; (+) strand; PAM type: YTN; PAM sequence: CTA
tcactccccactccccattg

SEQ ID NO: 59894 - DNA, 20 bp, Artificial Sequence
  Description of Artificial Sequence: Synthetic oligonucleotide
  Target: SCN10A; (+) strand; PAM type: YTN; PAM sequence: CTC
cccactccccattgtaatac

SEQ ID NO: 59895 - DNA, 20 bp, Artificial Sequence
  Description of Artificial Sequence: Synthetic oligonucleotide
  Target: SCN10A; (+) strand; PAM type: YTN; PAM sequence: CTC
cccattgtaatacttcttat

SEQ ID NO: 59896 - DNA, 20 bp, Artificial Sequence
  Description of Artificial Sequence: Synthetic oligonucleotide
  Target: SCN10A; (+) strand; PAM type: YTN; PAM sequence: TTG
taatacttcttatcagaatc

SEQ ID NO: 59897 - DNA, 20 bp, Artificial Sequence
  Description of Artificial Sequence: Synthetic oligonucleotide
  Target: SCN10A; (+) strand; PAM type: YTN; PAM sequence: CTT
cttatcagaatctagactag

SEQ ID NO: 59898 - DNA, 20 bp, Artificial Sequence
  Description of Artificial Sequence: Synthetic oligonucleotide
  Target: SCN10A; (+) strand; PAM type: YTN; PAM sequence: TTC
ttatcagaatctagactagt

SEQ ID NO: 59899 - DNA, 20 bp, Artificial Sequence
  Description of Artificial Sequence: Synthetic oligonucleotide
  Target: SCN10A; (+) strand; PAM type: YTN; PAM sequence: CTT
atcagaatctagactagtaa

SEQ ID NO: 59900 - DNA, 20 bp, Artificial Sequence
  Description of Artificial Sequence: Synthetic oligonucleotide
  Target: SCN10A; (+) strand; PAM type: YTN; PAM sequence: TTA
tcagaatctagactagtaat

SEQ ID NO: 59901 - DNA, 20 bp, Artificial Sequence
  Description of Artificial Sequence: Synthetic oligonucleotide
  Target: SCN10A; (+) strand; PAM type: YTN; PAM sequence: CTA
gactagtaataaattcatga

SEQ ID NO: 59902 - DNA, 20 bp, Artificial Sequence
  Description of Artificial Sequence: Synthetic oligonucleotide
  Target: SCN10A; (+) strand; PAM type: YTN; PAM sequence: CTA
gtaataaattcatgaccact

SEQ ID NO: 59903 - DNA, 20 bp, Artificial Sequence
  Description of Artificial Sequence: Synthetic oligonucleotide
  Target: SCN10A; (+) strand; PAM type: YTN; PAM sequence: TTC
atgaccactatttcaaaata

SEQ ID NO: 59904 - DNA, 20 bp, Artificial Sequence
  Description of Artificial Sequence: Synthetic oligonucleotide
  Target: SCN10A; (+) strand; PAM type: YTN; PAM sequence: CTA
tttcaaaatacagtgtcaaa

SEQ ID NO: 59905 - DNA, 20 bp, Artificial Sequence
  Description of Artificial Sequence: Synthetic oligonucleotide
  Target: SCN10A; (+) strand; PAM type: YTN; PAM sequence: TTT
caaaatacagtgtcaaaagt

SEQ ID NO: 59906 - DNA, 20 bp, Artificial Sequence
  Description of Artificial Sequence: Synthetic oligonucleotide
  Target: SCN10A; (+) strand; PAM type: YTN; PAM sequence: TTC
aaaatacagtgtcaaaagtc

SEQ ID NO: 59907 - DNA, 20 bp, Artificial Sequence
  Description of Artificial Sequence: Synthetic oligonucleotide
  Target: SCN10A; (+) strand; PAM type: YTN; PAM sequence: CTT
ttttctcttgtaaatgtttt

SEQ ID NO: 59908 - DNA, 20 bp, Artificial Sequence
  Description of Artificial Sequence: Synthetic oligonucleotide
  Target: SCN10A; (+) strand; PAM type: YTN; PAM sequence: TTT
tttctcttgtaaatgttttt

SEQ ID NO: 59909 - DNA, 20 bp, Artificial Sequence
  Description of Artificial Sequence: Synthetic oligonucleotide
  Target: SCN10A; (+) strand; PAM type: YTN; PAM sequence: TTT
ttctcttgtaaatgtttttc

SEQ ID NO: 59910 - DNA, 20 bp, Artificial Sequence
  Description of Artificial Sequence: Synthetic oligonucleotide
  Target: SCN10A; (+) strand; PAM type: YTN; PAM sequence: TTT
tctcttgtaaatgtttttca

SEQ ID NO: 59911 - DNA, 20 bp, Artificial Sequence
  Description of Artificial Sequence: Synthetic oligonucleotide
  Target: SCN10A; (+) strand; PAM type: YTN; PAM sequence: TTT
ctcttgtaaatgtttttcac

SEQ ID NO: 59912 - DNA, 20 bp, Artificial Sequence
  Description of Artificial Sequence: Synthetic oligonucleotide
  Target: SCN10A; (+) strand; PAM type: YTN; PAM sequence: TTC
tcttgtaaatgtttttcact

SEQ ID NO: 59913 - DNA, 20 bp, Artificial Sequence
  Description of Artificial Sequence: Synthetic oligonucleotide
  Target: SCN10A; (+) strand; PAM type: YTN; PAM sequence: CTC
ttgtaaatgtttttcacttt

SEQ ID NO: 59914 - DNA, 20 bp, Artificial Sequence
  Description of Artificial Sequence: Synthetic oligonucleotide
  Target: SCN10A; (+) strand; PAM type: YTN; PAM sequence: CTT
gtaaatgtttttcactttgt

SEQ ID NO: 59915 - DNA, 20 bp, Artificial Sequence
  Description of Artificial Sequence: Synthetic oligonucleotide
  Target: SCN10A; (+) strand; PAM type: YTN; PAM sequence: TTG
taaatgtttttcactttgtt

SEQ ID NO: 59916 - DNA, 20 bp, Artificial Sequence
  Description of Artificial Sequence: Synthetic oligonucleotide
  Target: SCN10A; (+) strand; PAM type: YTN; PAM sequence: TTT
ttcactttgttctgacaaag

SEQ ID NO: 59917 - DNA, 20 bp, Artificial Sequence
  Description of Artificial Sequence: Synthetic oligonucleotide
  Target: SCN10A; (+) strand; PAM type: YTN; PAM sequence: TTT
tcactttgttctgacaaagt

SEQ ID NO: 59918 - DNA, 20 bp, Artificial Sequence
  Description of Artificial Sequence: Synthetic oligonucleotide
  Target: SCN10A; (+) strand; PAM type: YTN; PAM sequence: TTT
cactttgttctgacaaagtt

SEQ ID NO: 59919 - DNA, 20 bp, Artificial Sequence
  Description of Artificial Sequence: Synthetic oligonucleotide
  Target: SCN10A; (+) strand; PAM type: YTN; PAM sequence: TTC
actttgttctgacaaagttt

SEQ ID NO: 59920 - DNA, 20 bp, Artificial Sequence
  Description of Artificial Sequence: Synthetic oligonucleotide
  Target: SCN10A; (+) strand; PAM type: YTN; PAM sequence: CTT
tgttctgacaaagtttgaag

SEQ ID NO: 59921 - DNA, 20 bp, Artificial Sequence
  Description of Artificial Sequence: Synthetic oligonucleotide
  Target: SCN10A; (+) strand; PAM type: YTN; PAM sequence: TTT
gttctgacaaagtttgaagt

SEQ ID NO: 59922 - DNA, 20 bp, Artificial Sequence
  Description of Artificial Sequence: Synthetic oligonucleotide
  Target: SCN10A; (+) strand; PAM type: YTN; PAM sequence: TTG
ttctgacaaagtttgaagta

SEQ ID NO: 59923 - DNA, 20 bp, Artificial Sequence
  Description of Artificial Sequence: Synthetic oligonucleotide
  Target: SCN10A; (+) strand; PAM type: YTN; PAM sequence: TTC
tgacaaagtttgaagtaaat

SEQ ID NO: 59924 - DNA, 20 bp, Artificial Sequence
  Description of Artificial Sequence: Synthetic oligonucleotide
  Target: SCN10A; (+) strand; PAM type: YTN; PAM sequence: CTG
acaaagtttgaagtaaatta

SEQ ID NO: 59925 - DNA, 20 bp, Artificial Sequence
  Description of Artificial Sequence: Synthetic oligonucleotide
  Target: SCN10A; (+) strand; PAM type: YTN; PAM sequence: TTT
gaagtaaattatgcaaatcc

SEQ ID NO: 59926 - DNA, 20 bp, Artificial Sequence
  Description of Artificial Sequence: Synthetic oligonucleotide
  Target: SCN10A; (+) strand; PAM type: YTN; PAM sequence: TTG
aagtaaattatgcaaatcct

SEQ ID NO: 59927 - DNA, 20 bp, Artificial Sequence
  Description of Artificial Sequence: Synthetic oligonucleotide
  Target: SCN10A; (+) strand; PAM type: YTN; PAM sequence: TTA
tgcaaatcctataccttgat

SEQ ID NO: 59928 - DNA, 20 bp, Artificial Sequence
  Description of Artificial Sequence: Synthetic oligonucleotide
  Target: SCN10A; (+) strand; PAM type: YTN; PAM sequence: CTA
taccttgatttaaaaaaatc

SEQ ID NO: 59929 - DNA, 20 bp, Artificial Sequence
  Description of Artificial Sequence: Synthetic oligonucleotide
  Target: SCN10A; (+) strand; PAM type: YTN; PAM sequence: CTT
gatttaaaaaaatctaatag

SEQ ID NO: 59930 - DNA, 20 bp, Artificial Sequence
  Description of Artificial Sequence: Synthetic oligonucleotide
  Target: SCN10A; (+) strand; PAM type: YTN; PAM sequence: TTG
atttaaaaaaatctaatagc

SEQ ID NO: 59931 - DNA, 20 bp, Artificial Sequence
  Description of Artificial Sequence: Synthetic oligonucleotide
  Target: SCN10A; (+) strand; PAM type: YTN; PAM sequence: TTT
aaaaaaatctaatagcttgg

SEQ ID NO: 59932 - DNA, 20 bp, Artificial Sequence
  Description of Artificial Sequence: Synthetic oligonucleotide
  Target: SCN10A; (+) strand; PAM type: YTN; PAM sequence: TTA
aaaaaatctaatagcttggc

SEQ ID NO: 59933 - DNA, 20 bp, Artificial Sequence
  Description of Artificial Sequence: Synthetic oligonucleotide
  Target: SCN10A; (+) strand; PAM type: YTN; PAM sequence: CTA
atagcttggctaacagaatg

SEQ ID NO: 59934 - DNA, 20 bp, Artificial Sequence
  Description of Artificial Sequence: Synthetic oligonucleotide
  Target: SCN10A; (+) strand; PAM type: YTN; PAM sequence: CTT
ggctaacagaatgcatgtct

SEQ ID NO: 59935 - DNA, 20 bp, Artificial Sequence
  Description of Artificial Sequence: Synthetic oligonucleotide
  Target: SCN10A; (+) strand; PAM type: YTN; PAM sequence: TTG
gctaacagaatgcatgtctc

SEQ ID NO: 59936 - DNA, 20 bp, Artificial Sequence
  Description of Artificial Sequence: Synthetic oligonucleotide
  Target: SCN10A; (+) strand; PAM type: YTN; PAM sequence: CTA
acagaatgcatgtctccata

SEQ ID NO: 59937 - DNA, 20 bp, Artificial Sequence
  Description of Artificial Sequence: Synthetic oligonucleotide
  Target: SCN10A; (+) strand; PAM type: YTN; PAM sequence: CTC
cataattcatttagggaaag

SEQ ID NO: 59938 - DNA, 20 bp, Artificial Sequence
  Description of Artificial Sequence: Synthetic oligonucleotide
  Target: SCN10A; (+) strand; PAM type: YTN; PAM sequence: TTC
atttagggaaaggcttgttc

SEQ ID NO: 59939 - DNA, 20 bp, Artificial Sequence
  Description of Artificial Sequence: Synthetic oligonucleotide
  Target: SCN10A; (+) strand; PAM type: YTN; PAM sequence: TTT
agggaaaggcttgttccttt

SEQ ID NO: 59940 - DNA, 20 bp, Artificial Sequence
  Description of Artificial Sequence: Synthetic oligonucleotide
  Target: SCN10A; (+) strand; PAM type: YTN; PAM sequence: TTA
gggaaaggcttgttcctttg

SEQ ID NO: 59941 - DNA, 20 bp, Artificial Sequence
  Description of Artificial Sequence: Synthetic oligonucleotide
  Target: SCN10A; (+) strand; PAM type: YTN; PAM sequence: CTT
gttcctttgttaaatgtcct

SEQ ID NO: 59942 - DNA, 20 bp, Artificial Sequence
  Description of Artificial Sequence: Synthetic oligonucleotide
  Target: SCN10A; (+) strand; PAM type: YTN; PAM sequence: TTG
ttcctttgttaaatgtcctt

SEQ ID NO: 59943 - DNA, 20 bp, Artificial Sequence
  Description of Artificial Sequence: Synthetic oligonucleotide
  Target: SCN10A; (+) strand; PAM type: YTN; PAM sequence: TTC
ctttgttaaatgtcctttgg

SEQ ID NO: 59944 - DNA, 20 bp, Artificial Sequence
  Description of Artificial Sequence: Synthetic oligonucleotide
  Target: SCN10A; (+) strand; PAM type: YTN; PAM sequence: CTT
tgttaaatgtcctttggact

SEQ ID NO: 59945 - DNA, 20 bp, Artificial Sequence
  Description of Artificial Sequence: Synthetic oligonucleotide
  Target: SCN10A; (+) strand; PAM type: YTN; PAM sequence: TTT
gttaaatgtcctttggactt

SEQ ID NO: 59946 - DNA, 20 bp, Artificial Sequence
  Description of Artificial Sequence: Synthetic oligonucleotide
  Target: SCN10A; (+) strand; PAM type: YTN; PAM sequence: TTG
ttaaatgtcctttggacttt

SEQ ID NO: 59947 - DNA, 20 bp, Artificial Sequence
  Description of Artificial Sequence: Synthetic oligonucleotide
  Target: SCN10A; (+) strand; PAM type: YTN; PAM sequence: TTA
aatgtcctttggacttttcc

SEQ ID NO: 59948 - DNA, 20 bp, Artificial Sequence
  Description of Artificial Sequence: Synthetic oligonucleotide
  Target: SCN10A; (+) strand; PAM type: YTN; PAM sequence: CTT
tggacttttcccttgtgtgg

SEQ ID NO: 59949 - DNA, 20 bp, Artificial Sequence
  Description of Artificial Sequence: Synthetic oligonucleotide
  Target: SCN10A; (+) strand; PAM type: YTN; PAM sequence: TTT
ggacttttcccttgtgtggg

SEQ ID NO: 59950 - DNA, 20 bp, Artificial Sequence
  Description of Artificial Sequence: Synthetic oligonucleotide
  Target: SCN10A; (+) strand; PAM type: YTN; PAM sequence: TTG
gacttttcccttgtgtgggg

SEQ ID NO: 59951 - DNA, 20 bp, Artificial Sequence
  Description of Artificial Sequence: Synthetic oligonucleotide
  Target: SCN10A; (+) strand; PAM type: YTN; PAM sequence: CTT
ttcccttgtgtggggaaggg

SEQ ID NO: 59952 - DNA, 20 bp, Artificial Sequence
  Description of Artificial Sequence: Synthetic oligonucleotide
  Target: SCN10A; (+) strand; PAM type: YTN; PAM sequence: TTT
tcccttgtgtggggaagggc

SEQ ID NO: 59953 - DNA, 20 bp, Artificial Sequence
  Description of Artificial Sequence: Synthetic oligonucleotide
  Target: SCN10A; (+) strand; PAM type: YTN; PAM sequence: TTT
cccttgtgtggggaagggct

SEQ ID NO: 59954 - DNA, 20 bp, Artificial Sequence
  Description of Artificial Sequence: Synthetic oligonucleotide
  Target: SCN10A; (+) strand; PAM type: YTN; PAM sequence: TTC
ccttgtgtggggaagggcta

SEQ ID NO: 59955 - DNA, 20 bp, Artificial Sequence
  Description of Artificial Sequence: Synthetic oligonucleotide
  Target: SCN10A; (+) strand; PAM type: YTN; PAM sequence: CTT
gtgtggggaagggctaatga

SEQ ID NO: 59956 - DNA, 20 bp, Artificial Sequence
  Description of Artificial Sequence: Synthetic oligonucleotide
  Target: SCN10A; (+) strand; PAM type: YTN; PAM sequence: TTG
tgtggggaagggctaatgaa

SEQ ID NO: 59957 - DNA, 20 bp, Artificial Sequence
  Description of Artificial Sequence: Synthetic oligonucleotide
  Target: SCN10A; (+) strand; PAM type: YTN; PAM sequence: CTA
atgaaattgtgtcatcagca

SEQ ID NO: 59958 - DNA, 20 bp, Artificial Sequence
  Description of Artificial Sequence: Synthetic oligonucleotide
  Target: SCN10A; (+) strand; PAM type: YTN; PAM sequence: TTG
tgtcatcagcaatacctgtg

SEQ ID NO: 59959 - DNA, 20 bp, Artificial Sequence
  Description of Artificial Sequence: Synthetic oligonucleotide
  Target: SCN10A; (+) strand; PAM type: YTN; PAM sequence: CTG
tgattttcttcactaatgct

SEQ ID NO: 59960 - DNA, 20 bp, Artificial Sequence
  Description of Artificial Sequence: Synthetic oligonucleotide
  Target: SCN10A; (+) strand; PAM type: YTN; PAM sequence: TTT
tcttcactaatgctgcatct

SEQ ID NO: 59961 - DNA, 20 bp, Artificial Sequence
  Description of Artificial Sequence: Synthetic oligonucleotide
  Target: SCN10A; (+) strand; PAM type: YTN; PAM sequence: TTT
cttcactaatgctgcatctt

SEQ ID NO: 59962 - DNA, 20 bp, Artificial Sequence
  Description of Artificial Sequence: Synthetic oligonucleotide
  Target: SCN10A; (+) strand; PAM type: YTN; PAM sequence: TTC
ttcactaatgctgcatctta

SEQ ID NO: 59963 - DNA, 20 bp, Artificial Sequence
  Description of Artificial Sequence: Synthetic oligonucleotide
  Target: SCN10A; (+) strand; PAM type: YTN; PAM sequence: CTT
cactaatgctgcatcttagc

SEQ ID NO: 59964 - DNA, 20 bp, Artificial Sequence
  Description of Artificial Sequence: Synthetic oligonucleotide
  Target: SCN10A; (+) strand; PAM type: YTN; PAM sequence: TTC
actaatgctgcatcttagcc

SEQ ID NO: 59965 - DNA, 20 bp, Artificial Sequence
  Description of Artificial Sequence: Synthetic oligonucleotide
  Target: SCN10A; (+) strand; PAM type: YTN; PAM sequence: CTA
atgctgcatcttagccacag

SEQ ID NO: 59966 - DNA, 20 bp, Artificial Sequence
  Description of Artificial Sequence: Synthetic oligonucleotide
  Target: SCN10A; (+) strand; PAM type: YTN; PAM sequence: CTG
catcttagccacagaaagtt

SEQ ID NO: 59967 - DNA, 20 bp, Artificial Sequence
  Description of Artificial Sequence: Synthetic oligonucleotide
  Target: SCN10A; (+) strand; PAM type: YTN; PAM sequence: CTT
agccacagaaagtttatgta

SEQ ID NO: 59968 - DNA, 20 bp, Artificial Sequence
  Description of Artificial Sequence: Synthetic oligonucleotide
  Target: SCN10A; (+) strand; PAM type: YTN; PAM sequence: TTA
gccacagaaagtttatgtag

SEQ ID NO: 59969 - DNA, 20 bp, Artificial Sequence
  Description of Artificial Sequence: Synthetic oligonucleotide
  Target: SCN10A; (+) strand; PAM type: YTN; PAM sequence: TTT
atgtagaaggacacagggcc

SEQ ID NO: 59970 - DNA, 20 bp, Artificial Sequence
  Description of Artificial Sequence: Synthetic oligonucleotide
  Target: SCN10A; (+) strand; PAM type: YTN; PAM sequence: TTA
tgtagaaggacacagggcca

SEQ ID NO: 59971 - DNA, 20 bp, Artificial Sequence
  Description of Artificial Sequence: Synthetic oligonucleotide
  Target: SCN10A; (+) strand; PAM type: YTN; PAM sequence: TTC
cattcactggagtggatggc

SEQ ID NO: 59972 - DNA, 20 bp, Artificial Sequence
  Description of Artificial Sequence: Synthetic oligonucleotide
  Target: SCN10A; (+) strand; PAM type: YTN; PAM sequence: TTC
actggagtggatggctcaga

SEQ ID NO: 59973 - DNA, 20 bp, Artificial Sequence
  Description of Artificial Sequence: Synthetic oligonucleotide
  Target: SCN10A; (+) strand; PAM type: YTN; PAM sequence: CTG
gagtggatggctcagaaatt

SEQ ID NO: 59974 - DNA, 20 bp, Artificial Sequence
  Description of Artificial Sequence: Synthetic oligonucleotide
  Target: SCN10A; (+) strand; PAM type: YTN; PAM sequence: CTC
agaaattctttgaagacgat

SEQ ID NO: 59975 - DNA, 20 bp, Artificial Sequence
  Description of Artificial Sequence: Synthetic oligonucleotide
  Target: SCN10A; (+) strand; PAM type: YTN; PAM sequence: TTC
tttgaagacgatcaacaata

SEQ ID NO: 59976 - DNA, 20 bp, Artificial Sequence
  Description of Artificial Sequence: Synthetic oligonucleotide
  Target: SCN10A; (+) strand; PAM type: YTN; PAM sequence: CTT
tgaagacgatcaacaataat

SEQ ID NO: 59977 - DNA, 20 bp, Artificial Sequence
  Description of Artificial Sequence: Synthetic oligonucleotide
  Target: SCN10A; (+) strand; PAM type: YTN; PAM sequence: TTT
gaagacgatcaacaataatt

SEQ ID NO: 59978 - DNA, 20 bp, Artificial Sequence
  Description of Artificial Sequence: Synthetic oligonucleotide
  Target: SCN10A; (+) strand; PAM type: YTN; PAM sequence: TTG
aagacgatcaacaataattt

SEQ ID NO: 59979 - DNA, 20 bp, Artificial Sequence
  Description of Artificial Sequence: Synthetic oligonucleotide
  Target: SCN10A; (+) strand; PAM type: YTN; PAM sequence: TTT
ctgacacatcaacatcttca

SEQ ID NO: 59980 - DNA, 20 bp, Artificial Sequence
  Description of Artificial Sequence: Synthetic oligonucleotide
  Target: SCN10A; (+) strand; PAM type: YTN; PAM sequence: TTC
tgacacatcaacatcttcac

SEQ ID NO: 59981 - DNA, 20 bp, Artificial Sequence
  Description of Artificial Sequence: Synthetic oligonucleotide
  Target: SCN10A; (+) strand; PAM type: YTN; PAM sequence: CTG
acacatcaacatcttcaccc

SEQ ID NO: 59982 - DNA, 20 bp, Artificial Sequence
  Description of Artificial Sequence: Synthetic oligonucleotide
  Target: SCN10A; (+) strand; PAM type: YTN; PAM sequence: CTT
cacccccaaacctgttcatc

SEQ ID NO: 59983 - DNA, 20 bp, Artificial Sequence
  Description of Artificial Sequence: Synthetic oligonucleotide
  Target: SCN10A; (+) strand; PAM type: YTN; PAM sequence: TTC
acccccaaacctgttcatcc

SEQ ID NO: 59984 - DNA, 20 bp, Artificial Sequence
  Description of Artificial Sequence: Synthetic oligonucleotide
  Target: SCN10A; (+) strand; PAM type: YTN; PAM sequence: CTG
ttcatccattcccaaaaaag

SEQ ID NO: 59985 - DNA, 20 bp, Artificial Sequence
  Description of Artificial Sequence: Synthetic oligonucleotide
  Target: SCN10A; (+) strand; PAM type: YTN; PAM sequence: TTC
atccattcccaaaaaagtgc

SEQ ID NO: 59986 - DNA, 20 bp, Artificial Sequence
  Description of Artificial Sequence: Synthetic oligonucleotide
  Target: SCN10A; (+) strand; PAM type: YTN; PAM sequence: TTC
ccaaaaaagtgctatcttag

SEQ ID NO: 59987 - DNA, 20 bp, Artificial Sequence
  Description of Artificial Sequence: Synthetic oligonucleotide
  Target: SCN10A; (+) strand; PAM type: YTN; PAM sequence: CTA
tcttagggcctctcagaggc

SEQ ID NO: 59988 - DNA, 20 bp, Artificial Sequence
  Description of Artificial Sequence: Synthetic oligonucleotide
  Target: SCN10A; (+) strand; PAM type: YTN; PAM sequence: CTT
agggcctctcagaggcttga

SEQ ID NO: 59989 - DNA, 20 bp, Artificial Sequence
  Description of Artificial Sequence: Synthetic oligonucleotide
  Target: SCN10A; (+) strand; PAM type: YTN; PAM sequence: TTA
gggcctctcagaggcttgat

SEQ ID NO: 59990 - DNA, 20 bp, Artificial Sequence
  Description of Artificial Sequence: Synthetic oligonucleotide
  Target: SCN10A; (+) strand; PAM type: YTN; PAM sequence: CTC
tcagaggcttgatgttttct

SEQ ID NO: 59991 - DNA, 20 bp, Artificial Sequence
  Description of Artificial Sequence: Synthetic oligonucleotide
  Target: SCN10A; (+) strand; PAM type: YTN; PAM sequence: CTC
agaggcttgatgttttctat

SEQ ID NO: 59992 - DNA, 20 bp, Artificial Sequence
  Description of Artificial Sequence: Synthetic oligonucleotide
  Target: SCN10A; (+) strand; PAM type: YTN; PAM sequence: CTT
gatgttttctatcttctggc

SEQ ID NO: 59993 - DNA, 20 bp, Artificial Sequence
  Description of Artificial Sequence: Synthetic oligonucleotide
  Target: SCN10A; (+) strand; PAM type: YTN; PAM sequence: TTG
atgttttctatcttctggca

SEQ ID NO: 59994 - DNA, 20 bp, Artificial Sequence
  Description of Artificial Sequence: Synthetic oligonucleotide
  Target: SCN10A; (+) strand; PAM type: YTN; PAM sequence: TTT
tctatcttctggcagaagac

SEQ ID NO: 59995 - DNA, 20 bp, Artificial Sequence
  Description of Artificial Sequence: Synthetic oligonucleotide
  Target: SCN10A; (+) strand; PAM type: YTN; PAM sequence: TTT
ctatcttctggcagaagact

SEQ ID NO: 59996 - DNA, 20 bp, Artificial Sequence
  Description of Artificial Sequence: Synthetic oligonucleotide
  Target: SCN10A; (+) strand; PAM type: YTN; PAM sequence: TTC
tatcttctggcagaagactg

SEQ ID NO: 59997 - DNA, 20 bp, Artificial Sequence
  Description of Artificial Sequence: Synthetic oligonucleotide
  Target: SCN10A; (+) strand; PAM type: YTN; PAM sequence: CTA
tcttctggcagaagactgag

SEQ ID NO: 59998 - DNA, 20 bp, Artificial Sequence
  Description of Artificial Sequence: Synthetic oligonucleotide
  Target: SCN10A; (+) strand; PAM type: YTN; PAM sequence: CTT
ctggcagaagactgagaaga

SEQ ID NO: 59999 - DNA, 20 bp, Artificial Sequence
  Description of Artificial Sequence: Synthetic oligonucleotide
  Target: SCN10A; (+) strand; PAM type: YTN; PAM sequence: TTC
tggcagaagactgagaagaa

SEQ ID NO: 60000 - DNA, 20 bp, Artificial Sequence
  Description of Artificial Sequence: Synthetic oligonucleotide
  Target: SCN10A; (+) strand; PAM type: YTN; PAM sequence: CTG
gcagaagactgagaagaact

SEQ ID NO: 60001 - DNA, 20 bp, Artificial Sequence
  Description of Artificial Sequence: Synthetic oligonucleotide
  Target: SCN10A; (+) strand; PAM type: YTN; PAM sequence: CTG
agaagaacttaggtgatatc

SEQ ID NO: 60002 - DNA, 20 bp, Artificial Sequence
  Description of Artificial Sequence: Synthetic oligonucleotide
  Target: SCN10A; (+) strand; PAM type: YTN; PAM sequence: CTT
aggtgatatcatgtgtggta

SEQ ID NO: 60003 - DNA, 20 bp, Artificial Sequence
  Description of Artificial Sequence: Synthetic oligonucleotide
  Target: SCN10A; (+) strand; PAM type: YTN; PAM sequence: TTA
ggtgatatcatgtgtggtat

SEQ ID NO: 60004 - DNA, 20 bp, Artificial Sequence
  Description of Artificial Sequence: Synthetic oligonucleotide
  Target: SCN10A; (+) strand; PAM type: YTN; PAM sequence: TTT
aatggaggaacgcaaagcca

SEQ ID NO: 60005 - DNA, 20 bp, Artificial Sequence
  Description of Artificial Sequence: Synthetic oligonucleotide
  Target: SCN10A; (+) strand; PAM type: YTN; PAM sequence: TTA
atggaggaacgcaaagccat

SEQ ID NO: 60006 - DNA, 20 bp, Artificial Sequence
  Description of Artificial Sequence: Synthetic oligonucleotide
  Target: SCN10A; (+) strand; PAM type: YTN; PAM sequence: CTC
ttgagatctttatgaaaaaa

SEQ ID NO: 60007 - DNA, 20 bp, Artificial Sequence
  Description of Artificial Sequence: Synthetic oligonucleotide
  Target: SCN10A; (+) strand; PAM type: YTN; PAM sequence: CTT
gagatctttatgaaaaaagg

SEQ ID NO: 60008 - DNA, 20 bp, Artificial Sequence
  Description of Artificial Sequence: Synthetic oligonucleotide
  Target: SCN10A; (+) strand; PAM type: YTN; PAM sequence: TTG
agatctttatgaaaaaagga

SEQ ID NO: 60009 - DNA, 20 bp, Artificial Sequence
  Description of Artificial Sequence: Synthetic oligonucleotide
  Target: SCN10A; (+) strand; PAM type: YTN; PAM sequence: CTT
tatgaaaaaaggagtgaaac

SEQ ID NO: 60010 - DNA, 20 bp, Artificial Sequence
  Description of Artificial Sequence: Synthetic oligonucleotide
  Target: SCN10A; (+) strand; PAM type: YTN; PAM sequence: TTT
atgaaaaaaggagtgaaact

SEQ ID NO: 60011 - DNA, 20 bp, Artificial Sequence
  Description of Artificial Sequence: Synthetic oligonucleotide
  Target: SCN10A; (+) strand; PAM type: YTN; PAM sequence: TTA
tgaaaaaaggagtgaaacta

SEQ ID NO: 60012 - DNA, 20 bp, Artificial Sequence
  Description of Artificial Sequence: Synthetic oligonucleotide
  Target: SCN10A; (+) strand; PAM type: YTN; PAM sequence: CTA
gagtctggccctaatttttg

SEQ ID NO: 60013 - DNA, 20 bp, Artificial Sequence
  Description of Artificial Sequence: Synthetic oligonucleotide
  Target: SCN10A; (+) strand; PAM type: YTN; PAM sequence: CTG
gccctaatttttgcccaatc

SEQ ID NO: 60014 - DNA, 20 bp, Artificial Sequence
  Description of Artificial Sequence: Synthetic oligonucleotide
  Target: SCN10A; (+) strand; PAM type: YTN; PAM sequence: CTA
atttttgcccaatctttaaa

SEQ ID NO: 60015 - DNA, 20 bp, Artificial Sequence
  Description of Artificial Sequence: Synthetic oligonucleotide
  Target: SCN10A; (+) strand; PAM type: YTN; PAM sequence: TTT
ttgcccaatctttaaactcg

SEQ ID NO: 60016 - DNA, 20 bp, Artificial Sequence
  Description of Artificial Sequence: Synthetic oligonucleotide
  Target: SCN10A; (+) strand; PAM type: YTN; PAM sequence: TTT
tgcccaatctttaaactcga

SEQ ID NO: 60017 - DNA, 20 bp, Artificial Sequence
  Description of Artificial Sequence: Synthetic oligonucleotide
  Target: SCN10A; (+) strand; PAM type: YTN; PAM sequence: TTT
gcccaatctttaaactcgag

SEQ ID NO: 60018 - DNA, 20 bp, Artificial Sequence
  Description of Artificial Sequence: Synthetic oligonucleotide
  Target: SCN10A; (+) strand; PAM type: YTN; PAM sequence: TTG
cccaatctttaaactcgagt

SEQ ID NO: 60019 - DNA, 20 bp, Artificial Sequence
  Description of Artificial Sequence: Synthetic oligonucleotide
  Target: SCN10A; (+) strand; PAM type: YTN; PAM sequence: CTT
taaactcgagtgggataact

SEQ ID NO: 60020 - DNA, 20 bp, Artificial Sequence
  Description of Artificial Sequence: Synthetic oligonucleotide
  Target: SCN10A; (+) strand; PAM type: YTN; PAM sequence: TTT
aaactcgagtgggataactt

SEQ ID NO: 60021 - DNA, 20 bp, Artificial Sequence
  Description of Artificial Sequence: Synthetic oligonucleotide
  Target: SCN10A; (+) strand; PAM type: YTN; PAM sequence: TTA
aactcgagtgggataacttt

SEQ ID NO: 60022 - DNA, 20 bp, Artificial Sequence
  Description of Artificial Sequence: Synthetic oligonucleotide
  Target: SCN10A; (+) strand; PAM type: YTN; PAM sequence: CTC
gagtgggataacttttggtt

SEQ ID NO: 60023 - DNA, 20 bp, Artificial Sequence
  Description of Artificial Sequence: Synthetic oligonucleotide
  Target: SCN10A; (+) strand; PAM type: YTN; PAM sequence: CTT
ttggttcctactgggccact

SEQ ID NO: 60024 - DNA, 20 bp, Artificial Sequence
  Description of Artificial Sequence: Synthetic oligonucleotide
  Target: SCN10A; (+) strand; PAM type: YTN; PAM sequence: TTT
tggttcctactgggccactt

SEQ ID NO: 60025 - DNA, 20 bp, Artificial Sequence
  Description of Artificial Sequence: Synthetic oligonucleotide
  Target: SCN10A; (+) strand; PAM type: YTN; PAM sequence: TTT
ggttcctactgggccacttg

SEQ ID NO: 60026 - DNA, 20 bp, Artificial Sequence
  Description of Artificial Sequence: Synthetic oligonucleotide
  Target: SCN10A; (+) strand; PAM type: YTN; PAM sequence: TTG
gttcctactgggccacttga

SEQ ID NO: 60027 - DNA, 20 bp, Artificial Sequence
  Description of Artificial Sequence: Synthetic oligonucleotide
  Target: SCN10A; (+) strand; PAM type: YTN; PAM sequence: TTC
ctactgggccacttgaccac

SEQ ID NO: 60028 - DNA, 20 bp, Artificial Sequence
  Description of Artificial Sequence: Synthetic oligonucleotide
  Target: SCN10A; (+) strand; PAM type: YTN; PAM sequence: CTA
ctgggccacttgaccactac

SEQ ID NO: 60029 - DNA, 20 bp, Artificial Sequence
  Description of Artificial Sequence: Synthetic oligonucleotide
  Target: SCN10A; (+) strand; PAM type: YTN; PAM sequence: CTG
ggccacttgaccactaccat

SEQ ID NO: 60030 - DNA, 20 bp, Artificial Sequence
  Description of Artificial Sequence: Synthetic oligonucleotide
  Target: SCN10A; (+) strand; PAM type: YTN; PAM sequence: CTT
gaccactaccatgactgcat

SEQ ID NO: 60031 - DNA, 20 bp, Artificial Sequence
  Description of Artificial Sequence: Synthetic oligonucleotide
  Target: SCN10A; (+) strand; PAM type: YTN; PAM sequence: TTG
accactaccatgactgcatc

SEQ ID NO: 60032 - DNA, 20 bp, Artificial Sequence
  Description of Artificial Sequence: Synthetic oligonucleotide
  Target: SCN10A; (+) strand; PAM type: YTN; PAM sequence: CTA
ccatgactgcatcttggatc

SEQ ID NO: 60033 - DNA, 20 bp, Artificial Sequence
  Description of Artificial Sequence: Synthetic oligonucleotide
  Target: SCN10A; (+) strand; PAM type: YTN; PAM sequence: CTG
catcttggatcctgacaggg

SEQ ID NO: 60034 - DNA, 20 bp, Artificial Sequence
  Description of Artificial Sequence: Synthetic oligonucleotide
  Target: SCN10A; (+) strand; PAM type: YTN; PAM sequence: CTT
ggatcctgacaggggagttg

SEQ ID NO: 60035 - DNA, 20 bp, Artificial Sequence
  Description of Artificial Sequence: Synthetic oligonucleotide
  Target: SCN10A; (+) strand; PAM type: YTN; PAM sequence: TTG
gatcctgacaggggagttgg

SEQ ID NO: 60036 - DNA, 20 bp, Artificial Sequence
  Description of Artificial Sequence: Synthetic oligonucleotide
  Target: SCN10A; (+) strand; PAM type: YTN; PAM sequence: CTG
acaggggagttgggttgttg

SEQ ID NO: 60037 - DNA, 20 bp, Artificial Sequence
  Description of Artificial Sequence: Synthetic oligonucleotide
  Target: SCN10A; (+) strand; PAM type: YTN; PAM sequence: TTG
ggttgttgtcatttcctctc

SEQ ID NO: 60038 - DNA, 20 bp, Artificial Sequence
  Description of Artificial Sequence: Synthetic oligonucleotide
  Target: SCN10A; (+) strand; PAM type: YTN; PAM sequence: TTG
ttgtcatttcctctctatac

SEQ ID NO: 60039 - DNA, 20 bp, Artificial Sequence
  Description of Artificial Sequence: Synthetic oligonucleotide
  Target: SCN10A; (+) strand; PAM type: YTN; PAM sequence: TTG
tcatttcctctctatacctg

SEQ ID NO: 60040 - DNA, 20 bp, Artificial Sequence
  Description of Artificial Sequence: Synthetic oligonucleotide
  Target: SCN10A; (+) strand; PAM type: YTN; PAM sequence: TTT
cctctctatacctgtaggcg

SEQ ID NO: 60041 - DNA, 20 bp, Artificial Sequence
  Description of Artificial Sequence: Synthetic oligonucleotide
  Target: SCN10A; (+) strand; PAM type: YTN; PAM sequence: TTC
ctctctatacctgtaggcgt

SEQ ID NO: 60042 - DNA, 20 bp, Artificial Sequence
  Description of Artificial Sequence: Synthetic oligonucleotide
  Target: SCN10A; (+) strand; PAM type: YTN; PAM sequence: CTC
tctatacctgtaggcgtggg

SEQ ID NO: 60043 - DNA, 20 bp, Artificial Sequence
  Description of Artificial Sequence: Synthetic oligonucleotide
  Target: SCN10A; (+) strand; PAM type: YTN; PAM sequence: CTC
tatacctgtaggcgtggggt

SEQ ID NO: 60044 - DNA, 20 bp, Artificial Sequence
  Description of Artificial Sequence: Synthetic oligonucleotide
  Target: SCN10A; (+) strand; PAM type: YTN; PAM sequence: CTA
tacctgtaggcgtggggtag

SEQ ID NO: 60045 - DNA, 20 bp, Artificial Sequence
  Description of Artificial Sequence: Synthetic oligonucleotide
  Target: SCN10A; (+) strand; PAM type: YTN; PAM sequence: CTG
taggcgtggggtagaatata

SEQ ID NO: 60046 - DNA, 20 bp, Artificial Sequence
  Description of Artificial Sequence: Synthetic oligonucleotide
  Target: SCN10A; (+) strand; PAM type: YTN; PAM sequence: CTG
gagatctactgcgacctaga

SEQ ID NO: 60047 - DNA, 20 bp, Artificial Sequence
  Description of Artificial Sequence: Synthetic oligonucleotide
  Target: SCN10A; (+) strand; PAM type: YTN; PAM sequence: CTA
ctgcgacctagaccatgata

SEQ ID NO: 60048 - DNA, 20 bp, Artificial Sequence
  Description of Artificial Sequence: Synthetic oligonucleotide
  Target: SCN10A; (+) strand; PAM type: YTN; PAM sequence: CTG
cgacctagaccatgatacat

SEQ ID NO: 60049 - DNA, 20 bp, Artificial Sequence
  Description of Artificial Sequence: Synthetic oligonucleotide
  Target: SCN10A; (+) strand; PAM type: YTN; PAM sequence: CTA
gaccatgatacataaccaca

SEQ ID NO: 60050 - DNA, 20 bp, Artificial Sequence
  Description of Artificial Sequence: Synthetic oligonucleotide
  Target: SCN10A; (+) strand; PAM type: YTN; PAM sequence: TTT
aatccctgggttctaactac

SEQ ID NO: 60051 - DNA, 20 bp, Artificial Sequence
  Description of Artificial Sequence: Synthetic oligonucleotide
  Target: SCN10A; (+) strand; PAM type: YTN; PAM sequence: TTA
atccctgggttctaactacc

SEQ ID NO: 60052 - DNA, 20 bp, Artificial Sequence
  Description of Artificial Sequence: Synthetic oligonucleotide
  Target: SCN10A; (+) strand; PAM type: YTN; PAM sequence: CTG
ggttctaactacccttactg

SEQ ID NO: 60053 - DNA, 20 bp, Artificial Sequence
  Description of Artificial Sequence: Synthetic oligonucleotide
  Target: SCN10A; (+) strand; PAM type: YTN; PAM sequence: TTC
taactacccttactgtcact

SEQ ID NO: 60054 - DNA, 20 bp, Artificial Sequence
  Description of Artificial Sequence: Synthetic oligonucleotide
  Target: SCN10A; (+) strand; PAM type: YTN; PAM sequence: CTA
actacccttactgtcactta

SEQ ID NO: 60055 - DNA, 20 bp, Artificial Sequence
  Description of Artificial Sequence: Synthetic oligonucleotide
  Target: SCN10A; (+) strand; PAM type: YTN; PAM sequence: CTA
cccttactgtcacttagctt

SEQ ID NO: 60056 - DNA, 20 bp, Artificial Sequence
  Description of Artificial Sequence: Synthetic oligonucleotide
  Target: SCN10A; (+) strand; PAM type: YTN; PAM sequence: CTT
actgtcacttagcttaacct

SEQ ID NO: 60057 - DNA, 20 bp, Artificial Sequence
  Description of Artificial Sequence: Synthetic oligonucleotide
  Target: SCN10A; (+) strand; PAM type: YTN; PAM sequence: TTA
ctgtcacttagcttaacctg

SEQ ID NO: 60058 - DNA, 20 bp, Artificial Sequence
  Description of Artificial Sequence: Synthetic oligonucleotide
  Target: SCN10A; (+) strand; PAM type: YTN; PAM sequence: CTG
tcacttagcttaacctgcct

SEQ ID NO: 60059 - DNA, 20 bp, Artificial Sequence
  Description of Artificial Sequence: Synthetic oligonucleotide
  Target: SCN10A; (+) strand; PAM type: YTN; PAM sequence: CTT
agcttaacctgcctccaatc

SEQ ID NO: 60060 - DNA, 20 bp, Artificial Sequence
  Description of Artificial Sequence: Synthetic oligonucleotide
  Target: SCN10A; (+) strand; PAM type: YTN; PAM sequence: TTA
gcttaacctgcctccaatcc

SEQ ID NO: 60061 - DNA, 20 bp, Artificial Sequence
  Description of Artificial Sequence: Synthetic oligonucleotide
  Target: SCN10A; (+) strand; PAM type: YTN; PAM sequence: CTT
aacctgcctccaatcctgta

SEQ ID NO: 60062 - DNA, 20 bp, Artificial Sequence
  Description of Artificial Sequence: Synthetic oligonucleotide
  Target: SCN10A; (+) strand; PAM type: YTN; PAM sequence: TTA
acctgcctccaatcctgtac

SEQ ID NO: 60063 - DNA, 20 bp, Artificial Sequence
  Description of Artificial Sequence: Synthetic oligonucleotide
  Target: SCN10A; (+) strand; PAM type: YTN; PAM sequence: CTG
cctccaatcctgtacttgaa

SEQ ID NO: 60064 - DNA, 20 bp, Artificial Sequence
  Description of Artificial Sequence: Synthetic oligonucleotide
  Target: SCN10A; (+) strand; PAM type: YTN; PAM sequence: CTC
caatcctgtacttgaactct

SEQ ID NO: 60065 - DNA, 20 bp, Artificial Sequence
  Description of Artificial Sequence: Synthetic oligonucleotide
  Target: SCN10A; (+) strand; PAM type: YTN; PAM sequence: CTG
tacttgaactctaaaactgt

SEQ ID NO: 60066 - DNA, 20 bp, Artificial Sequence
  Description of Artificial Sequence: Synthetic oligonucleotide
  Target: SCN10A; (+) strand; PAM type: YTN; PAM sequence: CTT
gaactctaaaactgttggag

SEQ ID NO: 60067 - DNA, 20 bp, Artificial Sequence
  Description of Artificial Sequence: Synthetic oligonucleotide
  Target: SCN10A; (+) strand; PAM type: YTN; PAM sequence: TTG
aactctaaaactgttggaga

SEQ ID NO: 60068 - DNA, 20 bp, Artificial Sequence
  Description of Artificial Sequence: Synthetic oligonucleotide
  Target: SCN10A; (+) strand; PAM type: YTN; PAM sequence: CTC
taaaactgttggagaaactc

SEQ ID NO: 60069 - DNA, 20 bp, Artificial Sequence
  Description of Artificial Sequence: Synthetic oligonucleotide
  Target: SCN10A; (+) strand; PAM type: YTN; PAM sequence: CTA
aaactgttggagaaactcag

SEQ ID NO: 60070 - DNA, 20 bp, Artificial Sequence
  Description of Artificial Sequence: Synthetic oligonucleotide
  Target: SCN10A; (+) strand; PAM type: YTN; PAM sequence: CTG
ttggagaaactcagtgcttc

SEQ ID NO: 60071 - DNA, 20 bp, Artificial Sequence
  Description of Artificial Sequence: Synthetic oligonucleotide
  Target: SCN10A; (+) strand; PAM type: YTN; PAM sequence: TTG
gagaaactcagtgcttcccc

SEQ ID NO: 60072 - DNA, 20 bp, Artificial Sequence
  Description of Artificial Sequence: Synthetic oligonucleotide
  Target: SCN10A; (+) strand; PAM type: YTN; PAM sequence: CTC
agtgcttcccccaacagatt

SEQ ID NO: 60073 - DNA, 20 bp, Artificial Sequence
  Description of Artificial Sequence: Synthetic oligonucleotide
  Target: SCN10A; (+) strand; PAM type: YTN; PAM sequence: CTT
cccccaacagattcatttca

SEQ ID NO: 60074 - DNA, 20 bp, Artificial Sequence
  Description of Artificial Sequence: Synthetic oligonucleotide
  Target: SCN10A; (+) strand; PAM type: YTN; PAM sequence: TTC
ccccaacagattcatttcaa

SEQ ID NO: 60075 - DNA, 20 bp, Artificial Sequence
  Description of Artificial Sequence: Synthetic oligonucleotide
  Target: SCN10A; (+) strand; PAM type: YTN; PAM sequence: TTC
atttcaaatagctgtaaaag

SEQ ID NO: 60076 - DNA, 20 bp, Artificial Sequence
  Description of Artificial Sequence: Synthetic oligonucleotide
  Target: SCN10A; (+) strand; PAM type: YTN; PAM sequence: TTT
caaatagctgtaaaaggtat

SEQ ID NO: 60077 - DNA, 20 bp, Artificial Sequence
  Description of Artificial Sequence: Synthetic oligonucleotide
  Target: SCN10A; (+) strand; PAM type: YTN; PAM sequence: TTC
aaatagctgtaaaaggtatg

SEQ ID NO: 60078 - DNA, 20 bp, Artificial Sequence
  Description of Artificial Sequence: Synthetic oligonucleotide
  Target: SCN10A; (+) strand; PAM type: YTN; PAM sequence: CTG
taaaaggtatgtttactcca

SEQ ID NO: 60079 - DNA, 20 bp, Artificial Sequence
  Description of Artificial Sequence: Synthetic oligonucleotide
  Target: SCN10A; (+) strand; PAM type: YTN; PAM sequence: TTT
actccagaagaccagagttg

SEQ ID NO: 60080 - DNA, 20 bp, Artificial Sequence
  Description of Artificial Sequence: Synthetic oligonucleotide
  Target: SCN10A; (+) strand; PAM type: YTN; PAM sequence: TTA
ctccagaagaccagagttgc

SEQ ID NO: 60081 - DNA, 20 bp, Artificial Sequence
  Description of Artificial Sequence: Synthetic oligonucleotide
  Target: SCN10A; (+) strand; PAM type: YTN; PAM sequence: CTC
cagaagaccagagttgcttc

SEQ ID NO: 60082 - DNA, 20 bp, Artificial Sequence
  Description of Artificial Sequence: Synthetic oligonucleotide
  Target: SCN10A; (+) strand; PAM type: YTN; PAM sequence: TTG
cttcttttgaacttctcatt

SEQ ID NO: 60083 - DNA, 20 bp, Artificial Sequence
  Description of Artificial Sequence: Synthetic oligonucleotide
  Target: SCN10A; (+) strand; PAM type: YTN; PAM sequence: CTT
cttttgaacttctcattcct

SEQ ID NO: 60084 - DNA, 20 bp, Artificial Sequence
  Description of Artificial Sequence: Synthetic oligonucleotide
  Target: SCN10A; (+) strand; PAM type: YTN; PAM sequence: TTC
ttttgaacttctcattcctt

SEQ ID NO: 60085 - DNA, 20 bp, Artificial Sequence
  Description of Artificial Sequence: Synthetic oligonucleotide
  Target: SCN10A; (+) strand; PAM type: YTN; PAM sequence: CTT
ttgaacttctcattccttgg

SEQ ID NO: 60086 - DNA, 20 bp, Artificial Sequence
  Description of Artificial Sequence: Synthetic oligonucleotide
  Target: SCN10A; (+) strand; PAM type: YTN; PAM sequence: TTT
tgaacttctcattccttggg

SEQ ID NO: 60087 - DNA, 20 bp, Artificial Sequence
  Description of Artificial Sequence: Synthetic oligonucleotide
  Target: SCN10A; (+) strand; PAM type: YTN; PAM sequence: TTT
gaacttctcattccttgggc

SEQ ID NO: 60088 - DNA, 20 bp, Artificial Sequence
  Description of Artificial Sequence: Synthetic oligonucleotide
  Target: SCN10A; (+) strand; PAM type: YTN; PAM sequence: TTG
aacttctcattccttgggcc

SEQ ID NO: 60089 - DNA, 20 bp, Artificial Sequence
  Description of Artificial Sequence: Synthetic oligonucleotide
  Target: SCN10A; (+) strand; PAM type: YTN; PAM sequence: CTT
ctcattccttgggcctagga

SEQ ID NO: 60090 - DNA, 20 bp, Artificial Sequence
  Description of Artificial Sequence: Synthetic oligonucleotide
  Target: SCN10A; (+) strand; PAM type: YTN; PAM sequence: TTC
tcattccttgggcctaggaa

SEQ ID NO: 60091 - DNA, 20 bp, Artificial Sequence
  Description of Artificial Sequence: Synthetic oligonucleotide
  Target: SCN10A; (+) strand; PAM type: YTN; PAM sequence: CTC
attccttgggcctaggaacc

SEQ ID NO: 60092 - DNA, 20 bp, Artificial Sequence
  Description of Artificial Sequence: Synthetic oligonucleotide
  Target: SCN10A; (+) strand; PAM type: YTN; PAM sequence: TTC
cttgggcctaggaaccctca

SEQ ID NO: 60093 - DNA, 20 bp, Artificial Sequence
  Description of Artificial Sequence: Synthetic oligonucleotide
  Target: SCN10A; (+) strand; PAM type: YTN; PAM sequence: CTT
gggcctaggaaccctcatca

SEQ ID NO: 60094 - DNA, 20 bp, Artificial Sequence
  Description of Artificial Sequence: Synthetic oligonucleotide
  Target: SCN10A; (+) strand; PAM type: YTN; PAM sequence: TTG
ggcctaggaaccctcatcac

SEQ ID NO: 60095 - DNA, 20 bp, Artificial Sequence
  Description of Artificial Sequence: Synthetic oligonucleotide
  Target: SCN10A; (+) strand; PAM type: YTN; PAM sequence: CTA
ggaaccctcatcaccctcat

SEQ ID NO: 60096 - DNA, 20 bp, Artificial Sequence
  Description of Artificial Sequence: Synthetic oligonucleotide
  Target: SCN10A; (+) strand; PAM type: YTN; PAM sequence: CTC
atcaccctcatcccaacgtc

SEQ ID NO: 60097 - DNA, 20 bp, Artificial Sequence
  Description of Artificial Sequence: Synthetic oligonucleotide
  Target: SCN10A; (+) strand; PAM type: YTN; PAM sequence: CTC
atcccaacgtcaacccagat

SEQ ID NO: 60098 - DNA, 20 bp, Artificial Sequence
  Description of Artificial Sequence: Synthetic oligonucleotide
  Target: SCN10A; (+) strand; PAM type: YTN; PAM sequence: CTT
ctcttccataaacagcactc

SEQ ID NO: 60099 - DNA, 20 bp, Artificial Sequence
  Description of Artificial Sequence: Synthetic oligonucleotide
  Target: SCN10A; (+) strand; PAM type: YTN; PAM sequence: TTC
tcttccataaacagcactcc

SEQ ID NO: 60100 - DNA, 20 bp, Artificial Sequence
  Description of Artificial Sequence: Synthetic oligonucleotide
  Target: SCN10A; (+) strand; PAM type: YTN; PAM sequence: CTC
ttccataaacagcactccct

SEQ ID NO: 60101 - DNA, 20 bp, Artificial Sequence
  Description of Artificial Sequence: Synthetic oligonucleotide
  Target: SCN10A; (+) strand; PAM type: YTN; PAM sequence: CTT
ccataaacagcactccctca

SEQ ID NO: 60102 - DNA, 20 bp, Artificial Sequence
  Description of Artificial Sequence: Synthetic oligonucleotide
  Target: SCN10A; (+) strand; PAM type: YTN; PAM sequence: TTC
cataaacagcactccctcag

SEQ ID NO: 60103 - DNA, 20 bp, Artificial Sequence
  Description of Artificial Sequence: Synthetic oligonucleotide
  Target: SCN10A; (+) strand; PAM type: YTN; PAM sequence: CTC
cctcaggcccctgcctgaca

SEQ ID NO: 60104 - DNA, 20 bp, Artificial Sequence
  Description of Artificial Sequence: Synthetic oligonucleotide
  Target: SCN10A; (+) strand; PAM type: YTN; PAM sequence: CTC
aggcccctgcctgacacagg

SEQ ID NO: 60105 - DNA, 20 bp, Artificial Sequence
  Description of Artificial Sequence: Synthetic oligonucleotide
  Target: SCN10A; (+) strand; PAM type: YTN; PAM sequence: CTG
cctgacacaggcatagactg

SEQ ID NO: 60106 - DNA, 20 bp, Artificial Sequence
  Description of Artificial Sequence: Synthetic oligonucleotide
  Target: SCN10A; (+) strand; PAM type: YTN; PAM sequence: CTG
acacaggcatagactgtcat

SEQ ID NO: 60107 - DNA, 20 bp, Artificial Sequence
  Description of Artificial Sequence: Synthetic oligonucleotide
  Target: SCN10A; (+) strand; PAM type: YTN; PAM sequence: CTG
tcatgttggattcacagaca

SEQ ID NO: 60108 - DNA, 20 bp, Artificial Sequence
  Description of Artificial Sequence: Synthetic oligonucleotide
  Target: SCN10A; (+) strand; PAM type: YTN; PAM sequence: TTG
gattcacagacaggctgtgc

SEQ ID NO: 60109 - DNA, 20 bp, Artificial Sequence
  Description of Artificial Sequence: Synthetic oligonucleotide
  Target: SCN10A; (+) strand; PAM type: YTN; PAM sequence: TTC
acagacaggctgtgctagag

SEQ ID NO: 60110 - DNA, 20 bp, Artificial Sequence
  Description of Artificial Sequence: Synthetic oligonucleotide
  Target: SCN10A; (+) strand; PAM type: YTN; PAM sequence: CTG
tgctagaggaaacctctggg

SEQ ID NO: 60111 - DNA, 20 bp, Artificial Sequence
  Description of Artificial Sequence: Synthetic oligonucleotide
  Target: SCN10A; (+) strand; PAM type: YTN; PAM sequence: CTA
gaggaaacctctggggctca

SEQ ID NO: 60112 - DNA, 20 bp, Artificial Sequence
  Description of Artificial Sequence: Synthetic oligonucleotide
  Target: SCN10A; (+) strand; PAM type: YTN; PAM sequence: CTC
tggggctcaccaggggccgt

SEQ ID NO: 60113 - DNA, 20 bp, Artificial Sequence
  Description of Artificial Sequence: Synthetic oligonucleotide
  Target: SCN10A; (+) strand; PAM type: YTN; PAM sequence: CTG
gggctcaccaggggccgtgg

SEQ ID NO: 60114 - DNA, 20 bp, Artificial Sequence
  Description of Artificial Sequence: Synthetic oligonucleotide
  Target: SCN10A; (+) strand; PAM type: YTN; PAM sequence: CTC
accaggggccgtgggatggg

SEQ ID NO: 60115 - DNA, 20 bp, Artificial Sequence
  Description of Artificial Sequence: Synthetic oligonucleotide
  Target: SCN10A; (+) strand; PAM type: YTN; PAM sequence: CTT
ctggggcttcttggagccca

SEQ ID NO: 60116 - DNA, 20 bp, Artificial Sequence
  Description of Artificial Sequence: Synthetic oligonucleotide
  Target: SCN10A; (+) strand; PAM type: YTN; PAM sequence: TTC
tggggcttcttggagcccaa

SEQ ID NO: 60117 - DNA, 20 bp, Artificial Sequence
  Description of Artificial Sequence: Synthetic oligonucleotide
  Target: SCN10A; (+) strand; PAM type: YTN; PAM sequence: CTG
gggcttcttggagcccaact

SEQ ID NO: 60118 - DNA, 20 bp, Artificial Sequence
  Description of Artificial Sequence: Synthetic oligonucleotide
  Target: SCN10A; (+) strand; PAM type: YTN; PAM sequence: CTT
cttggagcccaacttcttca

SEQ ID NO: 60119 - DNA, 20 bp, Artificial Sequence
  Description of Artificial Sequence: Synthetic oligonucleotide
  Target: SCN10A; (+) strand; PAM type: YTN; PAM sequence: TTC
ttggagcccaacttcttcat

SEQ ID NO: 60120 - DNA, 20 bp, Artificial Sequence
  Description of Artificial Sequence: Synthetic oligonucleotide
  Target: SCN10A; (+) strand; PAM type: YTN; PAM sequence: CTT
ggagcccaacttcttcatgg

SEQ ID NO: 60121 - DNA, 20 bp, Artificial Sequence
  Description of Artificial Sequence: Synthetic oligonucleotide
  Target: SCN10A; (+) strand; PAM type: YTN; PAM sequence: TTG
gagcccaacttcttcatggc

SEQ ID NO: 60122 - DNA, 20 bp, Artificial Sequence
  Description of Artificial Sequence: Synthetic oligonucleotide
  Target: SCN10A; (+) strand; PAM type: YTN; PAM sequence: CTT
cttcatggcattgtagtatt

SEQ ID NO: 60123 - DNA, 20 bp, Artificial Sequence
  Description of Artificial Sequence: Synthetic oligonucleotide
  Target: SCN10A; (+) strand; PAM type: YTN; PAM sequence: TTC
ttcatggcattgtagtattt

SEQ ID NO: 60124 - DNA, 20 bp, Artificial Sequence
  Description of Artificial Sequence: Synthetic oligonucleotide
  Target: SCN10A; (+) strand; PAM type: YTN; PAM sequence: CTT
catggcattgtagtatttct

SEQ ID NO: 60125 - DNA, 20 bp, Artificial Sequence
  Description of Artificial Sequence: Synthetic oligonucleotide
  Target: SCN10A; (+) strand; PAM type: YTN; PAM sequence: TTC
atggcattgtagtatttctt

SEQ ID NO: 60126 - DNA, 20 bp, Artificial Sequence
  Description of Artificial Sequence: Synthetic oligonucleotide
  Target: SCN10A; (+) strand; PAM type: YTN; PAM sequence: TTG
tagtatttcttctgctcctc

SEQ ID NO: 60127 - DNA, 20 bp, Artificial Sequence
  Description of Artificial Sequence: Synthetic oligonucleotide
  Target: SCN10A; (+) strand; PAM type: YTN; PAM sequence: TTT
cttctgctcctctgtcatga

SEQ ID NO: 60128 - DNA, 20 bp, Artificial Sequence
  Description of Artificial Sequence: Synthetic oligonucleotide
  Target: SCN10A; (+) strand; PAM type: YTN; PAM sequence: TTC
ttctgctcctctgtcatgaa

SEQ ID NO: 60129 - DNA, 20 bp, Artificial Sequence
  Description of Artificial Sequence: Synthetic oligonucleotide
  Target: SCN10A; (+) strand; PAM type: YTN; PAM sequence: CTT
ctgctcctctgtcatgaaga

SEQ ID NO: 60130 - DNA, 20 bp, Artificial Sequence
  Description of Artificial Sequence: Synthetic oligonucleotide
  Target: SCN10A; (+) strand; PAM type: YTN; PAM sequence: TTC
tgctcctctgtcatgaagat

SEQ ID NO: 60131 - DNA, 20 bp, Artificial Sequence
  Description of Artificial Sequence: Synthetic oligonucleotide
  Target: SCN10A; (+) strand; PAM type: YTN; PAM sequence: CTG
ctcctctgtcatgaagatgt

SEQ ID NO: 60132 - DNA, 20 bp, Artificial Sequence
  Description of Artificial Sequence: Synthetic oligonucleotide
  Target: SCN10A; (+) strand; PAM type: YTN; PAM sequence: CTC
ctctgtcatgaagatgtcct

SEQ ID NO: 60133 - DNA, 20 bp, Artificial Sequence
  Description of Artificial Sequence: Synthetic oligonucleotide
  Target: SCN10A; (+) strand; PAM type: YTN; PAM sequence: CTC
tgtcatgaagatgtcctggc

SEQ ID NO: 60134 - DNA, 20 bp, Artificial Sequence
  Description of Artificial Sequence: Synthetic oligonucleotide
  Target: SCN10A; (+) strand; PAM type: YTN; PAM sequence: CTG
tcatgaagatgtcctggccc

SEQ ID NO: 60135 - DNA, 20 bp, Artificial Sequence
  Description of Artificial Sequence: Synthetic oligonucleotide
  Target: SCN10A; (+) strand; PAM type: YTN; PAM sequence: CTG
gccccctaagtgcagagagg

SEQ ID NO: 60136 - DNA, 20 bp, Artificial Sequence
  Description of Artificial Sequence: Synthetic oligonucleotide
  Target: SCN10A; (+) strand; PAM type: YTN; PAM sequence: CTA
agtgcagagagggccacact

SEQ ID NO: 60137 - DNA, 20 bp, Artificial Sequence
  Description of Artificial Sequence: Synthetic oligonucleotide
  Target: SCN10A; (+) strand; PAM type: YTN; PAM sequence: CTG
ttactaaagcaagaggaacc

SEQ ID NO: 60138 - DNA, 20 bp, Artificial Sequence
  Description of Artificial Sequence: Synthetic oligonucleotide
  Target: SCN10A; (+) strand; PAM type: YTN; PAM sequence: TTA
ctaaagcaagaggaaccccc

SEQ ID NO: 60139 - DNA, 20 bp, Artificial Sequence
  Description of Artificial Sequence: Synthetic oligonucleotide
  Target: SCN10A; (+) strand; PAM type: YTN; PAM sequence: CTA
aagcaagaggaaccccctac

SEQ ID NO: 60140 - DNA, 20 bp, Artificial Sequence
  Description of Artificial Sequence: Synthetic oligonucleotide
  Target: SCN10A; (+) strand; PAM type: YTN; PAM sequence: CTA
cggataccaaaatcagaaca

SEQ ID NO: 60141 - DNA, 20 bp, Artificial Sequence
  Description of Artificial Sequence: Synthetic oligonucleotide
  Target: SCN10A; (+) strand; PAM type: YTN; PAM sequence: CTT
ctcccctcctctgcagatag

SEQ ID NO: 60142 - DNA, 20 bp, Artificial Sequence
  Description of Artificial Sequence: Synthetic oligonucleotide
  Target: SCN10A; (+) strand; PAM type: YTN; PAM sequence: TTC
tcccctcctctgcagataga

SEQ ID NO: 60143 - DNA, 20 bp, Artificial Sequence
  Description of Artificial Sequence: Synthetic oligonucleotide
  Target: SCN10A; (+) strand; PAM type: YTN; PAM sequence: CTC
ccctcctctgcagatagaca

SEQ ID NO: 60144 - DNA, 20 bp, Artificial Sequence
  Description of Artificial Sequence: Synthetic oligonucleotide
  Target: SCN10A; (+) strand; PAM type: YTN; PAM sequence: CTC
ctctgcagatagacaaacca

SEQ ID NO: 60145 - DNA, 20 bp, Artificial Sequence
  Description of Artificial Sequence: Synthetic oligonucleotide
  Target: SCN10A; (+) strand; PAM type: YTN; PAM sequence: CTC
tgcagatagacaaaccaagc

SEQ ID NO: 60146 - DNA, 20 bp, Artificial Sequence
  Description of Artificial Sequence: Synthetic oligonucleotide
  Target: SCN10A; (+) strand; PAM type: YTN; PAM sequence: CTG
cagatagacaaaccaagccc

SEQ ID NO: 60147 - DNA, 20 bp, Artificial Sequence
  Description of Artificial Sequence: Synthetic oligonucleotide
  Target: SCN10A; (+) strand; PAM type: YTN; PAM sequence: CTT
gccacatccagtgtcggaac

SEQ ID NO: 60148 - DNA, 20 bp, Artificial Sequence
  Description of Artificial Sequence: Synthetic oligonucleotide
  Target: SCN10A; (+) strand; PAM type: YTN; PAM sequence: TTG
ccacatccagtgtcggaacg

SEQ ID NO: 60149 - DNA, 20 bp, Artificial Sequence
  Description of Artificial Sequence: Synthetic oligonucleotide
  Target: SCN10A; (+) strand; PAM type: YTN; PAM sequence: CTG
agttccattgctgactccct

SEQ ID NO: 60150 - DNA, 20 bp, Artificial Sequence
  Description of Artificial Sequence: Synthetic oligonucleotide
  Target: SCN10A; (+) strand; PAM type: YTN; PAM sequence: TTC
cattgctgactccctgcctg

SEQ ID NO: 60151 - DNA, 20 bp, Artificial Sequence
  Description of Artificial Sequence: Synthetic oligonucleotide
  Target: SCN10A; (+) strand; PAM type: YTN; PAM sequence: TTG
ctgactccctgcctgggtct

SEQ ID NO: 60152 - DNA, 20 bp, Artificial Sequence
  Description of Artificial Sequence: Synthetic oligonucleotide
  Target: SCN10A; (+) strand; PAM type: YTN; PAM sequence: CTG
actccctgcctgggtctcta

SEQ ID NO: 60153 - DNA, 20 bp, Artificial Sequence
  Description of Artificial Sequence: Synthetic oligonucleotide
  Target: SCN10A; (+) strand; PAM type: YTN; PAM sequence: CTC
cctgcctgggtctctaaagc

SEQ ID NO: 60154 - DNA, 20 bp, Artificial Sequence
  Description of Artificial Sequence: Synthetic oligonucleotide
  Target: SCN10A; (+) strand; PAM type: YTN; PAM sequence: CTG
cctgggtctctaaagcaaag

SEQ ID NO: 60155 - DNA, 20 bp, Artificial Sequence
  Description of Artificial Sequence: Synthetic oligonucleotide
  Target: SCN10A; (+) strand; PAM type: YTN; PAM sequence: CTG
ggtctctaaagcaaagccag

SEQ ID NO: 60156 - DNA, 20 bp, Artificial Sequence
  Description of Artificial Sequence: Synthetic oligonucleotide
  Target: SCN10A; (+) strand; PAM type: YTN; PAM sequence: CTC
taaagcaaagccagtttctg

SEQ ID NO: 60157 - DNA, 20 bp, Artificial Sequence
  Description of Artificial Sequence: Synthetic oligonucleotide
  Target: SCN10A; (+) strand; PAM type: YTN; PAM sequence: CTA
aagcaaagccagtttctgtt

SEQ ID NO: 60158 - DNA, 20 bp, Artificial Sequence
  Description of Artificial Sequence: Synthetic oligonucleotide
  Target: SCN10A; (+) strand; PAM type: YTN; PAM sequence: TTT
ctgttctccagggatccaga

SEQ ID NO: 60159 - DNA, 20 bp, Artificial Sequence
  Description of Artificial Sequence: Synthetic oligonucleotide
  Target: SCN10A; (+) strand; PAM type: YTN; PAM sequence: TTC
tgttctccagggatccagag

SEQ ID NO: 60160 - DNA, 20 bp, Artificial Sequence
  Description of Artificial Sequence: Synthetic oligonucleotide
  Target: SCN10A; (+) strand; PAM type: YTN; PAM sequence: CTG
ttctccagggatccagagat

SEQ ID NO: 60161 - DNA, 20 bp, Artificial Sequence
  Description of Artificial Sequence: Synthetic oligonucleotide
  Target: SCN10A; (+) strand; PAM type: YTN; PAM sequence: TTC
tccagggatccagagatgct

SEQ ID NO: 60162 - DNA, 20 bp, Artificial Sequence
  Description of Artificial Sequence: Synthetic oligonucleotide
  Target: SCN10A; (+) strand; PAM type: YTN; PAM sequence: CTC
cagggatccagagatgctgg

SEQ ID NO: 60163 - DNA, 20 bp, Artificial Sequence
  Description of Artificial Sequence: Synthetic oligonucleotide
  Target: SCN10A; (+) strand; PAM type: YTN; PAM sequence: CTG
gataaagggtggggagggtt

SEQ ID NO: 60164 - DNA, 20 bp, Artificial Sequence
  Description of Artificial Sequence: Synthetic oligonucleotide
  Target: SCN10A; (+) strand; PAM type: YTN; PAM sequence: TTG
gtaaacaggactcaaggaga

SEQ ID NO: 60165 - DNA, 20 bp, Artificial Sequence
  Description of Artificial Sequence: Synthetic oligonucleotide
  Target: SCN10A; (+) strand; PAM type: YTN; PAM sequence: CTC
aaggagaaggtacatgttgg

SEQ ID NO: 60166 - DNA, 20 bp, Artificial Sequence
  Description of Artificial Sequence: Synthetic oligonucleotide
  Target: SCN10A; (+) strand; PAM type: YTN; PAM sequence: TTG
gttcaaatctgagccttgga

SEQ ID NO: 60167 - DNA, 20 bp, Artificial Sequence
  Description of Artificial Sequence: Synthetic oligonucleotide
  Target: SCN10A; (+) strand; PAM type: YTN; PAM sequence: TTC
aaatctgagccttggatcta

SEQ ID NO: 60168 - DNA, 20 bp, Artificial Sequence
  Description of Artificial Sequence: Synthetic oligonucleotide
  Target: SCN10A; (+) strand; PAM type: YTN; PAM sequence: CTG
agccttggatctagcctgtt

SEQ ID NO: 60169 - DNA, 20 bp, Artificial Sequence
  Description of Artificial Sequence: Synthetic oligonucleotide
  Target: SCN10A; (+) strand; PAM type: YTN; PAM sequence: CTT
ggatctagcctgttcattcc

SEQ ID NO: 60170 - DNA, 20 bp, Artificial Sequence
  Description of Artificial Sequence: Synthetic oligonucleotide
  Target: SCN10A; (+) strand; PAM type: YTN; PAM sequence: TTG
gatctagcctgttcattcca

SEQ ID NO: 60171 - DNA, 20 bp, Artificial Sequence
  Description of Artificial Sequence: Synthetic oligonucleotide
  Target: SCN10A; (+) strand; PAM type: YTN; PAM sequence: CTA
gcctgttcattccagtaaaa

SEQ ID NO: 60172 - DNA, 20 bp, Artificial Sequence
  Description of Artificial Sequence: Synthetic oligonucleotide
  Target: SCN10A; (+) strand; PAM type: YTN; PAM sequence: CTG
ttcattccagtaaaattctt

SEQ ID NO: 60173 - DNA, 20 bp, Artificial Sequence
  Description of Artificial Sequence: Synthetic oligonucleotide
  Target: SCN10A; (+) strand; PAM type: YTN; PAM sequence: TTC
attccagtaaaattctttgg

SEQ ID NO: 60174 - DNA, 20 bp, Artificial Sequence
  Description of Artificial Sequence: Synthetic oligonucleotide
  Target: SCN10A; (+) strand; PAM type: YTN; PAM sequence: TTC
cagtaaaattctttgggctt

SEQ ID NO: 60175 - DNA, 20 bp, Artificial Sequence
  Description of Artificial Sequence: Synthetic oligonucleotide
  Target: SCN10A; (+) strand; PAM type: YTN; PAM sequence: TTC
tttgggcttctagagtcaca

SEQ ID NO: 60176 - DNA, 20 bp, Artificial Sequence
  Description of Artificial Sequence: Synthetic oligonucleotide
  Target: SCN10A; (+) strand; PAM type: YTN; PAM sequence: CTT
tgggcttctagagtcacagt

SEQ ID NO: 60177 - DNA, 20 bp, Artificial Sequence
  Description of Artificial Sequence: Synthetic oligonucleotide
  Target: SCN10A; (+) strand; PAM type: YTN; PAM sequence: TTT
gggcttctagagtcacagtc

SEQ ID NO: 60178 - DNA, 20 bp, Artificial Sequence
  Description of Artificial Sequence: Synthetic oligonucleotide
  Target: SCN10A; (+) strand; PAM type: YTN; PAM sequence: TTG
ggcttctagagtcacagtcc

SEQ ID NO: 60179 - DNA, 20 bp, Artificial Sequence
  Description of Artificial Sequence: Synthetic oligonucleotide
  Target: SCN10A; (+) strand; PAM type: YTN; PAM sequence: CTT
ctagagtcacagtccctccc

SEQ ID NO: 60180 - DNA, 20 bp, Artificial Sequence
  Description of Artificial Sequence: Synthetic oligonucleotide
  Target: SCN10A; (+) strand; PAM type: YTN; PAM sequence: TTC
tagagtcacagtccctccca

SEQ ID NO: 60181 - DNA, 20 bp, Artificial Sequence
  Description of Artificial Sequence: Synthetic oligonucleotide
  Target: SCN10A; (+) strand; PAM type: YTN; PAM sequence: CTA
gagtcacagtccctcccagg

SEQ ID NO: 60182 - DNA, 20 bp, Artificial Sequence
  Description of Artificial Sequence: Synthetic oligonucleotide
  Target: SCN10A; (+) strand; PAM type: YTN; PAM sequence: CTC
ccagggggcaagagatttcc

SEQ ID NO: 60183 - DNA, 20 bp, Artificial Sequence
  Description of Artificial Sequence: Synthetic oligonucleotide
  Target: SCN10A; (+) strand; PAM type: YTN; PAM sequence: TTT
cctgaggaccttgaagcaaa

SEQ ID NO: 60184 - DNA, 20 bp, Artificial Sequence
  Description of Artificial Sequence: Synthetic oligonucleotide
  Target: SCN10A; (+) strand; PAM type: YTN; PAM sequence: TTC
ctgaggaccttgaagcaaag

SEQ ID NO: 60185 - DNA, 20 bp, Artificial Sequence
  Description of Artificial Sequence: Synthetic oligonucleotide
  Target: SCN10A; (+) strand; PAM type: YTN; PAM sequence: CTG
aggaccttgaagcaaagact

SEQ ID NO: 60186 - DNA, 20 bp, Artificial Sequence
  Description of Artificial Sequence: Synthetic oligonucleotide
  Target: SCN10A; (+) strand; PAM type: YTN; PAM sequence: CTT
gaagcaaagactctgggagg

SEQ ID NO: 60187 - DNA, 20 bp, Artificial Sequence
  Description of Artificial Sequence: Synthetic oligonucleotide
  Target: SCN10A; (+) strand; PAM type: YTN; PAM sequence: TTG
aagcaaagactctgggaggg

SEQ ID NO: 60188 - DNA, 20 bp, Artificial Sequence
  Description of Artificial Sequence: Synthetic oligonucleotide
  Target: SCN10A; (+) strand; PAM type: YTN; PAM sequence: CTC
tgggagggacagaagccctc

SEQ ID NO: 60189 - DNA, 20 bp, Artificial Sequence
  Description of Artificial Sequence: Synthetic oligonucleotide
  Target: SCN10A; (+) strand; PAM type: YTN; PAM sequence: CTG
ggagggacagaagccctcaa

SEQ ID NO: 60190 - DNA, 20 bp, Artificial Sequence
  Description of Artificial Sequence: Synthetic oligonucleotide
  Target: SCN10A; (+) strand; PAM type: YTN; PAM sequence: CTC
aaatcttttctggagaggag

SEQ ID NO: 60191 - DNA, 20 bp, Artificial Sequence
  Description of Artificial Sequence: Synthetic oligonucleotide
  Target: SCN10A; (+) strand; PAM type: YTN; PAM sequence: CTT
ttctggagaggaggagatga

SEQ ID NO: 60192 - DNA, 20 bp, Artificial Sequence
  Description of Artificial Sequence: Synthetic oligonucleotide
  Target: SCN10A; (+) strand; PAM type: YTN; PAM sequence: TTT
tctggagaggaggagatgag

SEQ ID NO: 60193 - DNA, 20 bp, Artificial Sequence
  Description of Artificial Sequence: Synthetic oligonucleotide
  Target: SCN10A; (+) strand; PAM type: YTN; PAM sequence: TTT
ctggagaggaggagatgagg

SEQ ID NO: 60194 - DNA, 20 bp, Artificial Sequence
  Description of Artificial Sequence: Synthetic oligonucleotide
  Target: SCN10A; (+) strand; PAM type: YTN; PAM sequence: TTC
tggagaggaggagatgagga

SEQ ID NO: 60195 - DNA, 20 bp, Artificial Sequence
  Description of Artificial Sequence: Synthetic oligonucleotide
  Target: SCN10A; (+) strand; PAM type: YTN; PAM sequence: CTG
gagaggaggagatgaggaca

SEQ ID NO: 60196 - DNA, 20 bp, Artificial Sequence
  Description of Artificial Sequence: Synthetic oligonucleotide
  Target: SCN10A; (+) strand; PAM type: YTN; PAM sequence: TTA
ctgccttatccttgggtcct

SEQ ID NO: 60197 - DNA, 20 bp, Artificial Sequence
  Description of Artificial Sequence: Synthetic oligonucleotide
  Target: SCN10A; (+) strand; PAM type: YTN; PAM sequence: CTG
ccttatccttgggtccttgg

SEQ ID NO: 60198 - DNA, 20 bp, Artificial Sequence
  Description of Artificial Sequence: Synthetic oligonucleotide
  Target: SCN10A; (+) strand; PAM type: YTN; PAM sequence: CTT
atccttgggtccttggtctc

SEQ ID NO: 60199 - DNA, 20 bp, Artificial Sequence
  Description of Artificial Sequence: Synthetic oligonucleotide
  Target: SCN10A; (+) strand; PAM type: YTN; PAM sequence: TTA
tccttgggtccttggtctca

SEQ ID NO: 60200 - DNA, 20 bp, Artificial Sequence
  Description of Artificial Sequence: Synthetic oligonucleotide
  Target: SCN10A; (+) strand; PAM type: YTN; PAM sequence: CTT
gggtccttggtctcagaggg

SEQ ID NO: 60201 - DNA, 20 bp, Artificial Sequence
  Description of Artificial Sequence: Synthetic oligonucleotide
  Target: SCN10A; (+) strand; PAM type: YTN; PAM sequence: TTG
ggtccttggtctcagaggga

SEQ ID NO: 60202 - DNA, 20 bp, Artificial Sequence
  Description of Artificial Sequence: Synthetic oligonucleotide
  Target: SCN10A; (+) strand; PAM type: YTN; PAM sequence: CTT
ggtctcagagggacctctgg

SEQ ID NO: 60203 - DNA, 20 bp, Artificial Sequence
  Description of Artificial Sequence: Synthetic oligonucleotide
  Target: SCN10A; (+) strand; PAM type: YTN; PAM sequence: TTG
gtctcagagggacctctggt

SEQ ID NO: 60204 - DNA, 20 bp, Artificial Sequence
  Description of Artificial Sequence: Synthetic oligonucleotide
  Target: SCN10A; (+) strand; PAM type: YTN; PAM sequence: CTC
agagggacctctggttctct

SEQ ID NO: 60205 - DNA, 20 bp, Artificial Sequence
  Description of Artificial Sequence: Synthetic oligonucleotide
  Target: SCN10A; (+) strand; PAM type: YTN; PAM sequence: CTC
tggttctcttgaggccctgc

SEQ ID NO: 60206 - DNA, 20 bp, Artificial Sequence
  Description of Artificial Sequence: Synthetic oligonucleotide
  Target: SCN10A; (+) strand; PAM type: YTN; PAM sequence: CTG
gttctcttgaggccctgcca

SEQ ID NO: 60207 - DNA, 20 bp, Artificial Sequence
  Description of Artificial Sequence: Synthetic oligonucleotide
  Target: SCN10A; (+) strand; PAM type: YTN; PAM sequence: TTC
tcttgaggccctgccagtca

SEQ ID NO: 60208 - DNA, 20 bp, Artificial Sequence
  Description of Artificial Sequence: Synthetic oligonucleotide
  Target: SCN10A; (+) strand; PAM type: YTN; PAM sequence: CTC
ttgaggccctgccagtcaca

SEQ ID NO: 60209 - DNA, 20 bp, Artificial Sequence
  Description of Artificial Sequence: Synthetic oligonucleotide
  Target: SCN10A; (+) strand; PAM type: YTN; PAM sequence: CTT
gaggccctgccagtcacact

SEQ ID NO: 60210 - DNA, 20 bp, Artificial Sequence
  Description of Artificial Sequence: Synthetic oligonucleotide
  Target: SCN10A; (+) strand; PAM type: YTN; PAM sequence: TTG
aggccctgccagtcacactg

SEQ ID NO: 60211 - DNA, 20 bp, Artificial Sequence
  Description of Artificial Sequence: Synthetic oligonucleotide
  Target: SCN10A; (+) strand; PAM type: YTN; PAM sequence: CTG
ccagtcacactgccctctgc

SEQ ID NO: 60212 - DNA, 20 bp, Artificial Sequence
  Description of Artificial Sequence: Synthetic oligonucleotide
  Target: SCN10A; (+) strand; PAM type: YTN; PAM sequence: CTG
ccctctgctgttacagtgcc

SEQ ID NO: 60213 - DNA, 20 bp, Artificial Sequence
  Description of Artificial Sequence: Synthetic oligonucleotide
  Target: SCN10A; (+) strand; PAM type: YTN; PAM sequence: CTC
tgctgttacagtgccagaaa

SEQ ID NO: 60214 - DNA, 20 bp, Artificial Sequence
  Description of Artificial Sequence: Synthetic oligonucleotide
  Target: SCN10A; (+) strand; PAM type: YTN; PAM sequence: CTG
ctgttacagtgccagaaact

SEQ ID NO: 60215 - DNA, 20 bp, Artificial Sequence
  Description of Artificial Sequence: Synthetic oligonucleotide
  Target: SCN10A; (+) strand; PAM type: YTN; PAM sequence: CTG
ttacagtgccagaaactgca

SEQ ID NO: 60216 - DNA, 20 bp, Artificial Sequence
  Description of Artificial Sequence: Synthetic oligonucleotide
  Target: SCN10A; (+) strand; PAM type: YTN; PAM sequence: TTA
cagtgccagaaactgcacca

SEQ ID NO: 60217 - DNA, 20 bp, Artificial Sequence
  Description of Artificial Sequence: Synthetic oligonucleotide
  Target: SCN10A; (+) strand; PAM type: YTN; PAM sequence: CTG
caccaacgaagatgttttcc

SEQ ID NO: 60218 - DNA, 20 bp, Artificial Sequence
  Description of Artificial Sequence: Synthetic oligonucleotide
  Target: SCN10A; (+) strand; PAM type: YTN; PAM sequence: TTT
tcctcccttaggattgggta

SEQ ID NO: 60219 - DNA, 20 bp, Artificial Sequence
  Description of Artificial Sequence: Synthetic oligonucleotide
  Target: SCN10A; (+) strand; PAM type: YTN; PAM sequence: TTT
cctcccttaggattgggtat

SEQ ID NO: 60220 - DNA, 20 bp, Artificial Sequence
  Description of Artificial Sequence: Synthetic oligonucleotide
  Target: SCN10A; (+) strand; PAM type: YTN; PAM sequence: TTC
ctcccttaggattgggtatt

SEQ ID NO: 60221 - DNA, 20 bp, Artificial Sequence
  Description of Artificial Sequence: Synthetic oligonucleotide
  Target: SCN10A; (+) strand; PAM type: YTN; PAM sequence: CTC
ccttaggattgggtattagt

SEQ ID NO: 60222 - DNA, 20 bp, Artificial Sequence
  Description of Artificial Sequence: Synthetic oligonucleotide
  Target: SCN10A; (+) strand; PAM type: YTN; PAM sequence: CTT
aggattgggtattagttttt

SEQ ID NO: 60223 - DNA, 20 bp, Artificial Sequence
  Description of Artificial Sequence: Synthetic oligonucleotide
  Target: SCN10A; (+) strand; PAM type: YTN; PAM sequence: TTA
ggattgggtattagtttttc

SEQ ID NO: 60224 - DNA, 20 bp, Artificial Sequence
  Description of Artificial Sequence: Synthetic oligonucleotide
  Target: SCN10A; (+) strand; PAM type: YTN; PAM sequence: TTG
ggtattagtttttctttagg

SEQ ID NO: 60225 - DNA, 20 bp, Artificial Sequence
  Description of Artificial Sequence: Synthetic oligonucleotide
  Target: SCN10A; (+) strand; PAM type: YTN; PAM sequence: TTA
gtttttctttaggggccctt

SEQ ID NO: 60226 - DNA, 20 bp, Artificial Sequence
  Description of Artificial Sequence: Synthetic oligonucleotide
  Target: SCN10A; (+) strand; PAM type: YTN; PAM sequence: TTT
ttctttaggggccctttgga

SEQ ID NO: 60227 - DNA, 20 bp, Artificial Sequence
  Description of Artificial Sequence: Synthetic oligonucleotide
  Target: SCN10A; (+) strand; PAM type: YTN; PAM sequence: TTT
tctttaggggccctttggat

SEQ ID NO: 60228 - DNA, 20 bp, Artificial Sequence
  Description of Artificial Sequence: Synthetic oligonucleotide
  Target: SCN10A; (+) strand; PAM type: YTN; PAM sequence: TTT
ctttaggggccctttggatt

SEQ ID NO: 60229 - DNA, 20 bp, Artificial Sequence
  Description of Artificial Sequence: Synthetic oligonucleotide
  Target: SCN10A; (+) strand; PAM type: YTN; PAM sequence: TTC
tttaggggccctttggattt

SEQ ID NO: 60230 - DNA, 20 bp, Artificial Sequence
  Description of Artificial Sequence: Synthetic oligonucleotide
  Target: SCN10A; (+) strand; PAM type: YTN; PAM sequence: CTT
taggggccctttggattttc

SEQ ID NO: 60231 - DNA, 20 bp, Artificial Sequence
  Description of Artificial Sequence: Synthetic oligonucleotide
  Target: SCN10A; (+) strand; PAM type: YTN; PAM sequence: TTT
aggggccctttggattttct

SEQ ID NO: 60232 - DNA, 20 bp, Artificial Sequence
  Description of Artificial Sequence: Synthetic oligonucleotide
  Target: SCN10A; (+) strand; PAM type: YTN; PAM sequence: TTA
ggggccctttggattttctt

SEQ ID NO: 60233 - DNA, 20 bp, Artificial Sequence
  Description of Artificial Sequence: Synthetic oligonucleotide
  Target: SCN10A; (+) strand; PAM type: YTN; PAM sequence: CTT
tggattttcttcattcaaac

SEQ ID NO: 60234 - DNA, 20 bp, Artificial Sequence
  Description of Artificial Sequence: Synthetic oligonucleotide
  Target: SCN10A; (+) strand; PAM type: YTN; PAM sequence: TTT
ggattttcttcattcaaact

SEQ ID NO: 60235 - DNA, 20 bp, Artificial Sequence
  Description of Artificial Sequence: Synthetic oligonucleotide
  Target: SCN10A; (+) strand; PAM type: YTN; PAM sequence: TTG
gattttcttcattcaaactc

SEQ ID NO: 60236 - DNA, 20 bp, Artificial Sequence
  Description of Artificial Sequence: Synthetic oligonucleotide
  Target: SCN10A; (+) strand; PAM type: YTN; PAM sequence: TTT
tcttcattcaaactctcacc

SEQ ID NO: 60237 - DNA, 20 bp, Artificial Sequence
  Description of Artificial Sequence: Synthetic oligonucleotide
  Target: SCN10A; (+) strand; PAM type: YTN; PAM sequence: TTT
cttcattcaaactctcacct

SEQ ID NO: 60238 - DNA, 20 bp, Artificial Sequence
  Description of Artificial Sequence: Synthetic oligonucleotide
  Target: SCN10A; (+) strand; PAM type: YTN; PAM sequence: TTC
ttcattcaaactctcacctt

SEQ ID NO: 60239 - DNA, 20 bp, Artificial Sequence
  Description of Artificial Sequence: Synthetic oligonucleotide
  Target: SCN10A; (+) strand; PAM type: YTN; PAM sequence: CTT
cattcaaactctcaccttta

SEQ ID NO: 60240 - DNA, 20 bp, Artificial Sequence
  Description of Artificial Sequence: Synthetic oligonucleotide
  Target: SCN10A; (+) strand; PAM type: YTN; PAM sequence: TTC
attcaaactctcacctttag

SEQ ID NO: 60241 - DNA, 20 bp, Artificial Sequence
  Description of Artificial Sequence: Synthetic oligonucleotide
  Target: SCN10A; (+) strand; PAM type: YTN; PAM sequence: TTC
aaactctcacctttagcttc

SEQ ID NO: 60242 - DNA, 20 bp, Artificial Sequence
  Description of Artificial Sequence: Synthetic oligonucleotide
  Target: SCN10A; (+) strand; PAM type: YTN; PAM sequence: CTC
tcacctttagcttcctgaca

SEQ ID NO: 60243 - DNA, 20 bp, Artificial Sequence
  Description of Artificial Sequence: Synthetic oligonucleotide
  Target: SCN10A; (+) strand; PAM type: YTN; PAM sequence: CTC
acctttagcttcctgacata

SEQ ID NO: 60244 - DNA, 20 bp, Artificial Sequence
  Description of Artificial Sequence: Synthetic oligonucleotide
  Target: SCN10A; (+) strand; PAM type: YTN; PAM sequence: CTT
tagcttcctgacataatttg

SEQ ID NO: 60245 - DNA, 20 bp, Artificial Sequence
  Description of Artificial Sequence: Synthetic oligonucleotide
  Target: SCN10A; (+) strand; PAM type: YTN; PAM sequence: TTT
agcttcctgacataatttga

SEQ ID NO: 60246 - DNA, 20 bp, Artificial Sequence
  Description of Artificial Sequence: Synthetic oligonucleotide
  Target: SCN10A; (+) strand; PAM type: YTN; PAM sequence: TTA
gcttcctgacataatttgaa

SEQ ID NO: 60247 - DNA, 20 bp, Artificial Sequence
  Description of Artificial Sequence: Synthetic oligonucleotide
  Target: SCN10A; (+) strand; PAM type: YTN; PAM sequence: CTT
cctgacataatttgaaagcc

SEQ ID NO: 60248 - DNA, 20 bp, Artificial Sequence
  Description of Artificial Sequence: Synthetic oligonucleotide
  Target: SCN10A; (+) strand; PAM type: YTN; PAM sequence: TTC
ctgacataatttgaaagcca

SEQ ID NO: 60249 - DNA, 20 bp, Artificial Sequence
  Description of Artificial Sequence: Synthetic oligonucleotide
  Target: SCN10A; (+) strand; PAM type: YTN; PAM sequence: CTG
acataatttgaaagccacct

SEQ ID NO: 60250 - DNA, 20 bp, Artificial Sequence
  Description of Artificial Sequence: Synthetic oligonucleotide
  Target: SCN10A; (+) strand; PAM type: YTN; PAM sequence: TTT
gaaagccacctattttaata

SEQ ID NO: 60251 - DNA, 20 bp, Artificial Sequence
  Description of Artificial Sequence: Synthetic oligonucleotide
  Target: SCN10A; (+) strand; PAM type: YTN; PAM sequence: TTG
aaagccacctattttaataa

SEQ ID NO: 60252 - DNA, 20 bp, Artificial Sequence
  Description of Artificial Sequence: Synthetic oligonucleotide
  Target: SCN10A; (+) strand; PAM type: YTN; PAM sequence: CTA
ttttaataacatgtttatgt

SEQ ID NO: 60253 - DNA, 20 bp, Artificial Sequence
  Description of Artificial Sequence: Synthetic oligonucleotide
  Target: SCN10A; (+) strand; PAM type: YTN; PAM sequence: TTT
taataacatgtttatgtaag

SEQ ID NO: 60254 - DNA, 20 bp, Artificial Sequence
  Description of Artificial Sequence: Synthetic oligonucleotide
  Target: SCN10A; (+) strand; PAM type: YTN; PAM sequence: TTT
aataacatgtttatgtaagt

SEQ ID NO: 60255 - DNA, 20 bp, Artificial Sequence
  Description of Artificial Sequence: Synthetic oligonucleotide
  Target: SCN10A; (+) strand; PAM type: YTN; PAM sequence: TTA
ataacatgtttatgtaagtt

SEQ ID NO: 60256 - DNA, 20 bp, Artificial Sequence
  Description of Artificial Sequence: Synthetic oligonucleotide
  Target: SCN10A; (+) strand; PAM type: YTN; PAM sequence: TTT
atgtaagttagtccctgcaa

SEQ ID NO: 60257 - DNA, 20 bp, Artificial Sequence
  Description of Artificial Sequence: Synthetic oligonucleotide
  Target: SCN10A; (+) strand; PAM type: YTN; PAM sequence: TTA
tgtaagttagtccctgcaaa

SEQ ID NO: 60258 - DNA, 20 bp, Artificial Sequence
  Description of Artificial Sequence: Synthetic oligonucleotide
  Target: SCN10A; (+) strand; PAM type: YTN; PAM sequence: TTA
gtccctgcaaatgctgggaa

SEQ ID NO: 60259 - DNA, 20 bp, Artificial Sequence
  Description of Artificial Sequence: Synthetic oligonucleotide
  Target: SCN10A; (+) strand; PAM type: YTN; PAM sequence: CTG
caaatgctgggaaactgggc

SEQ ID NO: 60260 - DNA, 20 bp, Artificial Sequence
  Description of Artificial Sequence: Synthetic oligonucleotide
  Target: SCN10A; (+) strand; PAM type: YTN; PAM sequence: CTG
ggaaactgggctgagatctg

SEQ ID NO: 60261 - DNA, 20 bp, Artificial Sequence
  Description of Artificial Sequence: Synthetic oligonucleotide
  Target: SCN10A; (+) strand; PAM type: YTN; PAM sequence: CTG
ggctgagatctgtggaattt

SEQ ID NO: 60262 - DNA, 20 bp, Artificial Sequence
  Description of Artificial Sequence: Synthetic oligonucleotide
  Target: SCN10A; (+) strand; PAM type: YTN; PAM sequence: CTG
agatctgtggaatttgaaag

SEQ ID NO: 60263 - DNA, 20 bp, Artificial Sequence
  Description of Artificial Sequence: Synthetic oligonucleotide
  Target: SCN10A; (+) strand; PAM type: YTN; PAM sequence: CTG
tggaatttgaaaggagatct

SEQ ID NO: 60264 - DNA, 20 bp, Artificial Sequence
  Description of Artificial Sequence: Synthetic oligonucleotide
  Target: SCN10A; (+) strand; PAM type: YTN; PAM sequence: TTT
gaaaggagatctgagaagat

SEQ ID NO: 60265 - DNA, 20 bp, Artificial Sequence
  Description of Artificial Sequence: Synthetic oligonucleotide
  Target: SCN10A; (+) strand; PAM type: YTN; PAM sequence: TTG
aaaggagatctgagaagatc

SEQ ID NO: 60266 - DNA, 20 bp, Artificial Sequence
  Description of Artificial Sequence: Synthetic oligonucleotide
  Target: SCN10A; (+) strand; PAM type: YTN; PAM sequence: CTG
agaagatctgtggacacaaa

SEQ ID NO: 60267 - DNA, 20 bp, Artificial Sequence
  Description of Artificial Sequence: Synthetic oligonucleotide
  Target: SCN10A; (+) strand; PAM type: YTN; PAM sequence: CTG
tggacacaaagggcttcctg

SEQ ID NO: 60268 - DNA, 20 bp, Artificial Sequence
  Description of Artificial Sequence: Synthetic oligonucleotide
  Target: SCN10A; (+) strand; PAM type: YTN; PAM sequence: CTT
cctgggaggaccatctttat

SEQ ID NO: 60269 - DNA, 20 bp, Artificial Sequence
  Description of Artificial Sequence: Synthetic oligonucleotide
  Target: SCN10A; (+) strand; PAM type: YTN; PAM sequence: TTC
ctgggaggaccatctttatg

SEQ ID NO: 60270 - DNA, 20 bp, Artificial Sequence
  Description of Artificial Sequence: Synthetic oligonucleotide
  Target: SCN10A; (+) strand; PAM type: YTN; PAM sequence: CTG
ggaggaccatctttatgggg

SEQ ID NO: 60271 - DNA, 20 bp, Artificial Sequence
  Description of Artificial Sequence: Synthetic oligonucleotide
  Target: SCN10A; (+) strand; PAM type: YTN; PAM sequence: CTT
tatggggggagagaaggaaa

SEQ ID NO: 60272 - DNA, 20 bp, Artificial Sequence
  Description of Artificial Sequence: Synthetic oligonucleotide
  Target: SCN10A; (+) strand; PAM type: YTN; PAM sequence: TTT
atggggggagagaaggaaag

SEQ ID NO: 60273 - DNA, 20 bp, Artificial Sequence
  Description of Artificial Sequence: Synthetic oligonucleotide
  Target: SCN10A; (+) strand; PAM type: YTN; PAM sequence: TTA
tggggggagagaaggaaagg

SEQ ID NO: 60274 - DNA, 20 bp, Artificial Sequence
  Description of Artificial Sequence: Synthetic oligonucleotide
  Target: SCN10A; (+) strand; PAM type: YTN; PAM sequence: CTC
caggtgaggtcatgctgaga

SEQ ID NO: 60275 - DNA, 20 bp, Artificial Sequence
  Description of Artificial Sequence: Synthetic oligonucleotide
  Target: SCN10A; (+) strand; PAM type: YTN; PAM sequence: CTG
agaactctgaccaaggattc

SEQ ID NO: 60276 - DNA, 20 bp, Artificial Sequence
  Description of Artificial Sequence: Synthetic oligonucleotide
  Target: SCN10A; (+) strand; PAM type: YTN; PAM sequence: CTC
tgaccaaggattcagtagat

SEQ ID NO: 60277 - DNA, 20 bp, Artificial Sequence
  Description of Artificial Sequence: Synthetic oligonucleotide
  Target: SCN10A; (+) strand; PAM type: YTN; PAM sequence: CTG
accaaggattcagtagatgc

SEQ ID NO: 60278 - DNA, 20 bp, Artificial Sequence
  Description of Artificial Sequence: Synthetic oligonucleotide
  Target: SCN10A; (+) strand; PAM type: YTN; PAM sequence: TTC
agtagatgcagtttctcagt

SEQ ID NO: 60279 - DNA, 20 bp, Artificial Sequence
  Description of Artificial Sequence: Synthetic oligonucleotide
  Target: SCN10A; (+) strand; PAM type: YTN; PAM sequence: TTT
ctcagtgaccccagcctggt

SEQ ID NO: 60280 - DNA, 20 bp, Artificial Sequence
  Description of Artificial Sequence: Synthetic oligonucleotide
  Target: SCN10A; (+) strand; PAM type: YTN; PAM sequence: TTC
tcagtgaccccagcctggtc

SEQ ID NO: 60281 - DNA, 20 bp, Artificial Sequence
  Description of Artificial Sequence: Synthetic oligonucleotide
  Target: SCN10A; (+) strand; PAM type: YTN; PAM sequence: CTC
agtgaccccagcctggtcac

SEQ ID NO: 60282 - DNA, 20 bp, Artificial Sequence
  Description of Artificial Sequence: Synthetic oligonucleotide
  Target: SCN10A; (+) strand; PAM type: YTN; PAM sequence: CTG
gtcactagctcatctccttc

SEQ ID NO: 60283 - DNA, 20 bp, Artificial Sequence
  Description of Artificial Sequence: Synthetic oligonucleotide
  Target: SCN10A; (+) strand; PAM type: YTN; PAM sequence: CTA
gctcatctccttccgttacc

SEQ ID NO: 60284 - DNA, 20 bp, Artificial Sequence
  Description of Artificial Sequence: Synthetic oligonucleotide
  Target: SCN10A; (+) strand; PAM type: YTN; PAM sequence: CTC
atctccttccgttacctaat

SEQ ID NO: 60285 - DNA, 20 bp, Artificial Sequence
  Description of Artificial Sequence: Synthetic oligonucleotide
  Target: SCN10A; (+) strand; PAM type: YTN; PAM sequence: CTC
cttccgttacctaatatctc

SEQ ID NO: 60286 - DNA, 20 bp, Artificial Sequence
  Description of Artificial Sequence: Synthetic oligonucleotide
  Target: SCN10A; (+) strand; PAM type: YTN; PAM sequence: CTT
ccgttacctaatatctccct

SEQ ID NO: 60287 - DNA, 20 bp, Artificial Sequence
  Description of Artificial Sequence: Synthetic oligonucleotide
  Target: SCN10A; (+) strand; PAM type: YTN; PAM sequence: TTC
cgttacctaatatctccctc

SEQ ID NO: 60288 - DNA, 20 bp, Artificial Sequence
  Description of Artificial Sequence: Synthetic oligonucleotide
  Target: SCN10A; (+) strand; PAM type: YTN; PAM sequence: TTA
cctaatatctccctctgtaa

SEQ ID NO: 60289 - DNA, 20 bp, Artificial Sequence
  Description of Artificial Sequence: Synthetic oligonucleotide
  Target: SCN10A; (+) strand; PAM type: YTN; PAM sequence: CTA
atatctccctctgtaatctg

SEQ ID NO: 60290 - DNA, 20 bp, Artificial Sequence
  Description of Artificial Sequence: Synthetic oligonucleotide
  Target: SCN10A; (+) strand; PAM type: YTN; PAM sequence: CTC
cctctgtaatctgtttcttg

SEQ ID NO: 60291 - DNA, 20 bp, Artificial Sequence
  Description of Artificial Sequence: Synthetic oligonucleotide
  Target: SCN10A; (+) strand; PAM type: YTN; PAM sequence: CTC
tgtaatctgtttcttgacct

SEQ ID NO: 60292 - DNA, 20 bp, Artificial Sequence
  Description of Artificial Sequence: Synthetic oligonucleotide
  Target: SCN10A; (+) strand; PAM type: YTN; PAM sequence: CTG
taatctgtttcttgacctca

SEQ ID NO: 60293 - DNA, 20 bp, Artificial Sequence
  Description of Artificial Sequence: Synthetic oligonucleotide
  Target: SCN10A; (+) strand; PAM type: YTN; PAM sequence: CTG
tttcttgacctcagttttct

SEQ ID NO: 60294 - DNA, 20 bp, Artificial Sequence
  Description of Artificial Sequence: Synthetic oligonucleotide
  Target: SCN10A; (+) strand; PAM type: YTN; PAM sequence: TTT
cttgacctcagttttctcat

SEQ ID NO: 60295 - DNA, 20 bp, Artificial Sequence
  Description of Artificial Sequence: Synthetic oligonucleotide
  Target: SCN10A; (+) strand; PAM type: YTN; PAM sequence: TTC
ttgacctcagttttctcatc

SEQ ID NO: 60296 - DNA, 20 bp, Artificial Sequence
  Description of Artificial Sequence: Synthetic oligonucleotide
  Target: SCN10A; (+) strand; PAM type: YTN; PAM sequence: CTT
gacctcagttttctcatctg

SEQ ID NO: 60297 - DNA, 20 bp, Artificial Sequence
  Description of Artificial Sequence: Synthetic oligonucleotide
  Target: SCN10A; (+) strand; PAM type: YTN; PAM sequence: TTG
acctcagttttctcatctgt

SEQ ID NO: 60298 - DNA, 20 bp, Artificial Sequence
  Description of Artificial Sequence: Synthetic oligonucleotide
  Target: SCN10A; (+) strand; PAM type: YTN; PAM sequence: CTC
agttttctcatctgtaaaat

SEQ ID NO: 60299 - DNA, 20 bp, Artificial Sequence
  Description of Artificial Sequence: Synthetic oligonucleotide
  Target: SCN10A; (+) strand; PAM type: YTN; PAM sequence: TTT
tctcatctgtaaaatgagag

SEQ ID NO: 60300 - DNA, 20 bp, Artificial Sequence
  Description of Artificial Sequence: Synthetic oligonucleotide
  Target: SCN10A; (+) strand; PAM type: YTN; PAM sequence: TTT
ctcatctgtaaaatgagaga

SEQ ID NO: 60301 - DNA, 20 bp, Artificial Sequence
  Description of Artificial Sequence: Synthetic oligonucleotide
  Target: SCN10A; (+) strand; PAM type: YTN; PAM sequence: TTC
tcatctgtaaaatgagagaa

SEQ ID NO: 60302 - DNA, 20 bp, Artificial Sequence
  Description of Artificial Sequence: Synthetic oligonucleotide
  Target: SCN10A; (+) strand; PAM type: YTN; PAM sequence: CTC
atctgtaaaatgagagaaat

SEQ ID NO: 60303 - DNA, 20 bp, Artificial Sequence
  Description of Artificial Sequence: Synthetic oligonucleotide
  Target: SCN10A; (+) strand; PAM type: YTN; PAM sequence: CTG
taaaatgagagaaatgattg

SEQ ID NO: 60304 - DNA, 20 bp, Artificial Sequence
  Description of Artificial Sequence: Synthetic oligonucleotide
  Target: SCN10A; (+) strand; PAM type: YTN; PAM sequence: TTG
cttcaataatctcaaacctc

SEQ ID NO: 60305 - DNA, 20 bp, Artificial Sequence
  Description of Artificial Sequence: Synthetic oligonucleotide
  Target: SCN10A; (+) strand; PAM type: YTN; PAM sequence: CTT
caataatctcaaacctcccc

SEQ ID NO: 60306 - DNA, 20 bp, Artificial Sequence
  Description of Artificial Sequence: Synthetic oligonucleotide
  Target: SCN10A; (+) strand; PAM type: YTN; PAM sequence: TTC
aataatctcaaacctcccca

SEQ ID NO: 60307 - DNA, 20 bp, Artificial Sequence
  Description of Artificial Sequence: Synthetic oligonucleotide
  Target: SCN10A; (+) strand; PAM type: YTN; PAM sequence: CTC
aaacctccccagggtactaa

SEQ ID NO: 60308 - DNA, 20 bp, Artificial Sequence
  Description of Artificial Sequence: Synthetic oligonucleotide
  Target: SCN10A; (+) strand; PAM type: YTN; PAM sequence: CTC
cccagggtactaaatagcac

SEQ ID NO: 60309 - DNA, 20 bp, Artificial Sequence
  Description of Artificial Sequence: Synthetic oligonucleotide
  Target: SCN10A; (+) strand; PAM type: YTN; PAM sequence: CTA
aatagcactgtcttgtccca

SEQ ID NO: 60310 - DNA, 20 bp, Artificial Sequence
  Description of Artificial Sequence: Synthetic oligonucleotide
  Target: SCN10A; (+) strand; PAM type: YTN; PAM sequence: CTG
tcttgtcccagacctatcct

SEQ ID NO: 60311 - DNA, 20 bp, Artificial Sequence
  Description of Artificial Sequence: Synthetic oligonucleotide
  Target: SCN10A; (+) strand; PAM type: YTN; PAM sequence: CTT
gtcccagacctatcctgtcc

SEQ ID NO: 60312 - DNA, 20 bp, Artificial Sequence
  Description of Artificial Sequence: Synthetic oligonucleotide
  Target: SCN10A; (+) strand; PAM type: YTN; PAM sequence: TTG
tcccagacctatcctgtcct

SEQ ID NO: 60313 - DNA, 20 bp, Artificial Sequence
  Description of Artificial Sequence: Synthetic oligonucleotide
  Target: SCN10A; (+) strand; PAM type: YTN; PAM sequence: CTA
tcctgtcctcttcttatgct

SEQ ID NO: 60314 - DNA, 20 bp, Artificial Sequence
  Description of Artificial Sequence: Synthetic oligonucleotide
  Target: SCN10A; (+) strand; PAM type: YTN; PAM sequence: CTG
tcctcttcttatgctcagaa

SEQ ID NO: 60315 - DNA, 20 bp, Artificial Sequence
  Description of Artificial Sequence: Synthetic oligonucleotide
  Target: SCN10A; (+) strand; PAM type: YTN; PAM sequence: CTC
ttcttatgctcagaaccctg

SEQ ID NO: 60316 - DNA, 20 bp, Artificial Sequence
  Description of Artificial Sequence: Synthetic oligonucleotide
  Target: SCN10A; (+) strand; PAM type: YTN; PAM sequence: CTT
cttatgctcagaaccctggg

SEQ ID NO: 60317 - DNA, 20 bp, Artificial Sequence
  Description of Artificial Sequence: Synthetic oligonucleotide
  Target: SCN10A; (+) strand; PAM type: YTN; PAM sequence: TTC
ttatgctcagaaccctgggc

SEQ ID NO: 60318 - DNA, 20 bp, Artificial Sequence
  Description of Artificial Sequence: Synthetic oligonucleotide
  Target: SCN10A; (+) strand; PAM type: YTN; PAM sequence: CTT
atgctcagaaccctgggcaa

SEQ ID NO: 60319 - DNA, 20 bp, Artificial Sequence
  Description of Artificial Sequence: Synthetic oligonucleotide
  Target: SCN10A; (+) strand; PAM type: YTN; PAM sequence: TTA
tgctcagaaccctgggcaag

SEQ ID NO: 60320 - DNA, 20 bp, Artificial Sequence
  Description of Artificial Sequence: Synthetic oligonucleotide
  Target: SCN10A; (+) strand; PAM type: YTN; PAM sequence: CTC
agaaccctgggcaaggattt

SEQ ID NO: 60321 - DNA, 20 bp, Artificial Sequence
  Description of Artificial Sequence: Synthetic oligonucleotide
  Target: SCN10A; (+) strand; PAM type: YTN; PAM sequence: CTG
ggcaaggatttcctgtaagt

SEQ ID NO: 60322 - DNA, 20 bp, Artificial Sequence
  Description of Artificial Sequence: Synthetic oligonucleotide
  Target: SCN10A; (+) strand; PAM type: YTN; PAM sequence: TTT
cctgtaagtggaatgcctgc

SEQ ID NO: 60323 - DNA, 20 bp, Artificial Sequence
  Description of Artificial Sequence: Synthetic oligonucleotide
  Target: SCN10A; (+) strand; PAM type: YTN; PAM sequence: TTC
ctgtaagtggaatgcctgcc

SEQ ID NO: 60324 - DNA, 20 bp, Artificial Sequence
  Description of Artificial Sequence: Synthetic oligonucleotide
  Target: SCN10A; (+) strand; PAM type: YTN; PAM sequence: CTG
taagtggaatgcctgcccta

SEQ ID NO: 60325 - DNA, 20 bp, Artificial Sequence
  Description of Artificial Sequence: Synthetic oligonucleotide
  Target: SCN10A; (+) strand; PAM type: YTN; PAM sequence: CTG
ccctagtaggtatatatttt

SEQ ID NO: 60326 - DNA, 20 bp, Artificial Sequence
  Description of Artificial Sequence: Synthetic oligonucleotide
  Target: SCN10A; (+) strand; PAM type: YTN; PAM sequence: CTA
gtaggtatatattttaaatt

SEQ ID NO: 60327 - DNA, 20 bp, Artificial Sequence
  Description of Artificial Sequence: Synthetic oligonucleotide
  Target: SCN10A; (+) strand; PAM type: YTN; PAM sequence: TTT
taaattgttaatagcaacag

SEQ ID NO: 60328 - DNA, 20 bp, Artificial Sequence
  Description of Artificial Sequence: Synthetic oligonucleotide
  Target: SCN10A; (+) strand; PAM type: YTN; PAM sequence: TTT
aaattgttaatagcaacagc

SEQ ID NO: 60329 - DNA, 20 bp, Artificial Sequence
  Description of Artificial Sequence: Synthetic oligonucleotide
  Target: SCN10A; (+) strand; PAM type: YTN; PAM sequence: TTA
aattgttaatagcaacagca

SEQ ID NO: 60330 - DNA, 20 bp, Artificial Sequence
  Description of Artificial Sequence: Synthetic oligonucleotide
  Target: SCN10A; (+) strand; PAM type: YTN; PAM sequence: TTG
ttaatagcaacagcatctgg

SEQ ID NO: 60331 - DNA, 20 bp, Artificial Sequence
  Description of Artificial Sequence: Synthetic oligonucleotide
  Target: SCN10A; (+) strand; PAM type: YTN; PAM sequence: TTA
atagcaacagcatctggtgc

SEQ ID NO: 60332 - DNA, 20 bp, Artificial Sequence
  Description of Artificial Sequence: Synthetic oligonucleotide
  Target: SCN10A; (+) strand; PAM type: YTN; PAM sequence: CTG
gtgctcttgaggcgctgcca

SEQ ID NO: 60333 - DNA, 20 bp, Artificial Sequence
  Description of Artificial Sequence: Synthetic oligonucleotide
  Target: SCN10A; (+) strand; PAM type: YTN; PAM sequence: CTC
ttgaggcgctgccagtcaca

SEQ ID NO: 60334 - DNA, 20 bp, Artificial Sequence
  Description of Artificial Sequence: Synthetic oligonucleotide
  Target: SCN10A; (+) strand; PAM type: YTN; PAM sequence: CTT
gaggcgctgccagtcacact

SEQ ID NO: 60335 - DNA, 20 bp, Artificial Sequence
  Description of Artificial Sequence: Synthetic oligonucleotide
  Target: SCN10A; (+) strand; PAM type: YTN; PAM sequence: TTG
aggcgctgccagtcacactc

SEQ ID NO: 60336 - DNA, 20 bp, Artificial Sequence
  Description of Artificial Sequence: Synthetic oligonucleotide
  Target: SCN10A; (+) strand; PAM type: YTN; PAM sequence: CTG
ccagtcacactcccctctgc

SEQ ID NO: 60337 - DNA, 20 bp, Artificial Sequence
  Description of Artificial Sequence: Synthetic oligonucleotide
  Target: SCN10A; (+) strand; PAM type: YTN; PAM sequence: CTC
ccctctgctgttacagtgcc

SEQ ID NO: 60338 - DNA, 20 bp, Artificial Sequence
  Description of Artificial Sequence: Synthetic oligonucleotide
  Target: SCN10A; (+) strand; PAM type: YTN; PAM sequence: CTC
tgctgttacagtgccagaaa

SEQ ID NO: 60339 - DNA, 20 bp, Artificial Sequence
  Description of Artificial Sequence: Synthetic oligonucleotide
  Target: SCN10A; (+) strand; PAM type: YTN; PAM sequence: CTG
ctgttacagtgccagaaact

SEQ ID NO: 60340 - DNA, 20 bp, Artificial Sequence
  Description of Artificial Sequence: Synthetic oligonucleotide
  Target: SCN10A; (+) strand; PAM type: YTN; PAM sequence: CTG
ttacagtgccagaaactgca

SEQ ID NO: 60341 - DNA, 20 bp, Artificial Sequence
  Description of Artificial Sequence: Synthetic oligonucleotide
  Target: SCN10A; (+) strand; PAM type: YTN; PAM sequence: TTA
cagtgccagaaactgcacca

SEQ ID NO: 60342 - DNA, 20 bp, Artificial Sequence
  Description of Artificial Sequence: Synthetic oligonucleotide
  Target: SCN10A; (+) strand; PAM type: YTN; PAM sequence: CTG
caccaccaaagttgtcttat

SEQ ID NO: 60343 - DNA, 20 bp, Artificial Sequence
  Description of Artificial Sequence: Synthetic oligonucleotide
  Target: SCN10A; (+) strand; PAM type: YTN; PAM sequence: TTG
tcttatgctcagtgatcttt

SEQ ID NO: 60344 - DNA, 20 bp, Artificial Sequence
  Description of Artificial Sequence: Synthetic oligonucleotide
  Target: SCN10A; (+) strand; PAM type: YTN; PAM sequence: CTT
atgctcagtgatctttgttc

SEQ ID NO: 60345 - DNA, 20 bp, Artificial Sequence
  Description of Artificial Sequence: Synthetic oligonucleotide
  Target: SCN10A; (+) strand; PAM type: YTN; PAM sequence: TTA
tgctcagtgatctttgttca

SEQ ID NO: 60346 - DNA, 20 bp, Artificial Sequence
  Description of Artificial Sequence: Synthetic oligonucleotide
  Target: SCN10A; (+) strand; PAM type: YTN; PAM sequence: CTC
agtgatctttgttcaggatt

SEQ ID NO: 60347 - DNA, 20 bp, Artificial Sequence
  Description of Artificial Sequence: Synthetic oligonucleotide
  Target: SCN10A; (+) strand; PAM type: YTN; PAM sequence: CTT
tgttcaggattttgtttacc

SEQ ID NO: 60348 - DNA, 20 bp, Artificial Sequence
  Description of Artificial Sequence: Synthetic oligonucleotide
  Target: SCN10A; (+) strand; PAM type: YTN; PAM sequence: TTT
gttcaggattttgtttaccc

SEQ ID NO: 60349 - DNA, 20 bp, Artificial Sequence
  Description of Artificial Sequence: Synthetic oligonucleotide
  Target: SCN10A; (+) strand; PAM type: YTN; PAM sequence: TTG
ttcaggattttgtttacccc

SEQ ID NO: 60350 - DNA, 20 bp, Artificial Sequence
  Description of Artificial Sequence: Synthetic oligonucleotide
  Target: SCN10A; (+) strand; PAM type: YTN; PAM sequence: TTC
aggattttgtttacccctca

SEQ ID NO: 60351 - DNA, 20 bp, Artificial Sequence
  Description of Artificial Sequence: Synthetic oligonucleotide
  Target: SCN10A; (+) strand; PAM type: YTN; PAM sequence: TTT
tgtttacccctcaccacaat

SEQ ID NO: 60352 - DNA, 20 bp, Artificial Sequence
  Description of Artificial Sequence: Synthetic oligonucleotide
  Target: SCN10A; (+) strand; PAM type: YTN; PAM sequence: TTT
gtttacccctcaccacaatc

SEQ ID NO: 60353 - DNA, 20 bp, Artificial Sequence
  Description of Artificial Sequence: Synthetic oligonucleotide
  Target: SCN10A; (+) strand; PAM type: YTN; PAM sequence: TTG
tttacccctcaccacaatcc

SEQ ID NO: 60354 - DNA, 20 bp, Artificial Sequence
  Description of Artificial Sequence: Synthetic oligonucleotide
  Target: SCN10A; (+) strand; PAM type: YTN; PAM sequence: TTT
acccctcaccacaatccaga

SEQ ID NO: 60355 - DNA, 20 bp, Artificial Sequence
  Description of Artificial Sequence: Synthetic oligonucleotide
  Target: SCN10A; (+) strand; PAM type: YTN; PAM sequence: TTA
cccctcaccacaatccagag

SEQ ID NO: 60356 - DNA, 20 bp, Artificial Sequence
  Description of Artificial Sequence: Synthetic oligonucleotide
  Target: SCN10A; (+) strand; PAM type: YTN; PAM sequence: CTC
accacaatccagagagtagg

SEQ ID NO: 60357 - DNA, 20 bp, Artificial Sequence
  Description of Artificial Sequence: Synthetic oligonucleotide
  Target: SCN10A; (+) strand; PAM type: YTN; PAM sequence: TTA
ttagccccattgaatgaatg

SEQ ID NO: 60358 - DNA, 20 bp, Artificial Sequence
  Description of Artificial Sequence: Synthetic oligonucleotide
  Target: SCN10A; (+) strand; PAM type: YTN; PAM sequence: TTA
gccccattgaatgaatgaga

SEQ ID NO: 60359 - DNA, 20 bp, Artificial Sequence
  Description of Artificial Sequence: Synthetic oligonucleotide
  Target: SCN10A; (+) strand; PAM type: YTN; PAM sequence: TTG
aatgaatgagaaaactgaga

SEQ ID NO: 60360 - DNA, 20 bp, Artificial Sequence
  Description of Artificial Sequence: Synthetic oligonucleotide
  Target: SCN10A; (+) strand; PAM type: YTN; PAM sequence: CTG
agactcagaggggtttaaaa

SEQ ID NO: 60361 - DNA, 20 bp, Artificial Sequence
  Description of Artificial Sequence: Synthetic oligonucleotide
  Target: SCN10A; (+) strand; PAM type: YTN; PAM sequence: CTC
agaggggtttaaaatattgc

SEQ ID NO: 60362 - DNA, 20 bp, Artificial Sequence
  Description of Artificial Sequence: Synthetic oligonucleotide
  Target: SCN10A; (+) strand; PAM type: YTN; PAM sequence: TTT
aaaatattgccagcatgagc

SEQ ID NO: 60363 - DNA, 20 bp, Artificial Sequence
  Description of Artificial Sequence: Synthetic oligonucleotide
  Target: SCN10A; (+) strand; PAM type: YTN; PAM sequence: TTA
aaatattgccagcatgagcc

SEQ ID NO: 60364 - DNA, 20 bp, Artificial Sequence
  Description of Artificial Sequence: Synthetic oligonucleotide
  Target: SCN10A; (+) strand; PAM type: YTN; PAM sequence: TTG
ccagcatgagccatccacaa

SEQ ID NO: 60365 - DNA, 20 bp, Artificial Sequence
  Description of Artificial Sequence: Synthetic oligonucleotide
  Target: SCN10A; (+) strand; PAM type: YTN; PAM sequence: TTG
agtcaggaatgcaaacccag

SEQ ID NO: 60366 - DNA, 20 bp, Artificial Sequence
  Description of Artificial Sequence: Synthetic oligonucleotide
  Target: SCN10A; (+) strand; PAM type: YTN; PAM sequence: TTT
gcatgtactctgtgacttat

SEQ ID NO: 60367 - DNA, 20 bp, Artificial Sequence
  Description of Artificial Sequence: Synthetic oligonucleotide
  Target: SCN10A; (+) strand; PAM type: YTN; PAM sequence: TTG
catgtactctgtgacttatc

SEQ ID NO: 60368 - DNA, 20 bp, Artificial Sequence
  Description of Artificial Sequence: Synthetic oligonucleotide
  Target: SCN10A; (+) strand; PAM type: YTN; PAM sequence: CTC
tgtgacttatccatgtagcc

SEQ ID NO: 60369 - DNA, 20 bp, Artificial Sequence
  Description of Artificial Sequence: Synthetic oligonucleotide
  Target: SCN10A; (+) strand; PAM type: YTN; PAM sequence: CTG
tgacttatccatgtagcccc

SEQ ID NO: 60370 - DNA, 20 bp, Artificial Sequence
  Description of Artificial Sequence: Synthetic oligonucleotide
  Target: SCN10A; (+) strand; PAM type: YTN; PAM sequence: CTT
atccatgtagccccttttct

SEQ ID NO: 60371 - DNA, 20 bp, Artificial Sequence
  Description of Artificial Sequence: Synthetic oligonucleotide
  Target: SCN10A; (+) strand; PAM type: YTN; PAM sequence: TTA
tccatgtagccccttttctc

SEQ ID NO: 60372 - DNA, 20 bp, Artificial Sequence
  Description of Artificial Sequence: Synthetic oligonucleotide
  Target: SCN10A; (+) strand; PAM type: YTN; PAM sequence: CTT
ttctctcgggatctcagtta

SEQ ID NO: 60373 - DNA, 20 bp, Artificial Sequence
  Description of Artificial Sequence: Synthetic oligonucleotide
  Target: SCN10A; (+) strand; PAM type: YTN; PAM sequence: TTT
tctctcgggatctcagttac

SEQ ID NO: 60374 - DNA, 20 bp, Artificial Sequence
  Description of Artificial Sequence: Synthetic oligonucleotide
  Target: SCN10A; (+) strand; PAM type: YTN; PAM sequence: TTT
ctctcgggatctcagttacg

SEQ ID NO: 60375 - DNA, 20 bp, Artificial Sequence
  Description of Artificial Sequence: Synthetic oligonucleotide
  Target: SCN10A; (+) strand; PAM type: YTN; PAM sequence: TTC
tctcgggatctcagttacgc

SEQ ID NO: 60376 - DNA, 20 bp, Artificial Sequence
  Description of Artificial Sequence: Synthetic oligonucleotide
  Target: SCN10A; (+) strand; PAM type: YTN; PAM sequence: CTC
tcgggatctcagttacgcaa

SEQ ID NO: 60377 - DNA, 20 bp, Artificial Sequence
  Description of Artificial Sequence: Synthetic oligonucleotide
  Target: SCN10A; (+) strand; PAM type: YTN; PAM sequence: CTC
gggatctcagttacgcaaat

SEQ ID NO: 60378 - DNA, 20 bp, Artificial Sequence
  Description of Artificial Sequence: Synthetic oligonucleotide
  Target: SCN10A; (+) strand; PAM type: YTN; PAM sequence: CTC
agttacgcaaatctagaaca

SEQ ID NO: 60379 - DNA, 20 bp, Artificial Sequence
  Description of Artificial Sequence: Synthetic oligonucleotide
  Target: SCN10A; (+) strand; PAM type: YTN; PAM sequence: TTA
cgcaaatctagaacagcgcc

SEQ ID NO: 60380 - DNA, 20 bp, Artificial Sequence
  Description of Artificial Sequence: Synthetic oligonucleotide
  Target: SCN10A; (+) strand; PAM type: YTN; PAM sequence: CTA
gaacagcgcctatctacctc

SEQ ID NO: 60381 - DNA, 20 bp, Artificial Sequence
  Description of Artificial Sequence: Synthetic oligonucleotide
  Target: SCN10A; (+) strand; PAM type: YTN; PAM sequence: CTA
tctacctcaggggtatggaa

SEQ ID NO: 60382 - DNA, 20 bp, Artificial Sequence
  Description of Artificial Sequence: Synthetic oligonucleotide
  Target: SCN10A; (+) strand; PAM type: YTN; PAM sequence: CTA
cctcaggggtatggaaggca

SEQ ID NO: 60383 - DNA, 20 bp, Artificial Sequence
  Description of Artificial Sequence: Synthetic oligonucleotide
  Target: SCN10A; (+) strand; PAM type: YTN; PAM sequence: CTC
aggggtatggaaggcattaa

SEQ ID NO: 60384 - DNA, 20 bp, Artificial Sequence
  Description of Artificial Sequence: Synthetic oligonucleotide
  Target: SCN10A; (+) strand; PAM type: YTN; PAM sequence: TTA
aatgaaaggataataggaaa

SEQ ID NO: 60385 - DNA, 20 bp, Artificial Sequence
  Description of Artificial Sequence: Synthetic oligonucleotide
  Target: SCN10A; (+) strand; PAM type: YTN; PAM sequence: CTT
tatacctttattgccctgac

SEQ ID NO: 60386 - DNA, 20 bp, Artificial Sequence
  Description of Artificial Sequence: Synthetic oligonucleotide
  Target: SCN10A; (+) strand; PAM type: YTN; PAM sequence: TTT
atacctttattgccctgaca

SEQ ID NO: 60387 - DNA, 20 bp, Artificial Sequence
  Description of Artificial Sequence: Synthetic oligonucleotide
  Target: SCN10A; (+) strand; PAM type: YTN; PAM sequence: TTA
tacctttattgccctgacat

SEQ ID NO: 60388 - DNA, 20 bp, Artificial Sequence
  Description of Artificial Sequence: Synthetic oligonucleotide
  Target: SCN10A; (+) strand; PAM type: YTN; PAM sequence: CTT
tattgccctgacattttctt

SEQ ID NO: 60389 - DNA, 20 bp, Artificial Sequence
  Description of Artificial Sequence: Synthetic oligonucleotide
  Target: SCN10A; (+) strand; PAM type: YTN; PAM sequence: TTT
attgccctgacattttctta

SEQ ID NO: 60390 - DNA, 20 bp, Artificial Sequence
  Description of Artificial Sequence: Synthetic oligonucleotide
  Target: SCN10A; (+) strand; PAM type: YTN; PAM sequence: TTA
ttgccctgacattttcttat

SEQ ID NO: 60391 - DNA, 20 bp, Artificial Sequence
  Description of Artificial Sequence: Synthetic oligonucleotide
  Target: SCN10A; (+) strand; PAM type: YTN; PAM sequence: TTG
ccctgacattttcttataaa

SEQ ID NO: 60392 - DNA, 20 bp, Artificial Sequence
  Description of Artificial Sequence: Synthetic oligonucleotide
  Target: SCN10A; (+) strand; PAM type: YTN; PAM sequence: CTG
acattttcttataaacatga

SEQ ID NO: 60393 - DNA, 20 bp, Artificial Sequence
  Description of Artificial Sequence: Synthetic oligonucleotide
  Target: SCN10A; (+) strand; PAM type: YTN; PAM sequence: TTT
tcttataaacatgagaggtt

SEQ ID NO: 60394 - DNA, 20 bp, Artificial Sequence
  Description of Artificial Sequence: Synthetic oligonucleotide
  Target: SCN10A; (+) strand; PAM type: YTN; PAM sequence: TTT
cttataaacatgagaggtta

SEQ ID NO: 60395 - DNA, 20 bp, Artificial Sequence
  Description of Artificial Sequence: Synthetic oligonucleotide
  Target: SCN10A; (+) strand; PAM type: YTN; PAM sequence: TTC
ttataaacatgagaggttat

SEQ ID NO: 60396 - DNA, 20 bp, Artificial Sequence
  Description of Artificial Sequence: Synthetic oligonucleotide
  Target: SCN10A; (+) strand; PAM type: YTN; PAM sequence: CTT
ataaacatgagaggttatct

SEQ ID NO: 60397 - DNA, 20 bp, Artificial Sequence
  Description of Artificial Sequence: Synthetic oligonucleotide
  Target: SCN10A; (+) strand; PAM type: YTN; PAM sequence: TTA
taaacatgagaggttatctg

SEQ ID NO: 60398 - DNA, 20 bp, Artificial Sequence
  Description of Artificial Sequence: Synthetic oligonucleotide
  Target: SCN10A; (+) strand; PAM type: YTN; PAM sequence: TTA
tctgggattcgattcctatt

SEQ ID NO: 60399 - DNA, 20 bp, Artificial Sequence
  Description of Artificial Sequence: Synthetic oligonucleotide
  Target: SCN10A; (+) strand; PAM type: YTN; PAM sequence: CTG
ggattcgattcctattaatc

SEQ ID NO: 60400 - DNA, 20 bp, Artificial Sequence
  Description of Artificial Sequence: Synthetic oligonucleotide
  Target: SCN10A; (+) strand; PAM type: YTN; PAM sequence: TTC
gattcctattaatcagagtc

SEQ ID NO: 60401 - DNA, 20 bp, Artificial Sequence
  Description of Artificial Sequence: Synthetic oligonucleotide
  Target: SCN10A; (+) strand; PAM type: YTN; PAM sequence: TTC
ctattaatcagagtcggcac

SEQ ID NO: 60402 - DNA, 20 bp, Artificial Sequence
  Description of Artificial Sequence: Synthetic oligonucleotide
  Target: SCN10A; (+) strand; PAM type: YTN; PAM sequence: CTA
ttaatcagagtcggcaccct

SEQ ID NO: 60403 - DNA, 20 bp, Artificial Sequence
  Description of Artificial Sequence: Synthetic oligonucleotide
  Target: SCN10A; (+) strand; PAM type: YTN; PAM sequence: TTA
atcagagtcggcacccttgg

SEQ ID NO: 60404 - DNA, 20 bp, Artificial Sequence
  Description of Artificial Sequence: Synthetic oligonucleotide
  Target: SCN10A; (+) strand; PAM type: YTN; PAM sequence: CTT
ggaggcacaagccttcctcc

SEQ ID NO: 60405 - DNA, 20 bp, Artificial Sequence
  Description of Artificial Sequence: Synthetic oligonucleotide
  Target: SCN10A; (+) strand; PAM type: YTN; PAM sequence: TTG
gaggcacaagccttcctccc

SEQ ID NO: 60406 - DNA, 20 bp, Artificial Sequence
  Description of Artificial Sequence: Synthetic oligonucleotide
  Target: SCN10A; (+) strand; PAM type: YTN; PAM sequence: CTT
cctccccatcccaaggaggg

SEQ ID NO: 60407 - DNA, 20 bp, Artificial Sequence
  Description of Artificial Sequence: Synthetic oligonucleotide
  Target: SCN10A; (+) strand; PAM type: YTN; PAM sequence: TTC
ctccccatcccaaggagggt

SEQ ID NO: 60408 - DNA, 20 bp, Artificial Sequence
  Description of Artificial Sequence: Synthetic oligonucleotide
  Target: SCN10A; (+) strand; PAM type: YTN; PAM sequence: CTC
cccatcccaaggagggttgg

SEQ ID NO: 60409 - DNA, 20 bp, Artificial Sequence
  Description of Artificial Sequence: Synthetic oligonucleotide
  Target: SCN10A; (+) strand; PAM type: YTN; PAM sequence: TTG
ggattctgccagtgctgggc

SEQ ID NO: 60410 - DNA, 20 bp, Artificial Sequence
  Description of Artificial Sequence: Synthetic oligonucleotide
  Target: SCN10A; (+) strand; PAM type: YTN; PAM sequence: TTC
tgccagtgctgggccatggc

SEQ ID NO: 60411 - DNA, 20 bp, Artificial Sequence
  Description of Artificial Sequence: Synthetic oligonucleotide
  Target: SCN10A; (+) strand; PAM type: YTN; PAM sequence: CTG
ccagtgctgggccatggcct

SEQ ID NO: 60412 - DNA, 20 bp, Artificial Sequence
  Description of Artificial Sequence: Synthetic oligonucleotide
  Target: SCN10A; (+) strand; PAM type: YTN; PAM sequence: CTG
ggccatggcctttcctgagg

SEQ ID NO: 60413 - DNA, 20 bp, Artificial Sequence
  Description of Artificial Sequence: Synthetic oligonucleotide
  Target: SCN10A; (+) strand; PAM type: YTN; PAM sequence: CTT
tcctgaggtgccctgactca

SEQ ID NO: 60414 - DNA, 20 bp, Artificial Sequence
  Description of Artificial Sequence: Synthetic oligonucleotide
  Target: SCN10A; (+) strand; PAM type: YTN; PAM sequence: TTT
cctgaggtgccctgactcag

SEQ ID NO: 60415 - DNA, 20 bp, Artificial Sequence
  Description of Artificial Sequence: Synthetic oligonucleotide
  Target: SCN10A; (+) strand; PAM type: YTN; PAM sequence: TTC
ctgaggtgccctgactcagt

SEQ ID NO: 60416 - DNA, 20 bp, Artificial Sequence
  Description of Artificial Sequence: Synthetic oligonucleotide
  Target: SCN10A; (+) strand; PAM type: YTN; PAM sequence: CTG
aggtgccctgactcagtcct

SEQ ID NO: 60417 - DNA, 20 bp, Artificial Sequence
  Description of Artificial Sequence: Synthetic oligonucleotide
  Target: SCN10A; (+) strand; PAM type: YTN; PAM sequence: CTG
actcagtcctttgtggggat

SEQ ID NO: 60418 - DNA, 20 bp, Artificial Sequence
  Description of Artificial Sequence: Synthetic oligonucleotide
  Target: SCN10A; (+) strand; PAM type: YTN; PAM sequence: CTC
agtcctttgtggggatcata

SEQ ID NO: 60419 - DNA, 20 bp, Artificial Sequence
  Description of Artificial Sequence: Synthetic oligonucleotide
  Target: SCN10A; (+) strand; PAM type: YTN; PAM sequence: CTT
tgtggggatcatatccccca

SEQ ID NO: 60420 - DNA, 20 bp, Artificial Sequence
  Description of Artificial Sequence: Synthetic oligonucleotide
  Target: SCN10A; (+) strand; PAM type: YTN; PAM sequence: TTT
gtggggatcatatcccccaa

SEQ ID NO: 60421 - DNA, 20 bp, Artificial Sequence
  Description of Artificial Sequence: Synthetic oligonucleotide
  Target: SCN10A; (+) strand; PAM type: YTN; PAM sequence: TTG
tggggatcatatcccccaac

SEQ ID NO: 60422 - DNA, 20 bp, Artificial Sequence
  Description of Artificial Sequence: Synthetic oligonucleotide
  Target: SCN10A; (+) strand; PAM type: YTN; PAM sequence: TTC
tagatccctttctttccctg

SEQ ID NO: 60423 - DNA, 20 bp, Artificial Sequence
  Description of Artificial Sequence: Synthetic oligonucleotide
  Target: SCN10A; (+) strand; PAM type: YTN; PAM sequence: CTA
gatccctttctttccctgct

SEQ ID NO: 60424 - DNA, 20 bp, Artificial Sequence
  Description of Artificial Sequence: Synthetic oligonucleotide
  Target: SCN10A; (+) strand; PAM type: YTN; PAM sequence: CTT
tctttccctgcttgtattct

SEQ ID NO: 60425 - DNA, 20 bp, Artificial Sequence
  Description of Artificial Sequence: Synthetic oligonucleotide
  Target: SCN10A; (+) strand; PAM type: YTN; PAM sequence: TTT
ctttccctgcttgtattctc

SEQ ID NO: 60426 - DNA, 20 bp, Artificial Sequence
  Description of Artificial Sequence: Synthetic oligonucleotide
  Target: SCN10A; (+) strand; PAM type: YTN; PAM sequence: TTC
tttccctgcttgtattctcc

SEQ ID NO: 60427 - DNA, 20 bp, Artificial Sequence
  Description of Artificial Sequence: Synthetic oligonucleotide
  Target: SCN10A; (+) strand; PAM type: YTN; PAM sequence: CTT
tccctgcttgtattctccca

SEQ ID NO: 60428 - DNA, 20 bp, Artificial Sequence
  Description of Artificial Sequence: Synthetic oligonucleotide
  Target: SCN10A; (+) strand; PAM type: YTN; PAM sequence: TTT
ccctgcttgtattctcccag

SEQ ID NO: 60429 - DNA, 20 bp, Artificial Sequence
  Description of Artificial Sequence: Synthetic oligonucleotide
  Target: SCN10A; (+) strand; PAM type: YTN; PAM sequence: TTC
cctgcttgtattctcccagg

SEQ ID NO: 60430 - DNA, 20 bp, Artificial Sequence
  Description of Artificial Sequence: Synthetic oligonucleotide
  Target: SCN10A; (+) strand; PAM type: YTN; PAM sequence: CTG
cttgtattctcccagggctc

SEQ ID NO: 60431 - DNA, 20 bp, Artificial Sequence
  Description of Artificial Sequence: Synthetic oligonucleotide
  Target: SCN10A; (+) strand; PAM type: YTN; PAM sequence: CTT
gtattctcccagggctcact

SEQ ID NO: 60432 - DNA, 20 bp, Artificial Sequence
  Description of Artificial Sequence: Synthetic oligonucleotide
  Target: SCN10A; (+) strand; PAM type: YTN; PAM sequence: TTG
tattctcccagggctcactt

SEQ ID NO: 60433 - DNA, 20 bp, Artificial Sequence
  Description of Artificial Sequence: Synthetic oligonucleotide
  Target: SCN10A; (+) strand; PAM type: YTN; PAM sequence: TTC
tcccagggctcacttggaac

SEQ ID NO: 60434 - DNA, 20 bp, Artificial Sequence
  Description of Artificial Sequence: Synthetic oligonucleotide
  Target: SCN10A; (+) strand; PAM type: YTN; PAM sequence: CTC
ccagggctcacttggaacac

SEQ ID NO: 60435 - DNA, 20 bp, Artificial Sequence
  Description of Artificial Sequence: Synthetic oligonucleotide
  Target: SCN10A; (+) strand; PAM type: YTN; PAM sequence: CTC
acttggaacacatctaacac

SEQ ID NO: 60436 - DNA, 20 bp, Artificial Sequence
  Description of Artificial Sequence: Synthetic oligonucleotide
  Target: SCN10A; (+) strand; PAM type: YTN; PAM sequence: CTT
ggaacacatctaacacacct

SEQ ID NO: 60437 - DNA, 20 bp, Artificial Sequence
  Description of Artificial Sequence: Synthetic oligonucleotide
  Target: SCN10A; (+) strand; PAM type: YTN; PAM sequence: TTG
gaacacatctaacacacctg

SEQ ID NO: 60438 - DNA, 20 bp, Artificial Sequence
  Description of Artificial Sequence: Synthetic oligonucleotide
  Target: SCN10A; (+) strand; PAM type: YTN; PAM sequence: CTA
acacacctggttccagttgg

SEQ ID NO: 60439 - DNA, 20 bp, Artificial Sequence
  Description of Artificial Sequence: Synthetic oligonucleotide
  Target: SCN10A; (+) strand; PAM type: YTN; PAM sequence: CTG
gttccagttgggaagaccaa

SEQ ID NO: 60440 - DNA, 20 bp, Artificial Sequence
  Description of Artificial Sequence: Synthetic oligonucleotide
  Target: SCN10A; (+) strand; PAM type: YTN; PAM sequence: TTC
cagttgggaagaccaagatc

SEQ ID NO: 60441 - DNA, 20 bp, Artificial Sequence
  Description of Artificial Sequence: Synthetic oligonucleotide
  Target: SCN10A; (+) strand; PAM type: YTN; PAM sequence: TTG
ggaagaccaagatccctttg

SEQ ID NO: 60442 - DNA, 20 bp, Artificial Sequence
  Description of Artificial Sequence: Synthetic oligonucleotide
  Target: SCN10A; (+) strand; PAM type: YTN; PAM sequence: CTT
tgagatgtgaatcctgagtg

SEQ ID NO: 60443 - DNA, 20 bp, Artificial Sequence
  Description of Artificial Sequence: Synthetic oligonucleotide
  Target: SCN10A; (+) strand; PAM type: YTN; PAM sequence: TTT
gagatgtgaatcctgagtga

SEQ ID NO: 60444 - DNA, 20 bp, Artificial Sequence
  Description of Artificial Sequence: Synthetic oligonucleotide
  Target: SCN10A; (+) strand; PAM type: YTN; PAM sequence: TTG
agatgtgaatcctgagtgag

SEQ ID NO: 60445 - DNA, 20 bp, Artificial Sequence
  Description of Artificial Sequence: Synthetic oligonucleotide
  Target: SCN10A; (+) strand; PAM type: YTN; PAM sequence: CTG
agtgaggatgttagtggggc

SEQ ID NO: 60446 - DNA, 20 bp, Artificial Sequence
  Description of Artificial Sequence: Synthetic oligonucleotide
  Target: SCN10A; (+) strand; PAM type: YTN; PAM sequence: TTA
gtggggcattgctgacagag

SEQ ID NO: 60447 - DNA, 20 bp, Artificial Sequence
  Description of Artificial Sequence: Synthetic oligonucleotide
  Target: SCN10A; (+) strand; PAM type: YTN; PAM sequence: TTG
ctgacagagagaaatgcaac

SEQ ID NO: 60448 - DNA, 20 bp, Artificial Sequence
  Description of Artificial Sequence: Synthetic oligonucleotide
  Target: SCN10A; (+) strand; PAM type: YTN; PAM sequence: CTG
acagagagaaatgcaactct

SEQ ID NO: 60449 - DNA, 20 bp, Artificial Sequence
  Description of Artificial Sequence: Synthetic oligonucleotide
  Target: SCN10A; (+) strand; PAM type: YTN; PAM sequence: CTC
ttcctgcaacagcaatcaca

SEQ ID NO: 60450 - DNA, 20 bp, Artificial Sequence
  Description of Artificial Sequence: Synthetic oligonucleotide
  Target: SCN10A; (+) strand; PAM type: YTN; PAM sequence: CTT
cctgcaacagcaatcacagg

SEQ ID NO: 60451 - DNA, 20 bp, Artificial Sequence
  Description of Artificial Sequence: Synthetic oligonucleotide
  Target: SCN10A; (+) strand; PAM type: YTN; PAM sequence: TTC
ctgcaacagcaatcacaggg

SEQ ID NO: 60452 - DNA, 20 bp, Artificial Sequence
  Description of Artificial Sequence: Synthetic oligonucleotide
  Target: SCN10A; (+) strand; PAM type: YTN; PAM sequence: CTG
caacagcaatcacagggcaa

SEQ ID NO: 60453 - DNA, 20 bp, Artificial Sequence
  Description of Artificial Sequence: Synthetic oligonucleotide
  Target: SCN10A; (+) strand; PAM type: YTN; PAM sequence: TTA
gcactgatattaaagtgatg

SEQ ID NO: 60454 - DNA, 20 bp, Artificial Sequence
  Description of Artificial Sequence: Synthetic oligonucleotide
  Target: SCN10A; (+) strand; PAM type: YTN; PAM sequence: CTG
atattaaagtgatgggctgt

SEQ ID NO: 60455 - DNA, 20 bp, Artificial Sequence
  Description of Artificial Sequence: Synthetic oligonucleotide
  Target: SCN10A; (+) strand; PAM type: YTN; PAM sequence: TTA
aagtgatgggctgtgagtag

SEQ ID NO: 60456 - DNA, 20 bp, Artificial Sequence
  Description of Artificial Sequence: Synthetic oligonucleotide
  Target: SCN10A; (+) strand; PAM type: YTN; PAM sequence: CTG
tgagtagtgttggcttttgt

SEQ ID NO: 60457 - DNA, 20 bp, Artificial Sequence
  Description of Artificial Sequence: Synthetic oligonucleotide
  Target: SCN10A; (+) strand; PAM type: YTN; PAM sequence: TTG
gcttttgtcaggaggccaga

SEQ ID NO: 60458 - DNA, 20 bp, Artificial Sequence
  Description of Artificial Sequence: Synthetic oligonucleotide
  Target: SCN10A; (+) strand; PAM type: YTN; PAM sequence: CTT
ttgtcaggaggccagagctg

SEQ ID NO: 60459 - DNA, 20 bp, Artificial Sequence
  Description of Artificial Sequence: Synthetic oligonucleotide
  Target: SCN10A; (+) strand; PAM type: YTN; PAM sequence: TTT
tgtcaggaggccagagctgg

SEQ ID NO: 60460 - DNA, 20 bp, Artificial Sequence
  Description of Artificial Sequence: Synthetic oligonucleotide
  Target: SCN10A; (+) strand; PAM type: YTN; PAM sequence: TTT
gtcaggaggccagagctggg

SEQ ID NO: 60461 - DNA, 20 bp, Artificial Sequence
  Description of Artificial Sequence: Synthetic oligonucleotide
  Target: SCN10A; (+) strand; PAM type: YTN; PAM sequence: TTG
tcaggaggccagagctgggc

SEQ ID NO: 60462 - DNA, 20 bp, Artificial Sequence
  Description of Artificial Sequence: Synthetic oligonucleotide
  Target: SCN10A; (+) strand; PAM type: YTN; PAM sequence: CTG
ggcagggaacaggaaatata

SEQ ID NO: 60463 - DNA, 20 bp, Artificial Sequence
  Description of Artificial Sequence: Synthetic oligonucleotide
  Target: SCN10A; (+) strand; PAM type: YTN; PAM sequence: CTT
accactacagcagaaaccag

SEQ ID NO: 60464 - DNA, 20 bp, Artificial Sequence
  Description of Artificial Sequence: Synthetic oligonucleotide
  Target: SCN10A; (+) strand; PAM type: YTN; PAM sequence: TTA
ccactacagcagaaaccaga

SEQ ID NO: 60465 - DNA, 20 bp, Artificial Sequence
  Description of Artificial Sequence: Synthetic oligonucleotide
  Target: SCN10A; (+) strand; PAM type: YTN; PAM sequence: CTA
cagcagaaaccagaaactcc

SEQ ID NO: 60466 - DNA, 20 bp, Artificial Sequence
  Description of Artificial Sequence: Synthetic oligonucleotide
  Target: SCN10A; (+) strand; PAM type: YTN; PAM sequence: CTC
ctgagcaccacttatctttt

SEQ ID NO: 60467 - DNA, 20 bp, Artificial Sequence
  Description of Artificial Sequence: Synthetic oligonucleotide
  Target: SCN10A; (+) strand; PAM type: YTN; PAM sequence: CTG
agcaccacttatcttttttt

SEQ ID NO: 60468 - DNA, 20 bp, Artificial Sequence
  Description of Artificial Sequence: Synthetic oligonucleotide
  Target: SCN10A; (+) strand; PAM type: YTN; PAM sequence: CTT
atcttttttttctgttgatt

SEQ ID NO: 60469 - DNA, 20 bp, Artificial Sequence
  Description of Artificial Sequence: Synthetic oligonucleotide
  Target: SCN10A; (+) strand; PAM type: YTN; PAM sequence: TTA
tcttttttttctgttgattg

SEQ ID NO: 60470 - DNA, 20 bp, Artificial Sequence
  Description of Artificial Sequence: Synthetic oligonucleotide
  Target: SCN10A; (+) strand; PAM type: YTN; PAM sequence: CTT
ttttttctgttgattgaagt

SEQ ID NO: 60471 - DNA, 20 bp, Artificial Sequence
  Description of Artificial Sequence: Synthetic oligonucleotide
  Target: SCN10A; (+) strand; PAM type: YTN; PAM sequence: TTT
tttttctgttgattgaagtt

SEQ ID NO: 60472 - DNA, 20 bp, Artificial Sequence
  Description of Artificial Sequence: Synthetic oligonucleotide
  Target: SCN10A; (+) strand; PAM type: YTN; PAM sequence: TTT
ttttctgttgattgaagttg

SEQ ID NO: 60473 - DNA, 20 bp, Artificial Sequence
  Description of Artificial Sequence: Synthetic oligonucleotide
  Target: SCN10A; (+) strand; PAM type: YTN; PAM sequence: TTT
tttctgttgattgaagttgt

SEQ ID NO: 60474 - DNA, 20 bp, Artificial Sequence
  Description of Artificial Sequence: Synthetic oligonucleotide
  Target: SCN10A; (+) strand; PAM type: YTN; PAM sequence: TTT
ttctgttgattgaagttgtc

SEQ ID NO: 60475 - DNA, 20 bp, Artificial Sequence
  Description of Artificial Sequence: Synthetic oligonucleotide
  Target: SCN10A; (+) strand; PAM type: YTN; PAM sequence: TTT
tctgttgattgaagttgtca

SEQ ID NO: 60476 - DNA, 20 bp, Artificial Sequence
  Description of Artificial Sequence: Synthetic oligonucleotide
  Target: SCN10A; (+) strand; PAM type: YTN; PAM sequence: TTT
ctgttgattgaagttgtcaa

SEQ ID NO: 60477 - DNA, 20 bp, Artificial Sequence
  Description of Artificial Sequence: Synthetic oligonucleotide
  Target: SCN10A; (+) strand; PAM type: YTN; PAM sequence: TTC
tgttgattgaagttgtcaat

SEQ ID NO: 60478 - DNA, 20 bp, Artificial Sequence
  Description of Artificial Sequence: Synthetic oligonucleotide
  Target: SCN10A; (+) strand; PAM type: YTN; PAM sequence: CTG
ttgattgaagttgtcaatta

SEQ ID NO: 60479 - DNA, 20 bp, Artificial Sequence
  Description of Artificial Sequence: Synthetic oligonucleotide
  Target: SCN10A; (+) strand; PAM type: YTN; PAM sequence: TTG
attgaagttgtcaattatga

SEQ ID NO: 60480 - DNA, 20 bp, Artificial Sequence
  Description of Artificial Sequence: Synthetic oligonucleotide
  Target: SCN10A; (+) strand; PAM type: YTN; PAM sequence: TTG
aagttgtcaattatgacccc

SEQ ID NO: 60481 - DNA, 20 bp, Artificial Sequence
  Description of Artificial Sequence: Synthetic oligonucleotide
  Target: SCN10A; (+) strand; PAM type: YTN; PAM sequence: TTG
tcaattatgaccccaacaaa

SEQ ID NO: 60482 - DNA, 20 bp, Artificial Sequence
  Description of Artificial Sequence: Synthetic oligonucleotide
  Target: SCN10A; (+) strand; PAM type: YTN; PAM sequence: TTA
tgaccccaacaaagagattc

SEQ ID NO: 60483 - DNA, 20 bp, Artificial Sequence
  Description of Artificial Sequence: Synthetic oligonucleotide
  Target: SCN10A; (+) strand; PAM type: YTN; PAM sequence: TTC
agtgtgaagaagcctccaaa

SEQ ID NO: 60484 - DNA, 20 bp, Artificial Sequence
  Description of Artificial Sequence: Synthetic oligonucleotide
  Target: SCN10A; (+) strand; PAM type: YTN; PAM sequence: CTC
caaaaatgatgaagatgaca

SEQ ID NO: 60485 - DNA, 20 bp, Artificial Sequence
  Description of Artificial Sequence: Synthetic oligonucleotide
  Target: SCN10A; (+) strand; PAM type: YTN; PAM sequence: TTG
tcctcccacttgggttgcat

SEQ ID NO: 60486 - DNA, 20 bp, Artificial Sequence
  Description of Artificial Sequence: Synthetic oligonucleotide
  Target: SCN10A; (+) strand; PAM type: YTN; PAM sequence: CTC
ccacttgggttgcatgttga

SEQ ID NO: 60487 - DNA, 20 bp, Artificial Sequence
  Description of Artificial Sequence: Synthetic oligonucleotide
  Target: SCN10A; (+) strand; PAM type: YTN; PAM sequence: CTT
gggttgcatgttgacctgtg

SEQ ID NO: 60488 - DNA, 20 bp, Artificial Sequence
  Description of Artificial Sequence: Synthetic oligonucleotide
  Target: SCN10A; (+) strand; PAM type: YTN; PAM sequence: TTG
ggttgcatgttgacctgtga

SEQ ID NO: 60489 - DNA, 20 bp, Artificial Sequence
  Description of Artificial Sequence: Synthetic oligonucleotide
  Target: SCN10A; (+) strand; PAM type: YTN; PAM sequence: TTG
catgttgacctgtgaccaga

SEQ ID NO: 60490 - DNA, 20 bp, Artificial Sequence
  Description of Artificial Sequence: Synthetic oligonucleotide
  Target: SCN10A; (+) strand; PAM type: YTN; PAM sequence: TTG
acctgtgaccagacaaggga

SEQ ID NO: 60491 - DNA, 20 bp, Artificial Sequence
  Description of Artificial Sequence: Synthetic oligonucleotide
  Target: SCN10A; (+) strand; PAM type: YTN; PAM sequence: CTG
tgaccagacaagggagagtg

SEQ ID NO: 60492 - DNA, 20 bp, Artificial Sequence
  Description of Artificial Sequence: Synthetic oligonucleotide
  Target: SCN10A; (+) strand; PAM type: YTN; PAM sequence: CTT
agttcaggttcactctgaaa

SEQ ID NO: 60493 - DNA, 20 bp, Artificial Sequence
  Description of Artificial Sequence: Synthetic oligonucleotide
  Target: SCN10A; (+) strand; PAM type: YTN; PAM sequence: TTA
gttcaggttcactctgaaag

SEQ ID NO: 60494 - DNA, 20 bp, Artificial Sequence
  Description of Artificial Sequence: Synthetic oligonucleotide
  Target: SCN10A; (+) strand; PAM type: YTN; PAM sequence: TTC
aggttcactctgaaagccaa

SEQ ID NO: 60495 - DNA, 20 bp, Artificial Sequence
  Description of Artificial Sequence: Synthetic oligonucleotide
  Target: SCN10A; (+) strand; PAM type: YTN; PAM sequence: TTC
actctgaaagccaagcctaa

SEQ ID NO: 60496 - DNA, 20 bp, Artificial Sequence
  Description of Artificial Sequence: Synthetic oligonucleotide
  Target: SCN10A; (+) strand; PAM type: YTN; PAM sequence: CTC
tgaaagccaagcctaagaca

SEQ ID NO: 60497 - DNA, 20 bp, Artificial Sequence
  Description of Artificial Sequence: Synthetic oligonucleotide
  Target: SCN10A; (+) strand; PAM type: YTN; PAM sequence: CTG
aaagccaagcctaagacatg

SEQ ID NO: 60498 - DNA, 20 bp, Artificial Sequence
  Description of Artificial Sequence: Synthetic oligonucleotide
  Target: SCN10A; (+) strand; PAM type: YTN; PAM sequence: CTA
agacatggacctgggtgcag

SEQ ID NO: 60499 - DNA, 20 bp, Artificial Sequence
  Description of Artificial Sequence: Synthetic oligonucleotide
  Target: SCN10A; (+) strand; PAM type: YTN; PAM sequence: CTG
ggtgcaggtgatttatctgg

SEQ ID NO: 60500 - DNA, 20 bp, Artificial Sequence
  Description of Artificial Sequence: Synthetic oligonucleotide
  Target: SCN10A; (+) strand; PAM type: YTN; PAM sequence: TTT
atctgggaggtgatccaagg

SEQ ID NO: 60501 - DNA, 20 bp, Artificial Sequence
  Description of Artificial Sequence: Synthetic oligonucleotide
  Target: SCN10A; (+) strand; PAM type: YTN; PAM sequence: TTA
tctgggaggtgatccaagga

SEQ ID NO: 60502 - DNA, 20 bp, Artificial Sequence
  Description of Artificial Sequence: Synthetic oligonucleotide
  Target: SCN10A; (+) strand; PAM type: YTN; PAM sequence: CTG
ggaggtgatccaaggaagca

SEQ ID NO: 60503 - DNA, 20 bp, Artificial Sequence
  Description of Artificial Sequence: Synthetic oligonucleotide
  Target: SCN10A; (+) strand; PAM type: YTN; PAM sequence: CTG
tgaagaggatgttgttaagc

SEQ ID NO: 60504 - DNA, 20 bp, Artificial Sequence
  Description of Artificial Sequence: Synthetic oligonucleotide
  Target: SCN10A; (+) strand; PAM type: YTN; PAM sequence: TTG
ttaagcagggcatcattgtg

SEQ ID NO: 60505 - DNA, 20 bp, Artificial Sequence
  Description of Artificial Sequence: Synthetic oligonucleotide
  Target: SCN10A; (+) strand; PAM type: YTN; PAM sequence: TTA
agcagggcatcattgtgggc

SEQ ID NO: 60506 - DNA, 20 bp, Artificial Sequence
  Description of Artificial Sequence: Synthetic oligonucleotide
  Target: SCN10A; (+) strand; PAM type: YTN; PAM sequence: TTG
tgggcaactgaagcgcaatc

SEQ ID NO: 60507 - DNA, 20 bp, Artificial Sequence
  Description of Artificial Sequence: Synthetic oligonucleotide
  Target: SCN10A; (+) strand; PAM type: YTN; PAM sequence: CTG
aagcgcaatcctactggggt

SEQ ID NO: 60508 - DNA, 20 bp, Artificial Sequence
  Description of Artificial Sequence: Synthetic oligonucleotide
  Target: SCN10A; (+) strand; PAM type: YTN; PAM sequence: CTA
ctggggtcctctgagtaact

SEQ ID NO: 60509 - DNA, 20 bp, Artificial Sequence
  Description of Artificial Sequence: Synthetic oligonucleotide
  Target: SCN10A; (+) strand; PAM type: YTN; PAM sequence: CTG
gggtcctctgagtaactgtg

SEQ ID NO: 60510 - DNA, 20 bp, Artificial Sequence
  Description of Artificial Sequence: Synthetic oligonucleotide
  Target: SCN10A; (+) strand; PAM type: YTN; PAM sequence: CTC
tgagtaactgtgtagagcac

SEQ ID NO: 60511 - DNA, 20 bp, Artificial Sequence
  Description of Artificial Sequence: Synthetic oligonucleotide
  Target: SCN10A; (+) strand; PAM type: YTN; PAM sequence: CTG
agtaactgtgtagagcacat

SEQ ID NO: 60512 - DNA, 20 bp, Artificial Sequence
  Description of Artificial Sequence: Synthetic oligonucleotide
  Target: SCN10A; (+) strand; PAM type: YTN; PAM sequence: CTG
tgtagagcacatgcaggatt

SEQ ID NO: 60513 - DNA, 20 bp, Artificial Sequence
  Description of Artificial Sequence: Synthetic oligonucleotide
  Target: SCN10A; (+) strand; PAM type: YTN; PAM sequence: TTA
tatcaccaagggacagggaa

SEQ ID NO: 60514 - DNA, 20 bp, Artificial Sequence
  Description of Artificial Sequence: Synthetic oligonucleotide
  Target: SCN10A; (+) strand; PAM type: YTN; PAM sequence: CTG
gagtatttatcctcagactc

SEQ ID NO: 60515 - DNA, 20 bp, Artificial Sequence
  Description of Artificial Sequence: Synthetic oligonucleotide
  Target: SCN10A; (+) strand; PAM type: YTN; PAM sequence: TTT
atcctcagactcccaaaact

SEQ ID NO: 60516 - DNA, 20 bp, Artificial Sequence
  Description of Artificial Sequence: Synthetic oligonucleotide
  Target: SCN10A; (+) strand; PAM type: YTN; PAM sequence: TTA
tcctcagactcccaaaactt

SEQ ID NO: 60517 - DNA, 20 bp, Artificial Sequence
  Description of Artificial Sequence: Synthetic oligonucleotide
  Target: SCN10A; (+) strand; PAM type: YTN; PAM sequence: CTC
agactcccaaaacttattgg

SEQ ID NO: 60518 - DNA, 20 bp, Artificial Sequence
  Description of Artificial Sequence: Synthetic oligonucleotide
  Target: SCN10A; (+) strand; PAM type: YTN; PAM sequence: CTC
ccaaaacttattggtaaggg

SEQ ID NO: 60519 - DNA, 20 bp, Artificial Sequence
  Description of Artificial Sequence: Synthetic oligonucleotide
  Target: SCN10A; (+) strand; PAM type: YTN; PAM sequence: CTT
attggtaagggttgccccta

SEQ ID NO: 60520 - DNA, 20 bp, Artificial Sequence
  Description of Artificial Sequence: Synthetic oligonucleotide
  Target: SCN10A; (+) strand; PAM type: YTN; PAM sequence: TTA
ttggtaagggttgcccctag

SEQ ID NO: 60521 - DNA, 20 bp, Artificial Sequence
  Description of Artificial Sequence: Synthetic oligonucleotide
  Target: SCN10A; (+) strand; PAM type: YTN; PAM sequence: TTG
gtaagggttgcccctaggga

SEQ ID NO: 60522 - DNA, 20 bp, Artificial Sequence
  Description of Artificial Sequence: Synthetic oligonucleotide
  Target: SCN10A; (+) strand; PAM type: YTN; PAM sequence: TTG
cccctagggacattaaatcc

SEQ ID NO: 60523 - DNA, 20 bp, Artificial Sequence
  Description of Artificial Sequence: Synthetic oligonucleotide
  Target: SCN10A; (+) strand; PAM type: YTN; PAM sequence: CTA
gggacattaaatccctggta

SEQ ID NO: 60524 - DNA, 20 bp, Artificial Sequence
  Description of Artificial Sequence: Synthetic oligonucleotide
  Target: SCN10A; (+) strand; PAM type: YTN; PAM sequence: TTA
aatccctggtacttggggga

SEQ ID NO: 60525 - DNA, 20 bp, Artificial Sequence
  Description of Artificial Sequence: Synthetic oligonucleotide
  Target: SCN10A; (+) strand; PAM type: YTN; PAM sequence: CTG
gtacttgggggagaagttgc

SEQ ID NO: 60526 - DNA, 20 bp, Artificial Sequence
  Description of Artificial Sequence: Synthetic oligonucleotide
  Target: SCN10A; (+) strand; PAM type: YTN; PAM sequence: CTT
gggggagaagttgctgcaca

SEQ ID NO: 60527 - DNA, 20 bp, Artificial Sequence
  Description of Artificial Sequence: Synthetic oligonucleotide
  Target: SCN10A; (+) strand; PAM type: YTN; PAM sequence: TTG
ggggagaagttgctgcacaa

SEQ ID NO: 60528 - DNA, 20 bp, Artificial Sequence
  Description of Artificial Sequence: Synthetic oligonucleotide
  Target: SCN10A; (+) strand; PAM type: YTN; PAM sequence: TTG
ctgcacaagctcctaagccc

SEQ ID NO: 60529 - DNA, 20 bp, Artificial Sequence
  Description of Artificial Sequence: Synthetic oligonucleotide
  Target: SCN10A; (+) strand; PAM type: YTN; PAM sequence: CTG
cacaagctcctaagccctgg

SEQ ID NO: 60530 - DNA, 20 bp, Artificial Sequence
  Description of Artificial Sequence: Synthetic oligonucleotide
  Target: SCN10A; (+) strand; PAM type: YTN; PAM sequence: CTC
ctaagccctggagtctttat

SEQ ID NO: 60531 - DNA, 20 bp, Artificial Sequence
  Description of Artificial Sequence: Synthetic oligonucleotide
  Target: SCN10A; (+) strand; PAM type: YTN; PAM sequence: CTA
agccctggagtctttataca

SEQ ID NO: 60532 - DNA, 20 bp, Artificial Sequence
  Description of Artificial Sequence: Synthetic oligonucleotide
  Target: SCN10A; (+) strand; PAM type: YTN; PAM sequence: CTG
gagtctttatacagagaatc

SEQ ID NO: 60533 - DNA, 20 bp, Artificial Sequence
  Description of Artificial Sequence: Synthetic oligonucleotide
  Target: SCN10A; (+) strand; PAM type: YTN; PAM sequence: CTT
tatacagagaatcagaagtg

SEQ ID NO: 60534 - DNA, 20 bp, Artificial Sequence
  Description of Artificial Sequence: Synthetic oligonucleotide
  Target: SCN10A; (+) strand; PAM type: YTN; PAM sequence: TTT
atacagagaatcagaagtgc

SEQ ID NO: 60535 - DNA, 20 bp, Artificial Sequence
  Description of Artificial Sequence: Synthetic oligonucleotide
  Target: SCN10A; (+) strand; PAM type: YTN; PAM sequence: TTA
tacagagaatcagaagtgca

SEQ ID NO: 60536 - DNA, 20 bp, Artificial Sequence
  Description of Artificial Sequence: Synthetic oligonucleotide
  Target: SCN10A; (+) strand; PAM type: YTN; PAM sequence: CTG
caggtgaaatcagaagtggg

SEQ ID NO: 60537 - DNA, 20 bp, Artificial Sequence
  Description of Artificial Sequence: Synthetic oligonucleotide
  Target: SCN10A; (+) strand; PAM type: YTN; PAM sequence: CTA
agggaagaggtggcagggaa

SEQ ID NO: 60538 - DNA, 20 bp, Artificial Sequence
  Description of Artificial Sequence: Synthetic oligonucleotide
  Target: SCN10A; (+) strand; PAM type: YTN; PAM sequence: TTG
acagtgcctgccacagcagg

SEQ ID NO: 60539 - DNA, 20 bp, Artificial Sequence
  Description of Artificial Sequence: Synthetic oligonucleotide
  Target: SCN10A; (+) strand; PAM type: YTN; PAM sequence: CTG
ccacagcaggaagtggtcat

SEQ ID NO: 60540 - DNA, 20 bp, Artificial Sequence
  Description of Artificial Sequence: Synthetic oligonucleotide
  Target: SCN10A; (+) strand; PAM type: YTN; PAM sequence: TTC
cccaatagtgtctccccagc

SEQ ID NO: 60541 - DNA, 20 bp, Artificial Sequence
  Description of Artificial Sequence: Synthetic oligonucleotide
  Target: SCN10A; (+) strand; PAM type: YTN; PAM sequence: CTC
cccagcctggctttttcttt

SEQ ID NO: 60542 - DNA, 20 bp, Artificial Sequence
  Description of Artificial Sequence: Synthetic oligonucleotide
  Target: SCN10A; (+) strand; PAM type: YTN; PAM sequence: CTG
gctttttcttttcttttctt

SEQ ID NO: 60543 - DNA, 20 bp, Artificial Sequence
  Description of Artificial Sequence: Synthetic oligonucleotide
  Target: SCN10A; (+) strand; PAM type: YTN; PAM sequence: CTT
tttcttttcttttctttttt

SEQ ID NO: 60544 - DNA, 20 bp, Artificial Sequence
  Description of Artificial Sequence: Synthetic oligonucleotide
  Target: SCN10A; (+) strand; PAM type: YTN; PAM sequence: TTT
ttcttttcttttcttttttt

SEQ ID NO: 60545 - DNA, 20 bp, Artificial Sequence
  Description of Artificial Sequence: Synthetic oligonucleotide
  Target: SCN10A; (+) strand; PAM type: YTN; PAM sequence: TTT
tcttttcttttctttttttt

SEQ ID NO: 60546 - DNA, 20 bp, Artificial Sequence
  Description of Artificial Sequence: Synthetic oligonucleotide
  Target: SCN10A; (+) strand; PAM type: YTN; PAM sequence: TTT
cttttcttttcttttttttt

SEQ ID NO: 60547 - DNA, 20 bp, Artificial Sequence
  Description of Artificial Sequence: Synthetic oligonucleotide
  Target: SCN10A; (+) strand; PAM type: YTN; PAM sequence: TTC
ttttcttttctttttttttg

SEQ ID NO: 60548 - DNA, 20 bp, Artificial Sequence
  Description of Artificial Sequence: Synthetic oligonucleotide
  Target: SCN10A; (+) strand; PAM type: YTN; PAM sequence: CTT
ttcttttctttttttttgag

SEQ ID NO: 60549 - DNA, 20 bp, Artificial Sequence
  Description of Artificial Sequence: Synthetic oligonucleotide
  Target: SCN10A; (+) strand; PAM type: YTN; PAM sequence: TTT
tcttttctttttttttgaga

SEQ ID NO: 60550 - DNA, 20 bp, Artificial Sequence
  Description of Artificial Sequence: Synthetic oligonucleotide
  Target: SCN10A; (+) strand; PAM type: YTN; PAM sequence: TTT
cttttctttttttttgagat

SEQ ID NO: 60551 - DNA, 20 bp, Artificial Sequence
  Description of Artificial Sequence: Synthetic oligonucleotide
  Target: SCN10A; (+) strand; PAM type: YTN; PAM sequence: TTC
ttttctttttttttgagatt

SEQ ID NO: 60552 - DNA, 20 bp, Artificial Sequence
  Description of Artificial Sequence: Synthetic oligonucleotide
  Target: SCN10A; (+) strand; PAM type: YTN; PAM sequence: CTT
ttctttttttttgagattga

SEQ ID NO: 60553 - DNA, 20 bp, Artificial Sequence
  Description of Artificial Sequence: Synthetic oligonucleotide
  Target: SCN10A; (+) strand; PAM type: YTN; PAM sequence: TTT
tctttttttttgagattgag

SEQ ID NO: 60554 - DNA, 20 bp, Artificial Sequence
  Description of Artificial Sequence: Synthetic oligonucleotide
  Target: SCN10A; (+) strand; PAM type: YTN; PAM sequence: TTT
ctttttttttgagattgagt

SEQ ID NO: 60555 - DNA, 20 bp, Artificial Sequence
  Description of Artificial Sequence: Synthetic oligonucleotide
  Target: SCN10A; (+) strand; PAM type: YTN; PAM sequence: TTC
tttttttttgagattgagtc

SEQ ID NO: 60556 - DNA, 20 bp, Artificial Sequence
  Description of Artificial Sequence: Synthetic oligonucleotide
  Target: SCN10A; (+) strand; PAM type: YTN; PAM sequence: CTT
tttttttgagattgagtctc

SEQ ID NO: 60557 - DNA, 20 bp, Artificial Sequence
  Description of Artificial Sequence: Synthetic oligonucleotide
  Target: SCN10A; (+) strand; PAM type: YTN; PAM sequence: TTT
ttttttgagattgagtctcg

SEQ ID NO: 60558 - DNA, 20 bp, Artificial Sequence
  Description of Artificial Sequence: Synthetic oligonucleotide
  Target: SCN10A; (+) strand; PAM type: YTN; PAM sequence: TTT
tttttgagattgagtctcgc

SEQ ID NO: 60559 - DNA, 20 bp, Artificial Sequence
  Description of Artificial Sequence: Synthetic oligonucleotide
  Target: SCN10A; (+) strand; PAM type: YTN; PAM sequence: TTT
ttttgagattgagtctcgct

SEQ ID NO: 60560 - DNA, 20 bp, Artificial Sequence
  Description of Artificial Sequence: Synthetic oligonucleotide
  Target: SCN10A; (+) strand; PAM type: YTN; PAM sequence: TTT
tttgagattgagtctcgctg

SEQ ID NO: 60561 - DNA, 20 bp, Artificial Sequence
  Description of Artificial Sequence: Synthetic oligonucleotide
  Target: SCN10A; (+) strand; PAM type: YTN; PAM sequence: TTT
ttgagattgagtctcgctgt

SEQ ID NO: 60562 - DNA, 20 bp, Artificial Sequence
  Description of Artificial Sequence: Synthetic oligonucleotide
  Target: SCN10A; (+) strand; PAM type: YTN; PAM sequence: TTT
tgagattgagtctcgctgtc

SEQ ID NO: 60563 - DNA, 20 bp, Artificial Sequence
  Description of Artificial Sequence: Synthetic oligonucleotide
  Target: SCN10A; (+) strand; PAM type: YTN; PAM sequence: TTT
gagattgagtctcgctgtct

SEQ ID NO: 60564 - DNA, 20 bp, Artificial Sequence
  Description of Artificial Sequence: Synthetic oligonucleotide
  Target: SCN10A; (+) strand; PAM type: YTN; PAM sequence: TTG
agattgagtctcgctgtctc

SEQ ID NO: 60565 - DNA, 20 bp, Artificial Sequence
  Description of Artificial Sequence: Synthetic oligonucleotide
  Target: SCN10A; (+) strand; PAM type: YTN; PAM sequence: TTG
agtctcgctgtctcgcccaa

SEQ ID NO: 60566 - DNA, 20 bp, Artificial Sequence
  Description of Artificial Sequence: Synthetic oligonucleotide
  Target: SCN10A; (+) strand; PAM type: YTN; PAM sequence: CTC
gctgtctcgcccaagctgga

SEQ ID NO: 60567 - DNA, 20 bp, Artificial Sequence
  Description of Artificial Sequence: Synthetic oligonucleotide
  Target: SCN10A; (+) strand; PAM type: YTN; PAM sequence: CTG
tctcgcccaagctggagtgc

SEQ ID NO: 60568 - DNA, 20 bp, Artificial Sequence
  Description of Artificial Sequence: Synthetic oligonucleotide
  Target: SCN10A; (+) strand; PAM type: YTN; PAM sequence: CTC
gcccaagctggagtgcagtg

SEQ ID NO: 60569 - DNA, 20 bp, Artificial Sequence
  Description of Artificial Sequence: Synthetic oligonucleotide
  Target: SCN10A; (+) strand; PAM type: YTN; PAM sequence: CTG
gagtgcagtgacgcaatctc

SEQ ID NO: 60570 - DNA, 20 bp, Artificial Sequence
  Description of Artificial Sequence: Synthetic oligonucleotide
  Target: SCN10A; (+) strand; PAM type: YTN; PAM sequence: CTC
agctcactgcaacttctgcc

SEQ ID NO: 60571 - DNA, 20 bp, Artificial Sequence
  Description of Artificial Sequence: Synthetic oligonucleotide
  Target: SCN10A; (+) strand; PAM type: YTN; PAM sequence: CTC
actgcaacttctgcctcccg

SEQ ID NO: 60572 - DNA, 20 bp, Artificial Sequence
  Description of Artificial Sequence: Synthetic oligonucleotide
  Target: SCN10A; (+) strand; PAM type: YTN; PAM sequence: CTG
caacttctgcctcccgggtt

SEQ ID NO: 60573 - DNA, 20 bp, Artificial Sequence
  Description of Artificial Sequence: Synthetic oligonucleotide
  Target: SCN10A; (+) strand; PAM type: YTN; PAM sequence: CTT
ctgcctcccgggttcaagag

SEQ ID NO: 60574 - DNA, 20 bp, Artificial Sequence
  Description of Artificial Sequence: Synthetic oligonucleotide
  Target: SCN10A; (+) strand; PAM type: YTN; PAM sequence: TTC
tgcctcccgggttcaagaga

SEQ ID NO: 60575 - DNA, 20 bp, Artificial Sequence
  Description of Artificial Sequence: Synthetic oligonucleotide
  Target: SCN10A; (+) strand; PAM type: YTN; PAM sequence: CTG
cctcccgggttcaagagatt

SEQ ID NO: 60576 - DNA, 20 bp, Artificial Sequence
  Description of Artificial Sequence: Synthetic oligonucleotide
  Target: SCN10A; (+) strand; PAM type: YTN; PAM sequence: CTC
ccgggttcaagagattctcc

SEQ ID NO: 60577 - DNA, 20 bp, Artificial Sequence
  Description of Artificial Sequence: Synthetic oligonucleotide
  Target: SCN10A; (+) strand; PAM type: YTN; PAM sequence: TTC
aagagattctcctgtctcag

SEQ ID NO: 60578 - DNA, 20 bp, Artificial Sequence
  Description of Artificial Sequence: Synthetic oligonucleotide
  Target: SCN10A; (+) strand; PAM type: YTN; PAM sequence: TTC
tcctgtctcagtctcccgag

SEQ ID NO: 60579 - DNA, 20 bp, Artificial Sequence
  Description of Artificial Sequence: Synthetic oligonucleotide
  Target: SCN10A; (+) strand; PAM type: YTN; PAM sequence: CTC
ctgtctcagtctcccgagca

SEQ ID NO: 60580 - DNA, 20 bp, Artificial Sequence
  Description of Artificial Sequence: Synthetic oligonucleotide
  Target: SCN10A; (+) strand; PAM type: YTN; PAM sequence: CTG
tctcagtctcccgagcagct

SEQ ID NO: 60581 - DNA, 20 bp, Artificial Sequence
  Description of Artificial Sequence: Synthetic oligonucleotide
  Target: SCN10A; (+) strand; PAM type: YTN; PAM sequence: CTC
agtctcccgagcagctggga

SEQ ID NO: 60582 - DNA, 20 bp, Artificial Sequence
  Description of Artificial Sequence: Synthetic oligonucleotide
  Target: SCN10A; (+) strand; PAM type: YTN; PAM sequence: CTC
ccgagcagctgggactacag

SEQ ID NO: 60583 - DNA, 20 bp, Artificial Sequence
  Description of Artificial Sequence: Synthetic oligonucleotide
  Target: SCN10A; (+) strand; PAM type: YTN; PAM sequence: CTG
ggactacaggcacaagccgc

SEQ ID NO: 60584 - DNA, 20 bp, Artificial Sequence
  Description of Artificial Sequence: Synthetic oligonucleotide
  Target: SCN10A; (+) strand; PAM type: YTN; PAM sequence: CTA
caggcacaagccgccatgcc

SEQ ID NO: 60585 - DNA, 20 bp, Artificial Sequence
  Description of Artificial Sequence: Synthetic oligonucleotide
  Target: SCN10A; (+) strand; PAM type: YTN; PAM sequence: CTG
ctaatttctttcatatttta

SEQ ID NO: 60586 - DNA, 20 bp, Artificial Sequence
  Description of Artificial Sequence: Synthetic oligonucleotide
  Target: SCN10A; (+) strand; PAM type: YTN; PAM sequence: CTA
atttctttcatattttagta

SEQ ID NO: 60587 - DNA, 20 bp, Artificial Sequence
  Description of Artificial Sequence: Synthetic oligonucleotide
  Target: SCN10A; (+) strand; PAM type: YTN; PAM sequence: TTT
ctttcatattttagtagaga

SEQ ID NO: 60588 - DNA, 20 bp, Artificial Sequence
  Description of Artificial Sequence: Synthetic oligonucleotide
  Target: SCN10A; (+) strand; PAM type: YTN; PAM sequence: TTC
tttcatattttagtagagat

SEQ ID NO: 60589 - DNA, 20 bp, Artificial Sequence
  Description of Artificial Sequence: Synthetic oligonucleotide
  Target: SCN10A; (+) strand; PAM type: YTN; PAM sequence: CTT
tcatattttagtagagatgg

SEQ ID NO: 60590 - DNA, 20 bp, Artificial Sequence
  Description of Artificial Sequence: Synthetic oligonucleotide
  Target: SCN10A; (+) strand; PAM type: YTN; PAM sequence: TTT
catattttagtagagatggg

SEQ ID NO: 60591 - DNA, 20 bp, Artificial Sequence
  Description of Artificial Sequence: Synthetic oligonucleotide
  Target: SCN10A; (+) strand; PAM type: YTN; PAM sequence: TTC
atattttagtagagatgggg

SEQ ID NO: 60592 - DNA, 20 bp, Artificial Sequence
  Description of Artificial Sequence: Synthetic oligonucleotide
  Target: SCN10A; (+) strand; PAM type: YTN; PAM sequence: TTT
tagtagagatggggtttcac

SEQ ID NO: 60593 - DNA, 20 bp, Artificial Sequence
  Description of Artificial Sequence: Synthetic oligonucleotide
  Target: SCN10A; (+) strand; PAM type: YTN; PAM sequence: TTT
agtagagatggggtttcacc

SEQ ID NO: 60594 - DNA, 20 bp, Artificial Sequence
  Description of Artificial Sequence: Synthetic oligonucleotide
  Target: SCN10A; (+) strand; PAM type: YTN; PAM sequence: TTA
gtagagatggggtttcaccg

SEQ ID NO: 60595 - DNA, 20 bp, Artificial Sequence
  Description of Artificial Sequence: Synthetic oligonucleotide
  Target: SCN10A; (+) strand; PAM type: YTN; PAM sequence: TTT
caccgtattgcccaggctgg

SEQ ID NO: 60596 - DNA, 20 bp, Artificial Sequence
  Description of Artificial Sequence: Synthetic oligonucleotide
  Target: SCN10A; (+) strand; PAM type: YTN; PAM sequence: TTC
accgtattgcccaggctggt

SEQ ID NO: 60597 - DNA, 20 bp, Artificial Sequence
  Description of Artificial Sequence: Synthetic oligonucleotide
  Target: SCN10A; (+) strand; PAM type: YTN; PAM sequence: TTG
cccaggctggtctcctgagc

SEQ ID NO: 60598 - DNA, 20 bp, Artificial Sequence
  Description of Artificial Sequence: Synthetic oligonucleotide
  Target: SCN10A; (+) strand; PAM type: YTN; PAM sequence: CTG
gtctcctgagctcaggcaat

SEQ ID NO: 60599 - DNA, 20 bp, Artificial Sequence
  Description of Artificial Sequence: Synthetic oligonucleotide
  Target: SCN10A; (+) strand; PAM type: YTN; PAM sequence: CTC
ctgagctcaggcaatctgcc

SEQ ID NO: 60600 - DNA, 20 bp, Artificial Sequence
  Description of Artificial Sequence: Synthetic oligonucleotide
  Target: SCN10A; (+) strand; PAM type: YTN; PAM sequence: CTG
agctcaggcaatctgcccac

SEQ ID NO: 60601 - DNA, 20 bp, Artificial Sequence
  Description of Artificial Sequence: Synthetic oligonucleotide
  Target: SCN10A; (+) strand; PAM type: YTN; PAM sequence: CTC
aggcaatctgcccacctcgg

SEQ ID NO: 60602 - DNA, 20 bp, Artificial Sequence
  Description of Artificial Sequence: Synthetic oligonucleotide
  Target: SCN10A; (+) strand; PAM type: YTN; PAM sequence: CTG
cccacctcggcctcccaaag

SEQ ID NO: 60603 - DNA, 20 bp, Artificial Sequence
  Description of Artificial Sequence: Synthetic oligonucleotide
  Target: SCN10A; (+) strand; PAM type: YTN; PAM sequence: CTC
ggcctcccaaagtgctagga

SEQ ID NO: 60604 - DNA, 20 bp, Artificial Sequence
  Description of Artificial Sequence: Synthetic oligonucleotide
  Target: SCN10A; (+) strand; PAM type: YTN; PAM sequence: CTC
ccaaagtgctaggattacag

SEQ ID NO: 60605 - DNA, 20 bp, Artificial Sequence
  Description of Artificial Sequence: Synthetic oligonucleotide
  Target: SCN10A; (+) strand; PAM type: YTN; PAM sequence: CTA
ggattacaggcatgaaccac

SEQ ID NO: 60606 - DNA, 20 bp, Artificial Sequence
  Description of Artificial Sequence: Synthetic oligonucleotide
  Target: SCN10A; (+) strand; PAM type: YTN; PAM sequence: TTA
caggcatgaaccactgcgcc

SEQ ID NO: 60607 - DNA, 20 bp, Artificial Sequence
  Description of Artificial Sequence: Synthetic oligonucleotide
  Target: SCN10A; (+) strand; PAM type: YTN; PAM sequence: CTG
cgcctggcccatcctgggtt

SEQ ID NO: 60608 - DNA, 20 bp, Artificial Sequence
  Description of Artificial Sequence: Synthetic oligonucleotide
  Target: SCN10A; (+) strand; PAM type: YTN; PAM sequence: CTG
gcccatcctgggttttatga

SEQ ID NO: 60609 - DNA, 20 bp, Artificial Sequence
  Description of Artificial Sequence: Synthetic oligonucleotide
  Target: SCN10A; (+) strand; PAM type: YTN; PAM sequence: CTG
ggttttatgatagttcctga

SEQ ID NO: 60610 - DNA, 20 bp, Artificial Sequence
  Description of Artificial Sequence: Synthetic oligonucleotide
  Target: SCN10A; (+) strand; PAM type: YTN; PAM sequence: TTT
tatgatagttcctgagattc

SEQ ID NO: 60611 - DNA, 20 bp, Artificial Sequence
  Description of Artificial Sequence: Synthetic oligonucleotide
  Target: SCN10A; (+) strand; PAM type: YTN; PAM sequence: TTT
atgatagttcctgagattct

SEQ ID NO: 60612 - DNA, 20 bp, Artificial Sequence
  Description of Artificial Sequence: Synthetic oligonucleotide
  Target: SCN10A; (+) strand; PAM type: YTN; PAM sequence: TTA
tgatagttcctgagattcta

SEQ ID NO: 60613 - DNA, 20 bp, Artificial Sequence
  Description of Artificial Sequence: Synthetic oligonucleotide
  Target: SCN10A; (+) strand; PAM type: YTN; PAM sequence: TTC
ctgagattctacctcattcc

SEQ ID NO: 60614 - DNA, 20 bp, Artificial Sequence
  Description of Artificial Sequence: Synthetic oligonucleotide
  Target: SCN10A; (+) strand; PAM type: YTN; PAM sequence: CTG
agattctacctcattcctcc

SEQ ID NO: 60615 - DNA, 20 bp, Artificial Sequence
  Description of Artificial Sequence: Synthetic oligonucleotide
  Target: SCN10A; (+) strand; PAM type: YTN; PAM sequence: TTC
tacctcattcctccctatgc

SEQ ID NO: 60616 - DNA, 20 bp, Artificial Sequence
  Description of Artificial Sequence: Synthetic oligonucleotide
  Target: SCN10A; (+) strand; PAM type: YTN; PAM sequence: CTA
cctcattcctccctatgcac

SEQ ID NO: 60617 - DNA, 20 bp, Artificial Sequence
  Description of Artificial Sequence: Synthetic oligonucleotide
  Target: SCN10A; (+) strand; PAM type: YTN; PAM sequence: CTC
attcctccctatgcaccttg

SEQ ID NO: 60618 - DNA, 20 bp, Artificial Sequence
  Description of Artificial Sequence: Synthetic oligonucleotide
  Target: SCN10A; (+) strand; PAM type: YTN; PAM sequence: TTC
ctccctatgcaccttgattt

SEQ ID NO: 60619 - DNA, 20 bp, Artificial Sequence
  Description of Artificial Sequence: Synthetic oligonucleotide
  Target: SCN10A; (+) strand; PAM type: YTN; PAM sequence: CTC
cctatgcaccttgatttagc

SEQ ID NO: 60620 - DNA, 20 bp, Artificial Sequence
  Description of Artificial Sequence: Synthetic oligonucleotide
  Target: SCN10A; (+) strand; PAM type: YTN; PAM sequence: CTA
tgcaccttgatttagctact

SEQ ID NO: 60621 - DNA, 20 bp, Artificial Sequence
  Description of Artificial Sequence: Synthetic oligonucleotide
  Target: SCN10A; (+) strand; PAM type: YTN; PAM sequence: CTT
gatttagctactacccttgc

SEQ ID NO: 60622 - DNA, 20 bp, Artificial Sequence
  Description of Artificial Sequence: Synthetic oligonucleotide
  Target: SCN10A; (+) strand; PAM type: YTN; PAM sequence: TTG
atttagctactacccttgct

SEQ ID NO: 60623 - DNA, 20 bp, Artificial Sequence
  Description of Artificial Sequence: Synthetic oligonucleotide
  Target: SCN10A; (+) strand; PAM type: YTN; PAM sequence: TTT
agctactacccttgctttgc

SEQ ID NO: 60624 - DNA, 20 bp, Artificial Sequence
  Description of Artificial Sequence: Synthetic oligonucleotide
  Target: SCN10A; (+) strand; PAM type: YTN; PAM sequence: TTA
gctactacccttgctttgct

SEQ ID NO: 60625 - DNA, 20 bp, Artificial Sequence
  Description of Artificial Sequence: Synthetic oligonucleotide
  Target: SCN10A; (+) strand; PAM type: YTN; PAM sequence: CTA
ctacccttgctttgctccca

SEQ ID NO: 60626 - DNA, 20 bp, Artificial Sequence
  Description of Artificial Sequence: Synthetic oligonucleotide
  Target: SCN10A; (+) strand; PAM type: YTN; PAM sequence: CTA
cccttgctttgctcccaccc

SEQ ID NO: 60627 - DNA, 20 bp, Artificial Sequence
  Description of Artificial Sequence: Synthetic oligonucleotide
  Target: SCN10A; (+) strand; PAM type: YTN; PAM sequence: CTT
gctttgctcccacccttgtc

SEQ ID NO: 60628 - DNA, 20 bp, Artificial Sequence
  Description of Artificial Sequence: Synthetic oligonucleotide
  Target: SCN10A; (+) strand; PAM type: YTN; PAM sequence: TTG
ctttgctcccacccttgtcc

SEQ ID NO: 60629 - DNA, 20 bp, Artificial Sequence
  Description of Artificial Sequence: Synthetic oligonucleotide
  Target: SCN10A; (+) strand; PAM type: YTN; PAM sequence: CTT
tgctcccacccttgtccagg

SEQ ID NO: 60630 - DNA, 20 bp, Artificial Sequence
  Description of Artificial Sequence: Synthetic oligonucleotide
  Target: SCN10A; (+) strand; PAM type: YTN; PAM sequence: TTT
gctcccacccttgtccaggg

SEQ ID NO: 60631 - DNA, 20 bp, Artificial Sequence
  Description of Artificial Sequence: Synthetic oligonucleotide
  Target: SCN10A; (+) strand; PAM type: YTN; PAM sequence: TTG
ctcccacccttgtccaggga

SEQ ID NO: 60632 - DNA, 20 bp, Artificial Sequence
  Description of Artificial Sequence: Synthetic oligonucleotide
  Target: SCN10A; (+) strand; PAM type: YTN; PAM sequence: CTC
ccacccttgtccagggagtg

SEQ ID NO: 60633 - DNA, 20 bp, Artificial Sequence
  Description of Artificial Sequence: Synthetic oligonucleotide
  Target: SCN10A; (+) strand; PAM type: YTN; PAM sequence: CTT
gtccagggagtggctcacat

SEQ ID NO: 60634 - DNA, 20 bp, Artificial Sequence
  Description of Artificial Sequence: Synthetic oligonucleotide
  Target: SCN10A; (+) strand; PAM type: YTN; PAM sequence: TTG
tccagggagtggctcacatg

SEQ ID NO: 60635 - DNA, 20 bp, Artificial Sequence
  Description of Artificial Sequence: Synthetic oligonucleotide
  Target: SCN10A; (+) strand; PAM type: YTN; PAM sequence: CTC
acatgaactgtctcttagag

SEQ ID NO: 60636 - DNA, 20 bp, Artificial Sequence
  Description of Artificial Sequence: Synthetic oligonucleotide
  Target: SCN10A; (+) strand; PAM type: YTN; PAM sequence: CTG
tctcttagaggttatctgat

SEQ ID NO: 60637 - DNA, 20 bp, Artificial Sequence
  Description of Artificial Sequence: Synthetic oligonucleotide
  Target: SCN10A; (+) strand; PAM type: YTN; PAM sequence: CTC
ttagaggttatctgatgctt

SEQ ID NO: 60638 - DNA, 20 bp, Artificial Sequence
  Description of Artificial Sequence: Synthetic oligonucleotide
  Target: SCN10A; (+) strand; PAM type: YTN; PAM sequence: CTT
agaggttatctgatgctttc

SEQ ID NO: 60639 - DNA, 20 bp, Artificial Sequence
  Description of Artificial Sequence: Synthetic oligonucleotide
  Target: SCN10A; (+) strand; PAM type: YTN; PAM sequence: TTA
gaggttatctgatgctttcc

SEQ ID NO: 60640 - DNA, 20 bp, Artificial Sequence
  Description of Artificial Sequence: Synthetic oligonucleotide
  Target: SCN10A; (+) strand; PAM type: YTN; PAM sequence: TTA
tctgatgctttcctcaacag

SEQ ID NO: 60641 - DNA, 20 bp, Artificial Sequence
  Description of Artificial Sequence: Synthetic oligonucleotide
  Target: SCN10A; (+) strand; PAM type: YTN; PAM sequence: CTG
atgctttcctcaacagtgaa

SEQ ID NO: 60642 - DNA, 20 bp, Artificial Sequence
  Description of Artificial Sequence: Synthetic oligonucleotide
  Target: SCN10A; (+) strand; PAM type: YTN; PAM sequence: CTT
tcctcaacagtgaacagagg

SEQ ID NO: 60643 - DNA, 20 bp, Artificial Sequence
  Description of Artificial Sequence: Synthetic oligonucleotide
  Target: SCN10A; (+) strand; PAM type: YTN; PAM sequence: TTT
cctcaacagtgaacagagga

SEQ ID NO: 60644 - DNA, 20 bp, Artificial Sequence
  Description of Artificial Sequence: Synthetic oligonucleotide
  Target: SCN10A; (+) strand; PAM type: YTN; PAM sequence: TTC
ctcaacagtgaacagaggaa

SEQ ID NO: 60645 - DNA, 20 bp, Artificial Sequence
  Description of Artificial Sequence: Synthetic oligonucleotide
  Target: SCN10A; (+) strand; PAM type: YTN; PAM sequence: CTC
aacagtgaacagaggaaaac

SEQ ID NO: 60646 - DNA, 20 bp, Artificial Sequence
  Description of Artificial Sequence: Synthetic oligonucleotide
  Target: SCN10A; (+) strand; PAM type: YTN; PAM sequence: CTC
gagaagcctggggagtgtag

SEQ ID NO: 60647 - DNA, 20 bp, Artificial Sequence
  Description of Artificial Sequence: Synthetic oligonucleotide
  Target: SCN10A; (+) strand; PAM type: YTN; PAM sequence: CTG
gggagtgtagatgaaagggg

SEQ ID NO: 60648 - DNA, 20 bp, Artificial Sequence
  Description of Artificial Sequence: Synthetic oligonucleotide
  Target: SCN10A; (+) strand; PAM type: YTN; PAM sequence: CTC
ggtggctgaaacactcaaca

SEQ ID NO: 60649 - DNA, 20 bp, Artificial Sequence
  Description of Artificial Sequence: Synthetic oligonucleotide
  Target: SCN10A; (+) strand; PAM type: YTN; PAM sequence: CTG
aaacactcaacagagagcca

SEQ ID NO: 60650 - DNA, 20 bp, Artificial Sequence
  Description of Artificial Sequence: Synthetic oligonucleotide
  Target: SCN10A; (+) strand; PAM type: YTN; PAM sequence: CTC
aacagagagccagctggaca

SEQ ID NO: 60651 - DNA, 20 bp, Artificial Sequence
  Description of Artificial Sequence: Synthetic oligonucleotide
  Target: SCN10A; (+) strand; PAM type: YTN; PAM sequence: CTG
gacactgctgcaaggaggga

SEQ ID NO: 60652 - DNA, 20 bp, Artificial Sequence
  Description of Artificial Sequence: Synthetic oligonucleotide
  Target: SCN10A; (+) strand; PAM type: YTN; PAM sequence: CTG
ctgcaaggagggacagtgtg

SEQ ID NO: 60653 - DNA, 20 bp, Artificial Sequence
  Description of Artificial Sequence: Synthetic oligonucleotide
  Target: SCN10A; (+) strand; PAM type: YTN; PAM sequence: CTG
caaggagggacagtgtgagg

SEQ ID NO: 60654 - DNA, 20 bp, Artificial Sequence
  Description of Artificial Sequence: Synthetic oligonucleotide
  Target: SCN10A; (+) strand; PAM type: YTN; PAM sequence: TTG
ctgggtgatcgcctcttcca

SEQ ID NO: 60655 - DNA, 20 bp, Artificial Sequence
  Description of Artificial Sequence: Synthetic oligonucleotide
  Target: SCN10A; (+) strand; PAM type: YTN; PAM sequence: CTG
ggtgatcgcctcttccagta

SEQ ID NO: 60656 - DNA, 20 bp, Artificial Sequence
  Description of Artificial Sequence: Synthetic oligonucleotide
  Target: SCN10A; (+) strand; PAM type: YTN; PAM sequence: CTC
ttccagtaccagggtcatcg

SEQ ID NO: 60657 - DNA, 20 bp, Artificial Sequence
  Description of Artificial Sequence: Synthetic oligonucleotide
  Target: SCN10A; (+) strand; PAM type: YTN; PAM sequence: CTT
ccagtaccagggtcatcgtc

SEQ ID NO: 60658 - DNA, 20 bp, Artificial Sequence
  Description of Artificial Sequence: Synthetic oligonucleotide
  Target: SCN10A; (+) strand; PAM type: YTN; PAM sequence: TTC
cagtaccagggtcatcgtca

SEQ ID NO: 60659 - DNA, 20 bp, Artificial Sequence
  Description of Artificial Sequence: Synthetic oligonucleotide
  Target: SCN10A; (+) strand; PAM type: YTN; PAM sequence: CTT
catttcaaatgcagactgat

SEQ ID NO: 60660 - DNA, 20 bp, Artificial Sequence
  Description of Artificial Sequence: Synthetic oligonucleotide
  Target: SCN10A; (+) strand; PAM type: YTN; PAM sequence: TTC
atttcaaatgcagactgata

SEQ ID NO: 60661 - DNA, 20 bp, Artificial Sequence
  Description of Artificial Sequence: Synthetic oligonucleotide
  Target: SCN10A; (+) strand; PAM type: YTN; PAM sequence: TTT
caaatgcagactgatatggg

SEQ ID NO: 60662 - DNA, 20 bp, Artificial Sequence
  Description of Artificial Sequence: Synthetic oligonucleotide
  Target: SCN10A; (+) strand; PAM type: YTN; PAM sequence: TTC
aaatgcagactgatatgggt

SEQ ID NO: 60663 - DNA, 20 bp, Artificial Sequence
  Description of Artificial Sequence: Synthetic oligonucleotide
  Target: SCN10A; (+) strand; PAM type: YTN; PAM sequence: CTG
atatgggtagaatgcacaga

SEQ ID NO: 60664 - DNA, 20 bp, Artificial Sequence
  Description of Artificial Sequence: Synthetic oligonucleotide
  Target: SCN10A; (+) strand; PAM type: YTN; PAM sequence: CTG
tagggacagtgggctgagac

SEQ ID NO: 60665 - DNA, 20 bp, Artificial Sequence
  Description of Artificial Sequence: Synthetic oligonucleotide
  Target: SCN10A; (+) strand; PAM type: YTN; PAM sequence: CTG
agactcacctcccgggaatc

SEQ ID NO: 60666 - DNA, 20 bp, Artificial Sequence
  Description of Artificial Sequence: Synthetic oligonucleotide
  Target: SCN10A; (+) strand; PAM type: YTN; PAM sequence: CTC
acctcccgggaatcaacagc

SEQ ID NO: 60667 - DNA, 20 bp, Artificial Sequence
  Description of Artificial Sequence: Synthetic oligonucleotide
  Target: SCN10A; (+) strand; PAM type: YTN; PAM sequence: CTC
ccgggaatcaacagctgcat

SEQ ID NO: 60668 - DNA, 20 bp, Artificial Sequence
  Description of Artificial Sequence: Synthetic oligonucleotide
  Target: SCN10A; (+) strand; PAM type: YTN; PAM sequence: CTG
catacataatgtccatccag

SEQ ID NO: 60669 - DNA, 20 bp, Artificial Sequence
  Description of Artificial Sequence: Synthetic oligonucleotide
  Target: SCN10A; (+) strand; PAM type: YTN; PAM sequence: CTT
taaaggttgcctggagacaa

SEQ ID NO: 60670 - DNA, 20 bp, Artificial Sequence
  Description of Artificial Sequence: Synthetic oligonucleotide
  Target: SCN10A; (+) strand; PAM type: YTN; PAM sequence: TTT
aaaggttgcctggagacaag

SEQ ID NO: 60671 - DNA, 20 bp, Artificial Sequence
  Description of Artificial Sequence: Synthetic oligonucleotide
  Target: SCN10A; (+) strand; PAM type: YTN; PAM sequence: TTA
aaggttgcctggagacaagg

SEQ ID NO: 60672 - DNA, 20 bp, Artificial Sequence
  Description of Artificial Sequence: Synthetic oligonucleotide
  Target: SCN10A; (+) strand; PAM type: YTN; PAM sequence: TTG
cctggagacaaggagcagag

SEQ ID NO: 60673 - DNA, 20 bp, Artificial Sequence
  Description of Artificial Sequence: Synthetic oligonucleotide
  Target: SCN10A; (+) strand; PAM type: YTN; PAM sequence: CTG
gagacaaggagcagaggcca

SEQ ID NO: 60674 - DNA, 20 bp, Artificial Sequence
  Description of Artificial Sequence: Synthetic oligonucleotide
  Target: SCN10A; (+) strand; PAM type: YTN; PAM sequence: CTC
agtgtctgcccatccatcta

SEQ ID NO: 60675 - DNA, 20 bp, Artificial Sequence
  Description of Artificial Sequence: Synthetic oligonucleotide
  Target: SCN10A; (+) strand; PAM type: YTN; PAM sequence: CTG
cccatccatctatactggac

SEQ ID NO: 60676 - DNA, 20 bp, Artificial Sequence
  Description of Artificial Sequence: Synthetic oligonucleotide
  Target: SCN10A; (+) strand; PAM type: YTN; PAM sequence: CTA
tactggacccttcccaagcc

SEQ ID NO: 60677 - DNA, 20 bp, Artificial Sequence
  Description of Artificial Sequence: Synthetic oligonucleotide
  Target: SCN10A; (+) strand; PAM type: YTN; PAM sequence: CTG
gacccttcccaagccatggt

SEQ ID NO: 60678 - DNA, 20 bp, Artificial Sequence
  Description of Artificial Sequence: Synthetic oligonucleotide
  Target: SCN10A; (+) strand; PAM type: YTN; PAM sequence: CTT
cccaagccatggtggcccag

SEQ ID NO: 60679 - DNA, 20 bp, Artificial Sequence
  Description of Artificial Sequence: Synthetic oligonucleotide
  Target: SCN10A; (+) strand; PAM type: YTN; PAM sequence: TTC
ccaagccatggtggcccagt

SEQ ID NO: 60680 - DNA, 20 bp, Artificial Sequence
  Description of Artificial Sequence: Synthetic oligonucleotide
  Target: SCN10A; (+) strand; PAM type: YTN; PAM sequence: CTG
tgttggaaagggcttgtgca

SEQ ID NO: 60681 - DNA, 20 bp, Artificial Sequence
  Description of Artificial Sequence: Synthetic oligonucleotide
  Target: SCN10A; (+) strand; PAM type: YTN; PAM sequence: TTG
gaaagggcttgtgcagaaag

SEQ ID NO: 60682 - DNA, 20 bp, Artificial Sequence
  Description of Artificial Sequence: Synthetic oligonucleotide
  Target: SCN10A; (+) strand; PAM type: YTN; PAM sequence: CTT
gtgcagaaagaatgaaagga

SEQ ID NO: 60683 - DNA, 20 bp, Artificial Sequence
  Description of Artificial Sequence: Synthetic oligonucleotide
  Target: SCN10A; (+) strand; PAM type: YTN; PAM sequence: TTG
tgcagaaagaatgaaaggaa

SEQ ID NO: 60684 - DNA, 20 bp, Artificial Sequence
  Description of Artificial Sequence: Synthetic oligonucleotide
  Target: SCN10A; (+) strand; PAM type: YTN; PAM sequence: TTC
ccttgggttacttgactaat

SEQ ID NO: 60685 - DNA, 20 bp, Artificial Sequence
  Description of Artificial Sequence: Synthetic oligonucleotide
  Target: SCN10A; (+) strand; PAM type: YTN; PAM sequence: CTT
gggttacttgactaatctca

SEQ ID NO: 60686 - DNA, 20 bp, Artificial Sequence
  Description of Artificial Sequence: Synthetic oligonucleotide
  Target: SCN10A; (+) strand; PAM type: YTN; PAM sequence: TTG
ggttacttgactaatctcat

SEQ ID NO: 60687 - DNA, 20 bp, Artificial Sequence
  Description of Artificial Sequence: Synthetic oligonucleotide
  Target: SCN10A; (+) strand; PAM type: YTN; PAM sequence: TTA
cttgactaatctcatatgat

SEQ ID NO: 60688 - DNA, 20 bp, Artificial Sequence
  Description of Artificial Sequence: Synthetic oligonucleotide
  Target: SCN10A; (+) strand; PAM type: YTN; PAM sequence: CTT
gactaatctcatatgatgat

SEQ ID NO: 60689 - DNA, 20 bp, Artificial Sequence
  Description of Artificial Sequence: Synthetic oligonucleotide
  Target: SCN10A; (+) strand; PAM type: YTN; PAM sequence: TTG
actaatctcatatgatgatt

SEQ ID NO: 60690 - DNA, 20 bp, Artificial Sequence
  Description of Artificial Sequence: Synthetic oligonucleotide
  Target: SCN10A; (+) strand; PAM type: YTN; PAM sequence: CTA
atctcatatgatgatttaaa

SEQ ID NO: 60691 - DNA, 20 bp, Artificial Sequence
  Description of Artificial Sequence: Synthetic oligonucleotide
  Target: SCN10A; (+) strand; PAM type: YTN; PAM sequence: CTC
atatgatgatttaaagtaat

SEQ ID NO: 60692 - DNA, 20 bp, Artificial Sequence
  Description of Artificial Sequence: Synthetic oligonucleotide
  Target: SCN10A; (+) strand; PAM type: YTN; PAM sequence: TTT
aaagtaatcccacatgtggc

SEQ ID NO: 60693 - DNA, 20 bp, Artificial Sequence
  Description of Artificial Sequence: Synthetic oligonucleotide
  Target: SCN10A; (+) strand; PAM type: YTN; PAM sequence: TTA
aagtaatcccacatgtggct

SEQ ID NO: 60694 - DNA, 20 bp, Artificial Sequence
  Description of Artificial Sequence: Synthetic oligonucleotide
  Target: SCN10A; (+) strand; PAM type: YTN; PAM sequence: CTG
tttaagaatagagtagcatt

SEQ ID NO: 60695 - DNA, 20 bp, Artificial Sequence
  Description of Artificial Sequence: Synthetic oligonucleotide
  Target: SCN10A; (+) strand; PAM type: YTN; PAM sequence: TTT
aagaatagagtagcattaaa

SEQ ID NO: 60696 - DNA, 20 bp, Artificial Sequence
  Description of Artificial Sequence: Synthetic oligonucleotide
  Target: SCN10A; (+) strand; PAM type: YTN; PAM sequence: TTA
agaatagagtagcattaaag

SEQ ID NO: 60697 - DNA, 20 bp, Artificial Sequence
  Description of Artificial Sequence: Synthetic oligonucleotide
  Target: SCN10A; (+) strand; PAM type: YTN; PAM sequence: TTA
aagacacagagcctttcaga

SEQ ID NO: 60698 - DNA, 20 bp, Artificial Sequence
  Description of Artificial Sequence: Synthetic oligonucleotide
  Target: SCN10A; (+) strand; PAM type: YTN; PAM sequence: CTT
tcagaatgtagtatggactg

SEQ ID NO: 60699 - DNA, 20 bp, Artificial Sequence
  Description of Artificial Sequence: Synthetic oligonucleotide
  Target: SCN10A; (+) strand; PAM type: YTN; PAM sequence: TTT
cagaatgtagtatggactga

SEQ ID NO: 60700 - DNA, 20 bp, Artificial Sequence
  Description of Artificial Sequence: Synthetic oligonucleotide
  Target: SCN10A; (+) strand; PAM type: YTN; PAM sequence: TTC
agaatgtagtatggactgag

SEQ ID NO: 60701 - DNA, 20 bp, Artificial Sequence
  Description of Artificial Sequence: Synthetic oligonucleotide
  Target: SCN10A; (+) strand; PAM type: YTN; PAM sequence: CTG
aggactgagtgtctaggtgt

SEQ ID NO: 60702 - DNA, 20 bp, Artificial Sequence
  Description of Artificial Sequence: Synthetic oligonucleotide
  Target: SCN10A; (+) strand; PAM type: YTN; PAM sequence: CTG
agtgtctaggtgtctggttc

SEQ ID NO: 60703 - DNA, 20 bp, Artificial Sequence
  Description of Artificial Sequence: Synthetic oligonucleotide
  Target: SCN10A; (+) strand; PAM type: YTN; PAM sequence: CTA
ggtgtctggttctagtgcca

SEQ ID NO: 60704 - DNA, 20 bp, Artificial Sequence
  Description of Artificial Sequence: Synthetic oligonucleotide
  Target: SCN10A; (+) strand; PAM type: YTN; PAM sequence: CTG
gttctagtgccaattgctac

SEQ ID NO: 60705 - DNA, 20 bp, Artificial Sequence
  Description of Artificial Sequence: Synthetic oligonucleotide
  Target: SCN10A; (+) strand; PAM type: YTN; PAM sequence: TTC
tagtgccaattgctacaagt

SEQ ID NO: 60706 - DNA, 20 bp, Artificial Sequence
  Description of Artificial Sequence: Synthetic oligonucleotide
  Target: SCN10A; (+) strand; PAM type: YTN; PAM sequence: CTA
gtgccaattgctacaagtct

SEQ ID NO: 60707 - DNA, 20 bp, Artificial Sequence
  Description of Artificial Sequence: Synthetic oligonucleotide
  Target: SCN10A; (+) strand; PAM type: YTN; PAM sequence: TTG
ctacaagtctgctctgtgca

SEQ ID NO: 60708 - DNA, 20 bp, Artificial Sequence
  Description of Artificial Sequence: Synthetic oligonucleotide
  Target: SCN10A; (+) strand; PAM type: YTN; PAM sequence: CTA
caagtctgctctgtgcactt

SEQ ID NO: 60709 - DNA, 20 bp, Artificial Sequence
  Description of Artificial Sequence: Synthetic oligonucleotide
  Target: SCN10A; (+) strand; PAM type: YTN; PAM sequence: CTG
ctctgtgcacttgcctaagg

SEQ ID NO: 60710 - DNA, 20 bp, Artificial Sequence
  Description of Artificial Sequence: Synthetic oligonucleotide
  Target: SCN10A; (+) strand; PAM type: YTN; PAM sequence: CTC
tgtgcacttgcctaaggttt

SEQ ID NO: 60711 - DNA, 20 bp, Artificial Sequence
  Description of Artificial Sequence: Synthetic oligonucleotide
  Target: SCN10A; (+) strand; PAM type: YTN; PAM sequence: CTG
tgcacttgcctaaggtttcc

SEQ ID NO: 60712 - DNA, 20 bp, Artificial Sequence
  Description of Artificial Sequence: Synthetic oligonucleotide
  Target: SCN10A; (+) strand; PAM type: YTN; PAM sequence: CTT
gcctaaggtttcccctctca

SEQ ID NO: 60713 - DNA, 20 bp, Artificial Sequence
  Description of Artificial Sequence: Synthetic oligonucleotide
  Target: SCN10A; (+) strand; PAM type: YTN; PAM sequence: TTG
cctaaggtttcccctctcag

SEQ ID NO: 60714 - DNA, 20 bp, Artificial Sequence
  Description of Artificial Sequence: Synthetic oligonucleotide
  Target: SCN10A; (+) strand; PAM type: YTN; PAM sequence: CTA
aggtttcccctctcagggct

SEQ ID NO: 60715 - DNA, 20 bp, Artificial Sequence
  Description of Artificial Sequence: Synthetic oligonucleotide
  Target: SCN10A; (+) strand; PAM type: YTN; PAM sequence: TTT
cccctctcagggctgccatt

SEQ ID NO: 60716 - DNA, 20 bp, Artificial Sequence
  Description of Artificial Sequence: Synthetic oligonucleotide
  Target: SCN10A; (+) strand; PAM type: YTN; PAM sequence: TTC
ccctctcagggctgccattt

SEQ ID NO: 60717 - DNA, 20 bp, Artificial Sequence
  Description of Artificial Sequence: Synthetic oligonucleotide
  Target: SCN10A; (+) strand; PAM type: YTN; PAM sequence: CTC
tcagggctgccattttctca

SEQ ID NO: 60718 - DNA, 20 bp, Artificial Sequence
  Description of Artificial Sequence: Synthetic oligonucleotide
  Target: SCN10A; (+) strand; PAM type: YTN; PAM sequence: CTC
agggctgccattttctcagc

SEQ ID NO: 60719 - DNA, 20 bp, Artificial Sequence
  Description of Artificial Sequence: Synthetic oligonucleotide
  Target: SCN10A; (+) strand; PAM type: YTN; PAM sequence: CTG
ccattttctcagccactttc

SEQ ID NO: 60720 - DNA, 20 bp, Artificial Sequence
  Description of Artificial Sequence: Synthetic oligonucleotide
  Target: SCN10A; (+) strand; PAM type: YTN; PAM sequence: TTT
tctcagccactttcccacct

SEQ ID NO: 60721 - DNA, 20 bp, Artificial Sequence
  Description of Artificial Sequence: Synthetic oligonucleotide
  Target: SCN10A; (+) strand; PAM type: YTN; PAM sequence: TTT
ctcagccactttcccacctt

SEQ ID NO: 60722 - DNA, 20 bp, Artificial Sequence
  Description of Artificial Sequence: Synthetic oligonucleotide
  Target: SCN10A; (+) strand; PAM type: YTN; PAM sequence: TTC
tcagccactttcccacctta

SEQ ID NO: 60723 - DNA, 20 bp, Artificial Sequence
  Description of Artificial Sequence: Synthetic oligonucleotide
  Target: SCN10A; (+) strand; PAM type: YTN; PAM sequence: CTC
agccactttcccaccttatg

SEQ ID NO: 60724 - DNA, 20 bp, Artificial Sequence
  Description of Artificial Sequence: Synthetic oligonucleotide
  Target: SCN10A; (+) strand; PAM type: YTN; PAM sequence: CTT
tcccaccttatgcacatgat

SEQ ID NO: 60725 - DNA, 20 bp, Artificial Sequence
  Description of Artificial Sequence: Synthetic oligonucleotide
  Target: SCN10A; (+) strand; PAM type: YTN; PAM sequence: TTT
cccaccttatgcacatgatg

SEQ ID NO: 60726 - DNA, 20 bp, Artificial Sequence
  Description of Artificial Sequence: Synthetic oligonucleotide
  Target: SCN10A; (+) strand; PAM type: YTN; PAM sequence: TTC
ccaccttatgcacatgatgt

SEQ ID NO: 60727 - DNA, 20 bp, Artificial Sequence
  Description of Artificial Sequence: Synthetic oligonucleotide
  Target: SCN10A; (+) strand; PAM type: YTN; PAM sequence: CTT
atgcacatgatgtaagaatg

SEQ ID NO: 60728 - DNA, 20 bp, Artificial Sequence
  Description of Artificial Sequence: Synthetic oligonucleotide
  Target: SCN10A; (+) strand; PAM type: YTN; PAM sequence: TTA
tgcacatgatgtaagaatgg

SEQ ID NO: 60729 - DNA, 20 bp, Artificial Sequence
  Description of Artificial Sequence: Synthetic oligonucleotide
  Target: SCN10A; (+) strand; PAM type: YTN; PAM sequence: CTT
ccagatggagaagttgagaa

SEQ ID NO: 60730 - DNA, 20 bp, Artificial Sequence
  Description of Artificial Sequence: Synthetic oligonucleotide
  Target: SCN10A; (+) strand; PAM type: YTN; PAM sequence: TTC
cagatggagaagttgagaat

SEQ ID NO: 60731 - DNA, 20 bp, Artificial Sequence
  Description of Artificial Sequence: Synthetic oligonucleotide
  Target: SCN10A; (+) strand; PAM type: YTN; PAM sequence: TTG
agaatagaagacctccatgt

SEQ ID NO: 60732 - DNA, 20 bp, Artificial Sequence
  Description of Artificial Sequence: Synthetic oligonucleotide
  Target: SCN10A; (+) strand; PAM type: YTN; PAM sequence: CTC
catgttcctgccttcagctt

SEQ ID NO: 60733 - DNA, 20 bp, Artificial Sequence
  Description of Artificial Sequence: Synthetic oligonucleotide
  Target: SCN10A; (+) strand; PAM type: YTN; PAM sequence: TTC
ctgccttcagctttagcatt

SEQ ID NO: 60734 - DNA, 20 bp, Artificial Sequence
  Description of Artificial Sequence: Synthetic oligonucleotide
  Target: SCN10A; (+) strand; PAM type: YTN; PAM sequence: CTG
ccttcagctttagcattctt

SEQ ID NO: 60735 - DNA, 20 bp, Artificial Sequence
  Description of Artificial Sequence: Synthetic oligonucleotide
  Target: SCN10A; (+) strand; PAM type: YTN; PAM sequence: CTT
cagctttagcattcttgagg

SEQ ID NO: 60736 - DNA, 20 bp, Artificial Sequence
  Description of Artificial Sequence: Synthetic oligonucleotide
  Target: SCN10A; (+) strand; PAM type: YTN; PAM sequence: TTC
agctttagcattcttgaggt

SEQ ID NO: 60737 - DNA, 20 bp, Artificial Sequence
  Description of Artificial Sequence: Synthetic oligonucleotide
  Target: SCN10A; (+) strand; PAM type: YTN; PAM sequence: CTT
tagcattcttgaggtctaga

SEQ ID NO: 60738 - DNA, 20 bp, Artificial Sequence
  Description of Artificial Sequence: Synthetic oligonucleotide
  Target: SCN10A; (+) strand; PAM type: YTN; PAM sequence: TTT
agcattcttgaggtctagaa

SEQ ID NO: 60739 - DNA, 20 bp, Artificial Sequence
  Description of Artificial Sequence: Synthetic oligonucleotide
  Target: SCN10A; (+) strand; PAM type: YTN; PAM sequence: TTA
gcattcttgaggtctagaaa

SEQ ID NO: 60740 - DNA, 20 bp, Artificial Sequence
  Description of Artificial Sequence: Synthetic oligonucleotide
  Target: SCN10A; (+) strand; PAM type: YTN; PAM sequence: TTC
ttgaggtctagaaactgggt

SEQ ID NO: 60741 - DNA, 20 bp, Artificial Sequence
  Description of Artificial Sequence: Synthetic oligonucleotide
  Target: SCN10A; (+) strand; PAM type: YTN; PAM sequence: CTT
gaggtctagaaactgggtgt

SEQ ID NO: 60742 - DNA, 20 bp, Artificial Sequence
  Description of Artificial Sequence: Synthetic oligonucleotide
  Target: SCN10A; (+) strand; PAM type: YTN; PAM sequence: TTG
aggtctagaaactgggtgtg

SEQ ID NO: 60743 - DNA, 20 bp, Artificial Sequence
  Description of Artificial Sequence: Synthetic oligonucleotide
  Target: SCN10A; (+) strand; PAM type: YTN; PAM sequence: CTA
gaaactgggtgtgccttcca

SEQ ID NO: 60744 - DNA, 20 bp, Artificial Sequence
  Description of Artificial Sequence: Synthetic oligonucleotide
  Target: SCN10A; (+) strand; PAM type: YTN; PAM sequence: CTG
ggtgtgccttccagcatgtt

SEQ ID NO: 60745 - DNA, 20 bp, Artificial Sequence
  Description of Artificial Sequence: Synthetic oligonucleotide
  Target: SCN10A; (+) strand; PAM type: YTN; PAM sequence: CTT
ccagcatgttcagagcatgc

SEQ ID NO: 60746 - DNA, 20 bp, Artificial Sequence
  Description of Artificial Sequence: Synthetic oligonucleotide
  Target: SCN10A; (+) strand; PAM type: YTN; PAM sequence: TTC
cagcatgttcagagcatgca

SEQ ID NO: 60747 - DNA, 20 bp, Artificial Sequence
  Description of Artificial Sequence: Synthetic oligonucleotide
  Target: SCN10A; (+) strand; PAM type: YTN; PAM sequence: TTC
agagcatgcaagacatctta

SEQ ID NO: 60748 - DNA, 20 bp, Artificial Sequence
  Description of Artificial Sequence: Synthetic oligonucleotide
  Target: SCN10A; (+) strand; PAM type: YTN; PAM sequence: CTT
agttcttacactcctaggcc

SEQ ID NO: 60749 - DNA, 20 bp, Artificial Sequence
  Description of Artificial Sequence: Synthetic oligonucleotide
  Target: SCN10A; (+) strand; PAM type: YTN; PAM sequence: TTA
gttcttacactcctaggcct

SEQ ID NO: 60750 - DNA, 20 bp, Artificial Sequence
  Description of Artificial Sequence: Synthetic oligonucleotide
  Target: SCN10A; (+) strand; PAM type: YTN; PAM sequence: TTC
ttacactcctaggcctgtta

SEQ ID NO: 60751 - DNA, 20 bp, Artificial Sequence
  Description of Artificial Sequence: Synthetic oligonucleotide
  Target: SCN10A; (+) strand; PAM type: YTN; PAM sequence: CTT
acactcctaggcctgttaca

SEQ ID NO: 60752 - DNA, 20 bp, Artificial Sequence
  Description of Artificial Sequence: Synthetic oligonucleotide
  Target: SCN10A; (+) strand; PAM type: YTN; PAM sequence: TTA
cactcctaggcctgttacag

SEQ ID NO: 60753 - DNA, 20 bp, Artificial Sequence
  Description of Artificial Sequence: Synthetic oligonucleotide
  Target: SCN10A; (+) strand; PAM type: YTN; PAM sequence: CTC
ctaggcctgttacagcactt

SEQ ID NO: 60754 - DNA, 20 bp, Artificial Sequence
  Description of Artificial Sequence: Synthetic oligonucleotide
  Target: SCN10A; (+) strand; PAM type: YTN; PAM sequence: CTA
ggcctgttacagcacttaat

SEQ ID NO: 60755 - DNA, 20 bp, Artificial Sequence
  Description of Artificial Sequence: Synthetic oligonucleotide
  Target: SCN10A; (+) strand; PAM type: YTN; PAM sequence: CTG
ttacagcacttaatgagctg

SEQ ID NO: 60756 - DNA, 20 bp, Artificial Sequence
  Description of Artificial Sequence: Synthetic oligonucleotide
  Target: SCN10A; (+) strand; PAM type: YTN; PAM sequence: TTA
cagcacttaatgagctgttt

SEQ ID NO: 60757 - DNA, 20 bp, Artificial Sequence
  Description of Artificial Sequence: Synthetic oligonucleotide
  Target: SCN10A; (+) strand; PAM type: YTN; PAM sequence: CTT
aatgagctgttttaattcac

SEQ ID NO: 60758 - DNA, 20 bp, Artificial Sequence
  Description of Artificial Sequence: Synthetic oligonucleotide
  Target: SCN10A; (+) strand; PAM type: YTN; PAM sequence: TTA
atgagctgttttaattcacc

SEQ ID NO: 60759 - DNA, 20 bp, Artificial Sequence
  Description of Artificial Sequence: Synthetic oligonucleotide
  Target: SCN10A; (+) strand; PAM type: YTN; PAM sequence: CTG
ttttaattcacctattagtc

SEQ ID NO: 60760 - DNA, 20 bp, Artificial Sequence
  Description of Artificial Sequence: Synthetic oligonucleotide
  Target: SCN10A; (+) strand; PAM type: YTN; PAM sequence: TTT
taattcacctattagtctgt

SEQ ID NO: 60761 - DNA, 20 bp, Artificial Sequence
  Description of Artificial Sequence: Synthetic oligonucleotide
  Target: SCN10A; (+) strand; PAM type: YTN; PAM sequence: TTT
aattcacctattagtctgtt

SEQ ID NO: 60762 - DNA, 20 bp, Artificial Sequence
  Description of Artificial Sequence: Synthetic oligonucleotide
  Target: SCN10A; (+) strand; PAM type: YTN; PAM sequence: TTA
attcacctattagtctgttt

SEQ ID NO: 60763 - DNA, 20 bp, Artificial Sequence
  Description of Artificial Sequence: Synthetic oligonucleotide
  Target: SCN10A; (+) strand; PAM type: YTN; PAM sequence: TTC
acctattagtctgtttctca

SEQ ID NO: 60764 - DNA, 20 bp, Artificial Sequence
  Description of Artificial Sequence: Synthetic oligonucleotide
  Target: SCN10A; (+) strand; PAM type: YTN; PAM sequence: CTA
ttagtctgtttctcatacag

SEQ ID NO: 60765 - DNA, 20 bp, Artificial Sequence
  Description of Artificial Sequence: Synthetic oligonucleotide
  Target: SCN10A; (+) strand; PAM type: YTN; PAM sequence: TTA
gtctgtttctcatacagcat

SEQ ID NO: 60766 - DNA, 20 bp, Artificial Sequence
  Description of Artificial Sequence: Synthetic oligonucleotide
  Target: SCN10A; (+) strand; PAM type: YTN; PAM sequence: CTG
tttctcatacagcatcagtg

SEQ ID NO: 60767 - DNA, 20 bp, Artificial Sequence
  Description of Artificial Sequence: Synthetic oligonucleotide
  Target: SCN10A; (+) strand; PAM type: YTN; PAM sequence: TTT
ctcatacagcatcagtgtcc

SEQ ID NO: 60768 - DNA, 20 bp, Artificial Sequence
  Description of Artificial Sequence: Synthetic oligonucleotide
  Target: SCN10A; (+) strand; PAM type: YTN; PAM sequence: TTC
tcatacagcatcagtgtcca

SEQ ID NO: 60769 - DNA, 20 bp, Artificial Sequence
  Description of Artificial Sequence: Synthetic oligonucleotide
  Target: SCN10A; (+) strand; PAM type: YTN; PAM sequence: CTC
atacagcatcagtgtccaag

SEQ ID NO: 60770 - DNA, 20 bp, Artificial Sequence
  Description of Artificial Sequence: Synthetic oligonucleotide
  Target: SCN10A; (+) strand; PAM type: YTN; PAM sequence: TTC
tgactgtatctcccagggct

SEQ ID NO: 60771 - DNA, 20 bp, Artificial Sequence
  Description of Artificial Sequence: Synthetic oligonucleotide
  Target: SCN10A; (+) strand; PAM type: YTN; PAM sequence: CTG
actgtatctcccagggctga

SEQ ID NO: 60772 - DNA, 20 bp, Artificial Sequence
  Description of Artificial Sequence: Synthetic oligonucleotide
  Target: SCN10A; (+) strand; PAM type: YTN; PAM sequence: CTG
tatctcccagggctgagtag

SEQ ID NO: 60773 - DNA, 20 bp, Artificial Sequence
  Description of Artificial Sequence: Synthetic oligonucleotide
  Target: SCN10A; (+) strand; PAM type: YTN; PAM sequence: CTC
ccagggctgagtagtaccat

SEQ ID NO: 60774 - DNA, 20 bp, Artificial Sequence
  Description of Artificial Sequence: Synthetic oligonucleotide
  Target: SCN10A; (+) strand; PAM type: YTN; PAM sequence: CTG
agtagtaccatgcctggcat

SEQ ID NO: 60775 - DNA, 20 bp, Artificial Sequence
  Description of Artificial Sequence: Synthetic oligonucleotide
  Target: SCN10A; (+) strand; PAM type: YTN; PAM sequence: CTG
gcataccagagctactcaga

SEQ ID NO: 60776 - DNA, 20 bp, Artificial Sequence
  Description of Artificial Sequence: Synthetic oligonucleotide
  Target: SCN10A; (+) strand; PAM type: YTN; PAM sequence: CTA
ctcagagattatttgttgaa

SEQ ID NO: 60777 - DNA, 20 bp, Artificial Sequence
  Description of Artificial Sequence: Synthetic oligonucleotide
  Target: SCN10A; (+) strand; PAM type: YTN; PAM sequence: CTC
agagattatttgttgaataa

SEQ ID NO: 60778 - DNA, 20 bp, Artificial Sequence
  Description of Artificial Sequence: Synthetic oligonucleotide
  Target: SCN10A; (+) strand; PAM type: YTN; PAM sequence: TTA
tttgttgaataaatgcaaga

SEQ ID NO: 60779 - DNA, 20 bp, Artificial Sequence
  Description of Artificial Sequence: Synthetic oligonucleotide
  Target: SCN10A; (+) strand; PAM type: YTN; PAM sequence: TTT
gttgaataaatgcaagaacc

SEQ ID NO: 60780 - DNA, 20 bp, Artificial Sequence
  Description of Artificial Sequence: Synthetic oligonucleotide
  Target: SCN10A; (+) strand; PAM type: YTN; PAM sequence: TTG
ttgaataaatgcaagaacca

SEQ ID NO: 60781 - DNA, 20 bp, Artificial Sequence
  Description of Artificial Sequence: Synthetic oligonucleotide
  Target: SCN10A; (+) strand; PAM type: YTN; PAM sequence: TTG
aataaatgcaagaaccaatg

SEQ ID NO: 60782 - DNA, 20 bp, Artificial Sequence
  Description of Artificial Sequence: Synthetic oligonucleotide
  Target: SCN10A; (+) strand; PAM type: YTN; PAM sequence: CTC
aagagtaactgcatgacaaa

SEQ ID NO: 60783 - DNA, 20 bp, Artificial Sequence
  Description of Artificial Sequence: Synthetic oligonucleotide
  Target: SCN10A; (+) strand; PAM type: YTN; PAM sequence: CTG
catgacaaatgtataagtaa

SEQ ID NO: 60784 - DNA, 20 bp, Artificial Sequence
  Description of Artificial Sequence: Synthetic oligonucleotide
  Target: SCN10A; (+) strand; PAM type: YTN; PAM sequence: TTG
tattaacacttgaatgaaca

SEQ ID NO: 60785 - DNA, 20 bp, Artificial Sequence
  Description of Artificial Sequence: Synthetic oligonucleotide
  Target: SCN10A; (+) strand; PAM type: YTN; PAM sequence: TTA
acacttgaatgaacagagga

SEQ ID NO: 60786 - DNA, 20 bp, Artificial Sequence
  Description of Artificial Sequence: Synthetic oligonucleotide
  Target: SCN10A; (+) strand; PAM type: YTN; PAM sequence: CTT
gaatgaacagaggactgaat

SEQ ID NO: 60787 - DNA, 20 bp, Artificial Sequence
  Description of Artificial Sequence: Synthetic oligonucleotide
  Target: SCN10A; (+) strand; PAM type: YTN; PAM sequence: TTG
aatgaacagaggactgaatg

SEQ ID NO: 60788 - DNA, 20 bp, Artificial Sequence
  Description of Artificial Sequence: Synthetic oligonucleotide
  Target: SCN10A; (+) strand; PAM type: YTN; PAM sequence: CTG
aatgaacaggtagatgaagg

SEQ ID NO: 60789 - DNA, 20 bp, Artificial Sequence
  Description of Artificial Sequence: Synthetic oligonucleotide
  Target: SCN10A; (+) strand; PAM type: YTN; PAM sequence: TTG
actggatgatgaaagaaaga

SEQ ID NO: 60790 - DNA, 20 bp, Artificial Sequence
  Description of Artificial Sequence: Synthetic oligonucleotide
  Target: SCN10A; (+) strand; PAM type: YTN; PAM sequence: CTG
gatgatgaaagaaagaaaga

SEQ ID NO: 60791 - DNA, 20 bp, Artificial Sequence
  Description of Artificial Sequence: Synthetic oligonucleotide
  Target: SCN10A; (+) strand; PAM type: YTN; PAM sequence: TTT
gactgtcattatcaccaaca

SEQ ID NO: 60792 - DNA, 20 bp, Artificial Sequence
  Description of Artificial Sequence: Synthetic oligonucleotide
  Target: SCN10A; (+) strand; PAM type: YTN; PAM sequence: TTG
actgtcattatcaccaacat

SEQ ID NO: 60793 - DNA, 20 bp, Artificial Sequence
  Description of Artificial Sequence: Synthetic oligonucleotide
  Target: SCN10A; (+) strand; PAM type: YTN; PAM sequence: CTG
tcattatcaccaacattata

SEQ ID NO: 60794 - DNA, 20 bp, Artificial Sequence
  Description of Artificial Sequence: Synthetic oligonucleotide
  Target: SCN10A; (+) strand; PAM type: YTN; PAM sequence: TTA
tcaccaacattatatatcat

SEQ ID NO: 60795 - DNA, 20 bp, Artificial Sequence
  Description of Artificial Sequence: Synthetic oligonucleotide
  Target: SCN10A; (+) strand; PAM type: YTN; PAM sequence: TTA
tatatcattacaatagacct

SEQ ID NO: 60796 - DNA, 20 bp, Artificial Sequence
  Description of Artificial Sequence: Synthetic oligonucleotide
  Target: SCN10A; (+) strand; PAM type: YTN; PAM sequence: TTA
caatagacctaatgagacat

SEQ ID NO: 60797 - DNA, 20 bp, Artificial Sequence
  Description of Artificial Sequence: Synthetic oligonucleotide
  Target: SCN10A; (+) strand; PAM type: YTN; PAM sequence: CTA
atgagacataatttattacc

SEQ ID NO: 60798 - DNA, 20 bp, Artificial Sequence
  Description of Artificial Sequence: Synthetic oligonucleotide
  Target: SCN10A; (+) strand; PAM type: YTN; PAM sequence: TTT
attaccatttaggaaatgat

SEQ ID NO: 60799 - DNA, 20 bp, Artificial Sequence
  Description of Artificial Sequence: Synthetic oligonucleotide
  Target: SCN10A; (+) strand; PAM type: YTN; PAM sequence: TTA
ttaccatttaggaaatgatg

SEQ ID NO: 60800 - DNA, 20 bp, Artificial Sequence
  Description of Artificial Sequence: Synthetic oligonucleotide
  Target: SCN10A; (+) strand; PAM type: YTN; PAM sequence: TTA
ccatttaggaaatgatgtga

SEQ ID NO: 60801 - DNA, 20 bp, Artificial Sequence
  Description of Artificial Sequence: Synthetic oligonucleotide
  Target: SCN10A; (+) strand; PAM type: YTN; PAM sequence: TTT
aggaaatgatgtgaagttga

SEQ ID NO: 60802 - DNA, 20 bp, Artificial Sequence
  Description of Artificial Sequence: Synthetic oligonucleotide
  Target: SCN10A; (+) strand; PAM type: YTN; PAM sequence: TTA
ggaaatgatgtgaagttgaa

SEQ ID NO: 60803 - DNA, 20 bp, Artificial Sequence
  Description of Artificial Sequence: Synthetic oligonucleotide
  Target: SCN10A; (+) strand; PAM type: YTN; PAM sequence: TTG
aagactgaacatgtggctat

SEQ ID NO: 60804 - DNA, 20 bp, Artificial Sequence
  Description of Artificial Sequence: Synthetic oligonucleotide
  Target: SCN10A; (+) strand; PAM type: YTN; PAM sequence: CTG
aacatgtggctatgccgtgt

SEQ ID NO: 60805 - DNA, 20 bp, Artificial Sequence
  Description of Artificial Sequence: Synthetic oligonucleotide
  Target: SCN10A; (+) strand; PAM type: YTN; PAM sequence: CTA
tgccgtgtctattttgtaca

SEQ ID NO: 60806 - DNA, 20 bp, Artificial Sequence
  Description of Artificial Sequence: Synthetic oligonucleotide
  Target: SCN10A; (+) strand; PAM type: YTN; PAM sequence: CTA
ttttgtacaggttctgtgtt

SEQ ID NO: 60807 - DNA, 20 bp, Artificial Sequence
  Description of Artificial Sequence: Synthetic oligonucleotide
  Target: SCN10A; (+) strand; PAM type: YTN; PAM sequence: TTT
tgtacaggttctgtgtttta

SEQ ID NO: 60808 - DNA, 20 bp, Artificial Sequence
  Description of Artificial Sequence: Synthetic oligonucleotide
  Target: SCN10A; (+) strand; PAM type: YTN; PAM sequence: TTT
gtacaggttctgtgttttaa

SEQ ID NO: 60809 - DNA, 20 bp, Artificial Sequence
  Description of Artificial Sequence: Synthetic oligonucleotide
  Target: SCN10A; (+) strand; PAM type: YTN; PAM sequence: TTG
tacaggttctgtgttttaac

SEQ ID NO: 60810 - DNA, 20 bp, Artificial Sequence
  Description of Artificial Sequence: Synthetic oligonucleotide
  Target: SCN10A; (+) strand; PAM type: YTN; PAM sequence: TTC
tgtgttttaactcaccacct

SEQ ID NO: 60811 - DNA, 20 bp, Artificial Sequence
  Description of Artificial Sequence: Synthetic oligonucleotide
  Target: SCN10A; (+) strand; PAM type: YTN; PAM sequence: CTG
tgttttaactcaccacctga

SEQ ID NO: 60812 - DNA, 20 bp, Artificial Sequence
  Description of Artificial Sequence: Synthetic oligonucleotide
  Target: SCN10A; (+) strand; PAM type: YTN; PAM sequence: TTT
taactcaccacctgataatc

SEQ ID NO: 60813 - DNA, 20 bp, Artificial Sequence
  Description of Artificial Sequence: Synthetic oligonucleotide
  Target: SCN10A; (+) strand; PAM type: YTN; PAM sequence: TTT
aactcaccacctgataatcc

SEQ ID NO: 60814 - DNA, 20 bp, Artificial Sequence
  Description of Artificial Sequence: Synthetic oligonucleotide
  Target: SCN10A; (+) strand; PAM type: YTN; PAM sequence: TTA
actcaccacctgataatccc

SEQ ID NO: 60815 - DNA, 20 bp, Artificial Sequence
  Description of Artificial Sequence: Synthetic oligonucleotide
  Target: SCN10A; (+) strand; PAM type: YTN; PAM sequence: CTC
accacctgataatcccatgg

SEQ ID NO: 60816 - DNA, 20 bp, Artificial Sequence
  Description of Artificial Sequence: Synthetic oligonucleotide
  Target: SCN10A; (+) strand; PAM type: YTN; PAM sequence: CTG
ataatcccatggcaggccca

SEQ ID NO: 60817 - DNA, 20 bp, Artificial Sequence
  Description of Artificial Sequence: Synthetic oligonucleotide
  Target: SCN10A; (+) strand; PAM type: YTN; PAM sequence: CTT
tatgctattctactagccca

SEQ ID NO: 60818 - DNA, 20 bp, Artificial Sequence
  Description of Artificial Sequence: Synthetic oligonucleotide
  Target: SCN10A; (+) strand; PAM type: YTN; PAM sequence: TTT
atgctattctactagcccac

SEQ ID NO: 60819 - DNA, 20 bp, Artificial Sequence
  Description of Artificial Sequence: Synthetic oligonucleotide
  Target: SCN10A; (+) strand; PAM type: YTN; PAM sequence: TTA
tgctattctactagcccaca

SEQ ID NO: 60820 - DNA, 20 bp, Artificial Sequence
  Description of Artificial Sequence: Synthetic oligonucleotide
  Target: SCN10A; (+) strand; PAM type: YTN; PAM sequence: CTA
ttctactagcccacacttgt

SEQ ID NO: 60821 - DNA, 20 bp, Artificial Sequence
  Description of Artificial Sequence: Synthetic oligonucleotide
  Target: SCN10A; (+) strand; PAM type: YTN; PAM sequence: TTC
tactagcccacacttgtgta

SEQ ID NO: 60822 - DNA, 20 bp, Artificial Sequence
  Description of Artificial Sequence: Synthetic oligonucleotide
  Target: SCN10A; (+) strand; PAM type: YTN; PAM sequence: CTA
ctagcccacacttgtgtaat

SEQ ID NO: 60823 - DNA, 20 bp, Artificial Sequence
  Description of Artificial Sequence: Synthetic oligonucleotide
  Target: SCN10A; (+) strand; PAM type: YTN; PAM sequence: CTA
gcccacacttgtgtaattgc

SEQ ID NO: 60824 - DNA, 20 bp, Artificial Sequence
  Description of Artificial Sequence: Synthetic oligonucleotide
  Target: SCN10A; (+) strand; PAM type: YTN; PAM sequence: CTT
gtgtaattgcaccactgtga

SEQ ID NO: 60825 - DNA, 20 bp, Artificial Sequence
  Description of Artificial Sequence: Synthetic oligonucleotide
  Target: SCN10A; (+) strand; PAM type: YTN; PAM sequence: TTG
tgtaattgcaccactgtgat

SEQ ID NO: 60826 - DNA, 20 bp, Artificial Sequence
  Description of Artificial Sequence: Synthetic oligonucleotide
  Target: SCN10A; (+) strand; PAM type: YTN; PAM sequence: TTG
caccactgtgatatcatatt

SEQ ID NO: 60827 - DNA, 20 bp, Artificial Sequence
  Description of Artificial Sequence: Synthetic oligonucleotide
  Target: SCN10A; (+) strand; PAM type: YTN; PAM sequence: CTG
tgatatcatattcactagga

SEQ ID NO: 60828 - DNA, 20 bp, Artificial Sequence
  Description of Artificial Sequence: Synthetic oligonucleotide
  Target: SCN10A; (+) strand; PAM type: YTN; PAM sequence: TTC
actaggaaggccctctagcc

SEQ ID NO: 60829 - DNA, 20 bp, Artificial Sequence
  Description of Artificial Sequence: Synthetic oligonucleotide
  Target: SCN10A; (+) strand; PAM type: YTN; PAM sequence: CTA
ggaaggccctctagcctcat

SEQ ID NO: 60830 - DNA, 20 bp, Artificial Sequence
  Description of Artificial Sequence: Synthetic oligonucleotide
  Target: SCN10A; (+) strand; PAM type: YTN; PAM sequence: CTC
tagcctcatggtgtagtctg

SEQ ID NO: 60831 - DNA, 20 bp, Artificial Sequence
  Description of Artificial Sequence: Synthetic oligonucleotide
  Target: SCN10A; (+) strand; PAM type: YTN; PAM sequence: CTA
gcctcatggtgtagtctgta

SEQ ID NO: 60832 - DNA, 20 bp, Artificial Sequence
  Description of Artificial Sequence: Synthetic oligonucleotide
  Target: SCN10A; (+) strand; PAM type: YTN; PAM sequence: CTC
atggtgtagtctgtaggaat

SEQ ID NO: 60833 - DNA, 20 bp, Artificial Sequence
  Description of Artificial Sequence: Synthetic oligonucleotide
  Target: SCN10A; (+) strand; PAM type: YTN; PAM sequence: CTG
taggaatagagaatgacctc

SEQ ID NO: 60834 - DNA, 20 bp, Artificial Sequence
  Description of Artificial Sequence: Synthetic oligonucleotide
  Target: SCN10A; (+) strand; PAM type: YTN; PAM sequence: CTC
agttcacactgagtgctact

SEQ ID NO: 60835 - DNA, 20 bp, Artificial Sequence
  Description of Artificial Sequence: Synthetic oligonucleotide
  Target: SCN10A; (+) strand; PAM type: YTN; PAM sequence: TTC
acactgagtgctactccttg

SEQ ID NO: 60836 - DNA, 20 bp, Artificial Sequence
  Description of Artificial Sequence: Synthetic oligonucleotide
  Target: SCN10A; (+) strand; PAM type: YTN; PAM sequence: CTG
agtgctactccttgcaaagt

SEQ ID NO: 60837 - DNA, 20 bp, Artificial Sequence
  Description of Artificial Sequence: Synthetic oligonucleotide
  Target: SCN10A; (+) strand; PAM type: YTN; PAM sequence: CTA
ctccttgcaaagtccccaca

SEQ ID NO: 60838 - DNA, 20 bp, Artificial Sequence
  Description of Artificial Sequence: Synthetic oligonucleotide
  Target: SCN10A; (+) strand; PAM type: YTN; PAM sequence: CTC
cttgcaaagtccccacatag

SEQ ID NO: 60839 - DNA, 20 bp, Artificial Sequence
  Description of Artificial Sequence: Synthetic oligonucleotide
  Target: SCN10A; (+) strand; PAM type: YTN; PAM sequence: CTT
gcaaagtccccacatagcat

SEQ ID NO: 60840 - DNA, 20 bp, Artificial Sequence
  Description of Artificial Sequence: Synthetic oligonucleotide
  Target: SCN10A; (+) strand; PAM type: YTN; PAM sequence: TTG
caaagtccccacatagcatc

SEQ ID NO: 60841 - DNA, 20 bp, Artificial Sequence
  Description of Artificial Sequence: Synthetic oligonucleotide
  Target: SCN10A; (+) strand; PAM type: YTN; PAM sequence: CTT
ctgggaacctagactctcca

SEQ ID NO: 60842 - DNA, 20 bp, Artificial Sequence
  Description of Artificial Sequence: Synthetic oligonucleotide
  Target: SCN10A; (+) strand; PAM type: YTN; PAM sequence: TTC
tgggaacctagactctccat

SEQ ID NO: 60843 - DNA, 20 bp, Artificial Sequence
  Description of Artificial Sequence: Synthetic oligonucleotide
  Target: SCN10A; (+) strand; PAM type: YTN; PAM sequence: CTG
ggaacctagactctccattt

SEQ ID NO: 60844 - DNA, 20 bp, Artificial Sequence
  Description of Artificial Sequence: Synthetic oligonucleotide
  Target: SCN10A; (+) strand; PAM type: YTN; PAM sequence: CTA
gactctccattttattgagc

SEQ ID NO: 60845 - DNA, 20 bp, Artificial Sequence
  Description of Artificial Sequence: Synthetic oligonucleotide
  Target: SCN10A; (+) strand; PAM type: YTN; PAM sequence: CTC
tccattttattgagcggcca

SEQ ID NO: 60846 - DNA, 20 bp, Artificial Sequence
  Description of Artificial Sequence: Synthetic oligonucleotide
  Target: SCN10A; (+) strand; PAM type: YTN; PAM sequence: CTC
cattttattgagcggccaaa

SEQ ID NO: 60847 - DNA, 20 bp, Artificial Sequence
  Description of Artificial Sequence: Synthetic oligonucleotide
  Target: SCN10A; (+) strand; PAM type: YTN; PAM sequence: TTT
tattgagcggccaaagcaag

SEQ ID NO: 60848 - DNA, 20 bp, Artificial Sequence
  Description of Artificial Sequence: Synthetic oligonucleotide
  Target: SCN10A; (+) strand; PAM type: YTN; PAM sequence: TTT
attgagcggccaaagcaaga

SEQ ID NO: 60849 - DNA, 20 bp, Artificial Sequence
  Description of Artificial Sequence: Synthetic oligonucleotide
  Target: SCN10A; (+) strand; PAM type: YTN; PAM sequence: TTA
ttgagcggccaaagcaagag

SEQ ID NO: 60850 - DNA, 20 bp, Artificial Sequence
  Description of Artificial Sequence: Synthetic oligonucleotide
  Target: SCN10A; (+) strand; PAM type: YTN; PAM sequence: TTG
agcggccaaagcaagagata

SEQ ID NO: 60851 - DNA, 20 bp, Artificial Sequence
  Description of Artificial Sequence: Synthetic oligonucleotide
  Target: SCN10A; (+) strand; PAM type: YTN; PAM sequence: TTG
atctcatggttgactcacca

SEQ ID NO: 60852 - DNA, 20 bp, Artificial Sequence
  Description of Artificial Sequence: Synthetic oligonucleotide
  Target: SCN10A; (+) strand; PAM type: YTN; PAM sequence: CTC
atggttgactcaccacctgc

SEQ ID NO: 60853 - DNA, 20 bp, Artificial Sequence
  Description of Artificial Sequence: Synthetic oligonucleotide
  Target: SCN10A; (+) strand; PAM type: YTN; PAM sequence: TTG
actcaccacctgcagaagtg

SEQ ID NO: 60854 - DNA, 20 bp, Artificial Sequence
  Description of Artificial Sequence: Synthetic oligonucleotide
  Target: SCN10A; (+) strand; PAM type: YTN; PAM sequence: CTC
accacctgcagaagtgcaag

SEQ ID NO: 60855 - DNA, 20 bp, Artificial Sequence
  Description of Artificial Sequence: Synthetic oligonucleotide
  Target: SCN10A; (+) strand; PAM type: YTN; PAM sequence: CTG
cagaagtgcaaggtaaccca

SEQ ID NO: 60856 - DNA, 20 bp, Artificial Sequence
  Description of Artificial Sequence: Synthetic oligonucleotide
  Target: SCN10A; (+) strand; PAM type: YTN; PAM sequence: TTG
caacattatcaaagttgact

SEQ ID NO: 60857 - DNA, 20 bp, Artificial Sequence
  Description of Artificial Sequence: Synthetic oligonucleotide
  Target: SCN10A; (+) strand; PAM type: YTN; PAM sequence: TTA
tcaaagttgactttcacatt

SEQ ID NO: 60858 - DNA, 20 bp, Artificial Sequence
  Description of Artificial Sequence: Synthetic oligonucleotide
  Target: SCN10A; (+) strand; PAM type: YTN; PAM sequence: TTG
actttcacattgacccagaa

SEQ ID NO: 60859 - DNA, 20 bp, Artificial Sequence
  Description of Artificial Sequence: Synthetic oligonucleotide
  Target: SCN10A; (+) strand; PAM type: YTN; PAM sequence: CTT
tcacattgacccagaagaag

SEQ ID NO: 60860 - DNA, 20 bp, Artificial Sequence
  Description of Artificial Sequence: Synthetic oligonucleotide
  Target: SCN10A; (+) strand; PAM type: YTN; PAM sequence: TTT
cacattgacccagaagaagc

SEQ ID NO: 60861 - DNA, 20 bp, Artificial Sequence
  Description of Artificial Sequence: Synthetic oligonucleotide
  Target: SCN10A; (+) strand; PAM type: YTN; PAM sequence: TTC
acattgacccagaagaagct

SEQ ID NO: 60862 - DNA, 20 bp, Artificial Sequence
  Description of Artificial Sequence: Synthetic oligonucleotide
  Target: SCN10A; (+) strand; PAM type: YTN; PAM sequence: TTG
acccagaagaagctgccagt

SEQ ID NO: 60863 - DNA, 20 bp, Artificial Sequence
  Description of Artificial Sequence: Synthetic oligonucleotide
  Target: SCN10A; (+) strand; PAM type: YTN; PAM sequence: CTG
ccagtggagttttgaatctt

SEQ ID NO: 60864 - DNA, 20 bp, Artificial Sequence
  Description of Artificial Sequence: Synthetic oligonucleotide
  Target: SCN10A; (+) strand; PAM type: YTN; PAM sequence: TTT
tgaatcttgcagtcagactt

SEQ ID NO: 60865 - DNA, 20 bp, Artificial Sequence
  Description of Artificial Sequence: Synthetic oligonucleotide
  Target: SCN10A; (+) strand; PAM type: YTN; PAM sequence: TTT
gaatcttgcagtcagacttg

SEQ ID NO: 60866 - DNA, 20 bp, Artificial Sequence
  Description of Artificial Sequence: Synthetic oligonucleotide
  Target: SCN10A; (+) strand; PAM type: YTN; PAM sequence: TTG
aatcttgcagtcagacttgt

SEQ ID NO: 60867 - DNA, 20 bp, Artificial Sequence
  Description of Artificial Sequence: Synthetic oligonucleotide
  Target: SCN10A; (+) strand; PAM type: YTN; PAM sequence: CTT
gcagtcagacttgttattca

SEQ ID NO: 60868 - DNA, 20 bp, Artificial Sequence
  Description of Artificial Sequence: Synthetic oligonucleotide
  Target: SCN10A; (+) strand; PAM type: YTN; PAM sequence: TTG
cagtcagacttgttattcac

SEQ ID NO: 60869 - DNA, 20 bp, Artificial Sequence
  Description of Artificial Sequence: Synthetic oligonucleotide
  Target: SCN10A; (+) strand; PAM type: YTN; PAM sequence: CTT
gttattcacaatcgacaaag

SEQ ID NO: 60870 - DNA, 20 bp, Artificial Sequence
  Description of Artificial Sequence: Synthetic oligonucleotide
  Target: SCN10A; (+) strand; PAM type: YTN; PAM sequence: TTG
ttattcacaatcgacaaagg

SEQ ID NO: 60871 - DNA, 20 bp, Artificial Sequence
  Description of Artificial Sequence: Synthetic oligonucleotide
  Target: SCN10A; (+) strand; PAM type: YTN; PAM sequence: TTA
ttcacaatcgacaaaggtac

SEQ ID NO: 60872 - DNA, 20 bp, Artificial Sequence
  Description of Artificial Sequence: Synthetic oligonucleotide
  Target: SCN10A; (+) strand; PAM type: YTN; PAM sequence: TTC
acaatcgacaaaggtacaag

SEQ ID NO: 60873 - DNA, 20 bp, Artificial Sequence
  Description of Artificial Sequence: Synthetic oligonucleotide
  Target: SCN10A; (+) strand; PAM type: YTN; PAM sequence: CTC
tccatcggtatagttgatgc

SEQ ID NO: 60874 - DNA, 20 bp, Artificial Sequence
  Description of Artificial Sequence: Synthetic oligonucleotide
  Target: SCN10A; (+) strand; PAM type: YTN; PAM sequence: CTC
catcggtatagttgatgcac

SEQ ID NO: 60875 - DNA, 20 bp, Artificial Sequence
  Description of Artificial Sequence: Synthetic oligonucleotide
  Target: SCN10A; (+) strand; PAM type: YTN; PAM sequence: TTG
atgcacctccaaaacttccc

SEQ ID NO: 60876 - DNA, 20 bp, Artificial Sequence
  Description of Artificial Sequence: Synthetic oligonucleotide
  Target: SCN10A; (+) strand; PAM type: YTN; PAM sequence: CTC
caaaacttccctgcgaagag

SEQ ID NO: 60877 - DNA, 20 bp, Artificial Sequence
  Description of Artificial Sequence: Synthetic oligonucleotide
  Target: SCN10A; (+) strand; PAM type: YTN; PAM sequence: CTT
ccctgcgaagaggttcacac

SEQ ID NO: 60878 - DNA, 20 bp, Artificial Sequence
  Description of Artificial Sequence: Synthetic oligonucleotide
  Target: SCN10A; (+) strand; PAM type: YTN; PAM sequence: TTC
cctgcgaagaggttcacacc

SEQ ID NO: 60879 - DNA, 20 bp, Artificial Sequence
  Description of Artificial Sequence: Synthetic oligonucleotide
  Target: SCN10A; (+) strand; PAM type: YTN; PAM sequence: CTG
cgaagaggttcacacccatg

SEQ ID NO: 60880 - DNA, 20 bp, Artificial Sequence
  Description of Artificial Sequence: Synthetic oligonucleotide
  Target: SCN10A; (+) strand; PAM type: YTN; PAM sequence: TTC
acacccatgatgctgaagat

SEQ ID NO: 60881 - DNA, 20 bp, Artificial Sequence
  Description of Artificial Sequence: Synthetic oligonucleotide
  Target: SCN10A; (+) strand; PAM type: YTN; PAM sequence: CTG
aagatgagccagaagatgag

SEQ ID NO: 60882 - DNA, 20 bp, Artificial Sequence
  Description of Artificial Sequence: Synthetic oligonucleotide
  Target: SCN10A; (+) strand; PAM type: YTN; PAM sequence: TTC
atgatggatgggatggcgcc

SEQ ID NO: 60883 - DNA, 20 bp, Artificial Sequence
  Description of Artificial Sequence: Synthetic oligonucleotide
  Target: SCN10A; (+) strand; PAM type: YTN; PAM sequence: CTG
gtgggagatagagaaagacc

SEQ ID NO: 60884 - DNA, 20 bp, Artificial Sequence
  Description of Artificial Sequence: Synthetic oligonucleotide
  Target: SCN10A; (+) strand; PAM type: YTN; PAM sequence: CTG
gaacctcccaatgccccacc

SEQ ID NO: 60885 - DNA, 20 bp, Artificial Sequence
  Description of Artificial Sequence: Synthetic oligonucleotide
  Target: SCN10A; (+) strand; PAM type: YTN; PAM sequence: CTC
ccaatgccccaccccctctg

SEQ ID NO: 60886 - DNA, 20 bp, Artificial Sequence
  Description of Artificial Sequence: Synthetic oligonucleotide
  Target: SCN10A; (+) strand; PAM type: YTN; PAM sequence: CTC
tgctggattctatctctttc

SEQ ID NO: 60887 - DNA, 20 bp, Artificial Sequence
  Description of Artificial Sequence: Synthetic oligonucleotide
  Target: SCN10A; (+) strand; PAM type: YTN; PAM sequence: CTG
ctggattctatctctttcta

SEQ ID NO: 60888 - DNA, 20 bp, Artificial Sequence
  Description of Artificial Sequence: Synthetic oligonucleotide
  Target: SCN10A; (+) strand; PAM type: YTN; PAM sequence: CTG
gattctatctctttctatac

SEQ ID NO: 60889 - DNA, 20 bp, Artificial Sequence
  Description of Artificial Sequence: Synthetic oligonucleotide
  Target: SCN10A; (+) strand; PAM type: YTN; PAM sequence: TTC
tatctctttctatactcatt

SEQ ID NO: 60890 - DNA, 20 bp, Artificial Sequence
  Description of Artificial Sequence: Synthetic oligonucleotide
  Target: SCN10A; (+) strand; PAM type: YTN; PAM sequence: CTA
tctctttctatactcattca

SEQ ID NO: 60891 - DNA, 20 bp, Artificial Sequence
  Description of Artificial Sequence: Synthetic oligonucleotide
  Target: SCN10A; (+) strand; PAM type: YTN; PAM sequence: CTC
tttctatactcattcaggct

SEQ ID NO: 60892 - DNA, 20 bp, Artificial Sequence
  Description of Artificial Sequence: Synthetic oligonucleotide
  Target: SCN10A; (+) strand; PAM type: YTN; PAM sequence: CTT
tctatactcattcaggctgc

SEQ ID NO: 60893 - DNA, 20 bp, Artificial Sequence
  Description of Artificial Sequence: Synthetic oligonucleotide
  Target: SCN10A; (+) strand; PAM type: YTN; PAM sequence: TTT
ctatactcattcaggctgct

SEQ ID NO: 60894 - DNA, 20 bp, Artificial Sequence
  Description of Artificial Sequence: Synthetic oligonucleotide
  Target: SCN10A; (+) strand; PAM type: YTN; PAM sequence: TTC
tatactcattcaggctgctt

SEQ ID NO: 60895 - DNA, 20 bp, Artificial Sequence
  Description of Artificial Sequence: Synthetic oligonucleotide
  Target: SCN10A; (+) strand; PAM type: YTN; PAM sequence: CTA
tactcattcaggctgcttca

SEQ ID NO: 60896 - DNA, 20 bp, Artificial Sequence
  Description of Artificial Sequence: Synthetic oligonucleotide
  Target: SCN10A; (+) strand; PAM type: YTN; PAM sequence: CTC
attcaggctgcttcatgagc

SEQ ID NO: 60897 - DNA, 20 bp, Artificial Sequence
  Description of Artificial Sequence: Synthetic oligonucleotide
  Target: SCN10A; (+) strand; PAM type: YTN; PAM sequence: TTC
aggctgcttcatgagccagt

SEQ ID NO: 60898 - DNA, 20 bp, Artificial Sequence
  Description of Artificial Sequence: Synthetic oligonucleotide
  Target: SCN10A; (+) strand; PAM type: YTN; PAM sequence: CTG
cttcatgagccagtggcctt

SEQ ID NO: 60899 - DNA, 20 bp, Artificial Sequence
  Description of Artificial Sequence: Synthetic oligonucleotide
  Target: SCN10A; (+) strand; PAM type: YTN; PAM sequence: CTT
catgagccagtggcctttgg

SEQ ID NO: 60900 - DNA, 20 bp, Artificial Sequence
  Description of Artificial Sequence: Synthetic oligonucleotide
  Target: SCN10A; (+) strand; PAM type: YTN; PAM sequence: TTC
atgagccagtggcctttgga

SEQ ID NO: 60901 - DNA, 20 bp, Artificial Sequence
  Description of Artificial Sequence: Synthetic oligonucleotide
  Target: SCN10A; (+) strand; PAM type: YTN; PAM sequence: CTT
tggaagaagcaagagaagtg

SEQ ID NO: 60902 - DNA, 20 bp, Artificial Sequence
  Description of Artificial Sequence: Synthetic oligonucleotide
  Target: SCN10A; (+) strand; PAM type: YTN; PAM sequence: TTT
ggaagaagcaagagaagtgg

SEQ ID NO: 60903 - DNA, 20 bp, Artificial Sequence
  Description of Artificial Sequence: Synthetic oligonucleotide
  Target: SCN10A; (+) strand; PAM type: YTN; PAM sequence: TTG
gaagaagcaagagaagtggg

SEQ ID NO: 60904 - DNA, 20 bp, Artificial Sequence
  Description of Artificial Sequence: Synthetic oligonucleotide
  Target: SCN10A; (+) strand; PAM type: YTN; PAM sequence: TTA
attagtgcaataattcagac

SEQ ID NO: 60905 - DNA, 20 bp, Artificial Sequence
  Description of Artificial Sequence: Synthetic oligonucleotide
  Target: SCN10A; (+) strand; PAM type: YTN; PAM sequence: TTA
gtgcaataattcagactcag

SEQ ID NO: 60906 - DNA, 20 bp, Artificial Sequence
  Description of Artificial Sequence: Synthetic oligonucleotide
  Target: SCN10A; (+) strand; PAM type: YTN; PAM sequence: TTC
agactcagaagactgagaga

SEQ ID NO: 60907 - DNA, 20 bp, Artificial Sequence
  Description of Artificial Sequence: Synthetic oligonucleotide
  Target: SCN10A; (+) strand; PAM type: YTN; PAM sequence: CTC
agaagactgagagacattgg

SEQ ID NO: 60908 - DNA, 20 bp, Artificial Sequence
  Description of Artificial Sequence: Synthetic oligonucleotide
  Target: SCN10A; (+) strand; PAM type: YTN; PAM sequence: CTG
agagacattgggcagctgaa

SEQ ID NO: 60909 - DNA, 20 bp, Artificial Sequence
  Description of Artificial Sequence: Synthetic oligonucleotide
  Target: SCN10A; (+) strand; PAM type: YTN; PAM sequence: TTG
ggcagctgaagatggattta

SEQ ID NO: 60910 - DNA, 20 bp, Artificial Sequence
  Description of Artificial Sequence: Synthetic oligonucleotide
  Target: SCN10A; (+) strand; PAM type: YTN; PAM sequence: CTG
aagatggatttagaccttct

SEQ ID NO: 60911 - DNA, 20 bp, Artificial Sequence
  Description of Artificial Sequence: Synthetic oligonucleotide
  Target: SCN10A; (+) strand; PAM type: YTN; PAM sequence: TTT
agaccttcttcccttaacct

SEQ ID NO: 60912 - DNA, 20 bp, Artificial Sequence
  Description of Artificial Sequence: Synthetic oligonucleotide
  Target: SCN10A; (+) strand; PAM type: YTN; PAM sequence: TTA
gaccttcttcccttaacctc

SEQ ID NO: 60913 - DNA, 20 bp, Artificial Sequence
  Description of Artificial Sequence: Synthetic oligonucleotide
  Target: SCN10A; (+) strand; PAM type: YTN; PAM sequence: CTT
cttcccttaacctcattcag

SEQ ID NO: 60914 - DNA, 20 bp, Artificial Sequence
  Description of Artificial Sequence: Synthetic oligonucleotide
  Target: SCN10A; (+) strand; PAM type: YTN; PAM sequence: TTC
ttcccttaacctcattcagg

SEQ ID NO: 60915 - DNA, 20 bp, Artificial Sequence
  Description of Artificial Sequence: Synthetic oligonucleotide
  Target: SCN10A; (+) strand; PAM type: YTN; PAM sequence: CTT
cccttaacctcattcagggt

SEQ ID NO: 60916 - DNA, 20 bp, Artificial Sequence
  Description of Artificial Sequence: Synthetic oligonucleotide
  Target: SCN10A; (+) strand; PAM type: YTN; PAM sequence: TTC
ccttaacctcattcagggtg

SEQ ID NO: 60917 - DNA, 20 bp, Artificial Sequence
  Description of Artificial Sequence: Synthetic oligonucleotide
  Target: SCN10A; (+) strand; PAM type: YTN; PAM sequence: CTT
aacctcattcagggtgggtt

SEQ ID NO: 60918 - DNA, 20 bp, Artificial Sequence
  Description of Artificial Sequence: Synthetic oligonucleotide
  Target: SCN10A; (+) strand; PAM type: YTN; PAM sequence: TTA
acctcattcagggtgggttg

SEQ ID NO: 60919 - DNA, 20 bp, Artificial Sequence
  Description of Artificial Sequence: Synthetic oligonucleotide
  Target: SCN10A; (+) strand; PAM type: YTN; PAM sequence: CTC
attcagggtgggttgcagtg

SEQ ID NO: 60920 - DNA, 20 bp, Artificial Sequence
  Description of Artificial Sequence: Synthetic oligonucleotide
  Target: SCN10A; (+) strand; PAM type: YTN; PAM sequence: TTC
agggtgggttgcagtgagaa

SEQ ID NO: 60921 - DNA, 20 bp, Artificial Sequence
  Description of Artificial Sequence: Synthetic oligonucleotide
  Target: SCN10A; (+) strand; PAM type: YTN; PAM sequence: TTG
cagtgagaagatggatgagt

SEQ ID NO: 60922 - DNA, 20 bp, Artificial Sequence
  Description of Artificial Sequence: Synthetic oligonucleotide
  Target: SCN10A; (+) strand; PAM type: YTN; PAM sequence: TTT
acaagcatactgcactcatt

SEQ ID NO: 60923 - DNA, 20 bp, Artificial Sequence
  Description of Artificial Sequence: Synthetic oligonucleotide
  Target: SCN10A; (+) strand; PAM type: YTN; PAM sequence: TTA
caagcatactgcactcattt

SEQ ID NO: 60924 - DNA, 20 bp, Artificial Sequence
  Description of Artificial Sequence: Synthetic oligonucleotide
  Target: SCN10A; (+) strand; PAM type: YTN; PAM sequence: CTG
cactcatttagaagtgtgag

SEQ ID NO: 60925 - DNA, 20 bp, Artificial Sequence
  Description of Artificial Sequence: Synthetic oligonucleotide
  Target: SCN10A; (+) strand; PAM type: YTN; PAM sequence: CTC
atttagaagtgtgagtgtgt

SEQ ID NO: 60926 - DNA, 20 bp, Artificial Sequence
  Description of Artificial Sequence: Synthetic oligonucleotide
  Target: SCN10A; (+) strand; PAM type: YTN; PAM sequence: TTT
agaagtgtgagtgtgtgtat

SEQ ID NO: 60927 - DNA, 20 bp, Artificial Sequence
  Description of Artificial Sequence: Synthetic oligonucleotide
  Target: SCN10A; (+) strand; PAM type: YTN; PAM sequence: TTA
gaagtgtgagtgtgtgtatt

SEQ ID NO: 60928 - DNA, 20 bp, Artificial Sequence
  Description of Artificial Sequence: Synthetic oligonucleotide
  Target: SCN10A; (+) strand; PAM type: YTN; PAM sequence: TTA
tacttgcacatacagacttc

SEQ ID NO: 60929 - DNA, 20 bp, Artificial Sequence
  Description of Artificial Sequence: Synthetic oligonucleotide
  Target: SCN10A; (+) strand; PAM type: YTN; PAM sequence: CTT
gcacatacagacttctagaa

SEQ ID NO: 60930 - DNA, 20 bp, Artificial Sequence
  Description of Artificial Sequence: Synthetic oligonucleotide
  Target: SCN10A; (+) strand; PAM type: YTN; PAM sequence: TTG
cacatacagacttctagaac

SEQ ID NO: 60931 - DNA, 20 bp, Artificial Sequence
  Description of Artificial Sequence: Synthetic oligonucleotide
  Target: SCN10A; (+) strand; PAM type: YTN; PAM sequence: CTT
ctagaaccttgacttattct

SEQ ID NO: 60932 - DNA, 20 bp, Artificial Sequence
  Description of Artificial Sequence: Synthetic oligonucleotide
  Target: SCN10A; (+) strand; PAM type: YTN; PAM sequence: TTC
tagaaccttgacttattctc

SEQ ID NO: 60933 - DNA, 20 bp, Artificial Sequence
  Description of Artificial Sequence: Synthetic oligonucleotide
  Target: SCN10A; (+) strand; PAM type: YTN; PAM sequence: CTA
gaaccttgacttattctcct

SEQ ID NO: 60934 - DNA, 20 bp, Artificial Sequence
  Description of Artificial Sequence: Synthetic oligonucleotide
  Target: SCN10A; (+) strand; PAM type: YTN; PAM sequence: CTT
gacttattctccttaaatac

SEQ ID NO: 60935 - DNA, 20 bp, Artificial Sequence
  Description of Artificial Sequence: Synthetic oligonucleotide
  Target: SCN10A; (+) strand; PAM type: YTN; PAM sequence: TTG
acttattctccttaaatacc

SEQ ID NO: 60936 - DNA, 20 bp, Artificial Sequence
  Description of Artificial Sequence: Synthetic oligonucleotide
  Target: SCN10A; (+) strand; PAM type: YTN; PAM sequence: CTT
attctccttaaataccatac

SEQ ID NO: 60937 - DNA, 20 bp, Artificial Sequence
  Description of Artificial Sequence: Synthetic oligonucleotide
  Target: SCN10A; (+) strand; PAM type: YTN; PAM sequence: TTA
ttctccttaaataccataca

SEQ ID NO: 60938 - DNA, 20 bp, Artificial Sequence
  Description of Artificial Sequence: Synthetic oligonucleotide
  Target: SCN10A; (+) strand; PAM type: YTN; PAM sequence: TTC
tccttaaataccatacataa

SEQ ID NO: 60939 - DNA, 20 bp, Artificial Sequence
  Description of Artificial Sequence: Synthetic oligonucleotide
  Target: SCN10A; (+) strand; PAM type: YTN; PAM sequence: CTC
cttaaataccatacataaaa

SEQ ID NO: 60940 - DNA, 20 bp, Artificial Sequence
  Description of Artificial Sequence: Synthetic oligonucleotide
  Target: SCN10A; (+) strand; PAM type: YTN; PAM sequence: CTT
aaataccatacataaaacac

SEQ ID NO: 60941 - DNA, 20 bp, Artificial Sequence
  Description of Artificial Sequence: Synthetic oligonucleotide
  Target: SCN10A; (+) strand; PAM type: YTN; PAM sequence: TTA
aataccatacataaaacaca

SEQ ID NO: 60942 - DNA, 20 bp, Artificial Sequence
  Description of Artificial Sequence: Synthetic oligonucleotide
  Target: SCN10A; (+) strand; PAM type: YTN; PAM sequence: TTT
aaatacaatttaaagtatgc

SEQ ID NO: 60943 - DNA, 20 bp, Artificial Sequence
  Description of Artificial Sequence: Synthetic oligonucleotide
  Target: SCN10A; (+) strand; PAM type: YTN; PAM sequence: TTA
aatacaatttaaagtatgcc

SEQ ID NO: 60944 - DNA, 20 bp, Artificial Sequence
  Description of Artificial Sequence: Synthetic oligonucleotide
  Target: SCN10A; (+) strand; PAM type: YTN; PAM sequence: TTT
aaagtatgccgtggtcaaga

SEQ ID NO: 60945 - DNA, 20 bp, Artificial Sequence
  Description of Artificial Sequence: Synthetic oligonucleotide
  Target: SCN10A; (+) strand; PAM type: YTN; PAM sequence: TTA
aagtatgccgtggtcaagaa

SEQ ID NO: 60946 - DNA, 20 bp, Artificial Sequence
  Description of Artificial Sequence: Synthetic oligonucleotide
  Target: SCN10A; (+) strand; PAM type: YTN; PAM sequence: CTA
aatccatattcacaaaatag

SEQ ID NO: 60947 - DNA, 20 bp, Artificial Sequence
  Description of Artificial Sequence: Synthetic oligonucleotide
  Target: SCN10A; (+) strand; PAM type: YTN; PAM sequence: TTC
acaaaatagcttatttgtaa

SEQ ID NO: 60948 - DNA, 20 bp, Artificial Sequence
  Description of Artificial Sequence: Synthetic oligonucleotide
  Target: SCN10A; (+) strand; PAM type: YTN; PAM sequence: CTT
atttgtaaataagcaaatga

SEQ ID NO: 60949 - DNA, 20 bp, Artificial Sequence
  Description of Artificial Sequence: Synthetic oligonucleotide
  Target: SCN10A; (+) strand; PAM type: YTN; PAM sequence: TTA
tttgtaaataagcaaatgag

SEQ ID NO: 60950 - DNA, 20 bp, Artificial Sequence
  Description of Artificial Sequence: Synthetic oligonucleotide
  Target: SCN10A; (+) strand; PAM type: YTN; PAM sequence: TTT
gtaaataagcaaatgagaat

SEQ ID NO: 60951 - DNA, 20 bp, Artificial Sequence
  Description of Artificial Sequence: Synthetic oligonucleotide
  Target: SCN10A; (+) strand; PAM type: YTN; PAM sequence: TTG
taaataagcaaatgagaatc

SEQ ID NO: 60952 - DNA, 20 bp, Artificial Sequence
  Description of Artificial Sequence: Synthetic oligonucleotide
  Target: SCN10A; (+) strand; PAM type: YTN; PAM sequence: CTA
ttagatacaaaatagaataa

SEQ ID NO: 60953 - DNA, 20 bp, Artificial Sequence
  Description of Artificial Sequence: Synthetic oligonucleotide
  Target: SCN10A; (+) strand; PAM type: YTN; PAM sequence: TTA
gatacaaaatagaataaatt

SEQ ID NO: 60954 - DNA, 20 bp, Artificial Sequence
  Description of Artificial Sequence: Synthetic oligonucleotide
  Target: SCN10A; (+) strand; PAM type: YTN; PAM sequence: TTT
caaactatttcaatcttcgg

SEQ ID NO: 60955 - DNA, 20 bp, Artificial Sequence
  Description of Artificial Sequence: Synthetic oligonucleotide
  Target: SCN10A; (+) strand; PAM type: YTN; PAM sequence: TTC
aaactatttcaatcttcggg

SEQ ID NO: 60956 - DNA, 20 bp, Artificial Sequence
  Description of Artificial Sequence: Synthetic oligonucleotide
  Target: SCN10A; (+) strand; PAM type: YTN; PAM sequence: CTA
tttcaatcttcgggtcctag

SEQ ID NO: 60957 - DNA, 20 bp, Artificial Sequence
  Description of Artificial Sequence: Synthetic oligonucleotide
  Target: SCN10A; (+) strand; PAM type: YTN; PAM sequence: TTT
caatcttcgggtcctagtgt

SEQ ID NO: 60958 - DNA, 20 bp, Artificial Sequence
  Description of Artificial Sequence: Synthetic oligonucleotide
  Target: SCN10A; (+) strand; PAM type: YTN; PAM sequence: TTC
aatcttcgggtcctagtgtt

SEQ ID NO: 60959 - DNA, 20 bp, Artificial Sequence
  Description of Artificial Sequence: Synthetic oligonucleotide
  Target: SCN10A; (+) strand; PAM type: YTN; PAM sequence: CTT
cgggtcctagtgtttgtaaa

SEQ ID NO: 60960 - DNA, 20 bp, Artificial Sequence
  Description of Artificial Sequence: Synthetic oligonucleotide
  Target: SCN10A; (+) strand; PAM type: YTN; PAM sequence: TTC
gggtcctagtgtttgtaaag

SEQ ID NO: 60961 - DNA, 20 bp, Artificial Sequence
  Description of Artificial Sequence: Synthetic oligonucleotide
  Target: SCN10A; (+) strand; PAM type: YTN; PAM sequence: CTA
gtgtttgtaaaggtacaagt

SEQ ID NO: 60962 - DNA, 20 bp, Artificial Sequence
  Description of Artificial Sequence: Synthetic oligonucleotide
  Target: SCN10A; (+) strand; PAM type: YTN; PAM sequence: TTT
gtaaaggtacaagttaattt

SEQ ID NO: 60963 - DNA, 20 bp, Artificial Sequence
  Description of Artificial Sequence: Synthetic oligonucleotide
  Target: SCN10A; (+) strand; PAM type: YTN; PAM sequence: TTG
taaaggtacaagttaatttc

SEQ ID NO: 60964 - DNA, 20 bp, Artificial Sequence
  Description of Artificial Sequence: Synthetic oligonucleotide
  Target: SCN10A; (+) strand; PAM type: YTN; PAM sequence: TTA
atttcaaaagcccacttttg

SEQ ID NO: 60965 - DNA, 20 bp, Artificial Sequence
  Description of Artificial Sequence: Synthetic oligonucleotide
  Target: SCN10A; (+) strand; PAM type: YTN; PAM sequence: TTT
caaaagcccacttttgtttt

SEQ ID NO: 60966 - DNA, 20 bp, Artificial Sequence
  Description of Artificial Sequence: Synthetic oligonucleotide
  Target: SCN10A; (+) strand; PAM type: YTN; PAM sequence: TTC
aaaagcccacttttgttttt

SEQ ID NO: 60967 - DNA, 20 bp, Artificial Sequence
  Description of Artificial Sequence: Synthetic oligonucleotide
  Target: SCN10A; (+) strand; PAM type: YTN; PAM sequence: CTT
ttgtttttgaagctatgatg

SEQ ID NO: 60968 - DNA, 20 bp, Artificial Sequence
  Description of Artificial Sequence: Synthetic oligonucleotide
  Target: SCN10A; (+) strand; PAM type: YTN; PAM sequence: TTT
tgtttttgaagctatgatga

SEQ ID NO: 60969 - DNA, 20 bp, Artificial Sequence
  Description of Artificial Sequence: Synthetic oligonucleotide
  Target: SCN10A; (+) strand; PAM type: YTN; PAM sequence: TTT
gtttttgaagctatgatgac

SEQ ID NO: 60970 - DNA, 20 bp, Artificial Sequence
  Description of Artificial Sequence: Synthetic oligonucleotide
  Target: SCN10A; (+) strand; PAM type: YTN; PAM sequence: TTG
tttttgaagctatgatgact

SEQ ID NO: 60971 - DNA, 20 bp, Artificial Sequence
  Description of Artificial Sequence: Synthetic oligonucleotide
  Target: SCN10A; (+) strand; PAM type: YTN; PAM sequence: TTT
ttgaagctatgatgactact

SEQ ID NO: 60972 - DNA, 20 bp, Artificial Sequence
  Description of Artificial Sequence: Synthetic oligonucleotide
  Target: SCN10A; (+) strand; PAM type: YTN; PAM sequence: TTT
tgaagctatgatgactactt

SEQ ID NO: 60973 - DNA, 20 bp, Artificial Sequence
  Description of Artificial Sequence: Synthetic oligonucleotide
  Target: SCN10A; (+) strand; PAM type: YTN; PAM sequence: TTT
gaagctatgatgactacttc

SEQ ID NO: 60974 - DNA, 20 bp, Artificial Sequence
  Description of Artificial Sequence: Synthetic oligonucleotide
  Target: SCN10A; (+) strand; PAM type: YTN; PAM sequence: TTG
aagctatgatgactacttcc

SEQ ID NO: 60975 - DNA, 20 bp, Artificial Sequence
  Description of Artificial Sequence: Synthetic oligonucleotide
  Target: SCN10A; (+) strand; PAM type: YTN; PAM sequence: CTA
tgatgactacttccagccaa

SEQ ID NO: 60976 - DNA, 20 bp, Artificial Sequence
  Description of Artificial Sequence: Synthetic oligonucleotide
  Target: SCN10A; (+) strand; PAM type: YTN; PAM sequence: CTA
cttccagccaatgatagtgg

SEQ ID NO: 60977 - DNA, 20 bp, Artificial Sequence
  Description of Artificial Sequence: Synthetic oligonucleotide
  Target: SCN10A; (+) strand; PAM type: YTN; PAM sequence: CTT
ccagccaatgatagtggagc

SEQ ID NO: 60978 - DNA, 20 bp, Artificial Sequence
  Description of Artificial Sequence: Synthetic oligonucleotide
  Target: SCN10A; (+) strand; PAM type: YTN; PAM sequence: TTC
cagccaatgatagtggagca

SEQ ID NO: 60979 - DNA, 20 bp, Artificial Sequence
  Description of Artificial Sequence: Synthetic oligonucleotide
  Target: SCN10A; (+) strand; PAM type: YTN; PAM sequence: CTT
actttctgctggggagccat

SEQ ID NO: 60980 - DNA, 20 bp, Artificial Sequence
  Description of Artificial Sequence: Synthetic oligonucleotide
  Target: SCN10A; (+) strand; PAM type: YTN; PAM sequence: TTA
ctttctgctggggagccatt

SEQ ID NO: 60981 - DNA, 20 bp, Artificial Sequence
  Description of Artificial Sequence: Synthetic oligonucleotide
  Target: SCN10A; (+) strand; PAM type: YTN; PAM sequence: CTT
tctgctggggagccatttgt

SEQ ID NO: 60982 - DNA, 20 bp, Artificial Sequence
  Description of Artificial Sequence: Synthetic oligonucleotide
  Target: SCN10A; (+) strand; PAM type: YTN; PAM sequence: TTT
ctgctggggagccatttgta

SEQ ID NO: 60983 - DNA, 20 bp, Artificial Sequence
  Description of Artificial Sequence: Synthetic oligonucleotide
  Target: SCN10A; (+) strand; PAM type: YTN; PAM sequence: TTC
tgctggggagccatttgtaa

SEQ ID NO: 60984 - DNA, 20 bp, Artificial Sequence
  Description of Artificial Sequence: Synthetic oligonucleotide
  Target: SCN10A; (+) strand; PAM type: YTN; PAM sequence: CTG
ctggggagccatttgtaatt

SEQ ID NO: 60985 - DNA, 20 bp, Artificial Sequence
  Description of Artificial Sequence: Synthetic oligonucleotide
  Target: SCN10A; (+) strand; PAM type: YTN; PAM sequence: CTG
gggagccatttgtaattatg

SEQ ID NO: 60986 - DNA, 20 bp, Artificial Sequence
  Description of Artificial Sequence: Synthetic oligonucleotide
  Target: SCN10A; (+) strand; PAM type: YTN; PAM sequence: TTT
gtaattatgaggaagaggtg

SEQ ID NO: 60987 - DNA, 20 bp, Artificial Sequence
  Description of Artificial Sequence: Synthetic oligonucleotide
  Target: SCN10A; (+) strand; PAM type: YTN; PAM sequence: TTG
taattatgaggaagaggtgg

SEQ ID NO: 60988 - DNA, 20 bp, Artificial Sequence
  Description of Artificial Sequence: Synthetic oligonucleotide
  Target: SCN10A; (+) strand; PAM type: YTN; PAM sequence: TTA
tgaggaagaggtgggtgtca

SEQ ID NO: 60989 - DNA, 20 bp, Artificial Sequence
  Description of Artificial Sequence: Synthetic oligonucleotide
  Target: SCN10A; (+) strand; PAM type: YTN; PAM sequence: CTC
taagacaaggctctggctgt

SEQ ID NO: 60990 - DNA, 20 bp, Artificial Sequence
  Description of Artificial Sequence: Synthetic oligonucleotide
  Target: SCN10A; (+) strand; PAM type: YTN; PAM sequence: CTA
agacaaggctctggctgtga

SEQ ID NO: 60991 - DNA, 20 bp, Artificial Sequence
  Description of Artificial Sequence: Synthetic oligonucleotide
  Target: SCN10A; (+) strand; PAM type: YTN; PAM sequence: CTC
tggctgtgagcattctgtcc

SEQ ID NO: 60992 - DNA, 20 bp, Artificial Sequence
  Description of Artificial Sequence: Synthetic oligonucleotide
  Target: SCN10A; (+) strand; PAM type: YTN; PAM sequence: CTG
gctgtgagcattctgtcctg

SEQ ID NO: 60993 - DNA, 20 bp, Artificial Sequence
  Description of Artificial Sequence: Synthetic oligonucleotide
  Target: SCN10A; (+) strand; PAM type: YTN; PAM sequence: CTG
tgagcattctgtcctgacgg

SEQ ID NO: 60994 - DNA, 20 bp, Artificial Sequence
  Description of Artificial Sequence: Synthetic oligonucleotide
  Target: SCN10A; (+) strand; PAM type: YTN; PAM sequence: TTC
tgtcctgacggaggcagtta

SEQ ID NO: 60995 - DNA, 20 bp, Artificial Sequence
  Description of Artificial Sequence: Synthetic oligonucleotide
  Target: SCN10A; (+) strand; PAM type: YTN; PAM sequence: CTG
tcctgacggaggcagttagg

SEQ ID NO: 60996 - DNA, 20 bp, Artificial Sequence
  Description of Artificial Sequence: Synthetic oligonucleotide
  Target: SCN10A; (+) strand; PAM type: YTN; PAM sequence: CTG
acggaggcagttagggcaag

SEQ ID NO: 60997 - DNA, 20 bp, Artificial Sequence
  Description of Artificial Sequence: Synthetic oligonucleotide
  Target: SCN10A; (+) strand; PAM type: YTN; PAM sequence: TTA
gggcaaggtggaggctgaca

SEQ ID NO: 60998 - DNA, 20 bp, Artificial Sequence
  Description of Artificial Sequence: Synthetic oligonucleotide
  Target: SCN10A; (+) strand; PAM type: YTN; PAM sequence: CTG
acagtggtggataaggaaag

SEQ ID NO: 60999 - DNA, 20 bp, Artificial Sequence
  Description of Artificial Sequence: Synthetic oligonucleotide
  Target: SCN10A; (+) strand; PAM type: YTN; PAM sequence: TTT
acaggacctgatgattgcat

SEQ ID NO: 61000 - DNA, 20 bp, Artificial Sequence
  Description of Artificial Sequence: Synthetic oligonucleotide
  Target: SCN10A; (+) strand; PAM type: YTN; PAM sequence: TTA
caggacctgatgattgcatt

SEQ ID NO: 61001 - DNA, 20 bp, Artificial Sequence
  Description of Artificial Sequence: Synthetic oligonucleotide
  Target: SCN10A; (+) strand; PAM type: YTN; PAM sequence: CTG
atgattgcattaagtaggag

SEQ ID NO: 61002 - DNA, 20 bp, Artificial Sequence
  Description of Artificial Sequence: Synthetic oligonucleotide
  Target: SCN10A; (+) strand; PAM type: YTN; PAM sequence: TTG
cattaagtaggagagaagaa

SEQ ID NO: 61003 - DNA, 20 bp, Artificial Sequence
  Description of Artificial Sequence: Synthetic oligonucleotide
  Target: SCN10A; (+) strand; PAM type: YTN; PAM sequence: TTA
agtaggagagaagaagcatt

SEQ ID NO: 61004 - DNA, 20 bp, Artificial Sequence
  Description of Artificial Sequence: Synthetic oligonucleotide
  Target: SCN10A; (+) strand; PAM type: YTN; PAM sequence: TTC
cagtgggtggcagctgaggt

SEQ ID NO: 61005 - DNA, 20 bp, Artificial Sequence
  Description of Artificial Sequence: Synthetic oligonucleotide
  Target: SCN10A; (+) strand; PAM type: YTN; PAM sequence: CTG
aggtaatgagctgatgatgt

SEQ ID NO: 61006 - DNA, 20 bp, Artificial Sequence
  Description of Artificial Sequence: Synthetic oligonucleotide
  Target: SCN10A; (+) strand; PAM type: YTN; PAM sequence: CTG
atgatgtcactcatggagta

SEQ ID NO: 61007 - DNA, 20 bp, Artificial Sequence
  Description of Artificial Sequence: Synthetic oligonucleotide
  Target: SCN10A; (+) strand; PAM type: YTN; PAM sequence: CTC
atggagtattagaggaaaga

SEQ ID NO: 61008 - DNA, 20 bp, Artificial Sequence
  Description of Artificial Sequence: Synthetic oligonucleotide
  Target: SCN10A; (+) strand; PAM type: YTN; PAM sequence: TTA
gaggaaagactcatttgtca

SEQ ID NO: 61009 - DNA, 20 bp, Artificial Sequence
  Description of Artificial Sequence: Synthetic oligonucleotide
  Target: SCN10A; (+) strand; PAM type: YTN; PAM sequence: CTC
atttgtcatggaaagacaga

SEQ ID NO: 61010 - DNA, 20 bp, Artificial Sequence
  Description of Artificial Sequence: Synthetic oligonucleotide
  Target: SCN10A; (+) strand; PAM type: YTN; PAM sequence: TTT
gtcatggaaagacagagaac

SEQ ID NO: 61011 - DNA, 20 bp, Artificial Sequence
  Description of Artificial Sequence: Synthetic oligonucleotide
  Target: SCN10A; (+) strand; PAM type: YTN; PAM sequence: TTG
tcatggaaagacagagaact

SEQ ID NO: 61012 - DNA, 20 bp, Artificial Sequence
  Description of Artificial Sequence: Synthetic oligonucleotide
  Target: SCN10A; (+) strand; PAM type: YTN; PAM sequence: CTT
gggatgttctggagatgttg

SEQ ID NO: 61013 - DNA, 20 bp, Artificial Sequence
  Description of Artificial Sequence: Synthetic oligonucleotide
  Target: SCN10A; (+) strand; PAM type: YTN; PAM sequence: TTG
ggatgttctggagatgttgg

SEQ ID NO: 61014 - DNA, 20 bp, Artificial Sequence
  Description of Artificial Sequence: Synthetic oligonucleotide
  Target: SCN10A; (+) strand; PAM type: YTN; PAM sequence: TTC
tggagatgttggcaataaga

SEQ ID NO: 61015 - DNA, 20 bp, Artificial Sequence
  Description of Artificial Sequence: Synthetic oligonucleotide
  Target: SCN10A; (+) strand; PAM type: YTN; PAM sequence: CTG
gagatgttggcaataagagg

SEQ ID NO: 61016 - DNA, 20 bp, Artificial Sequence
  Description of Artificial Sequence: Synthetic oligonucleotide
  Target: SCN10A; (+) strand; PAM type: YTN; PAM sequence: TTG
gcaataagaggcagagttgg

SEQ ID NO: 61017 - DNA, 20 bp, Artificial Sequence
  Description of Artificial Sequence: Synthetic oligonucleotide
  Target: SCN10A; (+) strand; PAM type: YTN; PAM sequence: TTG
ggtgattgagataatagatg

SEQ ID NO: 61018 - DNA, 20 bp, Artificial Sequence
  Description of Artificial Sequence: Synthetic oligonucleotide
  Target: SCN10A; (+) strand; PAM type: YTN; PAM sequence: TTG
agataatagatgcttgtgga

SEQ ID NO: 61019 - DNA, 20 bp, Artificial Sequence
  Description of Artificial Sequence: Synthetic oligonucleotide
  Target: SCN10A; (+) strand; PAM type: YTN; PAM sequence: CTT
gtggagcgatgattcaggat

SEQ ID NO: 61020 - DNA, 20 bp, Artificial Sequence
  Description of Artificial Sequence: Synthetic oligonucleotide
  Target: SCN10A; (+) strand; PAM type: YTN; PAM sequence: TTG
tggagcgatgattcaggatt

SEQ ID NO: 61021 - DNA, 20 bp, Artificial Sequence
  Description of Artificial Sequence: Synthetic oligonucleotide
  Target: SCN10A; (+) strand; PAM type: YTN; PAM sequence: TTC
aggattacttcactaagagc

SEQ ID NO: 61022 - DNA, 20 bp, Artificial Sequence
  Description of Artificial Sequence: Synthetic oligonucleotide
  Target: SCN10A; (+) strand; PAM type: YTN; PAM sequence: TTA
cttcactaagagcaaagggg

SEQ ID NO: 61023 - DNA, 20 bp, Artificial Sequence
  Description of Artificial Sequence: Synthetic oligonucleotide
  Target: SCN10A; (+) strand; PAM type: YTN; PAM sequence: CTT
cactaagagcaaagggggtg

SEQ ID NO: 61024 - DNA, 20 bp, Artificial Sequence
  Description of Artificial Sequence: Synthetic oligonucleotide
  Target: SCN10A; (+) strand; PAM type: YTN; PAM sequence: TTC
actaagagcaaagggggtga

SEQ ID NO: 61025 - DNA, 20 bp, Artificial Sequence
  Description of Artificial Sequence: Synthetic oligonucleotide
  Target: SCN10A; (+) strand; PAM type: YTN; PAM sequence: CTA
agagcaaagggggtgaggtc

SEQ ID NO: 61026 - DNA, 20 bp, Artificial Sequence
  Description of Artificial Sequence: Synthetic oligonucleotide
  Target: SCN10A; (+) strand; PAM type: YTN; PAM sequence: CTG
ggtcctggtggctgtaatat

SEQ ID NO: 61027 - DNA, 20 bp, Artificial Sequence
  Description of Artificial Sequence: Synthetic oligonucleotide
  Target: SCN10A; (+) strand; PAM type: YTN; PAM sequence: CTG
gtggctgtaatatttatggg

SEQ ID NO: 61028 - DNA, 20 bp, Artificial Sequence
  Description of Artificial Sequence: Synthetic oligonucleotide
  Target: SCN10A; (+) strand; PAM type: YTN; PAM sequence: CTG
taatatttatgggtgacaag

SEQ ID NO: 61029 - DNA, 20 bp, Artificial Sequence
  Description of Artificial Sequence: Synthetic oligonucleotide
  Target: SCN10A; (+) strand; PAM type: YTN; PAM sequence: TTT
atgggtgacaagggaagatg

SEQ ID NO: 61030 - DNA, 20 bp, Artificial Sequence
  Description of Artificial Sequence: Synthetic oligonucleotide
  Target: SCN10A; (+) strand; PAM type: YTN; PAM sequence: TTA
tgggtgacaagggaagatgg

SEQ ID NO: 61031 - DNA, 20 bp, Artificial Sequence
  Description of Artificial Sequence: Synthetic oligonucleotide
  Target: SCN10A; (+) strand; PAM type: YTN; PAM sequence: CTT
gaaagagaactaagagagtt

SEQ ID NO: 61032 - DNA, 20 bp, Artificial Sequence
  Description of Artificial Sequence: Synthetic oligonucleotide
  Target: SCN10A; (+) strand; PAM type: YTN; PAM sequence: TTG
aaagagaactaagagagtta

SEQ ID NO: 61033 - DNA, 20 bp, Artificial Sequence
  Description of Artificial Sequence: Synthetic oligonucleotide
  Target: SCN10A; (+) strand; PAM type: YTN; PAM sequence: CTA
agagagttaggacatgcagc

SEQ ID NO: 61034 - DNA, 20 bp, Artificial Sequence
  Description of Artificial Sequence: Synthetic oligonucleotide
  Target: SCN10A; (+) strand; PAM type: YTN; PAM sequence: TTA
ggacatgcagcaccaccaaa

SEQ ID NO: 61035 - DNA, 20 bp, Artificial Sequence
  Description of Artificial Sequence: Synthetic oligonucleotide
  Target: SCN10A; (+) strand; PAM type: YTN; PAM sequence: CTC
agagcctacctttggaggtg

SEQ ID NO: 61036 - DNA, 20 bp, Artificial Sequence
  Description of Artificial Sequence: Synthetic oligonucleotide
  Target: SCN10A; (+) strand; PAM type: YTN; PAM sequence: CTA
cctttggaggtggggccccg

SEQ ID NO: 61037 - DNA, 20 bp, Artificial Sequence
  Description of Artificial Sequence: Synthetic oligonucleotide
  Target: SCN10A; (+) strand; PAM type: YTN; PAM sequence: CTT
tggaggtggggccccggagc

SEQ ID NO: 61038 - DNA, 20 bp, Artificial Sequence
  Description of Artificial Sequence: Synthetic oligonucleotide
  Target: SCN10A; (+) strand; PAM type: YTN; PAM sequence: TTT
ggaggtggggccccggagct

SEQ ID NO: 61039 - DNA, 20 bp, Artificial Sequence
  Description of Artificial Sequence: Synthetic oligonucleotide
  Target: SCN10A; (+) strand; PAM type: YTN; PAM sequence: TTG
gaggtggggccccggagctc

SEQ ID NO: 61040 - DNA, 20 bp, Artificial Sequence
  Description of Artificial Sequence: Synthetic oligonucleotide
  Target: SCN10A; (+) strand; PAM type: YTN; PAM sequence: CTC
agggttggtgggatggaggg

SEQ ID NO: 61041 - DNA, 20 bp, Artificial Sequence
  Description of Artificial Sequence: Synthetic oligonucleotide
  Target: SCN10A; (+) strand; PAM type: YTN; PAM sequence: TTG
gtgggatggagggcataaag

SEQ ID NO: 61042 - DNA, 20 bp, Artificial Sequence
  Description of Artificial Sequence: Synthetic oligonucleotide
  Target: SCN10A; (+) strand; PAM type: YTN; PAM sequence: TTA
ccaaaacctgcagaccagag

SEQ ID NO: 61043 - DNA, 20 bp, Artificial Sequence
  Description of Artificial Sequence: Synthetic oligonucleotide
  Target: SCN10A; (+) strand; PAM type: YTN; PAM sequence: CTG
cagaccagagaagttttttg

SEQ ID NO: 61044 - DNA, 20 bp, Artificial Sequence
  Description of Artificial Sequence: Synthetic oligonucleotide
  Target: SCN10A; (+) strand; PAM type: YTN; PAM sequence: TTT
tttgtttgttttttgaggcg

SEQ ID NO: 61045 - DNA, 20 bp, Artificial Sequence
  Description of Artificial Sequence: Synthetic oligonucleotide
  Target: SCN10A; (+) strand; PAM type: YTN; PAM sequence: TTT
ttgtttgttttttgaggcgg

SEQ ID NO: 61046 - DNA, 20 bp, Artificial Sequence
  Description of Artificial Sequence: Synthetic oligonucleotide
  Target: SCN10A; (+) strand; PAM type: YTN; PAM sequence: TTT
tgtttgttttttgaggcgga

SEQ ID NO: 61047 - DNA, 20 bp, Artificial Sequence
  Description of Artificial Sequence: Synthetic oligonucleotide
  Target: SCN10A; (+) strand; PAM type: YTN; PAM sequence: TTT
gtttgttttttgaggcggag

SEQ ID NO: 61048 - DNA, 20 bp, Artificial Sequence
  Description of Artificial Sequence: Synthetic oligonucleotide
  Target: SCN10A; (+) strand; PAM type: YTN; PAM sequence: TTG
tttgttttttgaggcggagt

SEQ ID NO: 61049 - DNA, 20 bp, Artificial Sequence
  Description of Artificial Sequence: Synthetic oligonucleotide
  Target: SCN10A; (+) strand; PAM type: YTN; PAM sequence: TTT
gttttttgaggcggagtctc

SEQ ID NO: 61050 - DNA, 20 bp, Artificial Sequence
  Description of Artificial Sequence: Synthetic oligonucleotide
  Target: SCN10A; (+) strand; PAM type: YTN; PAM sequence: TTG
ttttttgaggcggagtctcg

SEQ ID NO: 61051 - DNA, 20 bp, Artificial Sequence
  Description of Artificial Sequence: Synthetic oligonucleotide
  Target: SCN10A; (+) strand; PAM type: YTN; PAM sequence: TTT
tttgaggcggagtctcgctc

SEQ ID NO: 61052 - DNA, 20 bp, Artificial Sequence
  Description of Artificial Sequence: Synthetic oligonucleotide
  Target: SCN10A; (+) strand; PAM type: YTN; PAM sequence: TTT
ttgaggcggagtctcgctct

SEQ ID NO: 61053 - DNA, 20 bp, Artificial Sequence
  Description of Artificial Sequence: Synthetic oligonucleotide
  Target: SCN10A; (+) strand; PAM type: YTN; PAM sequence: TTT
tgaggcggagtctcgctctg

SEQ ID NO: 61054 - DNA, 20 bp, Artificial Sequence
  Description of Artificial Sequence: Synthetic oligonucleotide
  Target: SCN10A; (+) strand; PAM type: YTN; PAM sequence: TTT
gaggcggagtctcgctctgt

SEQ ID NO: 61055 - DNA, 20 bp, Artificial Sequence
  Description of Artificial Sequence: Synthetic oligonucleotide
  Target: SCN10A; (+) strand; PAM type: YTN; PAM sequence: TTG
aggcggagtctcgctctgtc

SEQ ID NO: 61056 - DNA, 20 bp, Artificial Sequence
  Description of Artificial Sequence: Synthetic oligonucleotide
  Target: SCN10A; (+) strand; PAM type: YTN; PAM sequence: CTC
gctctgtcacccaggctgga

SEQ ID NO: 61057 - DNA, 20 bp, Artificial Sequence
  Description of Artificial Sequence: Synthetic oligonucleotide
  Target: SCN10A; (+) strand; PAM type: YTN; PAM sequence: CTC
tgtcacccaggctggagtat

SEQ ID NO: 61058 - DNA, 20 bp, Artificial Sequence
  Description of Artificial Sequence: Synthetic oligonucleotide
  Target: SCN10A; (+) strand; PAM type: YTN; PAM sequence: CTG
tcacccaggctggagtataa

SEQ ID NO: 61059 - DNA, 20 bp, Artificial Sequence
  Description of Artificial Sequence: Synthetic oligonucleotide
  Target: SCN10A; (+) strand; PAM type: YTN; PAM sequence: CTG
gagtataatggcacaatctc

SEQ ID NO: 61060 - DNA, 20 bp, Artificial Sequence
  Description of Artificial Sequence: Synthetic oligonucleotide
  Target: SCN10A; (+) strand; PAM type: YTN; PAM sequence: CTC
ggctcactaccaccacacct

SEQ ID NO: 61061 - DNA, 20 bp, Artificial Sequence
  Description of Artificial Sequence: Synthetic oligonucleotide
  Target: SCN10A; (+) strand; PAM type: YTN; PAM sequence: CTC
actaccaccacacctcgtgg

SEQ ID NO: 61062 - DNA, 20 bp, Artificial Sequence
  Description of Artificial Sequence: Synthetic oligonucleotide
  Target: SCN10A; (+) strand; PAM type: YTN; PAM sequence: CTA
ccaccacacctcgtggtggt

SEQ ID NO: 61063 - DNA, 20 bp, Artificial Sequence
  Description of Artificial Sequence: Synthetic oligonucleotide
  Target: SCN10A; (+) strand; PAM type: YTN; PAM sequence: CTC
gtggtggtagtgatttttgt

SEQ ID NO: 61064 - DNA, 20 bp, Artificial Sequence
  Description of Artificial Sequence: Synthetic oligonucleotide
  Target: SCN10A; (+) strand; PAM type: YTN; PAM sequence: TTT
ttgtacttttagcagagaca

SEQ ID NO: 61065 - DNA, 20 bp, Artificial Sequence
  Description of Artificial Sequence: Synthetic oligonucleotide
  Target: SCN10A; (+) strand; PAM type: YTN; PAM sequence: TTT
tgtacttttagcagagacag

SEQ ID NO: 61066 - DNA, 20 bp, Artificial Sequence
  Description of Artificial Sequence: Synthetic oligonucleotide
  Target: SCN10A; (+) strand; PAM type: YTN; PAM sequence: TTT
gtacttttagcagagacagg

SEQ ID NO: 61067 - DNA, 20 bp, Artificial Sequence
  Description of Artificial Sequence: Synthetic oligonucleotide
  Target: SCN10A; (+) strand; PAM type: YTN; PAM sequence: TTG
tacttttagcagagacaggg

SEQ ID NO: 61068 - DNA, 20 bp, Artificial Sequence
  Description of Artificial Sequence: Synthetic oligonucleotide
  Target: SCN10A; (+) strand; PAM type: YTN; PAM sequence: CTT
ttagcagagacagggtttcg

SEQ ID NO: 61069 - DNA, 20 bp, Artificial Sequence
  Description of Artificial Sequence: Synthetic oligonucleotide
  Target: SCN10A; (+) strand; PAM type: YTN; PAM sequence: TTT
tagcagagacagggtttcgg

SEQ ID NO: 61070 - DNA, 20 bp, Artificial Sequence
  Description of Artificial Sequence: Synthetic oligonucleotide
  Target: SCN10A; (+) strand; PAM type: YTN; PAM sequence: TTT
agcagagacagggtttcggc

SEQ ID NO: 61071 - DNA, 20 bp, Artificial Sequence
  Description of Artificial Sequence: Synthetic oligonucleotide
  Target: SCN10A; (+) strand; PAM type: YTN; PAM sequence: TTA
gcagagacagggtttcggca

SEQ ID NO: 61072 - DNA, 20 bp, Artificial Sequence
  Description of Artificial Sequence: Synthetic oligonucleotide
  Target: SCN10A; (+) strand; PAM type: YTN; PAM sequence: TTT
cggcatgttggccagggtgg

SEQ ID NO: 61073 - DNA, 20 bp, Artificial Sequence
  Description of Artificial Sequence: Synthetic oligonucleotide
  Target: SCN10A; (+) strand; PAM type: YTN; PAM sequence: TTC
ggcatgttggccagggtggt

SEQ ID NO: 61074 - DNA, 20 bp, Artificial Sequence
  Description of Artificial Sequence: Synthetic oligonucleotide
  Target: SCN10A; (+) strand; PAM type: YTN; PAM sequence: TTG
gccagggtggttttgaactc

SEQ ID NO: 61075 - DNA, 20 bp, Artificial Sequence
  Description of Artificial Sequence: Synthetic oligonucleotide
  Target: SCN10A; (+) strand; PAM type: YTN; PAM sequence: TTT
tgaactcctaacctcaggtg

SEQ ID NO: 61076 - DNA, 20 bp, Artificial Sequence
  Description of Artificial Sequence: Synthetic oligonucleotide
  Target: SCN10A; (+) strand; PAM type: YTN; PAM sequence: TTT
gaactcctaacctcaggtga

SEQ ID NO: 61077 - DNA, 20 bp, Artificial Sequence
  Description of Artificial Sequence: Synthetic oligonucleotide
  Target: SCN10A; (+) strand; PAM type: YTN; PAM sequence: TTG
aactcctaacctcaggtgat

SEQ ID NO: 61078 - DNA, 20 bp, Artificial Sequence
  Description of Artificial Sequence: Synthetic oligonucleotide
  Target: SCN10A; (+) strand; PAM type: YTN; PAM sequence: CTC
ctaacctcaggtgatccgcc

SEQ ID NO: 61079 - DNA, 20 bp, Artificial Sequence
  Description of Artificial Sequence: Synthetic oligonucleotide
  Target: SCN10A; (+) strand; PAM type: YTN; PAM sequence: CTA
acctcaggtgatccgcccgc

SEQ ID NO: 61080 - DNA, 20 bp, Artificial Sequence
  Description of Artificial Sequence: Synthetic oligonucleotide
  Target: SCN10A; (+) strand; PAM type: YTN; PAM sequence: CTC
aggtgatccgcccgcctcag

SEQ ID NO: 61081 - DNA, 20 bp, Artificial Sequence
  Description of Artificial Sequence: Synthetic oligonucleotide
  Target: SCN10A; (+) strand; PAM type: YTN; PAM sequence: CTC
agcctcccaaagtgctggga

SEQ ID NO: 61082 - DNA, 20 bp, Artificial Sequence
  Description of Artificial Sequence: Synthetic oligonucleotide
  Target: SCN10A; (+) strand; PAM type: YTN; PAM sequence: CTC
ccaaagtgctgggattacag

SEQ ID NO: 61083 - DNA, 20 bp, Artificial Sequence
  Description of Artificial Sequence: Synthetic oligonucleotide
  Target: SCN10A; (+) strand; PAM type: YTN; PAM sequence: CTG
ggattacaggcatgaaccac

SEQ ID NO: 61084 - DNA, 20 bp, Artificial Sequence
  Description of Artificial Sequence: Synthetic oligonucleotide
  Target: SCN10A; (+) strand; PAM type: YTN; PAM sequence: TTA
caggcatgaaccaccgtgcc

SEQ ID NO: 61085 - DNA, 20 bp, Artificial Sequence
  Description of Artificial Sequence: Synthetic oligonucleotide
  Target: SCN10A; (+) strand; PAM type: YTN; PAM sequence: CTG
gccagatgagagaagttttg

SEQ ID NO: 61086 - DNA, 20 bp, Artificial Sequence
  Description of Artificial Sequence: Synthetic oligonucleotide
  Target: SCN10A; (+) strand; PAM type: YTN; PAM sequence: TTT
tgagatcagacttacccgca

SEQ ID NO: 61087 - DNA, 20 bp, Artificial Sequence
  Description of Artificial Sequence: Synthetic oligonucleotide
  Target: SCN10A; (+) strand; PAM type: YTN; PAM sequence: TTT
gagatcagacttacccgcat

SEQ ID NO: 61088 - DNA, 20 bp, Artificial Sequence
  Description of Artificial Sequence: Synthetic oligonucleotide
  Target: SCN10A; (+) strand; PAM type: YTN; PAM sequence: TTG
agatcagacttacccgcatg

SEQ ID NO: 61089 - DNA, 20 bp, Artificial Sequence
  Description of Artificial Sequence: Synthetic oligonucleotide
  Target: SCN10A; (+) strand; PAM type: YTN; PAM sequence: CTT
acccgcatgccttcaaatcg

SEQ ID NO: 61090 - DNA, 20 bp, Artificial Sequence
  Description of Artificial Sequence: Synthetic oligonucleotide
  Target: SCN10A; (+) strand; PAM type: YTN; PAM sequence: TTA
cccgcatgccttcaaatcga

SEQ ID NO: 61091 - DNA, 20 bp, Artificial Sequence
  Description of Artificial Sequence: Synthetic oligonucleotide
  Target: SCN10A; (+) strand; PAM type: YTN; PAM sequence: CTT
caaatcgagaaagagcccgc

SEQ ID NO: 61092 - DNA, 20 bp, Artificial Sequence
  Description of Artificial Sequence: Synthetic oligonucleotide
  Target: SCN10A; (+) strand; PAM type: YTN; PAM sequence: TTC
aaatcgagaaagagcccgca

SEQ ID NO: 61093 - DNA, 20 bp, Artificial Sequence
  Description of Artificial Sequence: Synthetic oligonucleotide
  Target: SCN10A; (+) strand; PAM type: YTN; PAM sequence: TTC
gaagggctttgatgggagcc

SEQ ID NO: 61094 - DNA, 20 bp, Artificial Sequence
  Description of Artificial Sequence: Synthetic oligonucleotide
  Target: SCN10A; (+) strand; PAM type: YTN; PAM sequence: CTT
tgatgggagccacttcagaa

SEQ ID NO: 61095 - DNA, 20 bp, Artificial Sequence
  Description of Artificial Sequence: Synthetic oligonucleotide
  Target: SCN10A; (+) strand; PAM type: YTN; PAM sequence: TTT
gatgggagccacttcagaat

SEQ ID NO: 61096 - DNA, 20 bp, Artificial Sequence
  Description of Artificial Sequence: Synthetic oligonucleotide
  Target: SCN10A; (+) strand; PAM type: YTN; PAM sequence: TTG
atgggagccacttcagaata

SEQ ID NO: 61097 - DNA, 20 bp, Artificial Sequence
  Description of Artificial Sequence: Synthetic oligonucleotide
  Target: SCN10A; (+) strand; PAM type: YTN; PAM sequence: CTT
cagaatattccagaatcttc

SEQ ID NO: 61098 - DNA, 20 bp, Artificial Sequence
  Description of Artificial Sequence: Synthetic oligonucleotide
  Target: SCN10A; (+) strand; PAM type: YTN; PAM sequence: TTC
agaatattccagaatcttcg

SEQ ID NO: 61099 - DNA, 20 bp, Artificial Sequence
  Description of Artificial Sequence: Synthetic oligonucleotide
  Target: SCN10A; (+) strand; PAM type: YTN; PAM sequence: TTC
cagaatcttcgctgtgagac

SEQ ID NO: 61100 - DNA, 20 bp, Artificial Sequence
  Description of Artificial Sequence: Synthetic oligonucleotide
  Target: SCN10A; (+) strand; PAM type: YTN; PAM sequence: CTT
cgctgtgagacttatcagtg

SEQ ID NO: 61101 - DNA, 20 bp, Artificial Sequence
  Description of Artificial Sequence: Synthetic oligonucleotide
  Target: SCN10A; (+) strand; PAM type: YTN; PAM sequence: TTC
gctgtgagacttatcagtga

SEQ ID NO: 61102 - DNA, 20 bp, Artificial Sequence
  Description of Artificial Sequence: Synthetic oligonucleotide
  Target: SCN10A; (+) strand; PAM type: YTN; PAM sequence: CTG
tgagacttatcagtgagatc

SEQ ID NO: 61103 - DNA, 20 bp, Artificial Sequence
  Description of Artificial Sequence: Synthetic oligonucleotide
  Target: SCN10A; (+) strand; PAM type: YTN; PAM sequence: CTT
atcagtgagatctgagtgca

SEQ ID NO: 61104 - DNA, 20 bp, Artificial Sequence
  Description of Artificial Sequence: Synthetic oligonucleotide
  Target: SCN10A; (+) strand; PAM type: YTN; PAM sequence: TTA
tcagtgagatctgagtgcag

SEQ ID NO: 61105 - DNA, 20 bp, Artificial Sequence
  Description of Artificial Sequence: Synthetic oligonucleotide
  Target: SCN10A; (+) strand; PAM type: YTN; PAM sequence: CTG
agtgcaggagagggcagaaa

SEQ ID NO: 61106 - DNA, 20 bp, Artificial Sequence
  Description of Artificial Sequence: Synthetic oligonucleotide
  Target: SCN10A; (+) strand; PAM type: YTN; PAM sequence: CTC
taggtttccagaaaggcagt

SEQ ID NO: 61107 - DNA, 20 bp, Artificial Sequence
  Description of Artificial Sequence: Synthetic oligonucleotide
  Target: SCN10A; (+) strand; PAM type: YTN; PAM sequence: CTA
ggtttccagaaaggcagtcc

SEQ ID NO: 61108 - DNA, 20 bp, Artificial Sequence
  Description of Artificial Sequence: Synthetic oligonucleotide
  Target: SCN10A; (+) strand; PAM type: YTN; PAM sequence: TTT
ccagaaaggcagtcctcgtg

SEQ ID NO: 61109 - DNA, 20 bp, Artificial Sequence
  Description of Artificial Sequence: Synthetic oligonucleotide
  Target: SCN10A; (+) strand; PAM type: YTN; PAM sequence: TTC
cagaaaggcagtcctcgtgg

SEQ ID NO: 61110 - DNA, 20 bp, Artificial Sequence
  Description of Artificial Sequence: Synthetic oligonucleotide
  Target: SCN10A; (+) strand; PAM type: YTN; PAM sequence: CTC
gtggaaggagacaggaactc

SEQ ID NO: 61111 - DNA, 20 bp, Artificial Sequence
  Description of Artificial Sequence: Synthetic oligonucleotide
  Target: SCN10A; (+) strand; PAM type: YTN; PAM sequence: CTC
cctgcccagcctcccattcc

SEQ ID NO: 61112 - DNA, 20 bp, Artificial Sequence
  Description of Artificial Sequence: Synthetic oligonucleotide
  Target: SCN10A; (+) strand; PAM type: YTN; PAM sequence: CTG
cccagcctcccattcctaca

SEQ ID NO: 61113 - DNA, 20 bp, Artificial Sequence
  Description of Artificial Sequence: Synthetic oligonucleotide
  Target: SCN10A; (+) strand; PAM type: YTN; PAM sequence: CTC
ccattcctacacgtctaagc

SEQ ID NO: 61114 - DNA, 20 bp, Artificial Sequence
  Description of Artificial Sequence: Synthetic oligonucleotide
  Target: SCN10A; (+) strand; PAM type: YTN; PAM sequence: TTC
ctacacgtctaagccatcat

SEQ ID NO: 61115 - DNA, 20 bp, Artificial Sequence
  Description of Artificial Sequence: Synthetic oligonucleotide
  Target: SCN10A; (+) strand; PAM type: YTN; PAM sequence: CTA
cacgtctaagccatcatcct

SEQ ID NO: 61116 - DNA, 20 bp, Artificial Sequence
  Description of Artificial Sequence: Synthetic oligonucleotide
  Target: SCN10A; (+) strand; PAM type: YTN; PAM sequence: CTA
agccatcatcctagctccca

SEQ ID NO: 61117 - DNA, 20 bp, Artificial Sequence
  Description of Artificial Sequence: Synthetic oligonucleotide
  Target: SCN10A; (+) strand; PAM type: YTN; PAM sequence: CTA
gctcccaccttattcggaac

SEQ ID NO: 61118 - DNA, 20 bp, Artificial Sequence
  Description of Artificial Sequence: Synthetic oligonucleotide
  Target: SCN10A; (+) strand; PAM type: YTN; PAM sequence: CTC
ccaccttattcggaactcca

SEQ ID NO: 61119 - DNA, 20 bp, Artificial Sequence
  Description of Artificial Sequence: Synthetic oligonucleotide
  Target: SCN10A; (+) strand; PAM type: YTN; PAM sequence: CTT
attcggaactccaatgagag

SEQ ID NO: 61120 - DNA, 20 bp, Artificial Sequence
  Description of Artificial Sequence: Synthetic oligonucleotide
  Target: SCN10A; (+) strand; PAM type: YTN; PAM sequence: TTA
ttcggaactccaatgagagg

SEQ ID NO: 61121 - DNA, 20 bp, Artificial Sequence
  Description of Artificial Sequence: Synthetic oligonucleotide
  Target: SCN10A; (+) strand; PAM type: YTN; PAM sequence: TTC
ggaactccaatgagaggtct

SEQ ID NO: 61122 - DNA, 20 bp, Artificial Sequence
  Description of Artificial Sequence: Synthetic oligonucleotide
  Target: SCN10A; (+) strand; PAM type: YTN; PAM sequence: CTC
caatgagaggtctagaaaga

SEQ ID NO: 61123 - DNA, 20 bp, Artificial Sequence
  Description of Artificial Sequence: Synthetic oligonucleotide
  Target: SCN10A; (+) strand; PAM type: YTN; PAM sequence: CTA
gaaagagttttgtctcttcc

SEQ ID NO: 61124 - DNA, 20 bp, Artificial Sequence
  Description of Artificial Sequence: Synthetic oligonucleotide
  Target: SCN10A; (+) strand; PAM type: YTN; PAM sequence: TTT
tgtctcttcccttttattaa

SEQ ID NO: 61125 - DNA, 20 bp, Artificial Sequence
  Description of Artificial Sequence: Synthetic oligonucleotide
  Target: SCN10A; (+) strand; PAM type: YTN; PAM sequence: TTT
gtctcttcccttttattaaa

SEQ ID NO: 61126 - DNA, 20 bp, Artificial Sequence
  Description of Artificial Sequence: Synthetic oligonucleotide
  Target: SCN10A; (+) strand; PAM type: YTN; PAM sequence: TTG
tctcttcccttttattaaaa

SEQ ID NO: 61127 - DNA, 20 bp, Artificial Sequence
  Description of Artificial Sequence: Synthetic oligonucleotide
  Target: SCN10A; (+) strand; PAM type: YTN; PAM sequence: CTC
ttcccttttattaaaaattt

SEQ ID NO: 61128 - DNA, 20 bp, Artificial Sequence
  Description of Artificial Sequence: Synthetic oligonucleotide
  Target: SCN10A; (+) strand; PAM type: YTN; PAM sequence: CTT
cccttttattaaaaatttta

SEQ ID NO: 61129 - DNA, 20 bp, Artificial Sequence
  Description of Artificial Sequence: Synthetic oligonucleotide
  Target: SCN10A; (+) strand; PAM type: YTN; PAM sequence: TTC
ccttttattaaaaattttat

SEQ ID NO: 61130 - DNA, 20 bp, Artificial Sequence
  Description of Artificial Sequence: Synthetic oligonucleotide
  Target: SCN10A; (+) strand; PAM type: YTN; PAM sequence: CTT
ttattaaaaattttattcac

SEQ ID NO: 61131 - DNA, 20 bp, Artificial Sequence
  Description of Artificial Sequence: Synthetic oligonucleotide
  Target: SCN10A; (+) strand; PAM type: YTN; PAM sequence: TTT
tattaaaaattttattcacc

SEQ ID NO: 61132 - DNA, 20 bp, Artificial Sequence
  Description of Artificial Sequence: Synthetic oligonucleotide
  Target: SCN10A; (+) strand; PAM type: YTN; PAM sequence: TTT
attaaaaattttattcacca

SEQ ID NO: 61133 - DNA, 20 bp, Artificial Sequence
  Description of Artificial Sequence: Synthetic oligonucleotide
  Target: SCN10A; (+) strand; PAM type: YTN; PAM sequence: TTA
ttaaaaattttattcaccac

SEQ ID NO: 61134 - DNA, 20 bp, Artificial Sequence
  Description of Artificial Sequence: Synthetic oligonucleotide
  Target: SCN10A; (+) strand; PAM type: YTN; PAM sequence: TTA
aaaattttattcaccactct

SEQ ID NO: 61135 - DNA, 20 bp, Artificial Sequence
  Description of Artificial Sequence: Synthetic oligonucleotide
  Target: SCN10A; (+) strand; PAM type: YTN; PAM sequence: TTT
tattcaccactctcttaaac

SEQ ID NO: 61136 - DNA, 20 bp, Artificial Sequence
  Description of Artificial Sequence: Synthetic oligonucleotide
  Target: SCN10A; (+) strand; PAM type: YTN; PAM sequence: TTT
attcaccactctcttaaaca

SEQ ID NO: 61137 - DNA, 20 bp, Artificial Sequence
  Description of Artificial Sequence: Synthetic oligonucleotide
  Target: SCN10A; (+) strand; PAM type: YTN; PAM sequence: TTA
ttcaccactctcttaaacaa

SEQ ID NO: 61138 - DNA, 20 bp, Artificial Sequence
  Description of Artificial Sequence: Synthetic oligonucleotide
  Target: SCN10A; (+) strand; PAM type: YTN; PAM sequence: TTC
accactctcttaaacaatct

SEQ ID NO: 61139 - DNA, 20 bp, Artificial Sequence
  Description of Artificial Sequence: Synthetic oligonucleotide
  Target: SCN10A; (+) strand; PAM type: YTN; PAM sequence: CTC
tcttaaacaatctgggcaag

SEQ ID NO: 61140 - DNA, 20 bp, Artificial Sequence
  Description of Artificial Sequence: Synthetic oligonucleotide
  Target: SCN10A; (+) strand; PAM type: YTN; PAM sequence: CTC
ttaaacaatctgggcaagaa

SEQ ID NO: 61141 - DNA, 20 bp, Artificial Sequence
  Description of Artificial Sequence: Synthetic oligonucleotide
  Target: SCN10A; (+) strand; PAM type: YTN; PAM sequence: CTT
aaacaatctgggcaagaaaa

SEQ ID NO: 61142 - DNA, 20 bp, Artificial Sequence
  Description of Artificial Sequence: Synthetic oligonucleotide
  Target: SCN10A; (+) strand; PAM type: YTN; PAM sequence: TTA
aacaatctgggcaagaaaaa

SEQ ID NO: 61143 - DNA, 20 bp, Artificial Sequence
  Description of Artificial Sequence: Synthetic oligonucleotide
  Target: SCN10A; (+) strand; PAM type: YTN; PAM sequence: CTG
ggcaagaaaaactcagtctc

SEQ ID NO: 61144 - DNA, 20 bp, Artificial Sequence
  Description of Artificial Sequence: Synthetic oligonucleotide
  Target: SCN10A; (+) strand; PAM type: YTN; PAM sequence: CTC
agtctctaacatcaccaacc

SEQ ID NO: 61145 - DNA, 20 bp, Artificial Sequence
  Description of Artificial Sequence: Synthetic oligonucleotide
  Target: SCN10A; (+) strand; PAM type: YTN; PAM sequence: CTC
taacatcaccaacctctggt

SEQ ID NO: 61146 - DNA, 20 bp, Artificial Sequence
  Description of Artificial Sequence: Synthetic oligonucleotide
  Target: SCN10A; (+) strand; PAM type: YTN; PAM sequence: CTA
acatcaccaacctctggtac

SEQ ID NO: 61147 - DNA, 20 bp, Artificial Sequence
  Description of Artificial Sequence: Synthetic oligonucleotide
  Target: SCN10A; (+) strand; PAM type: YTN; PAM sequence: CTC
tggtacgtaggtggccaagc

SEQ ID NO: 61148 - DNA, 20 bp, Artificial Sequence
  Description of Artificial Sequence: Synthetic oligonucleotide
  Target: SCN10A; (+) strand; PAM type: YTN; PAM sequence: CTG
gtacgtaggtggccaagctt

SEQ ID NO: 61149 - DNA, 20 bp, Artificial Sequence
  Description of Artificial Sequence: Synthetic oligonucleotide
  Target: SCN10A; (+) strand; PAM type: YTN; PAM sequence: CTT
ccagtgtattaaatcaactc

SEQ ID NO: 61150 - DNA, 20 bp, Artificial Sequence
  Description of Artificial Sequence: Synthetic oligonucleotide
  Target: SCN10A; (+) strand; PAM type: YTN; PAM sequence: TTC
cagtgtattaaatcaactct

SEQ ID NO: 61151 - DNA, 20 bp, Artificial Sequence
  Description of Artificial Sequence: Synthetic oligonucleotide
  Target: SCN10A; (+) strand; PAM type: YTN; PAM sequence: TTA
aatcaactcttccttttcct

SEQ ID NO: 61152 - DNA, 20 bp, Artificial Sequence
  Description of Artificial Sequence: Synthetic oligonucleotide
  Target: SCN10A; (+) strand; PAM type: YTN; PAM sequence: CTC
ttccttttccttctaggggc

SEQ ID NO: 61153 - DNA, 20 bp, Artificial Sequence
  Description of Artificial Sequence: Synthetic oligonucleotide
  Target: SCN10A; (+) strand; PAM type: YTN; PAM sequence: CTT
ccttttccttctaggggcag

SEQ ID NO: 61154 - DNA, 20 bp, Artificial Sequence
  Description of Artificial Sequence: Synthetic oligonucleotide
  Target: SCN10A; (+) strand; PAM type: YTN; PAM sequence: TTC
cttttccttctaggggcagc

SEQ ID NO: 61155 - DNA, 20 bp, Artificial Sequence
  Description of Artificial Sequence: Synthetic oligonucleotide
  Target: SCN10A; (+) strand; PAM type: YTN; PAM sequence: CTT
ttccttctaggggcagcagt

SEQ ID NO: 61156 - DNA, 20 bp, Artificial Sequence
  Description of Artificial Sequence: Synthetic oligonucleotide
  Target: SCN10A; (+) strand; PAM type: YTN; PAM sequence: TTT
tccttctaggggcagcagtc

SEQ ID NO: 61157 - DNA, 20 bp, Artificial Sequence
  Description of Artificial Sequence: Synthetic oligonucleotide
  Target: SCN10A; (+) strand; PAM type: YTN; PAM sequence: TTT
ccttctaggggcagcagtca

SEQ ID NO: 61158 - DNA, 20 bp, Artificial Sequence
  Description of Artificial Sequence: Synthetic oligonucleotide
  Target: SCN10A; (+) strand; PAM type: YTN; PAM sequence: TTC
cttctaggggcagcagtcag

SEQ ID NO: 61159 - DNA, 20 bp, Artificial Sequence
  Description of Artificial Sequence: Synthetic oligonucleotide
  Target: SCN10A; (+) strand; PAM type: YTN; PAM sequence: CTT
ctaggggcagcagtcaggcc

SEQ ID NO: 61160 - DNA, 20 bp, Artificial Sequence
  Description of Artificial Sequence: Synthetic oligonucleotide
  Target: SCN10A; (+) strand; PAM type: YTN; PAM sequence: TTC
taggggcagcagtcaggcct

SEQ ID NO: 61161 - DNA, 20 bp, Artificial Sequence
  Description of Artificial Sequence: Synthetic oligonucleotide
  Target: SCN10A; (+) strand; PAM type: YTN; PAM sequence: CTA
ggggcagcagtcaggcctca

SEQ ID NO: 61162 - DNA, 20 bp, Artificial Sequence
  Description of Artificial Sequence: Synthetic oligonucleotide
  Target: SCN10A; (+) strand; PAM type: YTN; PAM sequence: CTC
aacaaccttgaaactgattt

SEQ ID NO: 61163 - DNA, 20 bp, Artificial Sequence
  Description of Artificial Sequence: Synthetic oligonucleotide
  Target: SCN10A; (+) strand; PAM type: YTN; PAM sequence: CTT
gaaactgattttcagagact

SEQ ID NO: 61164 - DNA, 20 bp, Artificial Sequence
  Description of Artificial Sequence: Synthetic oligonucleotide
  Target: SCN10A; (+) strand; PAM type: YTN; PAM sequence: TTG
aaactgattttcagagactt

SEQ ID NO: 61165 - DNA, 20 bp, Artificial Sequence
  Description of Artificial Sequence: Synthetic oligonucleotide
  Target: SCN10A; (+) strand; PAM type: YTN; PAM sequence: CTG
attttcagagacttggagac

SEQ ID NO: 61166 - DNA, 20 bp, Artificial Sequence
  Description of Artificial Sequence: Synthetic oligonucleotide
  Target: SCN10A; (+) strand; PAM type: YTN; PAM sequence: TTT
tcagagacttggagacatga

SEQ ID NO: 61167 - DNA, 20 bp, Artificial Sequence
  Description of Artificial Sequence: Synthetic oligonucleotide
  Target: SCN10A; (+) strand; PAM type: YTN; PAM sequence: TTT
cagagacttggagacatgat

SEQ ID NO: 61168 - DNA, 20 bp, Artificial Sequence
  Description of Artificial Sequence: Synthetic oligonucleotide
  Target: SCN10A; (+) strand; PAM type: YTN; PAM sequence: TTC
agagacttggagacatgatg

SEQ ID NO: 61169 - DNA, 20 bp, Artificial Sequence
  Description of Artificial Sequence: Synthetic oligonucleotide
  Target: SCN10A; (+) strand; PAM type: YTN; PAM sequence: CTT
ggagacatgatgttccctcc

SEQ ID NO: 61170 - DNA, 20 bp, Artificial Sequence
  Description of Artificial Sequence: Synthetic oligonucleotide
  Target: SCN10A; (+) strand; PAM type: YTN; PAM sequence: TTG
gagacatgatgttccctcct

SEQ ID NO: 61171 - DNA, 20 bp, Artificial Sequence
  Description of Artificial Sequence: Synthetic oligonucleotide
  Target: SCN10A; (+) strand; PAM type: YTN; PAM sequence: TTC
cctcctaggggctatgctga

SEQ ID NO: 61172 - DNA, 20 bp, Artificial Sequence
  Description of Artificial Sequence: Synthetic oligonucleotide
  Target: SCN10A; (+) strand; PAM type: YTN; PAM sequence: CTC
ctaggggctatgctgagagt

SEQ ID NO: 61173 - DNA, 20 bp, Artificial Sequence
  Description of Artificial Sequence: Synthetic oligonucleotide
  Target: SCN10A; (+) strand; PAM type: YTN; PAM sequence: CTA
ggggctatgctgagagtcta

SEQ ID NO: 61174 - DNA, 20 bp, Artificial Sequence
  Description of Artificial Sequence: Synthetic oligonucleotide
  Target: SCN10A; (+) strand; PAM type: YTN; PAM sequence: CTA
tgctgagagtctattctgag

SEQ ID NO: 61175 - DNA, 20 bp, Artificial Sequence
  Description of Artificial Sequence: Synthetic oligonucleotide
  Target: SCN10A; (+) strand; PAM type: YTN; PAM sequence: CTG
agagtctattctgaggaata

SEQ ID NO: 61176 - DNA, 20 bp, Artificial Sequence
  Description of Artificial Sequence: Synthetic oligonucleotide
  Target: SCN10A; (+) strand; PAM type: YTN; PAM sequence: CTA
ttctgaggaatatagtaatc

SEQ ID NO: 61177 - DNA, 20 bp, Artificial Sequence
  Description of Artificial Sequence: Synthetic oligonucleotide
  Target: SCN10A; (+) strand; PAM type: YTN; PAM sequence: TTC
tgaggaatatagtaatctga

SEQ ID NO: 61178 - DNA, 20 bp, Artificial Sequence
  Description of Artificial Sequence: Synthetic oligonucleotide
  Target: SCN10A; (+) strand; PAM type: YTN; PAM sequence: CTG
aggaatatagtaatctgaat

SEQ ID NO: 61179 - DNA, 20 bp, Artificial Sequence
  Description of Artificial Sequence: Synthetic oligonucleotide
  Target: SCN10A; (+) strand; PAM type: YTN; PAM sequence: CTG
aattatatttgctcagagaa

SEQ ID NO: 61180 - DNA, 20 bp, Artificial Sequence
  Description of Artificial Sequence: Synthetic oligonucleotide
  Target: SCN10A; (+) strand; PAM type: YTN; PAM sequence: TTA
tatttgctcagagaagtggg

SEQ ID NO: 61181 - DNA, 20 bp, Artificial Sequence
  Description of Artificial Sequence: Synthetic oligonucleotide
  Target: SCN10A; (+) strand; PAM type: YTN; PAM sequence: TTT
gctcagagaagtggggtgga

SEQ ID NO: 61182 - DNA, 20 bp, Artificial Sequence
  Description of Artificial Sequence: Synthetic oligonucleotide
  Target: SCN10A; (+) strand; PAM type: YTN; PAM sequence: TTG
ctcagagaagtggggtggaa

SEQ ID NO: 61183 - DNA, 20 bp, Artificial Sequence
  Description of Artificial Sequence: Synthetic oligonucleotide
  Target: SCN10A; (+) strand; PAM type: YTN; PAM sequence: CTC
agagaagtggggtggaaaga

SEQ ID NO: 61184 - DNA, 20 bp, Artificial Sequence
  Description of Artificial Sequence: Synthetic oligonucleotide
  Target: SCN10A; (+) strand; PAM type: YTN; PAM sequence: TTT
gggtggggtctaattcccat

SEQ ID NO: 61185 - DNA, 20 bp, Artificial Sequence
  Description of Artificial Sequence: Synthetic oligonucleotide
  Target: SCN10A; (+) strand; PAM type: YTN; PAM sequence: TTG
ggtggggtctaattcccatt

SEQ ID NO: 61186 - DNA, 20 bp, Artificial Sequence
  Description of Artificial Sequence: Synthetic oligonucleotide
  Target: SCN10A; (+) strand; PAM type: YTN; PAM sequence: CTA
attcccatttgaaccctgat

SEQ ID NO: 61187 - DNA, 20 bp, Artificial Sequence
  Description of Artificial Sequence: Synthetic oligonucleotide
  Target: SCN10A; (+) strand; PAM type: YTN; PAM sequence: TTC
ccatttgaaccctgattttt

SEQ ID NO: 61188 - DNA, 20 bp, Artificial Sequence
  Description of Artificial Sequence: Synthetic oligonucleotide
  Target: SCN10A; (+) strand; PAM type: YTN; PAM sequence: TTT
gaaccctgattttttgtgag

SEQ ID NO: 61189 - DNA, 20 bp, Artificial Sequence
  Description of Artificial Sequence: Synthetic oligonucleotide
  Target: SCN10A; (+) strand; PAM type: YTN; PAM sequence: TTG
aaccctgattttttgtgagc

SEQ ID NO: 61190 - DNA, 20 bp, Artificial Sequence
  Description of Artificial Sequence: Synthetic oligonucleotide
  Target: SCN10A; (+) strand; PAM type: YTN; PAM sequence: CTG
attttttgtgagcttgggtt

SEQ ID NO: 61191 - DNA, 20 bp, Artificial Sequence
  Description of Artificial Sequence: Synthetic oligonucleotide
  Target: SCN10A; (+) strand; PAM type: YTN; PAM sequence: TTT
tttgtgagcttgggttagtg

SEQ ID NO: 61192 - DNA, 20 bp, Artificial Sequence
  Description of Artificial Sequence: Synthetic oligonucleotide
  Target: SCN10A; (+) strand; PAM type: YTN; PAM sequence: TTT
ttgtgagcttgggttagtgc

SEQ ID NO: 61193 - DNA, 20 bp, Artificial Sequence
  Description of Artificial Sequence: Synthetic oligonucleotide
  Target: SCN10A; (+) strand; PAM type: YTN; PAM sequence: TTT
tgtgagcttgggttagtgcc

SEQ ID NO: 61194 - DNA, 20 bp, Artificial Sequence
  Description of Artificial Sequence: Synthetic oligonucleotide
  Target: SCN10A; (+) strand; PAM type: YTN; PAM sequence: TTT
gtgagcttgggttagtgcct

SEQ ID NO: 61195 - DNA, 20 bp, Artificial Sequence
  Description of Artificial Sequence: Synthetic oligonucleotide
  Target: SCN10A; (+) strand; PAM type: YTN; PAM sequence: TTG
tgagcttgggttagtgcctg

SEQ ID NO: 61196 - DNA, 20 bp, Artificial Sequence
  Description of Artificial Sequence: Synthetic oligonucleotide
  Target: SCN10A; (+) strand; PAM type: YTN; PAM sequence: CTT
gggttagtgcctggctagtc

SEQ ID NO: 61197 - DNA, 20 bp, Artificial Sequence
  Description of Artificial Sequence: Synthetic oligonucleotide
  Target: SCN10A; (+) strand; PAM type: YTN; PAM sequence: TTG
ggttagtgcctggctagtcc

SEQ ID NO: 61198 - DNA, 20 bp, Artificial Sequence
  Description of Artificial Sequence: Synthetic oligonucleotide
  Target: SCN10A; (+) strand; PAM type: YTN; PAM sequence: TTA
gtgcctggctagtccagggt

SEQ ID NO: 61199 - DNA, 20 bp, Artificial Sequence
  Description of Artificial Sequence: Synthetic oligonucleotide
  Target: SCN10A; (+) strand; PAM type: YTN; PAM sequence: CTG
gctagtccagggtactttca

SEQ ID NO: 61200 - DNA, 20 bp, Artificial Sequence
  Description of Artificial Sequence: Synthetic oligonucleotide
  Target: SCN10A; (+) strand; PAM type: YTN; PAM sequence: CTA
gtccagggtactttcaccct

SEQ ID NO: 61201 - DNA, 20 bp, Artificial Sequence
  Description of Artificial Sequence: Synthetic oligonucleotide
  Target: SCN10A; (+) strand; PAM type: YTN; PAM sequence: CTT
tcaccctttgtaaaatgaaa

SEQ ID NO: 61202 - DNA, 20 bp, Artificial Sequence
  Description of Artificial Sequence: Synthetic oligonucleotide
  Target: SCN10A; (+) strand; PAM type: YTN; PAM sequence: TTT
caccctttgtaaaatgaaaa

SEQ ID NO: 61203 - DNA, 20 bp, Artificial Sequence
  Description of Artificial Sequence: Synthetic oligonucleotide
  Target: SCN10A; (+) strand; PAM type: YTN; PAM sequence: TTC
accctttgtaaaatgaaaaa

SEQ ID NO: 61204 - DNA, 20 bp, Artificial Sequence
  Description of Artificial Sequence: Synthetic oligonucleotide
  Target: SCN10A; (+) strand; PAM type: YTN; PAM sequence: CTT
tgtaaaatgaaaaagtcaga

SEQ ID NO: 61205 - DNA, 20 bp, Artificial Sequence
  Description of Artificial Sequence: Synthetic oligonucleotide
  Target: SCN10A; (+) strand; PAM type: YTN; PAM sequence: TTT
gtaaaatgaaaaagtcagac

SEQ ID NO: 61206 - DNA, 20 bp, Artificial Sequence
  Description of Artificial Sequence: Synthetic oligonucleotide
  Target: SCN10A; (+) strand; PAM type: YTN; PAM sequence: TTG
taaaatgaaaaagtcagact

SEQ ID NO: 61207 - DNA, 20 bp, Artificial Sequence
  Description of Artificial Sequence: Synthetic oligonucleotide
  Target: SCN10A; (+) strand; PAM type: YTN; PAM sequence: CTA
agagaattccaaagttctga

SEQ ID NO: 61208 - DNA, 20 bp, Artificial Sequence
  Description of Artificial Sequence: Synthetic oligonucleotide
  Target: SCN10A; (+) strand; PAM type: YTN; PAM sequence: TTC
caaagttctgatagctctgc

SEQ ID NO: 61209 - DNA, 20 bp, Artificial Sequence
  Description of Artificial Sequence: Synthetic oligonucleotide
  Target: SCN10A; (+) strand; PAM type: YTN; PAM sequence: TTC
tgatagctctgcagttcttc

SEQ ID NO: 61210 - DNA, 20 bp, Artificial Sequence
  Description of Artificial Sequence: Synthetic oligonucleotide
  Target: SCN10A; (+) strand; PAM type: YTN; PAM sequence: CTG
atagctctgcagttcttcaa

SEQ ID NO: 61211 - DNA, 20 bp, Artificial Sequence
  Description of Artificial Sequence: Synthetic oligonucleotide
  Target: SCN10A; (+) strand; PAM type: YTN; PAM sequence: CTC
tgcagttcttcaaaaagttt

SEQ ID NO: 61212 - DNA, 20 bp, Artificial Sequence
  Description of Artificial Sequence: Synthetic oligonucleotide
  Target: SCN10A; (+) strand; PAM type: YTN; PAM sequence: CTG
cagttcttcaaaaagtttct

SEQ ID NO: 61213 - DNA, 20 bp, Artificial Sequence
  Description of Artificial Sequence: Synthetic oligonucleotide
  Target: SCN10A; (+) strand; PAM type: YTN; PAM sequence: TTC
ttcaaaaagtttctggtatg

SEQ ID NO: 61214 - DNA, 20 bp, Artificial Sequence
  Description of Artificial Sequence: Synthetic oligonucleotide
  Target: SCN10A; (+) strand; PAM type: YTN; PAM sequence: CTT
caaaaagtttctggtatggg

SEQ ID NO: 61215 - DNA, 20 bp, Artificial Sequence
  Description of Artificial Sequence: Synthetic oligonucleotide
  Target: SCN10A; (+) strand; PAM type: YTN; PAM sequence: TTC
aaaaagtttctggtatgggt

SEQ ID NO: 61216 - DNA, 20 bp, Artificial Sequence
  Description of Artificial Sequence: Synthetic oligonucleotide
  Target: SCN10A; (+) strand; PAM type: YTN; PAM sequence: TTT
ctggtatgggtccatgagat

SEQ ID NO: 61217 - DNA, 20 bp, Artificial Sequence
  Description of Artificial Sequence: Synthetic oligonucleotide
  Target: SCN10A; (+) strand; PAM type: YTN; PAM sequence: TTC
tggtatgggtccatgagatc

SEQ ID NO: 61218 - DNA, 20 bp, Artificial Sequence
  Description of Artificial Sequence: Synthetic oligonucleotide
  Target: SCN10A; (+) strand; PAM type: YTN; PAM sequence: CTG
gtatgggtccatgagatcta

SEQ ID NO: 61219 - DNA, 20 bp, Artificial Sequence
  Description of Artificial Sequence: Synthetic oligonucleotide
  Target: SCN10A; (+) strand; PAM type: YTN; PAM sequence: CTA
gcttcaatagatatctgaga

SEQ ID NO: 61220 - DNA, 20 bp, Artificial Sequence
  Description of Artificial Sequence: Synthetic oligonucleotide
  Target: SCN10A; (+) strand; PAM type: YTN; PAM sequence: CTT
caatagatatctgagatata

SEQ ID NO: 61221 - DNA, 20 bp, Artificial Sequence
  Description of Artificial Sequence: Synthetic oligonucleotide
  Target: SCN10A; (+) strand; PAM type: YTN; PAM sequence: TTC
aatagatatctgagatataa

SEQ ID NO: 61222 - DNA, 20 bp, Artificial Sequence
  Description of Artificial Sequence: Synthetic oligonucleotide
  Target: SCN10A; (+) strand; PAM type: YTN; PAM sequence: CTG
agatataatgactgacttgt

SEQ ID NO: 61223 - DNA, 20 bp, Artificial Sequence
  Description of Artificial Sequence: Synthetic oligonucleotide
  Target: SCN10A; (+) strand; PAM type: YTN; PAM sequence: CTG
acttgtgagccccttttggt

SEQ ID NO: 61224 - DNA, 20 bp, Artificial Sequence
  Description of Artificial Sequence: Synthetic oligonucleotide
  Target: SCN10A; (+) strand; PAM type: YTN; PAM sequence: CTT
gtgagccccttttggtctgt

SEQ ID NO: 61225 - DNA, 20 bp, Artificial Sequence
  Description of Artificial Sequence: Synthetic oligonucleotide
  Target: SCN10A; (+) strand; PAM type: YTN; PAM sequence: TTG
tgagccccttttggtctgtc

SEQ ID NO: 61226 - DNA, 20 bp, Artificial Sequence
  Description of Artificial Sequence: Synthetic oligonucleotide
  Target: SCN10A; (+) strand; PAM type: YTN; PAM sequence: CTT
ttggtctgtcagttttcttt

SEQ ID NO: 61227 - DNA, 20 bp, Artificial Sequence
  Description of Artificial Sequence: Synthetic oligonucleotide
  Target: SCN10A; (+) strand; PAM type: YTN; PAM sequence: TTT
tggtctgtcagttttcttta

SEQ ID NO: 61228 - DNA, 20 bp, Artificial Sequence
  Description of Artificial Sequence: Synthetic oligonucleotide
  Target: SCN10A; (+) strand; PAM type: YTN; PAM sequence: TTT
ggtctgtcagttttctttaa

SEQ ID NO: 61229 - DNA, 20 bp, Artificial Sequence
  Description of Artificial Sequence: Synthetic oligonucleotide
  Target: SCN10A; (+) strand; PAM type: YTN; PAM sequence: TTG
gtctgtcagttttctttaag

SEQ ID NO: 61230 - DNA, 20 bp, Artificial Sequence
  Description of Artificial Sequence: Synthetic oligonucleotide
  Target: SCN10A; (+) strand; PAM type: YTN; PAM sequence: CTG
tcagttttctttaagtggtg

SEQ ID NO: 61231 - DNA, 20 bp, Artificial Sequence
  Description of Artificial Sequence: Synthetic oligonucleotide
  Target: SCN10A; (+) strand; PAM type: YTN; PAM sequence: TTT
tctttaagtggtggtccaaa

SEQ ID NO: 61232 - DNA, 20 bp, Artificial Sequence
  Description of Artificial Sequence: Synthetic oligonucleotide
  Target: SCN10A; (+) strand; PAM type: YTN; PAM sequence: TTT
ctttaagtggtggtccaaag

SEQ ID NO: 61233 - DNA, 20 bp, Artificial Sequence
  Description of Artificial Sequence: Synthetic oligonucleotide
  Target: SCN10A; (+) strand; PAM type: YTN; PAM sequence: TTC
tttaagtggtggtccaaaga

SEQ ID NO: 61234 - DNA, 20 bp, Artificial Sequence
  Description of Artificial Sequence: Synthetic oligonucleotide
  Target: SCN10A; (+) strand; PAM type: YTN; PAM sequence: CTT
taagtggtggtccaaagact

SEQ ID NO: 61235 - DNA, 20 bp, Artificial Sequence
  Description of Artificial Sequence: Synthetic oligonucleotide
  Target: SCN10A; (+) strand; PAM type: YTN; PAM sequence: TTT
aagtggtggtccaaagactg

SEQ ID NO: 61236 - DNA, 20 bp, Artificial Sequence
  Description of Artificial Sequence: Synthetic oligonucleotide
  Target: SCN10A; (+) strand; PAM type: YTN; PAM sequence: TTA
agtggtggtccaaagactgc

SEQ ID NO: 61237 - DNA, 20 bp, Artificial Sequence
  Description of Artificial Sequence: Synthetic oligonucleotide
  Target: SCN10A; (+) strand; PAM type: YTN; PAM sequence: CTG
caaaggacagaaacttacat

SEQ ID NO: 61238 - DNA, 20 bp, Artificial Sequence
  Description of Artificial Sequence: Synthetic oligonucleotide
  Target: SCN10A; (+) strand; PAM type: YTN; PAM sequence: CTT
acatgaaaaaagttcccctg

SEQ ID NO: 61239 - DNA, 20 bp, Artificial Sequence
  Description of Artificial Sequence: Synthetic oligonucleotide
  Target: SCN10A; (+) strand; PAM type: YTN; PAM sequence: TTA
catgaaaaaagttcccctgc

SEQ ID NO: 61240 - DNA, 20 bp, Artificial Sequence
  Description of Artificial Sequence: Synthetic oligonucleotide
  Target: SCN10A; (+) strand; PAM type: YTN; PAM sequence: TTC
ccctgctaggaactttgaag

SEQ ID NO: 61241 - DNA, 20 bp, Artificial Sequence
  Description of Artificial Sequence: Synthetic oligonucleotide
  Target: SCN10A; (+) strand; PAM type: YTN; PAM sequence: CTG
ctaggaactttgaaggtgcc

SEQ ID NO: 61242 - DNA, 20 bp, Artificial Sequence
  Description of Artificial Sequence: Synthetic oligonucleotide
  Target: SCN10A; (+) strand; PAM type: YTN; PAM sequence: CTA
ggaactttgaaggtgccagg

SEQ ID NO: 61243 - DNA, 20 bp, Artificial Sequence
  Description of Artificial Sequence: Synthetic oligonucleotide
  Target: SCN10A; (+) strand; PAM type: YTN; PAM sequence: CTT
tgaaggtgccagggagatgt

SEQ ID NO: 61244 - DNA, 20 bp, Artificial Sequence
  Description of Artificial Sequence: Synthetic oligonucleotide
  Target: SCN10A; (+) strand; PAM type: YTN; PAM sequence: TTT
gaaggtgccagggagatgtc

SEQ ID NO: 61245 - DNA, 20 bp, Artificial Sequence
  Description of Artificial Sequence: Synthetic oligonucleotide
  Target: SCN10A; (+) strand; PAM type: YTN; PAM sequence: TTG
aaggtgccagggagatgtca

SEQ ID NO: 61246 - DNA, 20 bp, Artificial Sequence
  Description of Artificial Sequence: Synthetic oligonucleotide
  Target: SCN10A; (+) strand; PAM type: YTN; PAM sequence: CTA
tgaccctgtcctgtgagatc

SEQ ID NO: 61247 - DNA, 20 bp, Artificial Sequence
  Description of Artificial Sequence: Synthetic oligonucleotide
  Target: SCN10A; (+) strand; PAM type: YTN; PAM sequence: CTG
tcctgtgagatcttagccac

SEQ ID NO: 61248 - DNA, 20 bp, Artificial Sequence
  Description of Artificial Sequence: Synthetic oligonucleotide
  Target: SCN10A; (+) strand; PAM type: YTN; PAM sequence: CTG
tgagatcttagccacaccac

SEQ ID NO: 61249 - DNA, 20 bp, Artificial Sequence
  Description of Artificial Sequence: Synthetic oligonucleotide
  Target: SCN10A; (+) strand; PAM type: YTN; PAM sequence: CTT
agccacaccacagatggtgg

SEQ ID NO: 61250 - DNA, 20 bp, Artificial Sequence
  Description of Artificial Sequence: Synthetic oligonucleotide
  Target: SCN10A; (+) strand; PAM type: YTN; PAM sequence: TTA
gccacaccacagatggtggg

SEQ ID NO: 61251 - DNA, 20 bp, Artificial Sequence
  Description of Artificial Sequence: Synthetic oligonucleotide
  Target: SCN10A; (+) strand; PAM type: YTN; PAM sequence: CTG
aattcaggctcagcttatcc

SEQ ID NO: 61252 - DNA, 20 bp, Artificial Sequence
  Description of Artificial Sequence: Synthetic oligonucleotide
  Target: SCN10A; (+) strand; PAM type: YTN; PAM sequence: TTC
aggctcagcttatcctggca

SEQ ID NO: 61253 - DNA, 20 bp, Artificial Sequence
  Description of Artificial Sequence: Synthetic oligonucleotide
  Target: SCN10A; (+) strand; PAM type: YTN; PAM sequence: CTC
agcttatcctggcagttagg

SEQ ID NO: 61254 - DNA, 20 bp, Artificial Sequence
  Description of Artificial Sequence: Synthetic oligonucleotide
  Target: SCN10A; (+) strand; PAM type: YTN; PAM sequence: CTT
atcctggcagttaggtggga

SEQ ID NO: 61255 - DNA, 20 bp, Artificial Sequence
  Description of Artificial Sequence: Synthetic oligonucleotide
  Target: SCN10A; (+) strand; PAM type: YTN; PAM sequence: TTA
tcctggcagttaggtgggat

SEQ ID NO: 61256 - DNA, 20 bp, Artificial Sequence
  Description of Artificial Sequence: Synthetic oligonucleotide
  Target: SCN10A; (+) strand; PAM type: YTN; PAM sequence: CTG
gcagttaggtgggatgcaca

SEQ ID NO: 61257 - DNA, 20 bp, Artificial Sequence
  Description of Artificial Sequence: Synthetic oligonucleotide
  Target: SCN10A; (+) strand; PAM type: YTN; PAM sequence: TTA
ggtgggatgcacacaggagc

SEQ ID NO: 61258 - DNA, 20 bp, Artificial Sequence
  Description of Artificial Sequence: Synthetic oligonucleotide
  Target: SCN10A; (+) strand; PAM type: YTN; PAM sequence: CTT
cagaaaagaagggctttata

SEQ ID NO: 61259 - DNA, 20 bp, Artificial Sequence
  Description of Artificial Sequence: Synthetic oligonucleotide
  Target: SCN10A; (+) strand; PAM type: YTN; PAM sequence: TTC
agaaaagaagggctttatac

SEQ ID NO: 61260 - DNA, 20 bp, Artificial Sequence
  Description of Artificial Sequence: Synthetic oligonucleotide
  Target: SCN10A; (+) strand; PAM type: YTN; PAM sequence: CTT
tatacttgagtggcagagcc

SEQ ID NO: 61261 - DNA, 20 bp, Artificial Sequence
  Description of Artificial Sequence: Synthetic oligonucleotide
  Target: SCN10A; (+) strand; PAM type: YTN; PAM sequence: TTT
atacttgagtggcagagccc

SEQ ID NO: 61262 - DNA, 20 bp, Artificial Sequence
  Description of Artificial Sequence: Synthetic oligonucleotide
  Target: SCN10A; (+) strand; PAM type: YTN; PAM sequence: TTA
tacttgagtggcagagcccc

SEQ ID NO: 61263 - DNA, 20 bp, Artificial Sequence
  Description of Artificial Sequence: Synthetic oligonucleotide
  Target: SCN10A; (+) strand; PAM type: YTN; PAM sequence: CTT
gagtggcagagccccaagca

SEQ ID NO: 61264 - DNA, 20 bp, Artificial Sequence
  Description of Artificial Sequence: Synthetic oligonucleotide
  Target: SCN10A; (+) strand; PAM type: YTN; PAM sequence: TTG
agtggcagagccccaagcaa

SEQ ID NO: 61265 - DNA, 20 bp, Artificial Sequence
  Description of Artificial Sequence: Synthetic oligonucleotide
  Target: SCN10A; (+) strand; PAM type: YTN; PAM sequence: TTC
tttggatgagtggcttattg

SEQ ID NO: 61266 - DNA, 20 bp, Artificial Sequence
  Description of Artificial Sequence: Synthetic oligonucleotide
  Target: SCN10A; (+) strand; PAM type: YTN; PAM sequence: CTT
tggatgagtggcttattgca

SEQ ID NO: 61267 - DNA, 20 bp, Artificial Sequence
  Description of Artificial Sequence: Synthetic oligonucleotide
  Target: SCN10A; (+) strand; PAM type: YTN; PAM sequence: TTT
ggatgagtggcttattgcac

SEQ ID NO: 61268 - DNA, 20 bp, Artificial Sequence
  Description of Artificial Sequence: Synthetic oligonucleotide
  Target: SCN10A; (+) strand; PAM type: YTN; PAM sequence: TTG
gatgagtggcttattgcacc

SEQ ID NO: 61269 - DNA, 20 bp, Artificial Sequence
  Description of Artificial Sequence: Synthetic oligonucleotide
  Target: SCN10A; (+) strand; PAM type: YTN; PAM sequence: CTT
attgcaccaggacaaagaac

SEQ ID NO: 61270 - DNA, 20 bp, Artificial Sequence
  Description of Artificial Sequence: Synthetic oligonucleotide
  Target: SCN10A; (+) strand; PAM type: YTN; PAM sequence: TTA
ttgcaccaggacaaagaacc

SEQ ID NO: 61271 - DNA, 20 bp, Artificial Sequence
  Description of Artificial Sequence: Synthetic oligonucleotide
  Target: SCN10A; (+) strand; PAM type: YTN; PAM sequence: TTG
caccaggacaaagaaccgga

SEQ ID NO: 61272 - DNA, 20 bp, Artificial Sequence
  Description of Artificial Sequence: Synthetic oligonucleotide
  Target: SCN10A; (+) strand; PAM type: YTN; PAM sequence: CTC
ttccttcattcatgcaaggc

SEQ ID NO: 61273 - DNA, 20 bp, Artificial Sequence
  Description of Artificial Sequence: Synthetic oligonucleotide
  Target: SCN10A; (+) strand; PAM type: YTN; PAM sequence: CTT
ccttcattcatgcaaggctc

SEQ ID NO: 61274 - DNA, 20 bp, Artificial Sequence
  Description of Artificial Sequence: Synthetic oligonucleotide
  Target: SCN10A; (+) strand; PAM type: YTN; PAM sequence: TTC
cttcattcatgcaaggctcc

SEQ ID NO: 61275 - DNA, 20 bp, Artificial Sequence
  Description of Artificial Sequence: Synthetic oligonucleotide
  Target: SCN10A; (+) strand; PAM type: YTN; PAM sequence: CTT
cattcatgcaaggctccaga

SEQ ID NO: 61276 - DNA, 20 bp, Artificial Sequence
  Description of Artificial Sequence: Synthetic oligonucleotide
  Target: SCN10A; (+) strand; PAM type: YTN; PAM sequence: TTC
attcatgcaaggctccagac

SEQ ID NO: 61277 - DNA, 20 bp, Artificial Sequence
  Description of Artificial Sequence: Synthetic oligonucleotide
  Target: SCN10A; (+) strand; PAM type: YTN; PAM sequence: TTC
atgcaaggctccagacatca

SEQ ID NO: 61278 - DNA, 20 bp, Artificial Sequence
  Description of Artificial Sequence: Synthetic oligonucleotide
  Target: SCN10A; (+) strand; PAM type: YTN; PAM sequence: CTC
cagacatcagcaggtgagac

SEQ ID NO: 61279 - DNA, 20 bp, Artificial Sequence
  Description of Artificial Sequence: Synthetic oligonucleotide
  Target: SCN10A; (+) strand; PAM type: YTN; PAM sequence: CTG
cctgggtgcatgagggtagg

SEQ ID NO: 61280 - DNA, 20 bp, Artificial Sequence
  Description of Artificial Sequence: Synthetic oligonucleotide
  Target: SCN10A; (+) strand; PAM type: YTN; PAM sequence: CTG
ggtgcatgagggtagggagg

SEQ ID NO: 61281 - DNA, 20 bp, Artificial Sequence
  Description of Artificial Sequence: Synthetic oligonucleotide
  Target: SCN10A; (+) strand; PAM type: YTN; PAM sequence: TTT
ggggccagttccatgctgaa

SEQ ID NO: 61282 - DNA, 20 bp, Artificial Sequence
  Description of Artificial Sequence: Synthetic oligonucleotide
  Target: SCN10A; (+) strand; PAM type: YTN; PAM sequence: TTG
gggccagttccatgctgaac

SEQ ID NO: 61283 - DNA, 20 bp, Artificial Sequence
  Description of Artificial Sequence: Synthetic oligonucleotide
  Target: SCN10A; (+) strand; PAM type: YTN; PAM sequence: TTC
catgctgaaccctattcagt

SEQ ID NO: 61284 - DNA, 20 bp, Artificial Sequence
  Description of Artificial Sequence: Synthetic oligonucleotide
  Target: SCN10A; (+) strand; PAM type: YTN; PAM sequence: CTG
aaccctattcagtcttttgc

SEQ ID NO: 61285 - DNA, 20 bp, Artificial Sequence
  Description of Artificial Sequence: Synthetic oligonucleotide
  Target: SCN10A; (+) strand; PAM type: YTN; PAM sequence: CTA
ttcagtcttttgctcagccc

SEQ ID NO: 61286 - DNA, 20 bp, Artificial Sequence
  Description of Artificial Sequence: Synthetic oligonucleotide
  Target: SCN10A; (+) strand; PAM type: YTN; PAM sequence: TTC
agtcttttgctcagccccct

SEQ ID NO: 61287 - DNA, 20 bp, Artificial Sequence
  Description of Artificial Sequence: Synthetic oligonucleotide
  Target: SCN10A; (+) strand; PAM type: YTN; PAM sequence: CTT
ttgctcagccccctgggaag

SEQ ID NO: 61288 - DNA, 20 bp, Artificial Sequence
  Description of Artificial Sequence: Synthetic oligonucleotide
  Target: SCN10A; (+) strand; PAM type: YTN; PAM sequence: TTT
tgctcagccccctgggaagt

SEQ ID NO: 61289 - DNA, 20 bp, Artificial Sequence
  Description of Artificial Sequence: Synthetic oligonucleotide
  Target: SCN10A; (+) strand; PAM type: YTN; PAM sequence: TTT
gctcagccccctgggaagtc

SEQ ID NO: 61290 - DNA, 20 bp, Artificial Sequence
  Description of Artificial Sequence: Synthetic oligonucleotide
  Target: SCN10A; (+) strand; PAM type: YTN; PAM sequence: TTG
ctcagccccctgggaagtct

SEQ ID NO: 61291 - DNA, 20 bp, Artificial Sequence
  Description of Artificial Sequence: Synthetic oligonucleotide
  Target: SCN10A; (+) strand; PAM type: YTN; PAM sequence: CTC
agccccctgggaagtctgcc

SEQ ID NO: 61292 - DNA, 20 bp, Artificial Sequence
  Description of Artificial Sequence: Synthetic oligonucleotide
  Target: SCN10A; (+) strand; PAM type: YTN; PAM sequence: CTG
ggaagtctgcctcacatgga

SEQ ID NO: 61293 - DNA, 20 bp, Artificial Sequence
  Description of Artificial Sequence: Synthetic oligonucleotide
  Target: SCN10A; (+) strand; PAM type: YTN; PAM sequence: CTG
cctcacatggataatctgca

SEQ ID NO: 61294 - DNA, 20 bp, Artificial Sequence
  Description of Artificial Sequence: Synthetic oligonucleotide
  Target: SCN10A; (+) strand; PAM type: YTN; PAM sequence: CTC
acatggataatctgcagctg

SEQ ID NO: 61295 - DNA, 20 bp, Artificial Sequence
  Description of Artificial Sequence: Synthetic oligonucleotide
  Target: SCN10A; (+) strand; PAM type: YTN; PAM sequence: CTG
cagctggggcagacaggtgc

SEQ ID NO: 61296 - DNA, 20 bp, Artificial Sequence
  Description of Artificial Sequence: Synthetic oligonucleotide
  Target: SCN10A; (+) strand; PAM type: YTN; PAM sequence: CTG
gggcagacaggtgctgtgcc

SEQ ID NO: 61297 - DNA, 20 bp, Artificial Sequence
  Description of Artificial Sequence: Synthetic oligonucleotide
  Target: SCN10A; (+) strand; PAM type: YTN; PAM sequence: CTG
tgcctctccagcaaagtctg

SEQ ID NO: 61298 - DNA, 20 bp, Artificial Sequence
  Description of Artificial Sequence: Synthetic oligonucleotide
  Target: SCN10A; (+) strand; PAM type: YTN; PAM sequence: CTC
tccagcaaagtctgtccacc

SEQ ID NO: 61299 - DNA, 20 bp, Artificial Sequence
  Description of Artificial Sequence: Synthetic oligonucleotide
  Target: SCN10A; (+) strand; PAM type: YTN; PAM sequence: CTC
cagcaaagtctgtccaccca

SEQ ID NO: 61300 - DNA, 20 bp, Artificial Sequence
  Description of Artificial Sequence: Synthetic oligonucleotide
  Target: SCN10A; (+) strand; PAM type: YTN; PAM sequence: CTG
tccacccaagcccacctcca

SEQ ID NO: 61301 - DNA, 20 bp, Artificial Sequence
  Description of Artificial Sequence: Synthetic oligonucleotide
  Target: SCN10A; (+) strand; PAM type: YTN; PAM sequence: CTC
cattcccactgctcagccca

SEQ ID NO: 61302 - DNA, 20 bp, Artificial Sequence
  Description of Artificial Sequence: Synthetic oligonucleotide
  Target: SCN10A; (+) strand; PAM type: YTN; PAM sequence: TTC
ccactgctcagcccactagc

SEQ ID NO: 61303 - DNA, 20 bp, Artificial Sequence
  Description of Artificial Sequence: Synthetic oligonucleotide
  Target: SCN10A; (+) strand; PAM type: YTN; PAM sequence: CTG
ctcagcccactagcctccca

SEQ ID NO: 61304 - DNA, 20 bp, Artificial Sequence
  Description of Artificial Sequence: Synthetic oligonucleotide
  Target: SCN10A; (+) strand; PAM type: YTN; PAM sequence: CTC
agcccactagcctcccaagt

SEQ ID NO: 61305 - DNA, 20 bp, Artificial Sequence
  Description of Artificial Sequence: Synthetic oligonucleotide
  Target: SCN10A; (+) strand; PAM type: YTN; PAM sequence: CTA
gcctcccaagtagtctccag

SEQ ID NO: 61306 - DNA, 20 bp, Artificial Sequence
  Description of Artificial Sequence: Synthetic oligonucleotide
  Target: SCN10A; (+) strand; PAM type: YTN; PAM sequence: CTC
ccaagtagtctccaggccct

SEQ ID NO: 61307 - DNA, 20 bp, Artificial Sequence
  Description of Artificial Sequence: Synthetic oligonucleotide
  Target: SCN10A; (+) strand; PAM type: YTN; PAM sequence: CTC
caggccctagtactgcacca

SEQ ID NO: 61308 - DNA, 20 bp, Artificial Sequence
  Description of Artificial Sequence: Synthetic oligonucleotide
  Target: SCN10A; (+) strand; PAM type: YTN; PAM sequence: CTA
gtactgcaccatgcatctat

SEQ ID NO: 61309 - DNA, 20 bp, Artificial Sequence
  Description of Artificial Sequence: Synthetic oligonucleotide
  Target: SCN10A; (+) strand; PAM type: YTN; PAM sequence: CTG
caccatgcatctattctcca

SEQ ID NO: 61310 - DNA, 20 bp, Artificial Sequence
  Description of Artificial Sequence: Synthetic oligonucleotide
  Target: SCN10A; (+) strand; PAM type: YTN; PAM sequence: CTA
ttctccactgcaaatctgat

SEQ ID NO: 61311 - DNA, 20 bp, Artificial Sequence
  Description of Artificial Sequence: Synthetic oligonucleotide
  Target: SCN10A; (+) strand; PAM type: YTN; PAM sequence: TTC
tccactgcaaatctgattat

SEQ ID NO: 61312 - DNA, 20 bp, Artificial Sequence
  Description of Artificial Sequence: Synthetic oligonucleotide
  Target: SCN10A; (+) strand; PAM type: YTN; PAM sequence: CTC
cactgcaaatctgattatga

SEQ ID NO: 61313 - DNA, 20 bp, Artificial Sequence
  Description of Artificial Sequence: Synthetic oligonucleotide
  Target: SCN10A; (+) strand; PAM type: YTN; PAM sequence: CTG
caaatctgattatgatcatg

SEQ ID NO: 61314 - DNA, 20 bp, Artificial Sequence
  Description of Artificial Sequence: Synthetic oligonucleotide
  Target: SCN10A; (+) strand; PAM type: YTN; PAM sequence: CTG
attatgatcatgtctttctc

SEQ ID NO: 61315 - DNA, 20 bp, Artificial Sequence
  Description of Artificial Sequence: Synthetic oligonucleotide
  Target: SCN10A; (+) strand; PAM type: YTN; PAM sequence: TTA
tgatcatgtctttctcttac

SEQ ID NO: 61316 - DNA, 20 bp, Artificial Sequence
  Description of Artificial Sequence: Synthetic oligonucleotide
  Target: SCN10A; (+) strand; PAM type: YTN; PAM sequence: CTT
tctcttactcccaaacatca

SEQ ID NO: 61317 - DNA, 20 bp, Artificial Sequence
  Description of Artificial Sequence: Synthetic oligonucleotide
  Target: SCN10A; (+) strand; PAM type: YTN; PAM sequence: TTT
ctcttactcccaaacatcac

SEQ ID NO: 61318 - DNA, 20 bp, Artificial Sequence
  Description of Artificial Sequence: Synthetic oligonucleotide
  Target: SCN10A; (+) strand; PAM type: YTN; PAM sequence: TTC
tcttactcccaaacatcact

SEQ ID NO: 61319 - DNA, 20 bp, Artificial Sequence
  Description of Artificial Sequence: Synthetic oligonucleotide
  Target: SCN10A; (+) strand; PAM type: YTN; PAM sequence: CTC
ttactcccaaacatcactgg

SEQ ID NO: 61320 - DNA, 20 bp, Artificial Sequence
  Description of Artificial Sequence: Synthetic oligonucleotide
  Target: SCN10A; (+) strand; PAM type: YTN; PAM sequence: CTT
actcccaaacatcactggta

SEQ ID NO: 61321 - DNA, 20 bp, Artificial Sequence
  Description of Artificial Sequence: Synthetic oligonucleotide
  Target: SCN10A; (+) strand; PAM type: YTN; PAM sequence: TTA
ctcccaaacatcactggtac

SEQ ID NO: 61322 - DNA, 20 bp, Artificial Sequence
  Description of Artificial Sequence: Synthetic oligonucleotide
  Target: SCN10A; (+) strand; PAM type: YTN; PAM sequence: CTC
ccaaacatcactggtacttt

SEQ ID NO: 61323 - DNA, 20 bp, Artificial Sequence
  Description of Artificial Sequence: Synthetic oligonucleotide
  Target: SCN10A; (+) strand; PAM type: YTN; PAM sequence: CTG
gtactttatcaccctcagga

SEQ ID NO: 61324 - DNA, 20 bp, Artificial Sequence
  Description of Artificial Sequence: Synthetic oligonucleotide
  Target: SCN10A; (+) strand; PAM type: YTN; PAM sequence: CTT
tatcaccctcaggataaact

SEQ ID NO: 61325 - DNA, 20 bp, Artificial Sequence
  Description of Artificial Sequence: Synthetic oligonucleotide
  Target: SCN10A; (+) strand; PAM type: YTN; PAM sequence: TTT
atcaccctcaggataaactc

SEQ ID NO: 61326 - DNA, 20 bp, Artificial Sequence
  Description of Artificial Sequence: Synthetic oligonucleotide
  Target: SCN10A; (+) strand; PAM type: YTN; PAM sequence: TTA
tcaccctcaggataaactcc

SEQ ID NO: 61327 - DNA, 20 bp, Artificial Sequence
  Description of Artificial Sequence: Synthetic oligonucleotide
  Target: SCN10A; (+) strand; PAM type: YTN; PAM sequence: CTC
aggataaactccatactctg

SEQ ID NO: 61328 - DNA, 20 bp, Artificial Sequence
  Description of Artificial Sequence: Synthetic oligonucleotide
  Target: SCN10A; (+) strand; PAM type: YTN; PAM sequence: CTC
catactctgtagcctgtgtc

SEQ ID NO: 61329 - DNA, 20 bp, Artificial Sequence
  Description of Artificial Sequence: Synthetic oligonucleotide
  Target: SCN10A; (+) strand; PAM type: YTN; PAM sequence: CTC
tgtagcctgtgtcatatggt

SEQ ID NO: 61330 - DNA, 20 bp, Artificial Sequence
  Description of Artificial Sequence: Synthetic oligonucleotide
  Target: SCN10A; (+) strand; PAM type: YTN; PAM sequence: CTG
tagcctgtgtcatatggtca

SEQ ID NO: 61331 - DNA, 20 bp, Artificial Sequence
  Description of Artificial Sequence: Synthetic oligonucleotide
  Target: SCN10A; (+) strand; PAM type: YTN; PAM sequence: CTG
tgtcatatggtcacaaccta

SEQ ID NO: 61332 - DNA, 20 bp, Artificial Sequence
  Description of Artificial Sequence: Synthetic oligonucleotide
  Target: SCN10A; (+) strand; PAM type: YTN; PAM sequence: CTA
cttttccagtcatatttcac

SEQ ID NO: 61333 - DNA, 20 bp, Artificial Sequence
  Description of Artificial Sequence: Synthetic oligonucleotide
  Target: SCN10A; (+) strand; PAM type: YTN; PAM sequence: CTT
ttccagtcatatttcaccca

SEQ ID NO: 61334 - DNA, 20 bp, Artificial Sequence
  Description of Artificial Sequence: Synthetic oligonucleotide
  Target: SCN10A; (+) strand; PAM type: YTN; PAM sequence: TTT
tccagtcatatttcacccac

SEQ ID NO: 61335 - DNA, 20 bp, Artificial Sequence
  Description of Artificial Sequence: Synthetic oligonucleotide
  Target: SCN10A; (+) strand; PAM type: YTN; PAM sequence: TTT
ccagtcatatttcacccaca

SEQ ID NO: 61336 - DNA, 20 bp, Artificial Sequence
  Description of Artificial Sequence: Synthetic oligonucleotide
  Target: SCN10A; (+) strand; PAM type: YTN; PAM sequence: TTC
cagtcatatttcacccacac

SEQ ID NO: 61337 - DNA, 20 bp, Artificial Sequence
  Description of Artificial Sequence: Synthetic oligonucleotide
  Target: SCN10A; (+) strand; PAM type: YTN; PAM sequence: TTT
cacccacacattctacccaa

SEQ ID NO: 61338 - DNA, 20 bp, Artificial Sequence
  Description of Artificial Sequence: Synthetic oligonucleotide
  Target: SCN10A; (+) strand; PAM type: YTN; PAM sequence: TTC
acccacacattctacccaaa

SEQ ID NO: 61339 - DNA, 20 bp, Artificial Sequence
  Description of Artificial Sequence: Synthetic oligonucleotide
  Target: SCN10A; (+) strand; PAM type: YTN; PAM sequence: TTC
tacccaaatcaaattgttcc

SEQ ID NO: 61340 - DNA, 20 bp, Artificial Sequence
  Description of Artificial Sequence: Synthetic oligonucleotide
  Target: SCN10A; (+) strand; PAM type: YTN; PAM sequence: CTA
cccaaatcaaattgttccct

SEQ ID NO: 61341 - DNA, 20 bp, Artificial Sequence
  Description of Artificial Sequence: Synthetic oligonucleotide
  Target: SCN10A; (+) strand; PAM type: YTN; PAM sequence: TTG
ttccctgagcatacttgtgt

SEQ ID NO: 61342 - DNA, 20 bp, Artificial Sequence
  Description of Artificial Sequence: Synthetic oligonucleotide
  Target: SCN10A; (+) strand; PAM type: YTN; PAM sequence: TTC
cctgagcatacttgtgtctg

SEQ ID NO: 61343 - DNA, 20 bp, Artificial Sequence
  Description of Artificial Sequence: Synthetic oligonucleotide
  Target: SCN10A; (+) strand; PAM type: YTN; PAM sequence: CTG
agcatacttgtgtctgtgcc

SEQ ID NO: 61344 - DNA, 20 bp, Artificial Sequence
  Description of Artificial Sequence: Synthetic oligonucleotide
  Target: SCN10A; (+) strand; PAM type: YTN; PAM sequence: CTT
gtgtctgtgcctttgttcaa

SEQ ID NO: 61345 - DNA, 20 bp, Artificial Sequence
  Description of Artificial Sequence: Synthetic oligonucleotide
  Target: SCN10A; (+) strand; PAM type: YTN; PAM sequence: TTG
tgtctgtgcctttgttcaag

SEQ ID NO: 61346 - DNA, 20 bp, Artificial Sequence
  Description of Artificial Sequence: Synthetic oligonucleotide
  Target: SCN10A; (+) strand; PAM type: YTN; PAM sequence: CTG
tgcctttgttcaaggtcagc

SEQ ID NO: 61347 - DNA, 20 bp, Artificial Sequence
  Description of Artificial Sequence: Synthetic oligonucleotide
  Target: SCN10A; (+) strand; PAM type: YTN; PAM sequence: CTT
tgttcaaggtcagcctttag

SEQ ID NO: 61348 - DNA, 20 bp, Artificial Sequence
  Description of Artificial Sequence: Synthetic oligonucleotide
  Target: SCN10A; (+) strand; PAM type: YTN; PAM sequence: TTT
gttcaaggtcagcctttagc

SEQ ID NO: 61349 - DNA, 20 bp, Artificial Sequence
  Description of Artificial Sequence: Synthetic oligonucleotide
  Target: SCN10A; (+) strand; PAM type: YTN; PAM sequence: TTG
ttcaaggtcagcctttagct

SEQ ID NO: 61350 - DNA, 20 bp, Artificial Sequence
  Description of Artificial Sequence: Synthetic oligonucleotide
  Target: SCN10A; (+) strand; PAM type: YTN; PAM sequence: TTC
aaggtcagcctttagctaag

SEQ ID NO: 61351 - DNA, 20 bp, Artificial Sequence
  Description of Artificial Sequence: Synthetic oligonucleotide
  Target: SCN10A; (+) strand; PAM type: YTN; PAM sequence: CTT
tagctaagacgggccttccc

SEQ ID NO: 61352 - DNA, 20 bp, Artificial Sequence
  Description of Artificial Sequence: Synthetic oligonucleotide
  Target: SCN10A; (+) strand; PAM type: YTN; PAM sequence: TTT
agctaagacgggccttcccc

SEQ ID NO: 61353 - DNA, 20 bp, Artificial Sequence
  Description of Artificial Sequence: Synthetic oligonucleotide
  Target: SCN10A; (+) strand; PAM type: YTN; PAM sequence: TTA
gctaagacgggccttcccca

SEQ ID NO: 61354 - DNA, 20 bp, Artificial Sequence
  Description of Artificial Sequence: Synthetic oligonucleotide
  Target: SCN10A; (+) strand; PAM type: YTN; PAM sequence: CTA
agacgggccttccccagtcc

SEQ ID NO: 61355 - DNA, 20 bp, Artificial Sequence
  Description of Artificial Sequence: Synthetic oligonucleotide
  Target: SCN10A; (+) strand; PAM type: YTN; PAM sequence: CTT
ccccagtcctctcgcagctc

SEQ ID NO: 61356 - DNA, 20 bp, Artificial Sequence
  Description of Artificial Sequence: Synthetic oligonucleotide
  Target: SCN10A; (+) strand; PAM type: YTN; PAM sequence: TTC
cccagtcctctcgcagctcc

SEQ ID NO: 61357 - DNA, 20 bp, Artificial Sequence
  Description of Artificial Sequence: Synthetic oligonucleotide
  Target: SCN10A; (+) strand; PAM type: YTN; PAM sequence: CTC
tcgcagctccttggtcctgc

SEQ ID NO: 61358 - DNA, 20 bp, Artificial Sequence
  Description of Artificial Sequence: Synthetic oligonucleotide
  Target: SCN10A; (+) strand; PAM type: YTN; PAM sequence: CTC
gcagctccttggtcctgctc

SEQ ID NO: 61359 - DNA, 20 bp, Artificial Sequence
  Description of Artificial Sequence: Synthetic oligonucleotide
  Target: SCN10A; (+) strand; PAM type: YTN; PAM sequence: CTC
cttggtcctgctcatttcta

SEQ ID NO: 61360 - DNA, 20 bp, Artificial Sequence
  Description of Artificial Sequence: Synthetic oligonucleotide
  Target: SCN10A; (+) strand; PAM type: YTN; PAM sequence: CTT
ggtcctgctcatttctatgc

SEQ ID NO: 61361 - DNA, 20 bp, Artificial Sequence
  Description of Artificial Sequence: Synthetic oligonucleotide
  Target: SCN10A; (+) strand; PAM type: YTN; PAM sequence: TTG
gtcctgctcatttctatgcc

SEQ ID NO: 61362 - DNA, 20 bp, Artificial Sequence
  Description of Artificial Sequence: Synthetic oligonucleotide
  Target: SCN10A; (+) strand; PAM type: YTN; PAM sequence: CTG
ctcatttctatgccccacat

SEQ ID NO: 61363 - DNA, 20 bp, Artificial Sequence
  Description of Artificial Sequence: Synthetic oligonucleotide
  Target: SCN10A; (+) strand; PAM type: YTN; PAM sequence: CTC
atttctatgccccacatcta

SEQ ID NO: 61364 - DNA, 20 bp, Artificial Sequence
  Description of Artificial Sequence: Synthetic oligonucleotide
  Target: SCN10A; (+) strand; PAM type: YTN; PAM sequence: TTT
ctatgccccacatctaatgc

SEQ ID NO: 61365 - DNA, 20 bp, Artificial Sequence
  Description of Artificial Sequence: Synthetic oligonucleotide
  Target: SCN10A; (+) strand; PAM type: YTN; PAM sequence: TTC
tatgccccacatctaatgcc

SEQ ID NO: 61366 - DNA, 20 bp, Artificial Sequence
  Description of Artificial Sequence: Synthetic oligonucleotide
  Target: SCN10A; (+) strand; PAM type: YTN; PAM sequence: CTA
tgccccacatctaatgccac

SEQ ID NO: 61367 - DNA, 20 bp, Artificial Sequence
  Description of Artificial Sequence: Synthetic oligonucleotide
  Target: SCN10A; (+) strand; PAM type: YTN; PAM sequence: CTA
atgccacctcccataggaag

SEQ ID NO: 61368 - DNA, 20 bp, Artificial Sequence
  Description of Artificial Sequence: Synthetic oligonucleotide
  Target: SCN10A; (+) strand; PAM type: YTN; PAM sequence: CTC
ccataggaagaattctcaac

SEQ ID NO: 61369 - DNA, 20 bp, Artificial Sequence
  Description of Artificial Sequence: Synthetic oligonucleotide
  Target: SCN10A; (+) strand; PAM type: YTN; PAM sequence: TTC
tcaaccaccccaccccaaga

SEQ ID NO: 61370 - DNA, 20 bp, Artificial Sequence
  Description of Artificial Sequence: Synthetic oligonucleotide
  Target: SCN10A; (+) strand; PAM type: YTN; PAM sequence: CTC
aaccaccccaccccaagagt

SEQ ID NO: 61371 - DNA, 20 bp, Artificial Sequence
  Description of Artificial Sequence: Synthetic oligonucleotide
  Target: SCN10A; (+) strand; PAM type: YTN; PAM sequence: CTC
atgtctctgtgtctccaaga

SEQ ID NO: 61372 - DNA, 20 bp, Artificial Sequence
  Description of Artificial Sequence: Synthetic oligonucleotide
  Target: SCN10A; (+) strand; PAM type: YTN; PAM sequence: CTC
tgtgtctccaagatactaat

SEQ ID NO: 61373 - DNA, 20 bp, Artificial Sequence
  Description of Artificial Sequence: Synthetic oligonucleotide
  Target: SCN10A; (+) strand; PAM type: YTN; PAM sequence: CTG
tgtctccaagatactaattg

SEQ ID NO: 61374 - DNA, 20 bp, Artificial Sequence
  Description of Artificial Sequence: Synthetic oligonucleotide
  Target: SCN10A; (+) strand; PAM type: YTN; PAM sequence: CTC
caagatactaattgccccca

SEQ ID NO: 61375 - DNA, 20 bp, Artificial Sequence
  Description of Artificial Sequence: Synthetic oligonucleotide
  Target: SCN10A; (+) strand; PAM type: YTN; PAM sequence: CTA
attgcccccagcagtgctca

SEQ ID NO: 61376 - DNA, 20 bp, Artificial Sequence
  Description of Artificial Sequence: Synthetic oligonucleotide
  Target: SCN10A; (+) strand; PAM type: YTN; PAM sequence: TTG
cccccagcagtgctcaacac

SEQ ID NO: 61377 - DNA, 20 bp, Artificial Sequence
  Description of Artificial Sequence: Synthetic oligonucleotide
  Target: SCN10A; (+) strand; PAM type: YTN; PAM sequence: CTC
aacacattcacccttataat

SEQ ID NO: 61378 - DNA, 20 bp, Artificial Sequence
  Description of Artificial Sequence: Synthetic oligonucleotide
  Target: SCN10A; (+) strand; PAM type: YTN; PAM sequence: TTC
acccttataatacatttatt

SEQ ID NO: 61379 - DNA, 20 bp, Artificial Sequence
  Description of Artificial Sequence: Synthetic oligonucleotide
  Target: SCN10A; (+) strand; PAM type: YTN; PAM sequence: CTT
ataatacatttatttccatg

SEQ ID NO: 61380 - DNA, 20 bp, Artificial Sequence
  Description of Artificial Sequence: Synthetic oligonucleotide
  Target: SCN10A; (+) strand; PAM type: YTN; PAM sequence: TTA
taatacatttatttccatgt

SEQ ID NO: 61381 - DNA, 20 bp, Artificial Sequence
  Description of Artificial Sequence: Synthetic oligonucleotide
  Target: SCN10A; (+) strand; PAM type: YTN; PAM sequence: TTT
atttccatgtgtgtcttgtc

SEQ ID NO: 61382 - DNA, 20 bp, Artificial Sequence
  Description of Artificial Sequence: Synthetic oligonucleotide
  Target: SCN10A; (+) strand; PAM type: YTN; PAM sequence: TTA
tttccatgtgtgtcttgtct

SEQ ID NO: 61383 - DNA, 20 bp, Artificial Sequence
  Description of Artificial Sequence: Synthetic oligonucleotide
  Target: SCN10A; (+) strand; PAM type: YTN; PAM sequence: TTT
ccatgtgtgtcttgtctgct

SEQ ID NO: 61384 - DNA, 20 bp, Artificial Sequence
  Description of Artificial Sequence: Synthetic oligonucleotide
  Target: SCN10A; (+) strand; PAM type: YTN; PAM sequence: TTC
catgtgtgtcttgtctgctg

SEQ ID NO: 61385 - DNA, 20 bp, Artificial Sequence
  Description of Artificial Sequence: Synthetic oligonucleotide
  Target: SCN10A; (+) strand; PAM type: YTN; PAM sequence: CTT
gtctgctgaaagactaaagt

SEQ ID NO: 61386 - DNA, 20 bp, Artificial Sequence
  Description of Artificial Sequence: Synthetic oligonucleotide
  Target: SCN10A; (+) strand; PAM type: YTN; PAM sequence: TTG
tctgctgaaagactaaagtg

SEQ ID NO: 61387 - DNA, 20 bp, Artificial Sequence
  Description of Artificial Sequence: Synthetic oligonucleotide
  Target: SCN10A; (+) strand; PAM type: YTN; PAM sequence: CTG
ctgaaagactaaagtgtaag

SEQ ID NO: 61388 - DNA, 20 bp, Artificial Sequence
  Description of Artificial Sequence: Synthetic oligonucleotide
  Target: SCN10A; (+) strand; PAM type: YTN; PAM sequence: CTG
aaagactaaagtgtaagatc

SEQ ID NO: 61389 - DNA, 20 bp, Artificial Sequence
  Description of Artificial Sequence: Synthetic oligonucleotide
  Target: SCN10A; (+) strand; PAM type: YTN; PAM sequence: CTA
aagtgtaagatcctggagat

SEQ ID NO: 61390 - DNA, 20 bp, Artificial Sequence
  Description of Artificial Sequence: Synthetic oligonucleotide
  Target: SCN10A; (+) strand; PAM type: YTN; PAM sequence: CTG
gagatagtgagtatttattc

SEQ ID NO: 61391 - DNA, 20 bp, Artificial Sequence
  Description of Artificial Sequence: Synthetic oligonucleotide
  Target: SCN10A; (+) strand; PAM type: YTN; PAM sequence: TTT
attctgtgcttctgtttctt

SEQ ID NO: 61392 - DNA, 20 bp, Artificial Sequence
  Description of Artificial Sequence: Synthetic oligonucleotide
  Target: SCN10A; (+) strand; PAM type: YTN; PAM sequence: TTA
ttctgtgcttctgtttctta

SEQ ID NO: 61393 - DNA, 20 bp, Artificial Sequence
  Description of Artificial Sequence: Synthetic oligonucleotide
  Target: SCN10A; (+) strand; PAM type: YTN; PAM sequence: TTC
tgtgcttctgtttcttacaa

SEQ ID NO: 61394 - DNA, 20 bp, Artificial Sequence
  Description of Artificial Sequence: Synthetic oligonucleotide
  Target: SCN10A; (+) strand; PAM type: YTN; PAM sequence: CTG
tgcttctgtttcttacaaag

SEQ ID NO: 61395 - DNA, 20 bp, Artificial Sequence
  Description of Artificial Sequence: Synthetic oligonucleotide
  Target: SCN10A; (+) strand; PAM type: YTN; PAM sequence: CTT
ctgtttcttacaaagcactt

SEQ ID NO: 61396 - DNA, 20 bp, Artificial Sequence
  Description of Artificial Sequence: Synthetic oligonucleotide
  Target: SCN10A; (+) strand; PAM type: YTN; PAM sequence: TTC
tgtttcttacaaagcacttc

SEQ ID NO: 61397 - DNA, 20 bp, Artificial Sequence
  Description of Artificial Sequence: Synthetic oligonucleotide
  Target: SCN10A; (+) strand; PAM type: YTN; PAM sequence: CTG
tttcttacaaagcacttcat

SEQ ID NO: 61398 - DNA, 20 bp, Artificial Sequence
  Description of Artificial Sequence: Synthetic oligonucleotide
  Target: SCN10A; (+) strand; PAM type: YTN; PAM sequence: TTT
cttacaaagcacttcataag

SEQ ID NO: 61399 - DNA, 20 bp, Artificial Sequence
  Description of Artificial Sequence: Synthetic oligonucleotide
  Target: SCN10A; (+) strand; PAM type: YTN; PAM sequence: TTC
ttacaaagcacttcataaga

SEQ ID NO: 61400 - DNA, 20 bp, Artificial Sequence
  Description of Artificial Sequence: Synthetic oligonucleotide
  Target: SCN10A; (+) strand; PAM type: YTN; PAM sequence: CTT
acaaagcacttcataagaca

SEQ ID NO: 61401 - DNA, 20 bp, Artificial Sequence
  Description of Artificial Sequence: Synthetic oligonucleotide
  Target: SCN10A; (+) strand; PAM type: YTN; PAM sequence: TTA
caaagcacttcataagacaa

SEQ ID NO: 61402 - DNA, 20 bp, Artificial Sequence
  Description of Artificial Sequence: Synthetic oligonucleotide
  Target: SCN10A; (+) strand; PAM type: YTN; PAM sequence: CTT
cataagacaatcctgtattc

SEQ ID NO: 61403 - DNA, 20 bp, Artificial Sequence
  Description of Artificial Sequence: Synthetic oligonucleotide
  Target: SCN10A; (+) strand; PAM type: YTN; PAM sequence: TTC
ataagacaatcctgtattca

SEQ ID NO: 61404 - DNA, 20 bp, Artificial Sequence
  Description of Artificial Sequence: Synthetic oligonucleotide
  Target: SCN10A; (+) strand; PAM type: YTN; PAM sequence: CTG
tattcaatagttagatgtat

SEQ ID NO: 61405 - DNA, 20 bp, Artificial Sequence
  Description of Artificial Sequence: Synthetic oligonucleotide
  Target: SCN10A; (+) strand; PAM type: YTN; PAM sequence: TTC
aatagttagatgtatagcaa

SEQ ID NO: 61406 - DNA, 20 bp, Artificial Sequence
  Description of Artificial Sequence: Synthetic oligonucleotide
  Target: SCN10A; (+) strand; PAM type: YTN; PAM sequence: TTA
gatgtatagcaaatggaaga

SEQ ID NO: 61407 - DNA, 20 bp, Artificial Sequence
  Description of Artificial Sequence: Synthetic oligonucleotide
  Target: SCN10A; (+) strand; PAM type: YTN; PAM sequence: TTG
ggatggctagaaggaaagaa

SEQ ID NO: 61408 - DNA, 20 bp, Artificial Sequence
  Description of Artificial Sequence: Synthetic oligonucleotide
  Target: SCN10A; (+) strand; PAM type: YTN; PAM sequence: CTA
gaaggaaagaaagaaagaag

SEQ ID NO: 61409 - DNA, 20 bp, Artificial Sequence
  Description of Artificial Sequence: Synthetic oligonucleotide
  Target: SCN10A; (+) strand; PAM type: YTN; PAM sequence: CTG
gatgaaaagttgaagggtga

SEQ ID NO: 61410 - DNA, 20 bp, Artificial Sequence
  Description of Artificial Sequence: Synthetic oligonucleotide
  Target: SCN10A; (+) strand; PAM type: YTN; PAM sequence: TTG
aagggtgattgcatagaggg

SEQ ID NO: 61411 - DNA, 20 bp, Artificial Sequence
  Description of Artificial Sequence: Synthetic oligonucleotide
  Target: SCN10A; (+) strand; PAM type: YTN; PAM sequence: TTG
catagagggatgaattaaag

SEQ ID NO: 61412 - DNA, 20 bp, Artificial Sequence
  Description of Artificial Sequence: Synthetic oligonucleotide
  Target: SCN10A; (+) strand; PAM type: YTN; PAM sequence: TTA
aaggatacaatgataaatag

SEQ ID NO: 61413 - DNA, 20 bp, Artificial Sequence
  Description of Artificial Sequence: Synthetic oligonucleotide
  Target: SCN10A; (+) strand; PAM type: YTN; PAM sequence: TTT
aatgtataacatgaatacta

SEQ ID NO: 61414 - DNA, 20 bp, Artificial Sequence
  Description of Artificial Sequence: Synthetic oligonucleotide
  Target: SCN10A; (+) strand; PAM type: YTN; PAM sequence: TTA
atgtataacatgaatactat

SEQ ID NO: 61415 - DNA, 20 bp, Artificial Sequence
  Description of Artificial Sequence: Synthetic oligonucleotide
  Target: SCN10A; (+) strand; PAM type: YTN; PAM sequence: CTA
tagttaataatagcatattg

SEQ ID NO: 61416 - DNA, 20 bp, Artificial Sequence
  Description of Artificial Sequence: Synthetic oligonucleotide
  Target: SCN10A; (+) strand; PAM type: YTN; PAM sequence: TTA
ataatagcatattgttttca

SEQ ID NO: 61417 - DNA, 20 bp, Artificial Sequence
  Description of Artificial Sequence: Synthetic oligonucleotide
  Target: SCN10A; (+) strand; PAM type: YTN; PAM sequence: TTG
ttttcagtatttttgctcgc

SEQ ID NO: 61418 - DNA, 20 bp, Artificial Sequence
  Description of Artificial Sequence: Synthetic oligonucleotide
  Target: SCN10A; (+) strand; PAM type: YTN; PAM sequence: TTT
tcagtatttttgctcgctga

SEQ ID NO: 61419 - DNA, 20 bp, Artificial Sequence
  Description of Artificial Sequence: Synthetic oligonucleotide
  Target: SCN10A; (+) strand; PAM type: YTN; PAM sequence: TTT
cagtatttttgctcgctgag

SEQ ID NO: 61420 - DNA, 20 bp, Artificial Sequence
  Description of Artificial Sequence: Synthetic oligonucleotide
  Target: SCN10A; (+) strand; PAM type: YTN; PAM sequence: TTC
agtatttttgctcgctgagt

SEQ ID NO: 61421 - DNA, 20 bp, Artificial Sequence
  Description of Artificial Sequence: Synthetic oligonucleotide
  Target: SCN10A; (+) strand; PAM type: YTN; PAM sequence: TTT
ttgctcgctgagtaattata

SEQ ID NO: 61422 - DNA, 20 bp, Artificial Sequence
  Description of Artificial Sequence: Synthetic oligonucleotide
  Target: SCN10A; (+) strand; PAM type: YTN; PAM sequence: TTT
tgctcgctgagtaattatag

SEQ ID NO: 61423 - DNA, 20 bp, Artificial Sequence
  Description of Artificial Sequence: Synthetic oligonucleotide
  Target: SCN10A; (+) strand; PAM type: YTN; PAM sequence: TTT
gctcgctgagtaattatagc

SEQ ID NO: 61424 - DNA, 20 bp, Artificial Sequence
  Description of Artificial Sequence: Synthetic oligonucleotide
  Target: SCN10A; (+) strand; PAM type: YTN; PAM sequence: TTG
ctcgctgagtaattatagct

SEQ ID NO: 61425 - DNA, 20 bp, Artificial Sequence
  Description of Artificial Sequence: Synthetic oligonucleotide
  Target: SCN10A; (+) strand; PAM type: YTN; PAM sequence: CTC
gctgagtaattatagctgct

SEQ ID NO: 61426 - DNA, 20 bp, Artificial Sequence
  Description of Artificial Sequence: Synthetic oligonucleotide
  Target: SCN10A; (+) strand; PAM type: YTN; PAM sequence: CTG
agtaattatagctgctcttg

SEQ ID NO: 61427 - DNA, 20 bp, Artificial Sequence
  Description of Artificial Sequence: Synthetic oligonucleotide
  Target: SCN10A; (+) strand; PAM type: YTN; PAM sequence: TTA
tagctgctcttgccacaggg

SEQ ID NO: 61428 - DNA, 20 bp, Artificial Sequence
  Description of Artificial Sequence: Synthetic oligonucleotide
  Target: SCN10A; (+) strand; PAM type: YTN; PAM sequence: CTG
ctcttgccacagggggagaa

SEQ ID NO: 61429 - DNA, 20 bp, Artificial Sequence
  Description of Artificial Sequence: Synthetic oligonucleotide
  Target: SCN10A; (+) strand; PAM type: YTN; PAM sequence: CTC
ttgccacagggggagaaatg

SEQ ID NO: 61430 - DNA, 20 bp, Artificial Sequence
  Description of Artificial Sequence: Synthetic oligonucleotide
  Target: SCN10A; (+) strand; PAM type: YTN; PAM sequence: CTT
gccacagggggagaaatggg

SEQ ID NO: 61431 - DNA, 20 bp, Artificial Sequence
  Description of Artificial Sequence: Synthetic oligonucleotide
  Target: SCN10A; (+) strand; PAM type: YTN; PAM sequence: TTG
ccacagggggagaaatgggt

SEQ ID NO: 61432 - DNA, 20 bp, Artificial Sequence
  Description of Artificial Sequence: Synthetic oligonucleotide
  Target: SCN10A; (+) strand; PAM type: YTN; PAM sequence: CTA
tgtgagatgatggatatgtt

SEQ ID NO: 61433 - DNA, 20 bp, Artificial Sequence
  Description of Artificial Sequence: Synthetic oligonucleotide
  Target: SCN10A; (+) strand; PAM type: YTN; PAM sequence: TTA
atatgttccactatagtaat

SEQ ID NO: 61434 - DNA, 20 bp, Artificial Sequence
  Description of Artificial Sequence: Synthetic oligonucleotide
  Target: SCN10A; (+) strand; PAM type: YTN; PAM sequence: TTC
cactatagtaatcatttata

SEQ ID NO: 61435 - DNA, 20 bp, Artificial Sequence
  Description of Artificial Sequence: Synthetic oligonucleotide
  Target: SCN10A; (+) strand; PAM type: YTN; PAM sequence: CTA
tagtaatcatttatatatat

SEQ ID NO: 61436 - DNA, 20 bp, Artificial Sequence
  Description of Artificial Sequence: Synthetic oligonucleotide
  Target: SCN10A; (+) strand; PAM type: YTN; PAM sequence: TTT
atatatatatatatcttata

SEQ ID NO: 61437 - DNA, 20 bp, Artificial Sequence
  Description of Artificial Sequence: Synthetic oligonucleotide
  Target: SCN10A; (+) strand; PAM type: YTN; PAM sequence: TTA
tatatatatatatcttataa

SEQ ID NO: 61438 - DNA, 20 bp, Artificial Sequence
  Description of Artificial Sequence: Synthetic oligonucleotide
  Target: SCN10A; (+) strand; PAM type: YTN; PAM sequence: CTT
ataacatcattttgtatccc

SEQ ID NO: 61439 - DNA, 20 bp, Artificial Sequence
  Description of Artificial Sequence: Synthetic oligonucleotide
  Target: SCN10A; (+) strand; PAM type: YTN; PAM sequence: TTA
taacatcattttgtatccct

SEQ ID NO: 61440 - DNA, 20 bp, Artificial Sequence
  Description of Artificial Sequence: Synthetic oligonucleotide
  Target: SCN10A; (+) strand; PAM type: YTN; PAM sequence: TTT
tgtatcccttaaaaattgat

SEQ ID NO: 61441 - DNA, 20 bp, Artificial Sequence
  Description of Artificial Sequence: Synthetic oligonucleotide
  Target: SCN10A; (+) strand; PAM type: YTN; PAM sequence: TTT
gtatcccttaaaaattgata

SEQ ID NO: 61442 - DNA, 20 bp, Artificial Sequence
  Description of Artificial Sequence: Synthetic oligonucleotide
  Target: SCN10A; (+) strand; PAM type: YTN; PAM sequence: TTG
tatcccttaaaaattgatat

SEQ ID NO: 61443 - DNA, 20 bp, Artificial Sequence
  Description of Artificial Sequence: Synthetic oligonucleotide
  Target: SCN10A; (+) strand; PAM type: YTN; PAM sequence: CTT
aaaaattgatatggtttggc

SEQ ID NO: 61444 - DNA, 20 bp, Artificial Sequence
  Description of Artificial Sequence: Synthetic oligonucleotide
  Target: SCN10A; (+) strand; PAM type: YTN; PAM sequence: TTA
aaaattgatatggtttggct

SEQ ID NO: 61445 - DNA, 20 bp, Artificial Sequence
  Description of Artificial Sequence: Synthetic oligonucleotide
  Target: SCN10A; (+) strand; PAM type: YTN; PAM sequence: TTG
atatggtttggctgtgtccc

SEQ ID NO: 61446 - DNA, 20 bp, Artificial Sequence
  Description of Artificial Sequence: Synthetic oligonucleotide
  Target: SCN10A; (+) strand; PAM type: YTN; PAM sequence: TTT
ggctgtgtccccacccaaat

SEQ ID NO: 61447 - DNA, 20 bp, Artificial Sequence
  Description of Artificial Sequence: Synthetic oligonucleotide
  Target: SCN10A; (+) strand; PAM type: YTN; PAM sequence: TTG
gctgtgtccccacccaaatc

SEQ ID NO: 61448 - DNA, 20 bp, Artificial Sequence
  Description of Artificial Sequence: Synthetic oligonucleotide
  Target: SCN10A; (+) strand; PAM type: YTN; PAM sequence: CTG
tgtccccacccaaatcttat

SEQ ID NO: 61449 - DNA, 20 bp, Artificial Sequence
  Description of Artificial Sequence: Synthetic oligonucleotide
  Target: SCN10A; (+) strand; PAM type: YTN; PAM sequence: CTT
atcttgaattcccatgtgtt

SEQ ID NO: 61450 - DNA, 20 bp, Artificial Sequence
  Description of Artificial Sequence: Synthetic oligonucleotide
  Target: SCN10A; (+) strand; PAM type: YTN; PAM sequence: TTA
tcttgaattcccatgtgttg

SEQ ID NO: 61451 - DNA, 20 bp, Artificial Sequence
  Description of Artificial Sequence: Synthetic oligonucleotide
  Target: SCN10A; (+) strand; PAM type: YTN; PAM sequence: CTT
gaattcccatgtgttgtggg

SEQ ID NO: 61452 - DNA, 20 bp, Artificial Sequence
  Description of Artificial Sequence: Synthetic oligonucleotide
  Target: SCN10A; (+) strand; PAM type: YTN; PAM sequence: TTG
aattcccatgtgttgtggga

SEQ ID NO: 61453 - DNA, 20 bp, Artificial Sequence
  Description of Artificial Sequence: Synthetic oligonucleotide
  Target: SCN10A; (+) strand; PAM type: YTN; PAM sequence: TTC
ccatgtgttgtgggagggga

SEQ ID NO: 61454 - DNA, 20 bp, Artificial Sequence
  Description of Artificial Sequence: Synthetic oligonucleotide
  Target: SCN10A; (+) strand; PAM type: YTN; PAM sequence: TTG
tgggaggggagggaccctgt

SEQ ID NO: 61455 - DNA, 20 bp, Artificial Sequence
  Description of Artificial Sequence: Synthetic oligonucleotide
  Target: SCN10A; (+) strand; PAM type: YTN; PAM sequence: CTG
tgggaggtaagtgaatcatg

SEQ ID NO: 61456 - DNA, 20 bp, Artificial Sequence
  Description of Artificial Sequence: Synthetic oligonucleotide
  Target: SCN10A; (+) strand; PAM type: YTN; PAM sequence: CTT
tcccatgctgttctcatgat

SEQ ID NO: 61457 - DNA, 20 bp, Artificial Sequence
  Description of Artificial Sequence: Synthetic oligonucleotide
  Target: SCN10A; (+) strand; PAM type: YTN; PAM sequence: TTT
cccatgctgttctcatgata

SEQ ID NO: 61458 - DNA, 20 bp, Artificial Sequence
  Description of Artificial Sequence: Synthetic oligonucleotide
  Target: SCN10A; (+) strand; PAM type: YTN; PAM sequence: TTC
ccatgctgttctcatgatag

SEQ ID NO: 61459 - DNA, 20 bp, Artificial Sequence
  Description of Artificial Sequence: Synthetic oligonucleotide
  Target: SCN10A; (+) strand; PAM type: YTN; PAM sequence: CTG
ttctcatgatagtgaataag

SEQ ID NO: 61460 - DNA, 20 bp, Artificial Sequence
  Description of Artificial Sequence: Synthetic oligonucleotide
  Target: SCN10A; (+) strand; PAM type: YTN; PAM sequence: TTC
tcatgatagtgaataagttt

SEQ ID NO: 61461 - DNA, 20 bp, Artificial Sequence
  Description of Artificial Sequence: Synthetic oligonucleotide
  Target: SCN10A; (+) strand; PAM type: YTN; PAM sequence: CTC
atgatagtgaataagtttca

SEQ ID NO: 61462 - DNA, 20 bp, Artificial Sequence
  Description of Artificial Sequence: Synthetic oligonucleotide
  Target: SCN10A; (+) strand; PAM type: YTN; PAM sequence: TTT
catgagatgtgacggtatta

SEQ ID NO: 61463 - DNA, 20 bp, Artificial Sequence
  Description of Artificial Sequence: Synthetic oligonucleotide
  Target: SCN10A; (+) strand; PAM type: YTN; PAM sequence: TTC
atgagatgtgacggtattat

SEQ ID NO: 61464 - DNA, 20 bp, Artificial Sequence
  Description of Artificial Sequence: Synthetic oligonucleotide
  Target: SCN10A; (+) strand; PAM type: YTN; PAM sequence: TTA
taagggggagtttccctgcc

SEQ ID NO: 61465 - DNA, 20 bp, Artificial Sequence
  Description of Artificial Sequence: Synthetic oligonucleotide
  Target: SCN10A; (+) strand; PAM type: YTN; PAM sequence: TTT
ccctgcccaacctctctctt

SEQ ID NO: 61466 - DNA, 20 bp, Artificial Sequence
  Description of Artificial Sequence: Synthetic oligonucleotide
  Target: SCN10A; (+) strand; PAM type: YTN; PAM sequence: TTC
cctgcccaacctctctcttt

SEQ ID NO: 61467 - DNA, 20 bp, Artificial Sequence
  Description of Artificial Sequence: Synthetic oligonucleotide
  Target: SCN10A; (+) strand; PAM type: YTN; PAM sequence: CTG
cccaacctctctctttgcct

SEQ ID NO: 61468 - DNA, 20 bp, Artificial Sequence
  Description of Artificial Sequence: Synthetic oligonucleotide
  Target: SCN10A; (+) strand; PAM type: YTN; PAM sequence: CTC
tctctttgcctgctgccatc

SEQ ID NO: 61469 - DNA, 20 bp, Artificial Sequence
  Description of Artificial Sequence: Synthetic oligonucleotide
  Target: SCN10A; (+) strand; PAM type: YTN; PAM sequence: CTC
tctttgcctgctgccatcca

SEQ ID NO: 61470 - DNA, 20 bp, Artificial Sequence
  Description of Artificial Sequence: Synthetic oligonucleotide
  Target: SCN10A; (+) strand; PAM type: YTN; PAM sequence: CTC
tttgcctgctgccatccaca

SEQ ID NO: 61471 - DNA, 20 bp, Artificial Sequence
  Description of Artificial Sequence: Synthetic oligonucleotide
  Target: SCN10A; (+) strand; PAM type: YTN; PAM sequence: CTT
tgcctgctgccatccacata

SEQ ID NO: 61472 - DNA, 20 bp, Artificial Sequence
  Description of Artificial Sequence: Synthetic oligonucleotide
  Target: SCN10A; (+) strand; PAM type: YTN; PAM sequence: TTT
gcctgctgccatccacataa

SEQ ID NO: 61473 - DNA, 20 bp, Artificial Sequence
  Description of Artificial Sequence: Synthetic oligonucleotide
  Target: SCN10A; (+) strand; PAM type: YTN; PAM sequence: TTG
cctgctgccatccacataag

SEQ ID NO: 61474 - DNA, 20 bp, Artificial Sequence
  Description of Artificial Sequence: Synthetic oligonucleotide
  Target: SCN10A; (+) strand; PAM type: YTN; PAM sequence: CTG
ctgccatccacataagacgt

SEQ ID NO: 61475 - DNA, 20 bp, Artificial Sequence
  Description of Artificial Sequence: Synthetic oligonucleotide
  Target: SCN10A; (+) strand; PAM type: YTN; PAM sequence: CTG
ccatccacataagacgtgac

SEQ ID NO: 61476 - DNA, 20 bp, Artificial Sequence
  Description of Artificial Sequence: Synthetic oligonucleotide
  Target: SCN10A; (+) strand; PAM type: YTN; PAM sequence: CTC
gcacctcctttccttttgcc

SEQ ID NO: 61477 - DNA, 20 bp, Artificial Sequence
  Description of Artificial Sequence: Synthetic oligonucleotide
  Target: SCN10A; (+) strand; PAM type: YTN; PAM sequence: CTC
ctttccttttgccatgattg

SEQ ID NO: 61478 - DNA, 20 bp, Artificial Sequence
  Description of Artificial Sequence: Synthetic oligonucleotide
  Target: SCN10A; (+) strand; PAM type: YTN; PAM sequence: CTT
tccttttgccatgattgtaa

SEQ ID NO: 61479 - DNA, 20 bp, Artificial Sequence
  Description of Artificial Sequence: Synthetic oligonucleotide
  Target: SCN10A; (+) strand; PAM type: YTN; PAM sequence: TTT
ccttttgccatgattgtaag

SEQ ID NO: 61480 - DNA, 20 bp, Artificial Sequence
  Description of Artificial Sequence: Synthetic oligonucleotide
  Target: SCN10A; (+) strand; PAM type: YTN; PAM sequence: TTC
cttttgccatgattgtaagg

SEQ ID NO: 61481 - DNA, 20 bp, Artificial Sequence
  Description of Artificial Sequence: Synthetic oligonucleotide
  Target: SCN10A; (+) strand; PAM type: YTN; PAM sequence: CTT
ttgccatgattgtaaggctt

SEQ ID NO: 61482 - DNA, 20 bp, Artificial Sequence
  Description of Artificial Sequence: Synthetic oligonucleotide
  Target: SCN10A; (+) strand; PAM type: YTN; PAM sequence: TTT
tgccatgattgtaaggcttc

SEQ ID NO: 61483 - DNA, 20 bp, Artificial Sequence
  Description of Artificial Sequence: Synthetic oligonucleotide
  Target: SCN10A; (+) strand; PAM type: YTN; PAM sequence: TTT
gccatgattgtaaggcttcc

SEQ ID NO: 61484 - DNA, 20 bp, Artificial Sequence
  Description of Artificial Sequence: Synthetic oligonucleotide
  Target: SCN10A; (+) strand; PAM type: YTN; PAM sequence: TTG
ccatgattgtaaggcttccc

SEQ ID NO: 61485 - DNA, 20 bp, Artificial Sequence
  Description of Artificial Sequence: Synthetic oligonucleotide
  Target: SCN10A; (+) strand; PAM type: YTN; PAM sequence: TTG
taaggcttccccagccatgt

SEQ ID NO: 61486 - DNA, 20 bp, Artificial Sequence
  Description of Artificial Sequence: Synthetic oligonucleotide
  Target: SCN10A; (+) strand; PAM type: YTN; PAM sequence: CTT
ccccagccatgtgaagctgt

SEQ ID NO: 61487 - DNA, 20 bp, Artificial Sequence
  Description of Artificial Sequence: Synthetic oligonucleotide
  Target: SCN10A; (+) strand; PAM type: YTN; PAM sequence: TTC
cccagccatgtgaagctgta

SEQ ID NO: 61488 - DNA, 20 bp, Artificial Sequence
  Description of Artificial Sequence: Synthetic oligonucleotide
  Target: SCN10A; (+) strand; PAM type: YTN; PAM sequence: CTG
taagtccaattaaacctctt

SEQ ID NO: 61489 - DNA, 20 bp, Artificial Sequence
  Description of Artificial Sequence: Synthetic oligonucleotide
  Target: SCN10A; (+) strand; PAM type: YTN; PAM sequence: TTA
aacctctttcttttataaat

SEQ ID NO: 61490 - DNA, 20 bp, Artificial Sequence
  Description of Artificial Sequence: Synthetic oligonucleotide
  Target: SCN10A; (+) strand; PAM type: YTN; PAM sequence: CTC
tttcttttataaattgccca

SEQ ID NO: 61491 - DNA, 20 bp, Artificial Sequence
  Description of Artificial Sequence: Synthetic oligonucleotide
  Target: SCN10A; (+) strand; PAM type: YTN; PAM sequence: CTT
tcttttataaattgcccagt

SEQ ID NO: 61492 - DNA, 20 bp, Artificial Sequence
  Description of Artificial Sequence: Synthetic oligonucleotide
  Target: SCN10A; (+) strand; PAM type: YTN; PAM sequence: TTT
cttttataaattgcccagtc

SEQ ID NO: 61493 - DNA, 20 bp, Artificial Sequence
  Description of Artificial Sequence: Synthetic oligonucleotide
  Target: SCN10A; (+) strand; PAM type: YTN; PAM sequence: TTC
ttttataaattgcccagtct

SEQ ID NO: 61494 - DNA, 20 bp, Artificial Sequence
  Description of Artificial Sequence: Synthetic oligonucleotide
  Target: SCN10A; (+) strand; PAM type: YTN; PAM sequence: CTT
ttataaattgcccagtctta

SEQ ID NO: 61495 - DNA, 20 bp, Artificial Sequence
  Description of Artificial Sequence: Synthetic oligonucleotide
  Target: SCN10A; (+) strand; PAM type: YTN; PAM sequence: TTT
tataaattgcccagtcttag

SEQ ID NO: 61496 - DNA, 20 bp, Artificial Sequence
  Description of Artificial Sequence: Synthetic oligonucleotide
  Target: SCN10A; (+) strand; PAM type: YTN; PAM sequence: TTT
ataaattgcccagtcttagg

SEQ ID NO: 61497 - DNA, 20 bp, Artificial Sequence
  Description of Artificial Sequence: Synthetic oligonucleotide
  Target: SCN10A; (+) strand; PAM type: YTN; PAM sequence: TTA
taaattgcccagtcttaggt

SEQ ID NO: 61498 - DNA, 20 bp, Artificial Sequence
  Description of Artificial Sequence: Synthetic oligonucleotide
  Target: SCN10A; (+) strand; PAM type: YTN; PAM sequence: TTG
cccagtcttaggtatgtctt

SEQ ID NO: 61499 - DNA, 20 bp, Artificial Sequence
  Description of Artificial Sequence: Synthetic oligonucleotide
  Target: SCN10A; (+) strand; PAM type: YTN; PAM sequence: CTT
aggtatgtctttatcagcag

SEQ ID NO: 61500 - DNA, 20 bp, Artificial Sequence
  Description of Artificial Sequence: Synthetic oligonucleotide
  Target: SCN10A; (+) strand; PAM type: YTN; PAM sequence: TTA
ggtatgtctttatcagcagc

SEQ ID NO: 61501 - DNA, 20 bp, Artificial Sequence
  Description of Artificial Sequence: Synthetic oligonucleotide
  Target: SCN10A; (+) strand; PAM type: YTN; PAM sequence: CTT
tatcagcagcatgaaaatag

SEQ ID NO: 61502 - DNA, 20 bp, Artificial Sequence
  Description of Artificial Sequence: Synthetic oligonucleotide
  Target: SCN10A; (+) strand; PAM type: YTN; PAM sequence: TTT
atcagcagcatgaaaataga

SEQ ID NO: 61503 - DNA, 20 bp, Artificial Sequence
  Description of Artificial Sequence: Synthetic oligonucleotide
  Target: SCN10A; (+) strand; PAM type: YTN; PAM sequence: TTA
tcagcagcatgaaaatagac

SEQ ID NO: 61504 - DNA, 20 bp, Artificial Sequence
  Description of Artificial Sequence: Synthetic oligonucleotide
  Target: SCN10A; (+) strand; PAM type: YTN; PAM sequence: CTA
atacaaatatatacaataaa

SEQ ID NO: 61505 - DNA, 20 bp, Artificial Sequence
  Description of Artificial Sequence: Synthetic oligonucleotide
  Target: SCN10A; (+) strand; PAM type: YTN; PAM sequence: TTT
tttaaaattttaaaagataa

SEQ ID NO: 61506 - DNA, 20 bp, Artificial Sequence
  Description of Artificial Sequence: Synthetic oligonucleotide
  Target: SCN10A; (+) strand; PAM type: YTN; PAM sequence: TTT
ttaaaattttaaaagataac

SEQ ID NO: 61507 - DNA, 20 bp, Artificial Sequence
  Description of Artificial Sequence: Synthetic oligonucleotide
  Target: SCN10A; (+) strand; PAM type: YTN; PAM sequence: TTT
taaaattttaaaagataaca

SEQ ID NO: 61508 - DNA, 20 bp, Artificial Sequence
  Description of Artificial Sequence: Synthetic oligonucleotide
  Target: SCN10A; (+) strand; PAM type: YTN; PAM sequence: TTT
aaaattttaaaagataacag

SEQ ID NO: 61509 - DNA, 20 bp, Artificial Sequence
  Description of Artificial Sequence: Synthetic oligonucleotide
  Target: SCN10A; (+) strand; PAM type: YTN; PAM sequence: TTA
aaattttaaaagataacaga

SEQ ID NO: 61510 - DNA, 20 bp, Artificial Sequence
  Description of Artificial Sequence: Synthetic oligonucleotide
  Target: SCN10A; (+) strand; PAM type: YTN; PAM sequence: TTT
taaaagataacagacacaaa

SEQ ID NO: 61511 - DNA, 20 bp, Artificial Sequence
  Description of Artificial Sequence: Synthetic oligonucleotide
  Target: SCN10A; (+) strand; PAM type: YTN; PAM sequence: TTT
aaaagataacagacacaaaa

SEQ ID NO: 61512 - DNA, 20 bp, Artificial Sequence
  Description of Artificial Sequence: Synthetic oligonucleotide
  Target: SCN10A; (+) strand; PAM type: YTN; PAM sequence: TTA
aaagataacagacacaaaaa

SEQ ID NO: 61513 - DNA, 20 bp, Artificial Sequence
  Description of Artificial Sequence: Synthetic oligonucleotide
  Target: SCN10A; (+) strand; PAM type: YTN; PAM sequence: TTG
aatggaaggatgggagaaac

SEQ ID NO: 61514 - DNA, 20 bp, Artificial Sequence
  Description of Artificial Sequence: Synthetic oligonucleotide
  Target: SCN10A; (+) strand; PAM type: YTN; PAM sequence: CTG
ggtaaaatgactaatgcatg

SEQ ID NO: 61515 - DNA, 20 bp, Artificial Sequence
  Description of Artificial Sequence: Synthetic oligonucleotide
  Target: SCN10A; (+) strand; PAM type: YTN; PAM sequence: CTA
atgcatgaatggaaagatgg

SEQ ID NO: 61516 - DNA, 20 bp, Artificial Sequence
  Description of Artificial Sequence: Synthetic oligonucleotide
  Target: SCN10A; (+) strand; PAM type: YTN; PAM sequence: CTG
gacagaatagatgaatggaa

SEQ ID NO: 61517 - DNA, 20 bp, Artificial Sequence
  Description of Artificial Sequence: Synthetic oligonucleotide
  Target: SCN10A; (+) strand; PAM type: YTN; PAM sequence: TTA
gtgaatgactggaaggttga

SEQ ID NO: 61518 - DNA, 20 bp, Artificial Sequence
  Description of Artificial Sequence: Synthetic oligonucleotide
  Target: SCN10A; (+) strand; PAM type: YTN; PAM sequence: CTG
gaaggttgataggatggatg

SEQ ID NO: 61519 - DNA, 20 bp, Artificial Sequence
  Description of Artificial Sequence: Synthetic oligonucleotide
  Target: SCN10A; (+) strand; PAM type: YTN; PAM sequence: TTG
ataggatggatgaatggatg

SEQ ID NO: 61520 - DNA, 20 bp, Artificial Sequence
  Description of Artificial Sequence: Synthetic oligonucleotide
  Target: SCN10A; (+) strand; PAM type: YTN; PAM sequence: TTG
aaacaagaatggaaagatag

SEQ ID NO: 61521 - DNA, 20 bp, Artificial Sequence
  Description of Artificial Sequence: Synthetic oligonucleotide
  Target: SCN10A; (+) strand; PAM type: YTN; PAM sequence: CTT
ggatggaagatgcgtgaatg

SEQ ID NO: 61522 - DNA, 20 bp, Artificial Sequence
  Description of Artificial Sequence: Synthetic oligonucleotide
  Target: SCN10A; (+) strand; PAM type: YTN; PAM sequence: TTG
gatggaagatgcgtgaatga

SEQ ID NO: 61523 - DNA, 20 bp, Artificial Sequence
  Description of Artificial Sequence: Synthetic oligonucleotide
  Target: SCN10A; (+) strand; PAM type: YTN; PAM sequence: TTA
gatgattggacagttggata

SEQ ID NO: 61524 - DNA, 20 bp, Artificial Sequence
  Description of Artificial Sequence: Synthetic oligonucleotide
  Target: SCN10A; (+) strand; PAM type: YTN; PAM sequence: TTG
gacagttggatagaagaatg

SEQ ID NO: 61525 - DNA, 20 bp, Artificial Sequence
  Description of Artificial Sequence: Synthetic oligonucleotide
  Target: SCN10A; (+) strand; PAM type: YTN; PAM sequence: TTG
gatagaagaatgaatcaaaa

SEQ ID NO: 61526 - DNA, 20 bp, Artificial Sequence
  Description of Artificial Sequence: Synthetic oligonucleotide
  Target: SCN10A; (+) strand; PAM type: YTN; PAM sequence: TTA
aggatgatgaatagatggaa

SEQ ID NO: 61527 - DNA, 20 bp, Artificial Sequence
  Description of Artificial Sequence: Synthetic oligonucleotide
  Target: SCN10A; (+) strand; PAM type: YTN; PAM sequence: TTT
agaataaaagattgggcaga

SEQ ID NO: 61528 - DNA, 20 bp, Artificial Sequence
  Description of Artificial Sequence: Synthetic oligonucleotide
  Target: SCN10A; (+) strand; PAM type: YTN; PAM sequence: TTA
gaataaaagattgggcagaa

SEQ ID NO: 61529 - DNA, 20 bp, Artificial Sequence
  Description of Artificial Sequence: Synthetic oligonucleotide
  Target: SCN10A; (+) strand; PAM type: YTN; PAM sequence: TTG
ggcagaagagaagagggaaa

SEQ ID NO: 61530 - DNA, 20 bp, Artificial Sequence
  Description of Artificial Sequence: Synthetic oligonucleotide
  Target: SCN10A; (+) strand; PAM type: YTN; PAM sequence: CTG
atgaagatgtacagctggaa

SEQ ID NO: 61531 - DNA, 20 bp, Artificial Sequence
  Description of Artificial Sequence: Synthetic oligonucleotide
  Target: SCN10A; (+) strand; PAM type: YTN; PAM sequence: CTG
gaagaaataaagatggatgg

SEQ ID NO: 61532 - DNA, 20 bp, Artificial Sequence
  Description of Artificial Sequence: Synthetic oligonucleotide
  Target: SCN10A; (+) strand; PAM type: YTN; PAM sequence: TTT
gggaggaaggaaaaaggaag

SEQ ID NO: 61533 - DNA, 20 bp, Artificial Sequence
  Description of Artificial Sequence: Synthetic oligonucleotide
  Target: SCN10A; (+) strand; PAM type: YTN; PAM sequence: TTG
ggaggaaggaaaaaggaaga

SEQ ID NO: 61534 - DNA, 20 bp, Artificial Sequence
  Description of Artificial Sequence: Synthetic oligonucleotide
  Target: SCN10A; (+) strand; PAM type: YTN; PAM sequence: CTG
aatggttggatacaaaaggt

SEQ ID NO: 61535 - DNA, 20 bp, Artificial Sequence
  Description of Artificial Sequence: Synthetic oligonucleotide
  Target: SCN10A; (+) strand; PAM type: YTN; PAM sequence: TTG
gatacaaaaggtgaaatgta

SEQ ID NO: 61536 - DNA, 20 bp, Artificial Sequence
  Description of Artificial Sequence: Synthetic oligonucleotide
  Target: SCN10A; (+) strand; PAM type: YTN; PAM sequence: TTG
gaaggaagaatcagtaggaa

SEQ ID NO: 61537 - DNA, 20 bp, Artificial Sequence
  Description of Artificial Sequence: Synthetic oligonucleotide
  Target: SCN10A; (+) strand; PAM type: YTN; PAM sequence: TTT
aaggtgattaggactgagac

SEQ ID NO: 61538 - DNA, 20 bp, Artificial Sequence
  Description of Artificial Sequence: Synthetic oligonucleotide
  Target: SCN10A; (+) strand; PAM type: YTN; PAM sequence: TTA
aggtgattaggactgagact

SEQ ID NO: 61539 - DNA, 20 bp, Artificial Sequence
  Description of Artificial Sequence: Synthetic oligonucleotide
  Target: SCN10A; (+) strand; PAM type: YTN; PAM sequence: TTA
ggactgagactggtgagatc

SEQ ID NO: 61540 - DNA, 20 bp, Artificial Sequence
  Description of Artificial Sequence: Synthetic oligonucleotide
  Target: SCN10A; (+) strand; PAM type: YTN; PAM sequence: CTG
agactggtgagatcaacata

SEQ ID NO: 61541 - DNA, 20 bp, Artificial Sequence
  Description of Artificial Sequence: Synthetic oligonucleotide
  Target: SCN10A; (+) strand; PAM type: YTN; PAM sequence: CTG
gtgagatcaacataagcagg

SEQ ID NO: 61542 - DNA, 20 bp, Artificial Sequence
  Description of Artificial Sequence: Synthetic oligonucleotide
  Target: SCN10A; (+) strand; PAM type: YTN; PAM sequence: CTG
tgcccccaaaggggtgggac

SEQ ID NO: 61543 - DNA, 20 bp, Artificial Sequence
  Description of Artificial Sequence: Synthetic oligonucleotide
  Target: SCN10A; (+) strand; PAM type: YTN; PAM sequence: TTT
tcctttcatttatgaataat

SEQ ID NO: 61544 - DNA, 20 bp, Artificial Sequence
  Description of Artificial Sequence: Synthetic oligonucleotide
  Target: SCN10A; (+) strand; PAM type: YTN; PAM sequence: TTT
cctttcatttatgaataatt

SEQ ID NO: 61545 - DNA, 20 bp, Artificial Sequence
  Description of Artificial Sequence: Synthetic oligonucleotide
  Target: SCN10A; (+) strand; PAM type: YTN; PAM sequence: TTC
ctttcatttatgaataatta

SEQ ID NO: 61546 - DNA, 20 bp, Artificial Sequence
  Description of Artificial Sequence: Synthetic oligonucleotide
  Target: SCN10A; (+) strand; PAM type: YTN; PAM sequence: CTT
tcatttatgaataattattt

SEQ ID NO: 61547 - DNA, 20 bp, Artificial Sequence
  Description of Artificial Sequence: Synthetic oligonucleotide
  Target: SCN10A; (+) strand; PAM type: YTN; PAM sequence: TTT
catttatgaataattatttc

SEQ ID NO: 61548 - DNA, 20 bp, Artificial Sequence
  Description of Artificial Sequence: Synthetic oligonucleotide
  Target: SCN10A; (+) strand; PAM type: YTN; PAM sequence: TTC
atttatgaataattatttca

SEQ ID NO: 61549 - DNA, 20 bp, Artificial Sequence
  Description of Artificial Sequence: Synthetic oligonucleotide
  Target: SCN10A; (+) strand; PAM type: YTN; PAM sequence: TTT
atgaataattatttcatatg

SEQ ID NO: 61550 - DNA, 20 bp, Artificial Sequence
  Description of Artificial Sequence: Synthetic oligonucleotide
  Target: SCN10A; (+) strand; PAM type: YTN; PAM sequence: TTA
tgaataattatttcatatgc

SEQ ID NO: 61551 - DNA, 20 bp, Artificial Sequence
  Description of Artificial Sequence: Synthetic oligonucleotide
  Target: SCN10A; (+) strand; PAM type: YTN; PAM sequence: TTA
tttcatatgcacagaattat

SEQ ID NO: 61552 - DNA, 20 bp, Artificial Sequence
  Description of Artificial Sequence: Synthetic oligonucleotide
  Target: SCN10A; (+) strand; PAM type: YTN; PAM sequence: TTT
catatgcacagaattatcac

SEQ ID NO: 61553 - DNA, 20 bp, Artificial Sequence
  Description of Artificial Sequence: Synthetic oligonucleotide
  Target: SCN10A; (+) strand; PAM type: YTN; PAM sequence: TTC
atatgcacagaattatcacc

SEQ ID NO: 61554 - DNA, 20 bp, Artificial Sequence
  Description of Artificial Sequence: Synthetic oligonucleotide
  Target: SCN10A; (+) strand; PAM type: YTN; PAM sequence: TTA
tcacccatgactcagatttc

SEQ ID NO: 61555 - DNA, 20 bp, Artificial Sequence
  Description of Artificial Sequence: Synthetic oligonucleotide
  Target: SCN10A; (+) strand; PAM type: YTN; PAM sequence: CTC
agatttcaggcctcacagct

SEQ ID NO: 61556 - DNA, 20 bp, Artificial Sequence
  Description of Artificial Sequence: Synthetic oligonucleotide
  Target: SCN10A; (+) strand; PAM type: YTN; PAM sequence: TTT
caggcctcacagctaatcct

SEQ ID NO: 61557 - DNA, 20 bp, Artificial Sequence
  Description of Artificial Sequence: Synthetic oligonucleotide
  Target: SCN10A; (+) strand; PAM type: YTN; PAM sequence: TTC
aggcctcacagctaatcctt

SEQ ID NO: 61558 - DNA, 20 bp, Artificial Sequence
  Description of Artificial Sequence: Synthetic oligonucleotide
  Target: SCN10A; (+) strand; PAM type: YTN; PAM sequence: CTC
acagctaatccttgtggtac

SEQ ID NO: 61559 - DNA, 20 bp, Artificial Sequence
  Description of Artificial Sequence: Synthetic oligonucleotide
  Target: SCN10A; (+) strand; PAM type: YTN; PAM sequence: CTA
atccttgtggtacagtggcc

SEQ ID NO: 61560 - DNA, 20 bp, Artificial Sequence
  Description of Artificial Sequence: Synthetic oligonucleotide
  Target: SCN10A; (+) strand; PAM type: YTN; PAM sequence: CTT
gtggtacagtggcctgaagc

SEQ ID NO: 61561 - DNA, 20 bp, Artificial Sequence
  Description of Artificial Sequence: Synthetic oligonucleotide
  Target: SCN10A; (+) strand; PAM type: YTN; PAM sequence: TTG
tggtacagtggcctgaagct

SEQ ID NO: 61562 - DNA, 20 bp, Artificial Sequence
  Description of Artificial Sequence: Synthetic oligonucleotide
  Target: SCN10A; (+) strand; PAM type: YTN; PAM sequence: CTG
aagctgctagtgcattggca

SEQ ID NO: 61563 - DNA, 20 bp, Artificial Sequence
  Description of Artificial Sequence: Synthetic oligonucleotide
  Target: SCN10A; (+) strand; PAM type: YTN; PAM sequence: CTG
ctagtgcattggcatcaggg

SEQ ID NO: 61564 - DNA, 20 bp, Artificial Sequence
  Description of Artificial Sequence: Synthetic oligonucleotide
  Target: SCN10A; (+) strand; PAM type: YTN; PAM sequence: CTA
gtgcattggcatcagggaag

SEQ ID NO: 61565 - DNA, 20 bp, Artificial Sequence
  Description of Artificial Sequence: Synthetic oligonucleotide
  Target: SCN10A; (+) strand; PAM type: YTN; PAM sequence: TTG
gcatcagggaagaagagaat

SEQ ID NO: 61566 - DNA, 20 bp, Artificial Sequence
  Description of Artificial Sequence: Synthetic oligonucleotide
  Target: SCN10A; (+) strand; PAM type: YTN; PAM sequence: TTG
aatgcacaggcctgctatgg

SEQ ID NO: 61567 - DNA, 20 bp, Artificial Sequence
  Description of Artificial Sequence: Synthetic oligonucleotide
  Target: SCN10A; (+) strand; PAM type: YTN; PAM sequence: CTG
ctatggaggacctgccagca

SEQ ID NO: 61568 - DNA, 20 bp, Artificial Sequence
  Description of Artificial Sequence: Synthetic oligonucleotide
  Target: SCN10A; (+) strand; PAM type: YTN; PAM sequence: CTA
tggaggacctgccagcacag

SEQ ID NO: 61569 - DNA, 20 bp, Artificial Sequence
  Description of Artificial Sequence: Synthetic oligonucleotide
  Target: SCN10A; (+) strand; PAM type: YTN; PAM sequence: CTG
ccagcacaggaggctggaca

SEQ ID NO: 61570 - DNA, 20 bp, Artificial Sequence
  Description of Artificial Sequence: Synthetic oligonucleotide
  Target: SCN10A; (+) strand; PAM type: YTN; PAM sequence: CTG
gacagaatgttctgtgctga

SEQ ID NO: 61571 - DNA, 20 bp, Artificial Sequence
  Description of Artificial Sequence: Synthetic oligonucleotide
  Target: SCN10A; (+) strand; PAM type: YTN; PAM sequence: TTC
tgtgctgaacctcatccagc

SEQ ID NO: 61572 - DNA, 20 bp, Artificial Sequence
  Description of Artificial Sequence: Synthetic oligonucleotide
  Target: SCN10A; (+) strand; PAM type: YTN; PAM sequence: CTG
tgctgaacctcatccagctt

SEQ ID NO: 61573 - DNA, 20 bp, Artificial Sequence
  Description of Artificial Sequence: Synthetic oligonucleotide
  Target: SCN10A; (+) strand; PAM type: YTN; PAM sequence: CTG
aacctcatccagcttcagga

SEQ ID NO: 61574 - DNA, 20 bp, Artificial Sequence
  Description of Artificial Sequence: Synthetic oligonucleotide
  Target: SCN10A; (+) strand; PAM type: YTN; PAM sequence: CTC
atccagcttcaggaggcaag

SEQ ID NO: 61575 - DNA, 20 bp, Artificial Sequence
  Description of Artificial Sequence: Synthetic oligonucleotide
  Target: SCN10A; (+) strand; PAM type: YTN; PAM sequence: CTT
caggaggcaagcaccaaata

SEQ ID NO: 61576 - DNA, 20 bp, Artificial Sequence
  Description of Artificial Sequence: Synthetic oligonucleotide
  Target: SCN10A; (+) strand; PAM type: YTN; PAM sequence: TTC
aggaggcaagcaccaaatac

SEQ ID NO: 61577 - DNA, 20 bp, Artificial Sequence
  Description of Artificial Sequence: Synthetic oligonucleotide
  Target: SCN10A; (+) strand; PAM type: YTN; PAM sequence: TTT
cctgacacctctgctgggca

SEQ ID NO: 61578 - DNA, 20 bp, Artificial Sequence
  Description of Artificial Sequence: Synthetic oligonucleotide
  Target: SCN10A; (+) strand; PAM type: YTN; PAM sequence: TTC
ctgacacctctgctgggcag

SEQ ID NO: 61579 - DNA, 20 bp, Artificial Sequence
  Description of Artificial Sequence: Synthetic oligonucleotide
  Target: SCN10A; (+) strand; PAM type: YTN; PAM sequence: CTG
acacctctgctgggcagacc

SEQ ID NO: 61580 - DNA, 20 bp, Artificial Sequence
  Description of Artificial Sequence: Synthetic oligonucleotide
  Target: SCN10A; (+) strand; PAM type: YTN; PAM sequence: CTC
tgctgggcagaccttgctgc

SEQ ID NO: 61581 - DNA, 20 bp, Artificial Sequence
  Description of Artificial Sequence: Synthetic oligonucleotide
  Target: SCN10A; (+) strand; PAM type: YTN; PAM sequence: CTG
ctgggcagaccttgctgctg

SEQ ID NO: 61582 - DNA, 20 bp, Artificial Sequence
  Description of Artificial Sequence: Synthetic oligonucleotide
  Target: SCN10A; (+) strand; PAM type: YTN; PAM sequence: CTG
ggcagaccttgctgctggca

SEQ ID NO: 61583 - DNA, 20 bp, Artificial Sequence
  Description of Artificial Sequence: Synthetic oligonucleotide
  Target: SCN10A; (+) strand; PAM type: YTN; PAM sequence: CTT
gctgctggcagctgcttgag

SEQ ID NO: 61584 - DNA, 20 bp, Artificial Sequence
  Description of Artificial Sequence: Synthetic oligonucleotide
  Target: SCN10A; (+) strand; PAM type: YTN; PAM sequence: TTG
ctgctggcagctgcttgagt

SEQ ID NO: 61585 - DNA, 20 bp, Artificial Sequence
  Description of Artificial Sequence: Synthetic oligonucleotide
  Target: SCN10A; (+) strand; PAM type: YTN; PAM sequence: CTG
ctggcagctgcttgagtggg

SEQ ID NO: 61586 - DNA, 20 bp, Artificial Sequence
  Description of Artificial Sequence: Synthetic oligonucleotide
  Target: SCN10A; (+) strand; PAM type: YTN; PAM sequence: CTG
gcagctgcttgagtggggca

SEQ ID NO: 61587 - DNA, 20 bp, Artificial Sequence
  Description of Artificial Sequence: Synthetic oligonucleotide
  Target: SCN10A; (+) strand; PAM type: YTN; PAM sequence: CTG
cttgagtggggcaggcagag

SEQ ID NO: 61588 - DNA, 20 bp, Artificial Sequence
  Description of Artificial Sequence: Synthetic oligonucleotide
  Target: SCN10A; (+) strand; PAM type: YTN; PAM sequence: CTT
gagtggggcaggcagagacc

SEQ ID NO: 61589 - DNA, 20 bp, Artificial Sequence
  Description of Artificial Sequence: Synthetic oligonucleotide
  Target: SCN10A; (+) strand; PAM type: YTN; PAM sequence: TTG
agtggggcaggcagagacca

SEQ ID NO: 61590 - DNA, 20 bp, Artificial Sequence
  Description of Artificial Sequence: Synthetic oligonucleotide
  Target: SCN10A; (+) strand; PAM type: YTN; PAM sequence: CTC
accctgcttgcagaaaccct

SEQ ID NO: 61591 - DNA, 20 bp, Artificial Sequence
  Description of Artificial Sequence: Synthetic oligonucleotide
  Target: SCN10A; (+) strand; PAM type: YTN; PAM sequence: CTG
cttgcagaaaccctcagcta

SEQ ID NO: 61592 - DNA, 20 bp, Artificial Sequence
  Description of Artificial Sequence: Synthetic oligonucleotide
  Target: SCN10A; (+) strand; PAM type: YTN; PAM sequence: CTT
gcagaaaccctcagctatgc

SEQ ID NO: 61593 - DNA, 20 bp, Artificial Sequence
  Description of Artificial Sequence: Synthetic oligonucleotide
  Target: SCN10A; (+) strand; PAM type: YTN; PAM sequence: TTG
cagaaaccctcagctatgcg

SEQ ID NO: 61594 - DNA, 20 bp, Artificial Sequence
  Description of Artificial Sequence: Synthetic oligonucleotide
  Target: SCN10A; (+) strand; PAM type: YTN; PAM sequence: CTC
agctatgcggcagtgaacag

SEQ ID NO: 61595 - DNA, 20 bp, Artificial Sequence
  Description of Artificial Sequence: Synthetic oligonucleotide
  Target: SCN10A; (+) strand; PAM type: YTN; PAM sequence: CTA
tgcggcagtgaacagataac

SEQ ID NO: 61596 - DNA, 20 bp, Artificial Sequence
  Description of Artificial Sequence: Synthetic oligonucleotide
  Target: SCN10A; (+) strand; PAM type: YTN; PAM sequence: CTC
agttaaccatgctgcaaagc

SEQ ID NO: 61597 - DNA, 20 bp, Artificial Sequence
  Description of Artificial Sequence: Synthetic oligonucleotide
  Target: SCN10A; (+) strand; PAM type: YTN; PAM sequence: TTA
accatgctgcaaagcaaaga

SEQ ID NO: 61598 - DNA, 20 bp, Artificial Sequence
  Description of Artificial Sequence: Synthetic oligonucleotide
  Target: SCN10A; (+) strand; PAM type: YTN; PAM sequence: CTG
caaagcaaagaaggtagtgg

SEQ ID NO: 61599 - DNA, 20 bp, Artificial Sequence
  Description of Artificial Sequence: Synthetic oligonucleotide
  Target: SCN10A; (+) strand; PAM type: YTN; PAM sequence: CTA
gacagtgatagtgcaatgtg

SEQ ID NO: 61600 - DNA, 20 bp, Artificial Sequence
  Description of Artificial Sequence: Synthetic oligonucleotide
  Target: SCN10A; (+) strand; PAM type: YTN; PAM sequence: TTA
agatgaggaagagatgactg

SEQ ID NO: 61601 - DNA, 20 bp, Artificial Sequence
  Description of Artificial Sequence: Synthetic oligonucleotide
  Target: SCN10A; (+) strand; PAM type: YTN; PAM sequence: CTG
aggaatcacatgtctgatgt

SEQ ID NO: 61602 - DNA, 20 bp, Artificial Sequence
  Description of Artificial Sequence: Synthetic oligonucleotide
  Target: SCN10A; (+) strand; PAM type: YTN; PAM sequence: CTG
atgtgtgagaagcacacagt

SEQ ID NO: 61603 - DNA, 20 bp, Artificial Sequence
  Description of Artificial Sequence: Synthetic oligonucleotide
  Target: SCN10A; (+) strand; PAM type: YTN; PAM sequence: TTC
tctaatgcagggattactgg

SEQ ID NO: 61604 - DNA, 20 bp, Artificial Sequence
  Description of Artificial Sequence: Synthetic oligonucleotide
  Target: SCN10A; (+) strand; PAM type: YTN; PAM sequence: CTC
taatgcagggattactggcc

SEQ ID NO: 61605 - DNA, 20 bp, Artificial Sequence
  Description of Artificial Sequence: Synthetic oligonucleotide
  Target: SCN10A; (+) strand; PAM type: YTN; PAM sequence: CTA
atgcagggattactggccac

SEQ ID NO: 61606 - DNA, 20 bp, Artificial Sequence
  Description of Artificial Sequence: Synthetic oligonucleotide
  Target: SCN10A; (+) strand; PAM type: YTN; PAM sequence: TTA
ctggccacaggttaccatga

SEQ ID NO: 61607 - DNA, 20 bp, Artificial Sequence
  Description of Artificial Sequence: Synthetic oligonucleotide
  Target: SCN10A; (+) strand; PAM type: YTN; PAM sequence: CTG
gccacaggttaccatgagtg

SEQ ID NO: 61608 - DNA, 20 bp, Artificial Sequence
  Description of Artificial Sequence: Synthetic oligonucleotide
  Target: SCN10A; (+) strand; PAM type: YTN; PAM sequence: TTA
ccatgagtgtgaacacatga

SEQ ID NO: 61609 - DNA, 20 bp, Artificial Sequence
  Description of Artificial Sequence: Synthetic oligonucleotide
  Target: SCN10A; (+) strand; PAM type: YTN; PAM sequence: CTC
cagctcattacctctccaaa

SEQ ID NO: 61610 - DNA, 20 bp, Artificial Sequence
  Description of Artificial Sequence: Synthetic oligonucleotide
  Target: SCN10A; (+) strand; PAM type: YTN; PAM sequence: CTC
attacctctccaaatgcgcc

SEQ ID NO: 61611 - DNA, 20 bp, Artificial Sequence
  Description of Artificial Sequence: Synthetic oligonucleotide
  Target: SCN10A; (+) strand; PAM type: YTN; PAM sequence: TTA
cctctccaaatgcgccctct

SEQ ID NO: 61612 - DNA, 20 bp, Artificial Sequence
  Description of Artificial Sequence: Synthetic oligonucleotide
  Target: SCN10A; (+) strand; PAM type: YTN; PAM sequence: CTC
tccaaatgcgccctctgttc

SEQ ID NO: 61613 - DNA, 20 bp, Artificial Sequence
  Description of Artificial Sequence: Synthetic oligonucleotide
  Target: SCN10A; (+) strand; PAM type: YTN; PAM sequence: CTC
caaatgcgccctctgttctt

SEQ ID NO: 61614 - DNA, 20 bp, Artificial Sequence
  Description of Artificial Sequence: Synthetic oligonucleotide
  Target: SCN10A; (+) strand; PAM type: YTN; PAM sequence: CTC
tgttcttttcaatgccactg

SEQ ID NO: 61615 - DNA, 20 bp, Artificial Sequence
  Description of Artificial Sequence: Synthetic oligonucleotide
  Target: SCN10A; (+) strand; PAM type: YTN; PAM sequence: CTG
ttcttttcaatgccactggg

SEQ ID NO: 61616 - DNA, 20 bp, Artificial Sequence
  Description of Artificial Sequence: Synthetic oligonucleotide
  Target: SCN10A; (+) strand; PAM type: YTN; PAM sequence: TTC
ttttcaatgccactggggag

SEQ ID NO: 61617 - DNA, 20 bp, Artificial Sequence
  Description of Artificial Sequence: Synthetic oligonucleotide
  Target: SCN10A; (+) strand; PAM type: YTN; PAM sequence: CTT
ttcaatgccactggggagga

SEQ ID NO: 61618 - DNA, 20 bp, Artificial Sequence
  Description of Artificial Sequence: Synthetic oligonucleotide
  Target: SCN10A; (+) strand; PAM type: YTN; PAM sequence: TTT
tcaatgccactggggaggag

SEQ ID NO: 61619 - DNA, 20 bp, Artificial Sequence
  Description of Artificial Sequence: Synthetic oligonucleotide
  Target: SCN10A; (+) strand; PAM type: YTN; PAM sequence: TTT
caatgccactggggaggagg

SEQ ID NO: 61620 - DNA, 20 bp, Artificial Sequence
  Description of Artificial Sequence: Synthetic oligonucleotide
  Target: SCN10A; (+) strand; PAM type: YTN; PAM sequence: TTC
aatgccactggggaggaggc

SEQ ID NO: 61621 - DNA, 20 bp, Artificial Sequence
  Description of Artificial Sequence: Synthetic oligonucleotide
  Target: SCN10A; (+) strand; PAM type: YTN; PAM sequence: CTG
gggaggaggcagcagtataa

SEQ ID NO: 61622 - DNA, 20 bp, Artificial Sequence
  Description of Artificial Sequence: Synthetic oligonucleotide
  Target: SCN10A; (+) strand; PAM type: YTN; PAM sequence: CTC
agtggttctaagccatggct

SEQ ID NO: 61623 - DNA, 20 bp, Artificial Sequence
  Description of Artificial Sequence: Synthetic oligonucleotide
  Target: SCN10A; (+) strand; PAM type: YTN; PAM sequence: TTC
taagccatggctgcaccttg

SEQ ID NO: 61624 - DNA, 20 bp, Artificial Sequence
  Description of Artificial Sequence: Synthetic oligonucleotide
  Target: SCN10A; (+) strand; PAM type: YTN; PAM sequence: CTA
agccatggctgcaccttgga

SEQ ID NO: 61625 - DNA, 20 bp, Artificial Sequence
  Description of Artificial Sequence: Synthetic oligonucleotide
  Target: SCN10A; (+) strand; PAM type: YTN; PAM sequence: CTG
caccttggaaatgcctggga

SEQ ID NO: 61626 - DNA, 20 bp, Artificial Sequence
  Description of Artificial Sequence: Synthetic oligonucleotide
  Target: SCN10A; (+) strand; PAM type: YTN; PAM sequence: CTT
ggaaatgcctgggagcattt

SEQ ID NO: 61627 - DNA, 20 bp, Artificial Sequence
  Description of Artificial Sequence: Synthetic oligonucleotide
  Target: SCN10A; (+) strand; PAM type: YTN; PAM sequence: TTG
gaaatgcctgggagcattta

SEQ ID NO: 61628 - DNA, 20 bp, Artificial Sequence
  Description of Artificial Sequence: Synthetic oligonucleotide
  Target: SCN10A; (+) strand; PAM type: YTN; PAM sequence: CTG
ggagcatttataaaatacag

SEQ ID NO: 61629 - DNA, 20 bp, Artificial Sequence
  Description of Artificial Sequence: Synthetic oligonucleotide
  Target: SCN10A; (+) strand; PAM type: YTN; PAM sequence: TTT
ataaaatacaggtgcctggg

SEQ ID NO: 61630 - DNA, 20 bp, Artificial Sequence
  Description of Artificial Sequence: Synthetic oligonucleotide
  Target: SCN10A; (+) strand; PAM type: YTN; PAM sequence: TTA
taaaatacaggtgcctgggc

SEQ ID NO: 61631 - DNA, 20 bp, Artificial Sequence
  Description of Artificial Sequence: Synthetic oligonucleotide
  Target: SCN10A; (+) strand; PAM type: YTN; PAM sequence: CTG
ggcaccacccaagaccaata

SEQ ID NO: 61632 - DNA, 20 bp, Artificial Sequence
  Description of Artificial Sequence: Synthetic oligonucleotide
  Target: SCN10A; (+) strand; PAM type: YTN; PAM sequence: CTC
tggggtagtggtggtcggtc

SEQ ID NO: 61633 - DNA, 20 bp, Artificial Sequence
  Description of Artificial Sequence: Synthetic oligonucleotide
  Target: SCN10A; (+) strand; PAM type: YTN; PAM sequence: CTG
gggtagtggtggtcggtcac

SEQ ID NO: 61634 - DNA, 20 bp, Artificial Sequence
  Description of Artificial Sequence: Synthetic oligonucleotide
  Target: SCN10A; (+) strand; PAM type: YTN; PAM sequence: CTG
catatttcatagctccccag

SEQ ID NO: 61635 - DNA, 20 bp, Artificial Sequence
  Description of Artificial Sequence: Synthetic oligonucleotide
  Target: SCN10A; (+) strand; PAM type: YTN; PAM sequence: TTT
catagctccccaggtgattc

SEQ ID NO: 61636 - DNA, 20 bp, Artificial Sequence
  Description of Artificial Sequence: Synthetic oligonucleotide
  Target: SCN10A; (+) strand; PAM type: YTN; PAM sequence: TTC
atagctccccaggtgattct

SEQ ID NO: 61637 - DNA, 20 bp, Artificial Sequence
  Description of Artificial Sequence: Synthetic oligonucleotide
  Target: SCN10A; (+) strand; PAM type: YTN; PAM sequence: CTC
cccaggtgattctcaagtgc

SEQ ID NO: 61638 - DNA, 20 bp, Artificial Sequence
  Description of Artificial Sequence: Synthetic oligonucleotide
  Target: SCN10A; (+) strand; PAM type: YTN; PAM sequence: TTC
tcaagtgcagccaggtgtga

SEQ ID NO: 61639 - DNA, 20 bp, Artificial Sequence
  Description of Artificial Sequence: Synthetic oligonucleotide
  Target: SCN10A; (+) strand; PAM type: YTN; PAM sequence: CTC
aagtgcagccaggtgtgagg

SEQ ID NO: 61640 - DNA, 20 bp, Artificial Sequence
  Description of Artificial Sequence: Synthetic oligonucleotide
  Target: SCN10A; (+) strand; PAM type: YTN; PAM sequence: TTC
tctgtgctcacagttcatgg

SEQ ID NO: 61641 - DNA, 20 bp, Artificial Sequence
  Description of Artificial Sequence: Synthetic oligonucleotide
  Target: SCN10A; (+) strand; PAM type: YTN; PAM sequence: CTC
tgtgctcacagttcatggct

SEQ ID NO: 61642 - DNA, 20 bp, Artificial Sequence
  Description of Artificial Sequence: Synthetic oligonucleotide
  Target: SCN10A; (+) strand; PAM type: YTN; PAM sequence: CTG
tgctcacagttcatggctcc

SEQ ID NO: 61643 - DNA, 20 bp, Artificial Sequence
  Description of Artificial Sequence: Synthetic oligonucleotide
  Target: SCN10A; (+) strand; PAM type: YTN; PAM sequence: CTC
acagttcatggctccccaag

SEQ ID NO: 61644 - DNA, 20 bp, Artificial Sequence
  Description of Artificial Sequence: Synthetic oligonucleotide
  Target: SCN10A; (+) strand; PAM type: YTN; PAM sequence: TTC
atggctccccaaggtccaga

SEQ ID NO: 61645 - DNA, 20 bp, Artificial Sequence
  Description of Artificial Sequence: Synthetic oligonucleotide
  Target: SCN10A; (+) strand; PAM type: YTN; PAM sequence: CTC
cccaaggtccagaagaccca

SEQ ID NO: 61646 - DNA, 20 bp, Artificial Sequence
  Description of Artificial Sequence: Synthetic oligonucleotide
  Target: SCN10A; (+) strand; PAM type: YTN; PAM sequence: CTA
tggatgcagggccataagac

SEQ ID NO: 61647 - DNA, 20 bp, Artificial Sequence
  Description of Artificial Sequence: Synthetic oligonucleotide
  Target: SCN10A; (+) strand; PAM type: YTN; PAM sequence: CTC
tgagagctgcatgtgtcatc

SEQ ID NO: 61648 - DNA, 20 bp, Artificial Sequence
  Description of Artificial Sequence: Synthetic oligonucleotide
  Target: SCN10A; (+) strand; PAM type: YTN; PAM sequence: CTG
agagctgcatgtgtcatctc

SEQ ID NO: 61649 - DNA, 20 bp, Artificial Sequence
  Description of Artificial Sequence: Synthetic oligonucleotide
  Target: SCN10A; (+) strand; PAM type: YTN; PAM sequence: CTG
catgtgtcatctcactttgg

SEQ ID NO: 61650 - DNA, 20 bp, Artificial Sequence
  Description of Artificial Sequence: Synthetic oligonucleotide
  Target: SCN10A; (+) strand; PAM type: YTN; PAM sequence: CTC
actttggatgtaaaaatgca

SEQ ID NO: 61651 - DNA, 20 bp, Artificial Sequence
  Description of Artificial Sequence: Synthetic oligonucleotide
  Target: SCN10A; (+) strand; PAM type: YTN; PAM sequence: CTT
tggatgtaaaaatgcagagg

SEQ ID NO: 61652 - DNA, 20 bp, Artificial Sequence
  Description of Artificial Sequence: Synthetic oligonucleotide
  Target: SCN10A; (+) strand; PAM type: YTN; PAM sequence: TTT
ggatgtaaaaatgcagagga

SEQ ID NO: 61653 - DNA, 20 bp, Artificial Sequence
  Description of Artificial Sequence: Synthetic oligonucleotide
  Target: SCN10A; (+) strand; PAM type: YTN; PAM sequence: TTG
gatgtaaaaatgcagaggat

SEQ ID NO: 61654 - DNA, 20 bp, Artificial Sequence
  Description of Artificial Sequence: Synthetic oligonucleotide
  Target: SCN10A; (+) strand; PAM type: YTN; PAM sequence: TTG
cagggatctttctgaatgga

SEQ ID NO: 61655 - DNA, 20 bp, Artificial Sequence
  Description of Artificial Sequence: Synthetic oligonucleotide
  Target: SCN10A; (+) strand; PAM type: YTN; PAM sequence: CTT
tctgaatggagacctaataa

SEQ ID NO: 61656 - DNA, 20 bp, Artificial Sequence
  Description of Artificial Sequence: Synthetic oligonucleotide
  Target: SCN10A; (+) strand; PAM type: YTN; PAM sequence: TTT
ctgaatggagacctaataac

SEQ ID NO: 61657 - DNA, 20 bp, Artificial Sequence
  Description of Artificial Sequence: Synthetic oligonucleotide
  Target: SCN10A; (+) strand; PAM type: YTN; PAM sequence: TTC
tgaatggagacctaataact

SEQ ID NO: 61658 - DNA, 20 bp, Artificial Sequence
  Description of Artificial Sequence: Synthetic oligonucleotide
  Target: SCN10A; (+) strand; PAM type: YTN; PAM sequence: CTG
aatggagacctaataactca

SEQ ID NO: 61659 - DNA, 20 bp, Artificial Sequence
  Description of Artificial Sequence: Synthetic oligonucleotide
  Target: SCN10A; (+) strand; PAM type: YTN; PAM sequence: CTA
ataactcacctaacagtcac

SEQ ID NO: 61660 - DNA, 20 bp, Artificial Sequence
  Description of Artificial Sequence: Synthetic oligonucleotide
  Target: SCN10A; (+) strand; PAM type: YTN; PAM sequence: CTC
acctaacagtcactattgtg

SEQ ID NO: 61661 - DNA, 20 bp, Artificial Sequence
  Description of Artificial Sequence: Synthetic oligonucleotide
  Target: SCN10A; (+) strand; PAM type: YTN; PAM sequence: CTA
acagtcactattgtgtcaca

SEQ ID NO: 61662 - DNA, 20 bp, Artificial Sequence
  Description of Artificial Sequence: Synthetic oligonucleotide
  Target: SCN10A; (+) strand; PAM type: YTN; PAM sequence: CTA
ttgtgtcacagtcacatact

SEQ ID NO: 61663 - DNA, 20 bp, Artificial Sequence
  Description of Artificial Sequence: Synthetic oligonucleotide
  Target: SCN10A; (+) strand; PAM type: YTN; PAM sequence: TTG
tgtcacagtcacatactgcc

SEQ ID NO: 61664 - DNA, 20 bp, Artificial Sequence
  Description of Artificial Sequence: Synthetic oligonucleotide
  Target: SCN10A; (+) strand; PAM type: YTN; PAM sequence: CTG
cctggactttaccactcatg

SEQ ID NO: 61665 - DNA, 20 bp, Artificial Sequence
  Description of Artificial Sequence: Synthetic oligonucleotide
  Target: SCN10A; (+) strand; PAM type: YTN; PAM sequence: CTG
gactttaccactcatgggtg

SEQ ID NO: 61666 - DNA, 20 bp, Artificial Sequence
  Description of Artificial Sequence: Synthetic oligonucleotide
  Target: SCN10A; (+) strand; PAM type: YTN; PAM sequence: CTT
taccactcatgggtgtcagg

SEQ ID NO: 61667 - DNA, 20 bp, Artificial Sequence
  Description of Artificial Sequence: Synthetic oligonucleotide
  Target: SCN10A; (+) strand; PAM type: YTN; PAM sequence: TTT
accactcatgggtgtcaggg

SEQ ID NO: 61668 - DNA, 20 bp, Artificial Sequence
  Description of Artificial Sequence: Synthetic oligonucleotide
  Target: SCN10A; (+) strand; PAM type: YTN; PAM sequence: TTA
ccactcatgggtgtcagggc

SEQ ID NO: 61669 - DNA, 20 bp, Artificial Sequence
  Description of Artificial Sequence: Synthetic oligonucleotide
  Target: SCN10A; (+) strand; PAM type: YTN; PAM sequence: CTC
atgggtgtcagggctattct

SEQ ID NO: 61670 - DNA, 20 bp, Artificial Sequence
  Description of Artificial Sequence: Synthetic oligonucleotide
  Target: SCN10A; (+) strand; PAM type: YTN; PAM sequence: CTA
ttctcagactcctcactaaa

SEQ ID NO: 61671 - DNA, 20 bp, Artificial Sequence
  Description of Artificial Sequence: Synthetic oligonucleotide
  Target: SCN10A; (+) strand; PAM type: YTN; PAM sequence: TTC
tcagactcctcactaaatgc

SEQ ID NO: 61672 - DNA, 20 bp, Artificial Sequence
  Description of Artificial Sequence: Synthetic oligonucleotide
  Target: SCN10A; (+) strand; PAM type: YTN; PAM sequence: CTC
agactcctcactaaatgctc

SEQ ID NO: 61673 - DNA, 20 bp, Artificial Sequence
  Description of Artificial Sequence: Synthetic oligonucleotide
  Target: SCN10A; (+) strand; PAM type: YTN; PAM sequence: CTC
ctcactaaatgctcaaaact

SEQ ID NO: 61674 - DNA, 20 bp, Artificial Sequence
  Description of Artificial Sequence: Synthetic oligonucleotide
  Target: SCN10A; (+) strand; PAM type: YTN; PAM sequence: CTC
actaaatgctcaaaactttt

SEQ ID NO: 61675 - DNA, 20 bp, Artificial Sequence
  Description of Artificial Sequence: Synthetic oligonucleotide
  Target: SCN10A; (+) strand; PAM type: YTN; PAM sequence: CTA
aatgctcaaaacttttcttt

SEQ ID NO: 61676 - DNA, 20 bp, Artificial Sequence
  Description of Artificial Sequence: Synthetic oligonucleotide
  Target: SCN10A; (+) strand; PAM type: YTN; PAM sequence: CTC
aaaacttttctttggagtag

SEQ ID NO: 61677 - DNA, 20 bp, Artificial Sequence
  Description of Artificial Sequence: Synthetic oligonucleotide
  Target: SCN10A; (+) strand; PAM type: YTN; PAM sequence: CTT
ttctttggagtagcccttga

SEQ ID NO: 61678 - DNA, 20 bp, Artificial Sequence
  Description of Artificial Sequence: Synthetic oligonucleotide
  Target: SCN10A; (+) strand; PAM type: YTN; PAM sequence: TTT
tctttggagtagcccttgag

SEQ ID NO: 61679 - DNA, 20 bp, Artificial Sequence
  Description of Artificial Sequence: Synthetic oligonucleotide
  Target: SCN10A; (+) strand; PAM type: YTN; PAM sequence: TTT
ctttggagtagcccttgagg

SEQ ID NO: 61680 - DNA, 20 bp, Artificial Sequence
  Description of Artificial Sequence: Synthetic oligonucleotide
  Target: SCN10A; (+) strand; PAM type: YTN; PAM sequence: TTC
tttggagtagcccttgaggg

SEQ ID NO: 61681 - DNA, 20 bp, Artificial Sequence
  Description of Artificial Sequence: Synthetic oligonucleotide
  Target: SCN10A; (+) strand; PAM type: YTN; PAM sequence: CTT
tggagtagcccttgagggcc

SEQ ID NO: 61682 - DNA, 20 bp, Artificial Sequence
  Description of Artificial Sequence: Synthetic oligonucleotide
  Target: SCN10A; (+) strand; PAM type: YTN; PAM sequence: TTT
ggagtagcccttgagggcca

SEQ ID NO: 61683 - DNA, 20 bp, Artificial Sequence
  Description of Artificial Sequence: Synthetic oligonucleotide
  Target: SCN10A; (+) strand; PAM type: YTN; PAM sequence: TTG
gagtagcccttgagggccag

SEQ ID NO: 61684 - DNA, 20 bp, Artificial Sequence
  Description of Artificial Sequence: Synthetic oligonucleotide
  Target: SCN10A; (+) strand; PAM type: YTN; PAM sequence: CTT
gagggccaggtctctgagct

SEQ ID NO: 61685 - DNA, 20 bp, Artificial Sequence
  Description of Artificial Sequence: Synthetic oligonucleotide
  Target: SCN10A; (+) strand; PAM type: YTN; PAM sequence: TTG
agggccaggtctctgagctt

SEQ ID NO: 61686 - DNA, 20 bp, Artificial Sequence
  Description of Artificial Sequence: Synthetic oligonucleotide
  Target: SCN10A; (+) strand; PAM type: YTN; PAM sequence: CTC
tgagcttcctttgccctagc

SEQ ID NO: 61687 - DNA, 20 bp, Artificial Sequence
  Description of Artificial Sequence: Synthetic oligonucleotide
  Target: SCN10A; (+) strand; PAM type: YTN; PAM sequence: CTG
agcttcctttgccctagctg

SEQ ID NO: 61688 - DNA, 20 bp, Artificial Sequence
  Description of Artificial Sequence: Synthetic oligonucleotide
  Target: SCN10A; (+) strand; PAM type: YTN; PAM sequence: CTT
cctttgccctagctgtagcc

SEQ ID NO: 61689 - DNA, 20 bp, Artificial Sequence
  Description of Artificial Sequence: Synthetic oligonucleotide
  Target: SCN10A; (+) strand; PAM type: YTN; PAM sequence: TTC
ctttgccctagctgtagcca

SEQ ID NO: 61690 - DNA, 20 bp, Artificial Sequence
  Description of Artificial Sequence: Synthetic oligonucleotide
  Target: SCN10A; (+) strand; PAM type: YTN; PAM sequence: CTT
tgccctagctgtagccagga

SEQ ID NO: 61691 - DNA, 20 bp, Artificial Sequence
  Description of Artificial Sequence: Synthetic oligonucleotide
  Target: SCN10A; (+) strand; PAM type: YTN; PAM sequence: TTT
gccctagctgtagccaggag

SEQ ID NO: 61692 - DNA, 20 bp, Artificial Sequence
  Description of Artificial Sequence: Synthetic oligonucleotide
  Target: SCN10A; (+) strand; PAM type: YTN; PAM sequence: TTG
ccctagctgtagccaggagt

SEQ ID NO: 61693 - DNA, 20 bp, Artificial Sequence
  Description of Artificial Sequence: Synthetic oligonucleotide
  Target: SCN10A; (+) strand; PAM type: YTN; PAM sequence: CTA
gctgtagccaggagtcagag

SEQ ID NO: 61694 - DNA, 20 bp, Artificial Sequence
  Description of Artificial Sequence: Synthetic oligonucleotide
  Target: SCN10A; (+) strand; PAM type: YTN; PAM sequence: CTG
tagccaggagtcagagggga

SEQ ID NO: 61695 - DNA, 20 bp, Artificial Sequence
  Description of Artificial Sequence: Synthetic oligonucleotide
  Target: SCN10A; (+) strand; PAM type: YTN; PAM sequence: TTC
ccactgagccactcacattc

SEQ ID NO: 61696 - DNA, 20 bp, Artificial Sequence
  Description of Artificial Sequence: Synthetic oligonucleotide
  Target: SCN10A; (+) strand; PAM type: YTN; PAM sequence: CTG
agccactcacattcacaatg

SEQ ID NO: 61697 - DNA, 20 bp, Artificial Sequence
  Description of Artificial Sequence: Synthetic oligonucleotide
  Target: SCN10A; (+) strand; PAM type: YTN; PAM sequence: CTC
acattcacaatgaggaagtc

SEQ ID NO: 61698 - DNA, 20 bp, Artificial Sequence
  Description of Artificial Sequence: Synthetic oligonucleotide
  Target: SCN10A; (+) strand; PAM type: YTN; PAM sequence: TTC
acaatgaggaagtccagcca

SEQ ID NO: 61699 - DNA, 20 bp, Artificial Sequence
  Description of Artificial Sequence: Synthetic oligonucleotide
  Target: SCN10A; (+) strand; PAM type: YTN; PAM sequence: TTG
gtgaagtactttttgaagcc

SEQ ID NO: 61700 - DNA, 20 bp, Artificial Sequence
  Description of Artificial Sequence: Synthetic oligonucleotide
  Target: SCN10A; (+) strand; PAM type: YTN; PAM sequence: CTT
tttgaagccataggccaccc

SEQ ID NO: 61701 - DNA, 20 bp, Artificial Sequence
  Description of Artificial Sequence: Synthetic oligonucleotide
  Target: SCN10A; (+) strand; PAM type: YTN; PAM sequence: TTT
ttgaagccataggccaccca

SEQ ID NO: 61702 - DNA, 20 bp, Artificial Sequence
  Description of Artificial Sequence: Synthetic oligonucleotide
  Target: SCN10A; (+) strand; PAM type: YTN; PAM sequence: TTT
tgaagccataggccacccac

SEQ ID NO: 61703 - DNA, 20 bp, Artificial Sequence
  Description of Artificial Sequence: Synthetic oligonucleotide
  Target: SCN10A; (+) strand; PAM type: YTN; PAM sequence: TTT
gaagccataggccacccact

SEQ ID NO: 61704 - DNA, 20 bp, Artificial Sequence
  Description of Artificial Sequence: Synthetic oligonucleotide
  Target: SCN10A; (+) strand; PAM type: YTN; PAM sequence: TTG
aagccataggccacccactt

SEQ ID NO: 61705 - DNA, 20 bp, Artificial Sequence
  Description of Artificial Sequence: Synthetic oligonucleotide
  Target: SCN10A; (+) strand; PAM type: YTN; PAM sequence: CTT
aagcagcatctcgaacacaa

SEQ ID NO: 61706 - DNA, 20 bp, Artificial Sequence
  Description of Artificial Sequence: Synthetic oligonucleotide
  Target: SCN10A; (+) strand; PAM type: YTN; PAM sequence: TTA
agcagcatctcgaacacaaa

SEQ ID NO: 61707 - DNA, 20 bp, Artificial Sequence
  Description of Artificial Sequence: Synthetic oligonucleotide
  Target: SCN10A; (+) strand; PAM type: YTN; PAM sequence: CTC
gaacacaaagataaaggtga

SEQ ID NO: 61708 - DNA, 20 bp, Artificial Sequence
  Description of Artificial Sequence: Synthetic oligonucleotide
  Target: SCN10A; (+) strand; PAM type: YTN; PAM sequence: CTG
tcagtgtactccagcaaagc

SEQ ID NO: 61709 - DNA, 20 bp, Artificial Sequence
  Description of Artificial Sequence: Synthetic oligonucleotide
  Target: SCN10A; (+) strand; PAM type: YTN; PAM sequence: CTC
cagcaaagctttcaccgtgg

SEQ ID NO: 61710 - DNA, 20 bp, Artificial Sequence
  Description of Artificial Sequence: Synthetic oligonucleotide
  Target: SCN10A; (+) strand; PAM type: YTN; PAM sequence: CTT
tcaccgtgggcttctggtcc

SEQ ID NO: 61711 - DNA, 20 bp, Artificial Sequence
  Description of Artificial Sequence: Synthetic oligonucleotide
  Target: SCN10A; (+) strand; PAM type: YTN; PAM sequence: TTT
caccgtgggcttctggtcca

SEQ ID NO: 61712 - DNA, 20 bp, Artificial Sequence
  Description of Artificial Sequence: Synthetic oligonucleotide
  Target: SCN10A; (+) strand; PAM type: YTN; PAM sequence: TTC
accgtgggcttctggtccag

SEQ ID NO: 61713 - DNA, 20 bp, Artificial Sequence
  Description of Artificial Sequence: Synthetic oligonucleotide
  Target: SCN10A; (+) strand; PAM type: YTN; PAM sequence: CTT
ctggtccaggtaatagtctt

SEQ ID NO: 61714 - DNA, 20 bp, Artificial Sequence
  Description of Artificial Sequence: Synthetic oligonucleotide
  Target: SCN10A; (+) strand; PAM type: YTN; PAM sequence: TTC
tggtccaggtaatagtcttc

SEQ ID NO: 61715 - DNA, 20 bp, Artificial Sequence
  Description of Artificial Sequence: Synthetic oligonucleotide
  Target: SCN10A; (+) strand; PAM type: YTN; PAM sequence: CTG
gtccaggtaatagtcttcaa

SEQ ID NO: 61716 - DNA, 20 bp, Artificial Sequence
  Description of Artificial Sequence: Synthetic oligonucleotide
  Target: SCN10A; (+) strand; PAM type: YTN; PAM sequence: CTT
caaaggcctggaaggaagaa

SEQ ID NO: 61717 - DNA, 20 bp, Artificial Sequence
  Description of Artificial Sequence: Synthetic oligonucleotide
  Target: SCN10A; (+) strand; PAM type: YTN; PAM sequence: TTC
aaaggcctggaaggaagaaa

SEQ ID NO: 61718 - DNA, 20 bp, Artificial Sequence
  Description of Artificial Sequence: Synthetic oligonucleotide
  Target: SCN10A; (+) strand; PAM type: YTN; PAM sequence: CTG
gaaggaagaaaggatgcaga

SEQ ID NO: 61719 - DNA, 20 bp, Artificial Sequence
  Description of Artificial Sequence: Synthetic oligonucleotide
  Target: SCN10A; (+) strand; PAM type: YTN; PAM sequence: CTG
cctggacccacagcactggg

SEQ ID NO: 61720 - DNA, 20 bp, Artificial Sequence
  Description of Artificial Sequence: Synthetic oligonucleotide
  Target: SCN10A; (+) strand; PAM type: YTN; PAM sequence: CTG
gacccacagcactggggccc

SEQ ID NO: 61721 - DNA, 20 bp, Artificial Sequence
  Description of Artificial Sequence: Synthetic oligonucleotide
  Target: SCN10A; (+) strand; PAM type: YTN; PAM sequence: CTG
gggcccagactgatagggaa

SEQ ID NO: 61722 - DNA, 20 bp, Artificial Sequence
  Description of Artificial Sequence: Synthetic oligonucleotide
  Target: SCN10A; (+) strand; PAM type: YTN; PAM sequence: CTG
atagggaaggacccagccag

SEQ ID NO: 61723 - DNA, 20 bp, Artificial Sequence
  Description of Artificial Sequence: Synthetic oligonucleotide
  Target: SCN10A; (+) strand; PAM type: YTN; PAM sequence: CTG
accacagtccctggaagggg

SEQ ID NO: 61724 - DNA, 20 bp, Artificial Sequence
  Description of Artificial Sequence: Synthetic oligonucleotide
  Target: SCN10A; (+) strand; PAM type: YTN; PAM sequence: CTG
gaaggggatttggtagtcag

SEQ ID NO: 61725 - DNA, 20 bp, Artificial Sequence
  Description of Artificial Sequence: Synthetic oligonucleotide
  Target: SCN10A; (+) strand; PAM type: YTN; PAM sequence: TTT
ggtagtcagcttgccagtag

SEQ ID NO: 61726 - DNA, 20 bp, Artificial Sequence
  Description of Artificial Sequence: Synthetic oligonucleotide
  Target: SCN10A; (+) strand; PAM type: YTN; PAM sequence: TTG
gtagtcagcttgccagtagc

SEQ ID NO: 61727 - DNA, 20 bp, Artificial Sequence
  Description of Artificial Sequence: Synthetic oligonucleotide
  Target: SCN10A; (+) strand; PAM type: YTN; PAM sequence: CTT
gccagtagcattttgtttgc

SEQ ID NO: 61728 - DNA, 20 bp, Artificial Sequence
  Description of Artificial Sequence: Synthetic oligonucleotide
  Target: SCN10A; (+) strand; PAM type: YTN; PAM sequence: TTG
ccagtagcattttgtttgct

SEQ ID NO: 61729 - DNA, 20 bp, Artificial Sequence
  Description of Artificial Sequence: Synthetic oligonucleotide
  Target: SCN10A; (+) strand; PAM type: YTN; PAM sequence: TTT
tgtttgctgtggggaggtaa

SEQ ID NO: 61730 - DNA, 20 bp, Artificial Sequence
  Description of Artificial Sequence: Synthetic oligonucleotide
  Target: SCN10A; (+) strand; PAM type: YTN; PAM sequence: TTT
gtttgctgtggggaggtaaa

SEQ ID NO: 61731 - DNA, 20 bp, Artificial Sequence
  Description of Artificial Sequence: Synthetic oligonucleotide
  Target: SCN10A; (+) strand; PAM type: YTN; PAM sequence: TTG
tttgctgtggggaggtaaag

SEQ ID NO: 61732 - DNA, 20 bp, Artificial Sequence
  Description of Artificial Sequence: Synthetic oligonucleotide
  Target: SCN10A; (+) strand; PAM type: YTN; PAM sequence: TTT
gctgtggggaggtaaagtgg

SEQ ID NO: 61733 - DNA, 20 bp, Artificial Sequence
  Description of Artificial Sequence: Synthetic oligonucleotide
  Target: SCN10A; (+) strand; PAM type: YTN; PAM sequence: TTG
ctgtggggaggtaaagtggg

SEQ ID NO: 61734 - DNA, 20 bp, Artificial Sequence
  Description of Artificial Sequence: Synthetic oligonucleotide
  Target: SCN10A; (+) strand; PAM type: YTN; PAM sequence: CTG
tggggaggtaaagtgggata

SEQ ID NO: 61735 - DNA, 20 bp, Artificial Sequence
  Description of Artificial Sequence: Synthetic oligonucleotide
  Target: SCN10A; (+) strand; PAM type: YTN; PAM sequence: CTG
tgagatccaaagcatgactt

SEQ ID NO: 61736 - DNA, 20 bp, Artificial Sequence
  Description of Artificial Sequence: Synthetic oligonucleotide
  Target: SCN10A; (+) strand; PAM type: YTN; PAM sequence: CTT
cttcagggccaatggggaca

SEQ ID NO: 61737 - DNA, 20 bp, Artificial Sequence
  Description of Artificial Sequence: Synthetic oligonucleotide
  Target: SCN10A; (+) strand; PAM type: YTN; PAM sequence: TTC
ttcagggccaatggggacaa

SEQ ID NO: 61738 - DNA, 20 bp, Artificial Sequence
  Description of Artificial Sequence: Synthetic oligonucleotide
  Target: SCN10A; (+) strand; PAM type: YTN; PAM sequence: CTT
cagggccaatggggacaaac

SEQ ID NO: 61739 - DNA, 20 bp, Artificial Sequence
  Description of Artificial Sequence: Synthetic oligonucleotide
  Target: SCN10A; (+) strand; PAM type: YTN; PAM sequence: TTC
agggccaatggggacaaaca

SEQ ID NO: 61740 - DNA, 20 bp, Artificial Sequence
  Description of Artificial Sequence: Synthetic oligonucleotide
  Target: SCN10A; (+) strand; PAM type: YTN; PAM sequence: CTG
ctgatacttgcagggatgct

SEQ ID NO: 61741 - DNA, 20 bp, Artificial Sequence
  Description of Artificial Sequence: Synthetic oligonucleotide
  Target: SCN10A; (+) strand; PAM type: YTN; PAM sequence: CTG
atacttgcagggatgctgaa

SEQ ID NO: 61742 - DNA, 20 bp, Artificial Sequence
  Description of Artificial Sequence: Synthetic oligonucleotide
  Target: SCN10A; (+) strand; PAM type: YTN; PAM sequence: CTT
gcagggatgctgaatgcaag

SEQ ID NO: 61743 - DNA, 20 bp, Artificial Sequence
  Description of Artificial Sequence: Synthetic oligonucleotide
  Target: SCN10A; (+) strand; PAM type: YTN; PAM sequence: TTG
cagggatgctgaatgcaagg

SEQ ID NO: 61744 - DNA, 20 bp, Artificial Sequence
  Description of Artificial Sequence: Synthetic oligonucleotide
  Target: SCN10A; (+) strand; PAM type: YTN; PAM sequence: CTG
aatgcaagggagaaagaaaa

SEQ ID NO: 61745 - DNA, 20 bp, Artificial Sequence
  Description of Artificial Sequence: Synthetic oligonucleotide
  Target: SCN10A; (+) strand; PAM type: YTN; PAM sequence: CTT
ctcaaattggattttggaag

SEQ ID NO: 61746 - DNA, 20 bp, Artificial Sequence
  Description of Artificial Sequence: Synthetic oligonucleotide
  Target: SCN10A; (+) strand; PAM type: YTN; PAM sequence: TTC
tcaaattggattttggaagt

SEQ ID NO: 61747 - DNA, 20 bp, Artificial Sequence
  Description of Artificial Sequence: Synthetic oligonucleotide
  Target: SCN10A; (+) strand; PAM type: YTN; PAM sequence: CTC
aaattggattttggaagtga

SEQ ID NO: 61748 - DNA, 20 bp, Artificial Sequence
  Description of Artificial Sequence: Synthetic oligonucleotide
  Target: SCN10A; (+) strand; PAM type: YTN; PAM sequence: TTG
gattttggaagtgaaccaaa

SEQ ID NO: 61749 - DNA, 20 bp, Artificial Sequence
  Description of Artificial Sequence: Synthetic oligonucleotide
  Target: SCN10A; (+) strand; PAM type: YTN; PAM sequence: TTT
tggaagtgaaccaaagggat

SEQ ID NO: 61750 - DNA, 20 bp, Artificial Sequence
  Description of Artificial Sequence: Synthetic oligonucleotide
  Target: SCN10A; (+) strand; PAM type: YTN; PAM sequence: TTT
ggaagtgaaccaaagggatg

SEQ ID NO: 61751 - DNA, 20 bp, Artificial Sequence
  Description of Artificial Sequence: Synthetic oligonucleotide
  Target: SCN10A; (+) strand; PAM type: YTN; PAM sequence: TTG
gaagtgaaccaaagggatgc

SEQ ID NO: 61752 - DNA, 20 bp, Artificial Sequence
  Description of Artificial Sequence: Synthetic oligonucleotide
  Target: SCN10A; (+) strand; PAM type: YTN; PAM sequence: CTA
acagtgactttgtttaaaaa

SEQ ID NO: 61753 - DNA, 20 bp, Artificial Sequence
  Description of Artificial Sequence: Synthetic oligonucleotide
  Target: SCN10A; (+) strand; PAM type: YTN; PAM sequence: CTT
tgtttaaaaataaaagcatc

SEQ ID NO: 61754 - DNA, 20 bp, Artificial Sequence
  Description of Artificial Sequence: Synthetic oligonucleotide
  Target: SCN10A; (+) strand; PAM type: YTN; PAM sequence: TTT
gtttaaaaataaaagcatca

SEQ ID NO: 61755 - DNA, 20 bp, Artificial Sequence
  Description of Artificial Sequence: Synthetic oligonucleotide
  Target: SCN10A; (+) strand; PAM type: YTN; PAM sequence: TTG
tttaaaaataaaagcatcaa

SEQ ID NO: 61756 - DNA, 20 bp, Artificial Sequence
  Description of Artificial Sequence: Synthetic oligonucleotide
  Target: SCN10A; (+) strand; PAM type: YTN; PAM sequence: TTT
aaaaataaaagcatcaacgg

SEQ ID NO: 61757 - DNA, 20 bp, Artificial Sequence
  Description of Artificial Sequence: Synthetic oligonucleotide
  Target: SCN10A; (+) strand; PAM type: YTN; PAM sequence: TTA
aaaataaaagcatcaacgga

SEQ ID NO: 61758 - DNA, 20 bp, Artificial Sequence
  Description of Artificial Sequence: Synthetic oligonucleotide
  Target: SCN10A; (+) strand; PAM type: YTN; PAM sequence: TTC
acaggcagtttacaaaaatg

SEQ ID NO: 61759 - DNA, 20 bp, Artificial Sequence
  Description of Artificial Sequence: Synthetic oligonucleotide
  Target: SCN10A; (+) strand; PAM type: YTN; PAM sequence: TTT
acaaaaatgaaagtaagaat

SEQ ID NO: 61760 - DNA, 20 bp, Artificial Sequence
  Description of Artificial Sequence: Synthetic oligonucleotide
  Target: SCN10A; (+) strand; PAM type: YTN; PAM sequence: TTA
caaaaatgaaagtaagaatc

SEQ ID NO: 61761 - DNA, 20 bp, Artificial Sequence
  Description of Artificial Sequence: Synthetic oligonucleotide
  Target: SCN10A; (+) strand; PAM type: YTN; PAM sequence: CTC
tgaaaaagaatgttctatct

SEQ ID NO: 61762 - DNA, 20 bp, Artificial Sequence
  Description of Artificial Sequence: Synthetic oligonucleotide
  Target: SCN10A; (+) strand; PAM type: YTN; PAM sequence: CTG
aaaaagaatgttctatctca

SEQ ID NO: 61763 - DNA, 20 bp, Artificial Sequence
  Description of Artificial Sequence: Synthetic oligonucleotide
  Target: SCN10A; (+) strand; PAM type: YTN; PAM sequence: TTC
tatctcactggtaatcaagg

SEQ ID NO: 61764 - DNA, 20 bp, Artificial Sequence
  Description of Artificial Sequence: Synthetic oligonucleotide
  Target: SCN10A; (+) strand; PAM type: YTN; PAM sequence: CTA
tctcactggtaatcaaggaa

SEQ ID NO: 61765 - DNA, 20 bp, Artificial Sequence
  Description of Artificial Sequence: Synthetic oligonucleotide
  Target: SCN10A; (+) strand; PAM type: YTN; PAM sequence: CTC
actggtaatcaaggaaattc

SEQ ID NO: 61766 - DNA, 20 bp, Artificial Sequence
  Description of Artificial Sequence: Synthetic oligonucleotide
  Target: SCN10A; (+) strand; PAM type: YTN; PAM sequence: CTG
gtaatcaaggaaattcaaat

SEQ ID NO: 61767 - DNA, 20 bp, Artificial Sequence
  Description of Artificial Sequence: Synthetic oligonucleotide
  Target: SCN10A; (+) strand; PAM type: YTN; PAM sequence: TTC
aaattaaaagaagatgctgt

SEQ ID NO: 61768 - DNA, 20 bp, Artificial Sequence
  Description of Artificial Sequence: Synthetic oligonucleotide
  Target: SCN10A; (+) strand; PAM type: YTN; PAM sequence: TTA
aaagaagatgctgtttttct

SEQ ID NO: 61769 - DNA, 20 bp, Artificial Sequence
  Description of Artificial Sequence: Synthetic oligonucleotide
  Target: SCN10A; (+) strand; PAM type: YTN; PAM sequence: CTG
tttttcttttatcagactgg

SEQ ID NO: 61770 - DNA, 20 bp, Artificial Sequence
  Description of Artificial Sequence: Synthetic oligonucleotide
  Target: SCN10A; (+) strand; PAM type: YTN; PAM sequence: TTT
ttcttttatcagactggtgg

SEQ ID NO: 61771 - DNA, 20 bp, Artificial Sequence
  Description of Artificial Sequence: Synthetic oligonucleotide
  Target: SCN10A; (+) strand; PAM type: YTN; PAM sequence: TTT
tcttttatcagactggtgga

SEQ ID NO: 61772 - DNA, 20 bp, Artificial Sequence
  Description of Artificial Sequence: Synthetic oligonucleotide
  Target: SCN10A; (+) strand; PAM type: YTN; PAM sequence: TTT
cttttatcagactggtggag

SEQ ID NO: 61773 - DNA, 20 bp, Artificial Sequence
  Description of Artificial Sequence: Synthetic oligonucleotide
  Target: SCN10A; (+) strand; PAM type: YTN; PAM sequence: TTC
ttttatcagactggtggaga

SEQ ID NO: 61774 - DNA, 20 bp, Artificial Sequence
  Description of Artificial Sequence: Synthetic oligonucleotide
  Target: SCN10A; (+) strand; PAM type: YTN; PAM sequence: CTT
ttatcagactggtggagatg

SEQ ID NO: 61775 - DNA, 20 bp, Artificial Sequence
  Description of Artificial Sequence: Synthetic oligonucleotide
  Target: SCN10A; (+) strand; PAM type: YTN; PAM sequence: TTT
tatcagactggtggagatgg

SEQ ID NO: 61776 - DNA, 20 bp, Artificial Sequence
  Description of Artificial Sequence: Synthetic oligonucleotide
  Target: SCN10A; (+) strand; PAM type: YTN; PAM sequence: TTT
atcagactggtggagatgga

SEQ ID NO: 61777 - DNA, 20 bp, Artificial Sequence
  Description of Artificial Sequence: Synthetic oligonucleotide
  Target: SCN10A; (+) strand; PAM type: YTN; PAM sequence: TTA
tcagactggtggagatggaa

SEQ ID NO: 61778 - DNA, 20 bp, Artificial Sequence
  Description of Artificial Sequence: Synthetic oligonucleotide
  Target: SCN10A; (+) strand; PAM type: YTN; PAM sequence: CTG
gtggagatggaaaagaatag

SEQ ID NO: 61779 - DNA, 20 bp, Artificial Sequence
  Description of Artificial Sequence: Synthetic oligonucleotide
  Target: SCN10A; (+) strand; PAM type: YTN; PAM sequence: CTA
ggatgctgtggctgtggggg

SEQ ID NO: 61780 - DNA, 20 bp, Artificial Sequence
  Description of Artificial Sequence: Synthetic oligonucleotide
  Target: SCN10A; (+) strand; PAM type: YTN; PAM sequence: CTG
tggctgtggggggctgccac

SEQ ID NO: 61781 - DNA, 20 bp, Artificial Sequence
  Description of Artificial Sequence: Synthetic oligonucleotide
  Target: SCN10A; (+) strand; PAM type: YTN; PAM sequence: CTG
tggggggctgccactctttt

SEQ ID NO: 61782 - DNA, 20 bp, Artificial Sequence
  Description of Artificial Sequence: Synthetic oligonucleotide
  Target: SCN10A; (+) strand; PAM type: YTN; PAM sequence: CTG
ccactctttttttttttttt

SEQ ID NO: 61783 - DNA, 20 bp, Artificial Sequence
  Description of Artificial Sequence: Synthetic oligonucleotide
  Target: SCN10A; (+) strand; PAM type: YTN; PAM sequence: CTC
tttttttttttttttttttt

SEQ ID NO: 61784 - DNA, 20 bp, Artificial Sequence
  Description of Artificial Sequence: Synthetic oligonucleotide
  Target: SCN10A; (+) strand; PAM type: YTN; PAM sequence: CTT
tttttttttttttttttttt

SEQ ID NO: 61785 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61786 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61787 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61788 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61789 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61790 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61791 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61792 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61793 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61794 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61795 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61796 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61797 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61798 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61799 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61800 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61801 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61802 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61803 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61804 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61805 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61806 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 61807 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttg

SEQ ID NO: 61808 - DNA, 20 bp, Artificial Sequence
  Description of Artificial Sequence: Synthetic oligonucleotide
  Target: SCN10A; (+) strand; PAM type: YTN; PAM sequence: TTT
ttttttttttttttttttga

SEQ ID NO: 61809 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttgag

SEQ ID NO: 61810 - DNA, 20 bp, Artificial Sequence
  Description of Artificial Sequence: Synthetic oligonucleotide
  Target: SCN10A; (+) strand; PAM type: YTN; PAM sequence: TTT
ttttttttttttttttgaga

SEQ ID NO: 61811 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttgagac

SEQ ID NO: 61812 - DNA, 20 bp, Artificial Sequence
  Description of Artificial Sequence: Synthetic oligonucleotide
  Target: SCN10A; (+) strand; PAM type: YTN; PAM sequence: TTT
ttttttttttttttgagacg

SEQ ID NO: 61813 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttgagacgg

SEQ ID NO: 61814 - DNA, 20 bp, Artificial Sequence
  Description of Artificial Sequence: Synthetic oligonucleotide
  Target: SCN10A; (+) strand; PAM type: YTN; PAM sequence: TTT
ttttttttttttgagacgga

SEQ ID NO: 61815 - DNA, 20 bp, Artificial Sequence
  Description of Artificial Sequence: Synthetic oligonucleotide
  Target: SCN10A; (+) strand; PAM type: YTN; PAM sequence: TTT
tttttttttttgagacggag

SEQ ID NO: 61816 - DNA, 20 bp, Artificial Sequence
  Description of Artificial Sequence: Synthetic oligonucleotide
  Target: SCN10A; (+) strand; PAM type: YTN; PAM sequence: TTT
ttttttttttgagacggagt

SEQ ID NO: 61817 - DNA, 20 bp, Artificial Sequence
  Description of Artificial Sequence: Synthetic oligonucleotide
  Target: SCN10A; (+) strand; PAM type: YTN; PAM sequence: TTT
tttttttttgagacggagtc

SEQ ID NO: 61818 - DNA, 20 bp, Artificial Sequence
  Description of Artificial Sequence: Synthetic oligonucleotide
  Target: SCN10A; (+) strand; PAM type: YTN; PAM sequence: TTT
ttttttttgagacggagtct

SEQ ID NO: 61819 - DNA, 20 bp, Artificial Sequence
  Description of Artificial Sequence: Synthetic oligonucleotide
  Target: SCN10A; (+) strand; PAM type: YTN; PAM sequence: TTT
tttttttgagacggagtctc

SEQ ID NO: 61820 - DNA, 20 bp, Artificial Sequence
  Description of Artificial Sequence: Synthetic oligonucleotide
  Target: SCN10A; (+) strand; PAM type: YTN; PAM sequence: TTT
ttttttgagacggagtctcg

SEQ ID NO: 61821 - DNA, 20 bp, Artificial Sequence
  Description of Artificial Sequence: Synthetic oligonucleotide
  Target: SCN10A; (+) strand; PAM type: YTN; PAM sequence: TTT
tttttgagacggagtctcgc

SEQ ID NO: 61822 - DNA, 20 bp, Artificial Sequence
  Description of Artificial Sequence: Synthetic oligonucleotide
  Target: SCN10A; (+) strand; PAM type: YTN; PAM sequence: TTT
ttttgagacggagtctcgct

SEQ ID NO: 61823 - DNA, 20 bp, Artificial Sequence
  Description of Artificial Sequence: Synthetic oligonucleotide
  Target: SCN10A; (+) strand; PAM type: YTN; PAM sequence: TTT
tttgagacggagtctcgctc

SEQ ID NO: 61824 - DNA, 20 bp, Artificial Sequence
  Description of Artificial Sequence: Synthetic oligonucleotide
  Target: SCN10A; (+) strand; PAM type: YTN; PAM sequence: TTT
ttgagacggagtctcgctct

SEQ ID NO: 61825 - DNA, 20 bp, Artificial Sequence
  Description of Artificial Sequence: Synthetic oligonucleotide
  Target: SCN10A; (+) strand; PAM type: YTN; PAM sequence: TTT
tgagacggagtctcgctctg

SEQ ID NO: 61826 - DNA, 20 bp, Artificial Sequence
  Description of Artificial Sequence: Synthetic oligonucleotide
  Target: SCN10A; (+) strand; PAM type: YTN; PAM sequence: TTT
gagacggagtctcgctctgt

SEQ ID NO: 61827 - DNA, 20 bp, Artificial Sequence
  Description of Artificial Sequence: Synthetic oligonucleotide
  Target: SCN10A; (+) strand; PAM type: YTN; PAM sequence: TTG
agacggagtctcgctctgtc

SEQ ID NO: 61828 - DNA, 20 bp, Artificial Sequence
  Description of Artificial Sequence: Synthetic oligonucleotide
  Target: SCN10A; (+) strand; PAM type: YTN; PAM sequence: CTC
gctctgtcgcccaggctgga

SEQ ID NO: 61829 - DNA, 20 bp, Artificial Sequence
  Description of Artificial Sequence: Synthetic oligonucleotide
  Target: SCN10A; (+) strand; PAM type: YTN; PAM sequence: CTC
tgtcgcccaggctggagtgc

SEQ ID NO: 61830 - DNA, 20 bp, Artificial Sequence
  Description of Artificial Sequence: Synthetic oligonucleotide
  Target: SCN10A; (+) strand; PAM type: YTN; PAM sequence: CTG
tcgcccaggctggagtgcag

SEQ ID NO: 61831 - DNA, 20 bp, Artificial Sequence
  Description of Artificial Sequence: Synthetic oligonucleotide
  Target: SCN10A; (+) strand; PAM type: YTN; PAM sequence: CTG
gagtgcagtagcgggatctc

SEQ ID NO: 61832 - DNA, 20 bp, Artificial Sequence
  Description of Artificial Sequence: Synthetic oligonucleotide
  Target: SCN10A; (+) strand; PAM type: YTN; PAM sequence: CTC
ggctcactgcaagctctgcc

SEQ ID NO: 61833 - DNA, 20 bp, Artificial Sequence
  Description of Artificial Sequence: Synthetic oligonucleotide
  Target: SCN10A; (+) strand; PAM type: YTN; PAM sequence: CTC
actgcaagctctgcctccca

SEQ ID NO: 61834 - DNA, 20 bp, Artificial Sequence
  Description of Artificial Sequence: Synthetic oligonucleotide
  Target: SCN10A; (+) strand; PAM type: YTN; PAM sequence: CTG
caagctctgcctcccaggtt

SEQ ID NO: 61835 - DNA, 20 bp, Artificial Sequence
  Description of Artificial Sequence: Synthetic oligonucleotide
  Target: SCN10A; (+) strand; PAM type: YTN; PAM sequence: CTC
tgcctcccaggttcacgcca

SEQ ID NO: 61836 - DNA, 20 bp, Artificial Sequence
  Description of Artificial Sequence: Synthetic oligonucleotide
  Target: SCN10A; (+) strand; PAM type: YTN; PAM sequence: CTG
cctcccaggttcacgccatt

SEQ ID NO: 61837 - DNA, 20 bp, Artificial Sequence
  Description of Artificial Sequence: Synthetic oligonucleotide
  Target: SCN10A; (+) strand; PAM type: YTN; PAM sequence: CTC
ccaggttcacgccattctcc

SEQ ID NO: 61838 - DNA, 20 bp, Artificial Sequence
  Description of Artificial Sequence: Synthetic oligonucleotide
  Target: SCN10A; (+) strand; PAM type: YTN; PAM sequence: TTC
acgccattctcctgcctcag

SEQ ID NO: 61839 - DNA, 20 bp, Artificial Sequence
  Description of Artificial Sequence: Synthetic oligonucleotide
  Target: SCN10A; (+) strand; PAM type: YTN; PAM sequence: TTC
tcctgcctcagcctcccaag

SEQ ID NO: 61840 - DNA, 20 bp, Artificial Sequence
  Description of Artificial Sequence: Synthetic oligonucleotide
  Target: SCN10A; (+) strand; PAM type: YTN; PAM sequence: CTC
ctgcctcagcctcccaagta

SEQ ID NO: 61841 - DNA, 20 bp, Artificial Sequence
  Description of Artificial Sequence: Synthetic oligonucleotide
  Target: SCN10A; (+) strand; PAM type: YTN; PAM sequence: CTG
cctcagcctcccaagtagct

SEQ ID NO: 61842 - DNA, 20 bp, Artificial Sequence
  Description of Artificial Sequence: Synthetic oligonucleotide
  Target: SCN10A; (+) strand; PAM type: YTN; PAM sequence: CTC
agcctcccaagtagctggga

SEQ ID NO: 61843 - DNA, 20 bp, Artificial Sequence
  Description of Artificial Sequence: Synthetic oligonucleotide
  Target: SCN10A; (+) strand; PAM type: YTN; PAM sequence: CTC
ccaagtagctgggactacag

SEQ ID NO: 61844 - DNA, 20 bp, Artificial Sequence
  Description of Artificial Sequence: Synthetic oligonucleotide
  Target: SCN10A; (+) strand; PAM type: YTN; PAM sequence: CTG
ggactacaggcgcccgccac

SEQ ID NO: 61845 - DNA, 20 bp, Artificial Sequence
  Description of Artificial Sequence: Synthetic oligonucleotide
  Target: SCN10A; (+) strand; PAM type: YTN; PAM sequence: CTA
caggcgcccgccactacgcc

SEQ ID NO: 61846 - DNA, 20 bp, Artificial Sequence
  Description of Artificial Sequence: Synthetic oligonucleotide
  Target: SCN10A; (+) strand; PAM type: YTN; PAM sequence: CTA
cgcccggctaattttttgta

SEQ ID NO: 61847 - DNA, 20 bp, Artificial Sequence
  Description of Artificial Sequence: Synthetic oligonucleotide
  Target: SCN10A; (+) strand; PAM type: YTN; PAM sequence: CTA
attttttgtatttttagtag

SEQ ID NO: 61848 - DNA, 20 bp, Artificial Sequence
  Description of Artificial Sequence: Synthetic oligonucleotide
  Target: SCN10A; (+) strand; PAM type: YTN; PAM sequence: TTT
tttgtatttttagtagagac

SEQ ID NO: 61849 - DNA, 20 bp, Artificial Sequence
  Description of Artificial Sequence: Synthetic oligonucleotide
  Target: SCN10A; (+) strand; PAM type: YTN; PAM sequence: TTT
ttgtatttttagtagagacg

SEQ ID NO: 61850 - DNA, 20 bp, Artificial Sequence
  Description of Artificial Sequence: Synthetic oligonucleotide
  Target: SCN10A; (+) strand; PAM type: YTN; PAM sequence: TTT
tgtatttttagtagagacgg

SEQ ID NO: 61851 - DNA, 20 bp, Artificial Sequence
  Description of Artificial Sequence: Synthetic oligonucleotide
  Target: SCN10A; (+) strand; PAM type: YTN; PAM sequence: TTT
gtatttttagtagagacggg

SEQ ID NO: 61852 - DNA, 20 bp, Artificial Sequence
  Description of Artificial Sequence: Synthetic oligonucleotide
  Target: SCN10A; (+) strand; PAM type: YTN; PAM sequence: TTG
tatttttagtagagacgggg

SEQ ID NO: 61853 - DNA, 20 bp, Artificial Sequence
  Description of Artificial Sequence: Synthetic oligonucleotide
  Target: SCN10A; (+) strand; PAM type: YTN; PAM sequence: TTT
ttagtagagacggggtttca

SEQ ID NO: 61854 - DNA, 20 bp, Artificial Sequence
  Description of Artificial Sequence: Synthetic oligonucleotide
  Target: SCN10A; (+) strand; PAM type: YTN; PAM sequence: TTT
tagtagagacggggtttcac

SEQ ID NO: 61855 - DNA, 20 bp, Artificial Sequence
  Description of Artificial Sequence: Synthetic oligonucleotide
  Target: SCN10A; (+) strand; PAM type: YTN; PAM sequence: TTT
agtagagacggggtttcacc

SEQ ID NO: 61856 - DNA, 20 bp, Artificial Sequence
  Description of Artificial Sequence: Synthetic oligonucleotide
  Target: SCN10A; (+) strand; PAM type: YTN; PAM sequence: TTA
gtagagacggggtttcaccg

SEQ ID NO: 61857 - DNA, 20 bp, Artificial Sequence
  Description of Artificial Sequence: Synthetic oligonucleotide
  Target: SCN10A; (+) strand; PAM type: YTN; PAM sequence: TTT
caccgttttagccgggatgg

SEQ ID NO: 61858 - DNA, 20 bp, Artificial Sequence
  Description of Artificial Sequence: Synthetic oligonucleotide
  Target: SCN10A; (+) strand; PAM type: YTN; PAM sequence: TTC
accgttttagccgggatggt

SEQ ID NO: 61859 - DNA, 20 bp, Artificial Sequence
  Description of Artificial Sequence: Synthetic oligonucleotide
  Target: SCN10A; (+) strand; PAM type: YTN; PAM sequence: TTT
tagccgggatggtctcgatc

SEQ ID NO: 61860 - DNA, 20 bp, Artificial Sequence
  Description of Artificial Sequence: Synthetic oligonucleotide
  Target: SCN10A; (+) strand; PAM type: YTN; PAM sequence: TTT
agccgggatggtctcgatct

SEQ ID NO: 61861 - DNA, 20 bp, Artificial Sequence
  Description of Artificial Sequence: Synthetic oligonucleotide
  Target: SCN10A; (+) strand; PAM type: YTN; PAM sequence: TTA
gccgggatggtctcgatctc

SEQ ID NO: 61862 - DNA, 20 bp, Artificial Sequence
  Description of Artificial Sequence: Synthetic oligonucleotide
  Target: SCN10A; (+) strand; PAM type: YTN; PAM sequence: CTC
gatctcctgacctcatgatc

SEQ ID NO: 61863 - DNA, 20 bp, Artificial Sequence
  Description of Artificial Sequence: Synthetic oligonucleotide
  Target: SCN10A; (+) strand; PAM type: YTN; PAM sequence: CTC
ctgacctcatgatccgcccg

SEQ ID NO: 61864 - DNA, 20 bp, Artificial Sequence
  Description of Artificial Sequence: Synthetic oligonucleotide
  Target: SCN10A; (+) strand; PAM type: YTN; PAM sequence: CTG
acctcatgatccgcccgcct

SEQ ID NO: 61865 - DNA, 20 bp, Artificial Sequence
  Description of Artificial Sequence: Synthetic oligonucleotide
  Target: SCN10A; (+) strand; PAM type: YTN; PAM sequence: CTC
atgatccgcccgcctcagcc

SEQ ID NO: 61866 - DNA, 20 bp, Artificial Sequence
  Description of Artificial Sequence: Synthetic oligonucleotide
  Target: SCN10A; (+) strand; PAM type: YTN; PAM sequence: CTC
agcctcccaaagtgctggga

SEQ ID NO: 61867 - DNA, 20 bp, Artificial Sequence
  Description of Artificial Sequence: Synthetic oligonucleotide
  Target: SCN10A; (+) strand; PAM type: YTN; PAM sequence: CTC
ccaaagtgctgggattacag

SEQ ID NO: 61868 - DNA, 20 bp, Artificial Sequence
  Description of Artificial Sequence: Synthetic oligonucleotide
  Target: SCN10A; (+) strand; PAM type: YTN; PAM sequence: CTG
ggattacaggcgtgagccac

SEQ ID NO: 61869 - DNA, 20 bp, Artificial Sequence
  Description of Artificial Sequence: Synthetic oligonucleotide
  Target: SCN10A; (+) strand; PAM type: YTN; PAM sequence: TTA
caggcgtgagccaccgcgcc

SEQ ID NO: 61870 - DNA, 20 bp, Artificial Sequence
  Description of Artificial Sequence: Synthetic oligonucleotide
  Target: SCN10A; (+) strand; PAM type: YTN; PAM sequence: CTC
ttacaagtgactggcaggag

SEQ ID NO: 61871 - DNA, 20 bp, Artificial Sequence
  Description of Artificial Sequence: Synthetic oligonucleotide
  Target: SCN10A; (+) strand; PAM type: YTN; PAM sequence: CTT
acaagtgactggcaggagtg

SEQ ID NO: 61872 - DNA, 20 bp, Artificial Sequence
  Description of Artificial Sequence: Synthetic oligonucleotide
  Target: SCN10A; (+) strand; PAM type: YTN; PAM sequence: TTA
caagtgactggcaggagtga

SEQ ID NO: 61873 - DNA, 20 bp, Artificial Sequence
  Description of Artificial Sequence: Synthetic oligonucleotide
  Target: SCN10A; (+) strand; PAM type: YTN; PAM sequence: CTG
gcaggagtgaaaacctggcc

SEQ ID NO: 61874 - DNA, 20 bp, Artificial Sequence
  Description of Artificial Sequence: Synthetic oligonucleotide
  Target: SCN10A; (+) strand; PAM type: YTN; PAM sequence: CTG
gccagtcctgtgtgaagcca

SEQ ID NO: 61875 - DNA, 20 bp, Artificial Sequence
  Description of Artificial Sequence: Synthetic oligonucleotide
  Target: SCN10A; (+) strand; PAM type: YTN; PAM sequence: CTG
tgtgaagccaaattggcaat

SEQ ID NO: 61876 - DNA, 20 bp, Artificial Sequence
  Description of Artificial Sequence: Synthetic oligonucleotide
  Target: SCN10A; (+) strand; PAM type: YTN; PAM sequence: TTG
gcaatgtgactcagaggttt

SEQ ID NO: 61877 - DNA, 20 bp, Artificial Sequence
  Description of Artificial Sequence: Synthetic oligonucleotide
  Target: SCN10A; (+) strand; PAM type: YTN; PAM sequence: CTC
agaggtttcaggaacctagc

SEQ ID NO: 61878 - DNA, 20 bp, Artificial Sequence
  Description of Artificial Sequence: Synthetic oligonucleotide
  Target: SCN10A; (+) strand; PAM type: YTN; PAM sequence: TTT
caggaacctagcaattcctc

SEQ ID NO: 61879 - DNA, 20 bp, Artificial Sequence
  Description of Artificial Sequence: Synthetic oligonucleotide
  Target: SCN10A; (+) strand; PAM type: YTN; PAM sequence: TTC
aggaacctagcaattcctcc

SEQ ID NO: 61880 - DNA, 20 bp, Artificial Sequence
  Description of Artificial Sequence: Synthetic oligonucleotide
  Target: SCN10A; (+) strand; PAM type: YTN; PAM sequence: CTA
gcaattcctccttcaagcac

SEQ ID NO: 61881 - DNA, 20 bp, Artificial Sequence
  Description of Artificial Sequence: Synthetic oligonucleotide
  Target: SCN10A; (+) strand; PAM type: YTN; PAM sequence: TTC
ctccttcaagcactaatcct

SEQ ID NO: 61882 - DNA, 20 bp, Artificial Sequence
  Description of Artificial Sequence: Synthetic oligonucleotide
  Target: SCN10A; (+) strand; PAM type: YTN; PAM sequence: CTC
cttcaagcactaatcctaag

SEQ ID NO: 61883 - DNA, 20 bp, Artificial Sequence
  Description of Artificial Sequence: Synthetic oligonucleotide
  Target: SCN10A; (+) strand; PAM type: YTN; PAM sequence: CTT
caagcactaatcctaaggac

SEQ ID NO: 61884 - DNA, 20 bp, Artificial Sequence
  Description of Artificial Sequence: Synthetic oligonucleotide
  Target: SCN10A; (+) strand; PAM type: YTN; PAM sequence: TTC
aagcactaatcctaaggaca

SEQ ID NO: 61885 - DNA, 20 bp, Artificial Sequence
  Description of Artificial Sequence: Synthetic oligonucleotide
  Target: SCN10A; (+) strand; PAM type: YTN; PAM sequence: CTA
atcctaaggacactggaggc

SEQ ID NO: 61886 - DNA, 20 bp, Artificial Sequence
  Description of Artificial Sequence: Synthetic oligonucleotide
  Target: SCN10A; (+) strand; PAM type: YTN; PAM sequence: CTA
aggacactggaggctgttgg

SEQ ID NO: 61887 - DNA, 20 bp, Artificial Sequence
  Description of Artificial Sequence: Synthetic oligonucleotide
  Target: SCN10A; (+) strand; PAM type: YTN; PAM sequence: CTG
gaggctgttggtgcccactc

SEQ ID NO: 61888 - DNA, 20 bp, Artificial Sequence
  Description of Artificial Sequence: Synthetic oligonucleotide
  Target: SCN10A; (+) strand; PAM type: YTN; PAM sequence: CTG
ttggtgcccactcaggtcct

SEQ ID NO: 61889 - DNA, 20 bp, Artificial Sequence
  Description of Artificial Sequence: Synthetic oligonucleotide
  Target: SCN10A; (+) strand; PAM type: YTN; PAM sequence: TTG
gtgcccactcaggtcctctt

SEQ ID NO: 61890 - DNA, 20 bp, Artificial Sequence
  Description of Artificial Sequence: Synthetic oligonucleotide
  Target: SCN10A; (+) strand; PAM type: YTN; PAM sequence: CTC
aggtcctctttaaggggcca

SEQ ID NO: 61891 - DNA, 20 bp, Artificial Sequence
  Description of Artificial Sequence: Synthetic oligonucleotide
  Target: SCN10A; (+) strand; PAM type: YTN; PAM sequence: CTC
tttaaggggccagtgcccct

SEQ ID NO: 61892 - DNA, 20 bp, Artificial Sequence
  Description of Artificial Sequence: Synthetic oligonucleotide
  Target: SCN10A; (+) strand; PAM type: YTN; PAM sequence: CTT
taaggggccagtgcccctat

SEQ ID NO: 61893 - DNA, 20 bp, Artificial Sequence
  Description of Artificial Sequence: Synthetic oligonucleotide
  Target: SCN10A; (+) strand; PAM type: YTN; PAM sequence: TTT
aaggggccagtgcccctatc

SEQ ID NO: 61894 - DNA, 20 bp, Artificial Sequence
  Description of Artificial Sequence: Synthetic oligonucleotide
  Target: SCN10A; (+) strand; PAM type: YTN; PAM sequence: TTA
aggggccagtgcccctatcc

SEQ ID NO: 61895 - DNA, 20 bp, Artificial Sequence
  Description of Artificial Sequence: Synthetic oligonucleotide
  Target: SCN10A; (+) strand; PAM type: YTN; PAM sequence: CTA
tccttcatctgctgggagtg

SEQ ID NO: 61896 - DNA, 20 bp, Artificial Sequence
  Description of Artificial Sequence: Synthetic oligonucleotide
  Target: SCN10A; (+) strand; PAM type: YTN; PAM sequence: CTT
catctgctgggagtgtcggc

SEQ ID NO: 61897 - DNA, 20 bp, Artificial Sequence
  Description of Artificial Sequence: Synthetic oligonucleotide
  Target: SCN10A; (+) strand; PAM type: YTN; PAM sequence: TTC
atctgctgggagtgtcggct

SEQ ID NO: 61898 - DNA, 20 bp, Artificial Sequence
  Description of Artificial Sequence: Synthetic oligonucleotide
  Target: SCN10A; (+) strand; PAM type: YTN; PAM sequence: CTG
ctgggagtgtcggctgctaa

SEQ ID NO: 61899 - DNA, 20 bp, Artificial Sequence
  Description of Artificial Sequence: Synthetic oligonucleotide
  Target: SCN10A; (+) strand; PAM type: YTN; PAM sequence: CTG
ggagtgtcggctgctaatag

SEQ ID NO: 61900 - DNA, 20 bp, Artificial Sequence
  Description of Artificial Sequence: Synthetic oligonucleotide
  Target: SCN10A; (+) strand; PAM type: YTN; PAM sequence: CTG
ctaatagttcatggatgcag

SEQ ID NO: 61901 - DNA, 20 bp, Artificial Sequence
  Description of Artificial Sequence: Synthetic oligonucleotide
  Target: SCN10A; (+) strand; PAM type: YTN; PAM sequence: CTA
atagttcatggatgcagaca

SEQ ID NO: 61902 - DNA, 20 bp, Artificial Sequence
  Description of Artificial Sequence: Synthetic oligonucleotide
  Target: SCN10A; (+) strand; PAM type: YTN; PAM sequence: TTC
atggatgcagacaccccctt

SEQ ID NO: 61903 - DNA, 20 bp, Artificial Sequence
  Description of Artificial Sequence: Synthetic oligonucleotide
  Target: SCN10A; (+) strand; PAM type: YTN; PAM sequence: CTT
cctgatggcttcgctgggct

SEQ ID NO: 61904 - DNA, 20 bp, Artificial Sequence
  Description of Artificial Sequence: Synthetic oligonucleotide
  Target: SCN10A; (+) strand; PAM type: YTN; PAM sequence: TTC
ctgatggcttcgctgggctg

SEQ ID NO: 61905 - DNA, 20 bp, Artificial Sequence
  Description of Artificial Sequence: Synthetic oligonucleotide
  Target: SCN10A; (+) strand; PAM type: YTN; PAM sequence: CTG
atggcttcgctgggctggag

SEQ ID NO: 61906 - DNA, 20 bp, Artificial Sequence
  Description of Artificial Sequence: Synthetic oligonucleotide
  Target: SCN10A; (+) strand; PAM type: YTN; PAM sequence: CTT
cgctgggctggaggaaactg

SEQ ID NO: 61907 - DNA, 20 bp, Artificial Sequence
  Description of Artificial Sequence: Synthetic oligonucleotide
  Target: SCN10A; (+) strand; PAM type: YTN; PAM sequence: TTC
gctgggctggaggaaactgt

SEQ ID NO: 61908 - DNA, 20 bp, Artificial Sequence
  Description of Artificial Sequence: Synthetic oligonucleotide
  Target: SCN10A; (+) strand; PAM type: YTN; PAM sequence: CTG
ggctggaggaaactgtgtcc

SEQ ID NO: 61909 - DNA, 20 bp, Artificial Sequence
  Description of Artificial Sequence: Synthetic oligonucleotide
  Target: SCN10A; (+) strand; PAM type: YTN; PAM sequence: CTG
gaggaaactgtgtccacctt

SEQ ID NO: 61910 - DNA, 20 bp, Artificial Sequence
  Description of Artificial Sequence: Synthetic oligonucleotide
  Target: SCN10A; (+) strand; PAM type: YTN; PAM sequence: CTG
tgtccaccttgggaaatgct

SEQ ID NO: 61911 - DNA, 20 bp, Artificial Sequence
  Description of Artificial Sequence: Synthetic oligonucleotide
  Target: SCN10A; (+) strand; PAM type: YTN; PAM sequence: CTT
gggaaatgcttatcctcccc

SEQ ID NO: 61912 - DNA, 20 bp, Artificial Sequence
  Description of Artificial Sequence: Synthetic oligonucleotide
  Target: SCN10A; (+) strand; PAM type: YTN; PAM sequence: TTG
ggaaatgcttatcctccccg

SEQ ID NO: 61913 - DNA, 20 bp, Artificial Sequence
  Description of Artificial Sequence: Synthetic oligonucleotide
  Target: SCN10A; (+) strand; PAM type: YTN; PAM sequence: CTT
atcctccccgctggggcagc

SEQ ID NO: 61914 - DNA, 20 bp, Artificial Sequence
  Description of Artificial Sequence: Synthetic oligonucleotide
  Target: SCN10A; (+) strand; PAM type: YTN; PAM sequence: TTA
tcctccccgctggggcagcc

SEQ ID NO: 61915 - DNA, 20 bp, Artificial Sequence
  Description of Artificial Sequence: Synthetic oligonucleotide
  Target: SCN10A; (+) strand; PAM type: YTN; PAM sequence: CTC
cccgctggggcagccctcag

SEQ ID NO: 61916 - DNA, 20 bp, Artificial Sequence
  Description of Artificial Sequence: Synthetic oligonucleotide
  Target: SCN10A; (+) strand; PAM type: YTN; PAM sequence: CTG
gggcagccctcagccaggga

SEQ ID NO: 61917 - DNA, 20 bp, Artificial Sequence
  Description of Artificial Sequence: Synthetic oligonucleotide
  Target: SCN10A; (+) strand; PAM type: YTN; PAM sequence: CTC
agccagggacagtgacaggg

SEQ ID NO: 61918 - DNA, 20 bp, Artificial Sequence
  Description of Artificial Sequence: Synthetic oligonucleotide
  Target: SCN10A; (+) strand; PAM type: YTN; PAM sequence: TTT
acaaggctgtcttctttgcc

SEQ ID NO: 61919 - DNA, 20 bp, Artificial Sequence
  Description of Artificial Sequence: Synthetic oligonucleotide
  Target: SCN10A; (+) strand; PAM type: YTN; PAM sequence: TTA
caaggctgtcttctttgcct

SEQ ID NO: 61920 - DNA, 20 bp, Artificial Sequence
  Description of Artificial Sequence: Synthetic oligonucleotide
  Target: SCN10A; (+) strand; PAM type: YTN; PAM sequence: CTG
tcttctttgcctcaaggtgg

SEQ ID NO: 61921 - DNA, 20 bp, Artificial Sequence
  Description of Artificial Sequence: Synthetic oligonucleotide
  Target: SCN10A; (+) strand; PAM type: YTN; PAM sequence: CTT
ctttgcctcaaggtgggaca

SEQ ID NO: 61922 - DNA, 20 bp, Artificial Sequence
  Description of Artificial Sequence: Synthetic oligonucleotide
  Target: SCN10A; (+) strand; PAM type: YTN; PAM sequence: TTC
tttgcctcaaggtgggacag

SEQ ID NO: 61923 - DNA, 20 bp, Artificial Sequence
  Description of Artificial Sequence: Synthetic oligonucleotide
  Target: SCN10A; (+) strand; PAM type: YTN; PAM sequence: CTT
tgcctcaaggtgggacagct

SEQ ID NO: 61924 - DNA, 20 bp, Artificial Sequence
  Description of Artificial Sequence: Synthetic oligonucleotide
  Target: SCN10A; (+) strand; PAM type: YTN; PAM sequence: TTT
gcctcaaggtgggacagctc

SEQ ID NO: 61925 - DNA, 20 bp, Artificial Sequence
  Description of Artificial Sequence: Synthetic oligonucleotide
  Target: SCN10A; (+) strand; PAM type: YTN; PAM sequence: TTG
cctcaaggtgggacagctct

SEQ ID NO: 61926 - DNA, 20 bp, Artificial Sequence
  Description of Artificial Sequence: Synthetic oligonucleotide
  Target: SCN10A; (+) strand; PAM type: YTN; PAM sequence: CTC
aaggtgggacagctctttgg

SEQ ID NO: 61927 - DNA, 20 bp, Artificial Sequence
  Description of Artificial Sequence: Synthetic oligonucleotide
  Target: SCN10A; (+) strand; PAM type: YTN; PAM sequence: CTC
tttggtgtcctttgtgcttc

SEQ ID NO: 61928 - DNA, 20 bp, Artificial Sequence
  Description of Artificial Sequence: Synthetic oligonucleotide
  Target: SCN10A; (+) strand; PAM type: YTN; PAM sequence: CTT
tggtgtcctttgtgcttcag

SEQ ID NO: 61929 - DNA, 20 bp, Artificial Sequence
  Description of Artificial Sequence: Synthetic oligonucleotide
  Target: SCN10A; (+) strand; PAM type: YTN; PAM sequence: TTT
ggtgtcctttgtgcttcagg

SEQ ID NO: 61930 - DNA, 20 bp, Artificial Sequence
  Description of Artificial Sequence: Synthetic oligonucleotide
  Target: SCN10A; (+) strand; PAM type: YTN; PAM sequence: TTG
gtgtcctttgtgcttcaggg

SEQ ID NO: 61931 - DNA, 20 bp, Artificial Sequence
  Description of Artificial Sequence: Synthetic oligonucleotide
  Target: SCN10A; (+) strand; PAM type: YTN; PAM sequence: CTT
tgtgcttcagggctttccat

SEQ ID NO: 61932 - DNA, 20 bp, Artificial Sequence
  Description of Artificial Sequence: Synthetic oligonucleotide
  Target: SCN10A; (+) strand; PAM type: YTN; PAM sequence: TTT
gtgcttcagggctttccatg

SEQ ID NO: 61933 - DNA, 20 bp, Artificial Sequence
  Description of Artificial Sequence: Synthetic oligonucleotide
  Target: SCN10A; (+) strand; PAM type: YTN; PAM sequence: TTG
tgcttcagggctttccatgg

SEQ ID NO: 61934 - DNA, 20 bp, Artificial Sequence
  Description of Artificial Sequence: Synthetic oligonucleotide
  Target: SCN10A; (+) strand; PAM type: YTN; PAM sequence: CTT
cagggctttccatgggatca

SEQ ID NO: 61935 - DNA, 20 bp, Artificial Sequence
  Description of Artificial Sequence: Synthetic oligonucleotide
  Target: SCN10A; (+) strand; PAM type: YTN; PAM sequence: TTC
agggctttccatgggatcag

SEQ ID NO: 61936 - DNA, 20 bp, Artificial Sequence
  Description of Artificial Sequence: Synthetic oligonucleotide
  Target: SCN10A; (+) strand; PAM type: YTN; PAM sequence: CTT
tccatgggatcagctgaagc

SEQ ID NO: 61937 - DNA, 20 bp, Artificial Sequence
  Description of Artificial Sequence: Synthetic oligonucleotide
  Target: SCN10A; (+) strand; PAM type: YTN; PAM sequence: TTT
ccatgggatcagctgaagcc

SEQ ID NO: 61938 - DNA, 20 bp, Artificial Sequence
  Description of Artificial Sequence: Synthetic oligonucleotide
  Target: SCN10A; (+) strand; PAM type: YTN; PAM sequence: TTC
catgggatcagctgaagccg

SEQ ID NO: 61939 - DNA, 20 bp, Artificial Sequence
  Description of Artificial Sequence: Synthetic oligonucleotide
  Target: SCN10A; (+) strand; PAM type: YTN; PAM sequence: CTG
aagccggatttcaactgaac

SEQ ID NO: 61940 - DNA, 20 bp, Artificial Sequence
  Description of Artificial Sequence: Synthetic oligonucleotide
  Target: SCN10A; (+) strand; PAM type: YTN; PAM sequence: TTT
caactgaacccacatctttt

SEQ ID NO: 61941 - DNA, 20 bp, Artificial Sequence
  Description of Artificial Sequence: Synthetic oligonucleotide
  Target: SCN10A; (+) strand; PAM type: YTN; PAM sequence: TTC
aactgaacccacatcttttc

SEQ ID NO: 61942 - DNA, 20 bp, Artificial Sequence
  Description of Artificial Sequence: Synthetic oligonucleotide
  Target: SCN10A; (+) strand; PAM type: YTN; PAM sequence: CTG
aacccacatcttttctcagc

SEQ ID NO: 61943 - DNA, 20 bp, Artificial Sequence
  Description of Artificial Sequence: Synthetic oligonucleotide
  Target: SCN10A; (+) strand; PAM type: YTN; PAM sequence: CTT
ttctcagcttccgattctgt

SEQ ID NO: 61944 - DNA, 20 bp, Artificial Sequence
  Description of Artificial Sequence: Synthetic oligonucleotide
  Target: SCN10A; (+) strand; PAM type: YTN; PAM sequence: TTT
tctcagcttccgattctgtg

SEQ ID NO: 61945 - DNA, 20 bp, Artificial Sequence
  Description of Artificial Sequence: Synthetic oligonucleotide
  Target: SCN10A; (+) strand; PAM type: YTN; PAM sequence: TTT
ctcagcttccgattctgtgt

SEQ ID NO: 61946 - DNA, 20 bp, Artificial Sequence
  Description of Artificial Sequence: Synthetic oligonucleotide
  Target: SCN10A; (+) strand; PAM type: YTN; PAM sequence: TTC
tcagcttccgattctgtgtc

SEQ ID NO: 61947 - DNA, 20 bp, Artificial Sequence
  Description of Artificial Sequence: Synthetic oligonucleotide
  Target: SCN10A; (+) strand; PAM type: YTN; PAM sequence: CTC
agcttccgattctgtgtcta

SEQ ID NO: 61948 - DNA, 20 bp, Artificial Sequence
  Description of Artificial Sequence: Synthetic oligonucleotide
  Target: SCN10A; (+) strand; PAM type: YTN; PAM sequence: CTT
ccgattctgtgtctaggacg

SEQ ID NO: 61949 - DNA, 20 bp, Artificial Sequence
  Description of Artificial Sequence: Synthetic oligonucleotide
  Target: SCN10A; (+) strand; PAM type: YTN; PAM sequence: TTC
cgattctgtgtctaggacga

SEQ ID NO: 61950 - DNA, 20 bp, Artificial Sequence
  Description of Artificial Sequence: Synthetic oligonucleotide
  Target: SCN10A; (+) strand; PAM type: YTN; PAM sequence: TTC
tgtgtctaggacgaggacta

SEQ ID NO: 61951 - DNA, 20 bp, Artificial Sequence
  Description of Artificial Sequence: Synthetic oligonucleotide
  Target: SCN10A; (+) strand; PAM type: YTN; PAM sequence: CTG
tgtctaggacgaggactaag

SEQ ID NO: 61952 - DNA, 20 bp, Artificial Sequence
  Description of Artificial Sequence: Synthetic oligonucleotide
  Target: SCN10A; (+) strand; PAM type: YTN; PAM sequence: CTA
ggacgaggactaagatggga

SEQ ID NO: 61953 - DNA, 20 bp, Artificial Sequence
  Description of Artificial Sequence: Synthetic oligonucleotide
  Target: SCN10A; (+) strand; PAM type: YTN; PAM sequence: CTA
agatgggagattatccaacg

SEQ ID NO: 61954 - DNA, 20 bp, Artificial Sequence
  Description of Artificial Sequence: Synthetic oligonucleotide
  Target: SCN10A; (+) strand; PAM type: YTN; PAM sequence: TTA
tccaacgtctctaagggagt

SEQ ID NO: 61955 - DNA, 20 bp, Artificial Sequence
  Description of Artificial Sequence: Synthetic oligonucleotide
  Target: SCN10A; (+) strand; PAM type: YTN; PAM sequence: CTC
taagggagtacacacaggga

SEQ ID NO: 61956 - DNA, 20 bp, Artificial Sequence
  Description of Artificial Sequence: Synthetic oligonucleotide
  Target: SCN10A; (+) strand; PAM type: YTN; PAM sequence: CTA
agggagtacacacagggaat

SEQ ID NO: 61957 - DNA, 20 bp, Artificial Sequence
  Description of Artificial Sequence: Synthetic oligonucleotide
  Target: SCN10A; (+) strand; PAM type: YTN; PAM sequence: TTC
aatgtgtattagaagtaaac

SEQ ID NO: 61958 - DNA, 20 bp, Artificial Sequence
  Description of Artificial Sequence: Synthetic oligonucleotide
  Target: SCN10A; (+) strand; PAM type: YTN; PAM sequence: TTA
gaagtaaacatagagattgg

SEQ ID NO: 61959 - DNA, 20 bp, Artificial Sequence
  Description of Artificial Sequence: Synthetic oligonucleotide
  Target: SCN10A; (+) strand; PAM type: YTN; PAM sequence: TTG
gttgagtaaattataaagga

SEQ ID NO: 61960 - DNA, 20 bp, Artificial Sequence
  Description of Artificial Sequence: Synthetic oligonucleotide
  Target: SCN10A; (+) strand; PAM type: YTN; PAM sequence: TTG
agtaaattataaaggaatat

SEQ ID NO: 61961 - DNA, 20 bp, Artificial Sequence
  Description of Artificial Sequence: Synthetic oligonucleotide
  Target: SCN10A; (+) strand; PAM type: YTN; PAM sequence: TTA
taaaggaatatgttatagcc

SEQ ID NO: 61962 - DNA, 20 bp, Artificial Sequence
  Description of Artificial Sequence: Synthetic oligonucleotide
  Target: SCN10A; (+) strand; PAM type: YTN; PAM sequence: TTA
tagccattaaatgagataat

SEQ ID NO: 61963 - DNA, 20 bp, Artificial Sequence
  Description of Artificial Sequence: Synthetic oligonucleotide
  Target: SCN10A; (+) strand; PAM type: YTN; PAM sequence: TTA
aatgagataatatgagacta

SEQ ID NO: 61964 - DNA, 20 bp, Artificial Sequence
  Description of Artificial Sequence: Synthetic oligonucleotide
  Target: SCN10A; (+) strand; PAM type: YTN; PAM sequence: CTA
tttactgagaaaaatgtact

SEQ ID NO: 61965 - DNA, 20 bp, Artificial Sequence
  Description of Artificial Sequence: Synthetic oligonucleotide
  Target: SCN10A; (+) strand; PAM type: YTN; PAM sequence: TTT
actgagaaaaatgtactgag

SEQ ID NO: 61966 - DNA, 20 bp, Artificial Sequence
  Description of Artificial Sequence: Synthetic oligonucleotide
  Target: SCN10A; (+) strand; PAM type: YTN; PAM sequence: TTA
ctgagaaaaatgtactgagg

SEQ ID NO: 61967 - DNA, 20 bp, Artificial Sequence
  Description of Artificial Sequence: Synthetic oligonucleotide
  Target: SCN10A; (+) strand; PAM type: YTN; PAM sequence: CTG
agaaaaatgtactgaggtta

SEQ ID NO: 61968 - DNA, 20 bp, Artificial Sequence
  Description of Artificial Sequence: Synthetic oligonucleotide
  Target: SCN10A; (+) strand; PAM type: YTN; PAM sequence: CTG
aggttatagaatgcataaat

SEQ ID NO: 61969 - DNA, 20 bp, Artificial Sequence
  Description of Artificial Sequence: Synthetic oligonucleotide
  Target: SCN10A; (+) strand; PAM type: YTN; PAM sequence: TTA
tagaatgcataaatgtggtt

SEQ ID NO: 61970 - DNA, 20 bp, Artificial Sequence
  Description of Artificial Sequence: Synthetic oligonucleotide
  Target: SCN10A; (+) strand; PAM type: YTN; PAM sequence: TTT
tatttttgtaatatgtgtat

SEQ ID NO: 61971 - DNA, 20 bp, Artificial Sequence
  Description of Artificial Sequence: Synthetic oligonucleotide
  Target: SCN10A; (+) strand; PAM type: YTN; PAM sequence: TTT
atttttgtaatatgtgtata

SEQ ID NO: 61972 - DNA, 20 bp, Artificial Sequence
  Description of Artificial Sequence: Synthetic oligonucleotide
  Target: SCN10A; (+) strand; PAM type: YTN; PAM sequence: TTA
tttttgtaatatgtgtatat

SEQ ID NO: 61973 - DNA, 20 bp, Artificial Sequence
  Description of Artificial Sequence: Synthetic oligonucleotide
  Target: SCN10A; (+) strand; PAM type: YTN; PAM sequence: TTT
ttgtaatatgtgtatatttt

SEQ ID NO: 61974 - DNA, 20 bp, Artificial Sequence
  Description of Artificial Sequence: Synthetic oligonucleotide
  Target: SCN10A; (+) strand; PAM type: YTN; PAM sequence: TTT
tgtaatatgtgtatatttta

SEQ ID NO: 61975 - DNA, 20 bp, Artificial Sequence
  Description of Artificial Sequence: Synthetic oligonucleotide
  Target: SCN10A; (+) strand; PAM type: YTN; PAM sequence: TTT
gtaatatgtgtatattttat

SEQ ID NO: 61976 - DNA, 20 bp, Artificial Sequence
  Description of Artificial Sequence: Synthetic oligonucleotide
  Target: SCN10A; (+) strand; PAM type: YTN; PAM sequence: TTG
taatatgtgtatattttatg

SEQ ID NO: 61977 - DNA, 20 bp, Artificial Sequence
  Description of Artificial Sequence: Synthetic oligonucleotide
  Target: SCN10A; (+) strand; PAM type: YTN; PAM sequence: TTT
tatgcataagcaagatgaga

SEQ ID NO: 61978 - DNA, 20 bp, Artificial Sequence
  Description of Artificial Sequence: Synthetic oligonucleotide
  Target: SCN10A; (+) strand; PAM type: YTN; PAM sequence: TTT
atgcataagcaagatgagaa

SEQ ID NO: 61979 - DNA, 20 bp, Artificial Sequence
  Description of Artificial Sequence: Synthetic oligonucleotide
  Target: SCN10A; (+) strand; PAM type: YTN; PAM sequence: TTA
tgcataagcaagatgagaaa

SEQ ID NO: 61980 - DNA, 20 bp, Artificial Sequence
  Description of Artificial Sequence: Synthetic oligonucleotide
  Target: SCN10A; (+) strand; PAM type: YTN; PAM sequence: TTT
tcaagtgagtttctctttga

SEQ ID NO: 61981 - DNA, 20 bp, Artificial Sequence
  Description of Artificial Sequence: Synthetic oligonucleotide
  Target: SCN10A; (+) strand; PAM type: YTN; PAM sequence: TTT
caagtgagtttctctttgag

SEQ ID NO: 61982 - DNA, 20 bp, Artificial Sequence
  Description of Artificial Sequence: Synthetic oligonucleotide
  Target: SCN10A; (+) strand; PAM type: YTN; PAM sequence: TTC
aagtgagtttctctttgagt

SEQ ID NO: 61983 - DNA, 20 bp, Artificial Sequence
  Description of Artificial Sequence: Synthetic oligonucleotide
  Target: SCN10A; (+) strand; PAM type: YTN; PAM sequence: TTT
ctctttgagtgatagggaaa

SEQ ID NO: 61984 - DNA, 20 bp, Artificial Sequence
  Description of Artificial Sequence: Synthetic oligonucleotide
  Target: SCN10A; (+) strand; PAM type: YTN; PAM sequence: TTC
tctttgagtgatagggaaat

SEQ ID NO: 61985 - DNA, 20 bp, Artificial Sequence
  Description of Artificial Sequence: Synthetic oligonucleotide
  Target: SCN10A; (+) strand; PAM type: YTN; PAM sequence: CTC
tttgagtgatagggaaatgg

SEQ ID NO: 61986 - DNA, 20 bp, Artificial Sequence
  Description of Artificial Sequence: Synthetic oligonucleotide
  Target: SCN10A; (+) strand; PAM type: YTN; PAM sequence: CTT
tgagtgatagggaaatggat

SEQ ID NO: 61987 - DNA, 20 bp, Artificial Sequence
  Description of Artificial Sequence: Synthetic oligonucleotide
  Target: SCN10A; (+) strand; PAM type: YTN; PAM sequence: TTT
gagtgatagggaaatggatg

SEQ ID NO: 61988 - DNA, 20 bp, Artificial Sequence
  Description of Artificial Sequence: Synthetic oligonucleotide
  Target: SCN10A; (+) strand; PAM type: YTN; PAM sequence: TTG
agtgatagggaaatggatga

SEQ ID NO: 61989 - DNA, 20 bp, Artificial Sequence
  Description of Artificial Sequence: Synthetic oligonucleotide
  Target: SCN10A; (+) strand; PAM type: YTN; PAM sequence: TTT
ttttttctttacctttttct

SEQ ID NO: 61990 - DNA, 20 bp, Artificial Sequence
  Description of Artificial Sequence: Synthetic oligonucleotide
  Target: SCN10A; (+) strand; PAM type: YTN; PAM sequence: TTT
tttttctttacctttttcta

SEQ ID NO: 61991 - DNA, 20 bp, Artificial Sequence
  Description of Artificial Sequence: Synthetic oligonucleotide
  Target: SCN10A; (+) strand; PAM type: YTN; PAM sequence: TTT
ttttctttacctttttctat

SEQ ID NO: 61992 - DNA, 20 bp, Artificial Sequence
  Description of Artificial Sequence: Synthetic oligonucleotide
  Target: SCN10A; (+) strand; PAM type: YTN; PAM sequence: TTT
tttctttacctttttctata

SEQ ID NO: 61993 - DNA, 20 bp, Artificial Sequence
  Description of Artificial Sequence: Synthetic oligonucleotide
  Target: SCN10A; (+) strand; PAM type: YTN; PAM sequence: TTT
ttctttacctttttctataa

SEQ ID NO: 61994 - DNA, 20 bp, Artificial Sequence
  Description of Artificial Sequence: Synthetic oligonucleotide
  Target: SCN10A; (+) strand; PAM type: YTN; PAM sequence: TTT
tctttacctttttctataat

SEQ ID NO: 61995 - DNA, 20 bp, Artificial Sequence
  Description of Artificial Sequence: Synthetic oligonucleotide
  Target: SCN10A; (+) strand; PAM type: YTN; PAM sequence: TTT
ctttacctttttctataatt

SEQ ID NO: 61996 - DNA, 20 bp, Artificial Sequence
  Description of Artificial Sequence: Synthetic oligonucleotide
  Target: SCN10A; (+) strand; PAM type: YTN; PAM sequence: TTC
tttacctttttctataattt

SEQ ID NO: 61997 - DNA, 20 bp, Artificial Sequence
  Description of Artificial Sequence: Synthetic oligonucleotide
  Target: SCN10A; (+) strand; PAM type: YTN; PAM sequence: CTT
tacctttttctataatttcc

SEQ ID NO: 61998 - DNA, 20 bp, Artificial Sequence
  Description of Artificial Sequence: Synthetic oligonucleotide
  Target: SCN10A; (+) strand; PAM type: YTN; PAM sequence: TTT
acctttttctataatttcca

SEQ ID NO: 61999 - DNA, 20 bp, Artificial Sequence
  Description of Artificial Sequence: Synthetic oligonucleotide
  Target: SCN10A; (+) strand; PAM type: YTN; PAM sequence: TTA
cctttttctataatttccaa

SEQ ID NO: 62000 - DNA, 20 bp, Artificial Sequence
  Description of Artificial Sequence: Synthetic oligonucleotide
  Target: SCN10A; (+) strand; PAM type: YTN; PAM sequence: CTT
tttctataatttccaagtat

SEQ ID NO: 62001 - DNA, 20 bp, Artificial Sequence
  Description of Artificial Sequence: Synthetic oligonucleotide
  Target: SCN10A; (+) strand; PAM type: YTN; PAM sequence: TTT
ttctataatttccaagtatt

SEQ ID NO: 62002 - DNA, 20 bp, Artificial Sequence
  Description of Artificial Sequence: Synthetic oligonucleotide
  Target: SCN10A; (+) strand; PAM type: YTN; PAM sequence: TTT
tctataatttccaagtattt

SEQ ID NO: 62003 - DNA, 20 bp, Artificial Sequence
  Description of Artificial Sequence: Synthetic oligonucleotide
  Target: SCN10A; (+) strand; PAM type: YTN; PAM sequence: TTT
ctataatttccaagtatttt

SEQ ID NO: 62004 - DNA, 20 bp, Artificial Sequence
  Description of Artificial Sequence: Synthetic oligonucleotide
  Target: SCN10A; (+) strand; PAM type: YTN; PAM sequence: TTC
tataatttccaagtattttt

SEQ ID NO: 62005 - DNA, 20 bp, Artificial Sequence
  Description of Artificial Sequence: Synthetic oligonucleotide
  Target: SCN10A; (+) strand; PAM type: YTN; PAM sequence: CTA
taatttccaagtattttttt

SEQ ID NO: 62006 - DNA, 20 bp, Artificial Sequence
  Description of Artificial Sequence: Synthetic oligonucleotide
  Target: SCN10A; (+) strand; PAM type: YTN; PAM sequence: TTT
ccaagtatttttttggtact

SEQ ID NO: 62007 - DNA, 20 bp, Artificial Sequence
  Description of Artificial Sequence: Synthetic oligonucleotide
  Target: SCN10A; (+) strand; PAM type: YTN; PAM sequence: TTC
caagtatttttttggtactt

SEQ ID NO: 62008 - DNA, 20 bp, Artificial Sequence
  Description of Artificial Sequence: Synthetic oligonucleotide
  Target: SCN10A; (+) strand; PAM type: YTN; PAM sequence: TTT
ttttggtactttactttgtc

SEQ ID NO: 62009 - DNA, 20 bp, Artificial Sequence
  Description of Artificial Sequence: Synthetic oligonucleotide
  Target: SCN10A; (+) strand; PAM type: YTN; PAM sequence: TTT
tttggtactttactttgtca

SEQ ID NO: 62010 - DNA, 20 bp, Artificial Sequence
  Description of Artificial Sequence: Synthetic oligonucleotide
  Target: SCN10A; (+) strand; PAM type: YTN; PAM sequence: TTT
ttggtactttactttgtcag

SEQ ID NO: 62011 - DNA, 20 bp, Artificial Sequence
  Description of Artificial Sequence: Synthetic oligonucleotide
  Target: SCN10A; (+) strand; PAM type: YTN; PAM sequence: TTT
tggtactttactttgtcaga

SEQ ID NO: 62012 - DNA, 20 bp, Artificial Sequence
  Description of Artificial Sequence: Synthetic oligonucleotide
  Target: SCN10A; (+) strand; PAM type: YTN; PAM sequence: TTT
ggtactttactttgtcagat

SEQ ID NO: 62013 - DNA, 20 bp, Artificial Sequence
  Description of Artificial Sequence: Synthetic oligonucleotide
  Target: SCN10A; (+) strand; PAM type: YTN; PAM sequence: TTG
gtactttactttgtcagatg

SEQ ID NO: 62014 - DNA, 20 bp, Artificial Sequence
  Description of Artificial Sequence: Synthetic oligonucleotide
  Target: SCN10A; (+) strand; PAM type: YTN; PAM sequence: CTT
tactttgtcagatgaaaatg

SEQ ID NO: 62015 - DNA, 20 bp, Artificial Sequence
  Description of Artificial Sequence: Synthetic oligonucleotide
  Target: SCN10A; (+) strand; PAM type: YTN; PAM sequence: TTT
actttgtcagatgaaaatgc

SEQ ID NO: 62016 - DNA, 20 bp, Artificial Sequence
  Description of Artificial Sequence: Synthetic oligonucleotide
  Target: SCN10A; (+) strand; PAM type: YTN; PAM sequence: TTA
ctttgtcagatgaaaatgca

SEQ ID NO: 62017 - DNA, 20 bp, Artificial Sequence
  Description of Artificial Sequence: Synthetic oligonucleotide
  Target: SCN10A; (+) strand; PAM type: YTN; PAM sequence: CTT
tgtcagatgaaaatgcatgt

SEQ ID NO: 62018 - DNA, 20 bp, Artificial Sequence
  Description of Artificial Sequence: Synthetic oligonucleotide
  Target: SCN10A; (+) strand; PAM type: YTN; PAM sequence: TTT
gtcagatgaaaatgcatgtt

SEQ ID NO: 62019 - DNA, 20 bp, Artificial Sequence
  Description of Artificial Sequence: Synthetic oligonucleotide
  Target: SCN10A; (+) strand; PAM type: YTN; PAM sequence: TTG
tcagatgaaaatgcatgtta

SEQ ID NO: 62020 - DNA, 20 bp, Artificial Sequence
  Description of Artificial Sequence: Synthetic oligonucleotide
  Target: SCN10A; (+) strand; PAM type: YTN; PAM sequence: TTA
tttttaaaaggtactcaaag

SEQ ID NO: 62021 - DNA, 20 bp, Artificial Sequence
  Description of Artificial Sequence: Synthetic oligonucleotide
  Target: SCN10A; (+) strand; PAM type: YTN; PAM sequence: TTT
ttaaaaggtactcaaagtga

SEQ ID NO: 62022 - DNA, 20 bp, Artificial Sequence
  Description of Artificial Sequence: Synthetic oligonucleotide
  Target: SCN10A; (+) strand; PAM type: YTN; PAM sequence: TTT
taaaaggtactcaaagtgaa

SEQ ID NO: 62023 - DNA, 20 bp, Artificial Sequence
  Description of Artificial Sequence: Synthetic oligonucleotide
  Target: SCN10A; (+) strand; PAM type: YTN; PAM sequence: TTT
aaaaggtactcaaagtgaaa

SEQ ID NO: 62024 - DNA, 20 bp, Artificial Sequence
  Description of Artificial Sequence: Synthetic oligonucleotide
  Target: SCN10A; (+) strand; PAM type: YTN; PAM sequence: TTA
aaaggtactcaaagtgaaag

SEQ ID NO: 62025 - DNA, 20 bp, Artificial Sequence
  Description of Artificial Sequence: Synthetic oligonucleotide
  Target: SCN10A; (+) strand; PAM type: YTN; PAM sequence: CTC
aaagtgaaagcctaaagaag

SEQ ID NO: 62026 - DNA, 20 bp, Artificial Sequence
  Description of Artificial Sequence: Synthetic oligonucleotide
  Target: SCN10A; (+) strand; PAM type: YTN; PAM sequence: CTA
aagaaggctaaatttggtgc

SEQ ID NO: 62027 - DNA, 20 bp, Artificial Sequence
  Description of Artificial Sequence: Synthetic oligonucleotide
  Target: SCN10A; (+) strand; PAM type: YTN; PAM sequence: CTA
aatttggtgccagcctgttc

SEQ ID NO: 62028 - DNA, 20 bp, Artificial Sequence
  Description of Artificial Sequence: Synthetic oligonucleotide
  Target: SCN10A; (+) strand; PAM type: YTN; PAM sequence: TTT
ggtgccagcctgttcagtcc

SEQ ID NO: 62029 - DNA, 20 bp, Artificial Sequence
  Description of Artificial Sequence: Synthetic oligonucleotide
  Target: SCN10A; (+) strand; PAM type: YTN; PAM sequence: TTG
gtgccagcctgttcagtccc

SEQ ID NO: 62030 - DNA, 20 bp, Artificial Sequence
  Description of Artificial Sequence: Synthetic oligonucleotide
  Target: SCN10A; (+) strand; PAM type: YTN; PAM sequence: CTG
ttcagtcccaggggaaggag

SEQ ID NO: 62031 - DNA, 20 bp, Artificial Sequence
  Description of Artificial Sequence: Synthetic oligonucleotide
  Target: SCN10A; (+) strand; PAM type: YTN; PAM sequence: TTC
agtcccaggggaaggagatg

SEQ ID NO: 62032 - DNA, 20 bp, Artificial Sequence
  Description of Artificial Sequence: Synthetic oligonucleotide
  Target: SCN10A; (+) strand; PAM type: YTN; PAM sequence: CTG
cagggggcgggctgggctgg

SEQ ID NO: 62033 - DNA, 20 bp, Artificial Sequence
  Description of Artificial Sequence: Synthetic oligonucleotide
  Target: SCN10A; (+) strand; PAM type: YTN; PAM sequence: CTG
ggctggcgcagtgctgcagg

SEQ ID NO: 62034 - DNA, 20 bp, Artificial Sequence
  Description of Artificial Sequence: Synthetic oligonucleotide
  Target: SCN10A; (+) strand; PAM type: YTN; PAM sequence: CTG
gcgcagtgctgcaggtctga

SEQ ID NO: 62035 - DNA, 20 bp, Artificial Sequence
  Description of Artificial Sequence: Synthetic oligonucleotide
  Target: SCN10A; (+) strand; PAM type: YTN; PAM sequence: CTG
caggtctgagcttcctcctg

SEQ ID NO: 62036 - DNA, 20 bp, Artificial Sequence
  Description of Artificial Sequence: Synthetic oligonucleotide
  Target: SCN10A; (+) strand; PAM type: YTN; PAM sequence: CTG
agcttcctcctgggaatgtg

SEQ ID NO: 62037 - DNA, 20 bp, Artificial Sequence
  Description of Artificial Sequence: Synthetic oligonucleotide
  Target: SCN10A; (+) strand; PAM type: YTN; PAM sequence: CTT
cctcctgggaatgtgggggg

SEQ ID NO: 62038 - DNA, 20 bp, Artificial Sequence
  Description of Artificial Sequence: Synthetic oligonucleotide
  Target: SCN10A; (+) strand; PAM type: YTN; PAM sequence: TTC
ctcctgggaatgtggggggt

SEQ ID NO: 62039 - DNA, 20 bp, Artificial Sequence
  Description of Artificial Sequence: Synthetic oligonucleotide
  Target: SCN10A; (+) strand; PAM type: YTN; PAM sequence: CTC
ctgggaatgtggggggtgga

SEQ ID NO: 62040 - DNA, 20 bp, Artificial Sequence
  Description of Artificial Sequence: Synthetic oligonucleotide
  Target: SCN10A; (+) strand; PAM type: YTN; PAM sequence: CTG
ggaatgtggggggtggaccg

SEQ ID NO: 62041 - DNA, 20 bp, Artificial Sequence
  Description of Artificial Sequence: Synthetic oligonucleotide
  Target: SCN10A; (+) strand; PAM type: YTN; PAM sequence: CTA
gagagagaagggagggagca

SEQ ID NO: 62042 - DNA, 20 bp, Artificial Sequence
  Description of Artificial Sequence: Synthetic oligonucleotide
  Target: SCN10A; (+) strand; PAM type: YTN; PAM sequence: CTG
gccaacagcacatgtggtta

SEQ ID NO: 62043 - DNA, 20 bp, Artificial Sequence
  Description of Artificial Sequence: Synthetic oligonucleotide
  Target: SCN10A; (+) strand; PAM type: YTN; PAM sequence: TTA
ttactttaatccagcaggac

SEQ ID NO: 62044 - DNA, 20 bp, Artificial Sequence
  Description of Artificial Sequence: Synthetic oligonucleotide
  Target: SCN10A; (+) strand; PAM type: YTN; PAM sequence: TTA
ctttaatccagcaggactgg

SEQ ID NO: 62045 - DNA, 20 bp, Artificial Sequence
  Description of Artificial Sequence: Synthetic oligonucleotide
  Target: SCN10A; (+) strand; PAM type: YTN; PAM sequence: CTT
taatccagcaggactggaag

SEQ ID NO: 62046 - DNA, 20 bp, Artificial Sequence
  Description of Artificial Sequence: Synthetic oligonucleotide
  Target: SCN10A; (+) strand; PAM type: YTN; PAM sequence: TTT
aatccagcaggactggaagg

SEQ ID NO: 62047 - DNA, 20 bp, Artificial Sequence
  Description of Artificial Sequence: Synthetic oligonucleotide
  Target: SCN10A; (+) strand; PAM type: YTN; PAM sequence: TTA
atccagcaggactggaagga

SEQ ID NO: 62048 - DNA, 20 bp, Artificial Sequence
  Description of Artificial Sequence: Synthetic oligonucleotide
  Target: SCN10A; (+) strand; PAM type: YTN; PAM sequence: CTG
gaaggagaagagcataggtg

SEQ ID NO: 62049 - DNA, 20 bp, Artificial Sequence
  Description of Artificial Sequence: Synthetic oligonucleotide
  Target: SCN10A; (+) strand; PAM type: YTN; PAM sequence: CTG
cccagccctctcttgcccct

SEQ ID NO: 62050 - DNA, 20 bp, Artificial Sequence
  Description of Artificial Sequence: Synthetic oligonucleotide
  Target: SCN10A; (+) strand; PAM type: YTN; PAM sequence: CTC
tcttgcccctgcaatttggc

SEQ ID NO: 62051 - DNA, 20 bp, Artificial Sequence
  Description of Artificial Sequence: Synthetic oligonucleotide
  Target: SCN10A; (+) strand; PAM type: YTN; PAM sequence: CTC
ttgcccctgcaatttggcct

SEQ ID NO: 62052 - DNA, 20 bp, Artificial Sequence
  Description of Artificial Sequence: Synthetic oligonucleotide
  Target: SCN10A; (+) strand; PAM type: YTN; PAM sequence: CTT
gcccctgcaatttggcctct

SEQ ID NO: 62053 - DNA, 20 bp, Artificial Sequence
  Description of Artificial Sequence: Synthetic oligonucleotide
  Target: SCN10A; (+) strand; PAM type: YTN; PAM sequence: TTG
cccctgcaatttggcctcta

SEQ ID NO: 62054 - DNA, 20 bp, Artificial Sequence
  Description of Artificial Sequence: Synthetic oligonucleotide
  Target: SCN10A; (+) strand; PAM type: YTN; PAM sequence: CTG
caatttggcctctacactgt

SEQ ID NO: 62055 - DNA, 20 bp, Artificial Sequence
  Description of Artificial Sequence: Synthetic oligonucleotide
  Target: SCN10A; (+) strand; PAM type: YTN; PAM sequence: TTT
ggcctctacactgtgctgag

SEQ ID NO: 62056 - DNA, 20 bp, Artificial Sequence
  Description of Artificial Sequence: Synthetic oligonucleotide
  Target: SCN10A; (+) strand; PAM type: YTN; PAM sequence: TTG
gcctctacactgtgctgagg

SEQ ID NO: 62057 - DNA, 20 bp, Artificial Sequence
  Description of Artificial Sequence: Synthetic oligonucleotide
  Target: SCN10A; (+) strand; PAM type: YTN; PAM sequence: CTC
tacactgtgctgaggtccgt

SEQ ID NO: 62058 - DNA, 20 bp, Artificial Sequence
  Description of Artificial Sequence: Synthetic oligonucleotide
  Target: SCN10A; (+) strand; PAM type: YTN; PAM sequence: CTA
cactgtgctgaggtccgtgt

SEQ ID NO: 62059 - DNA, 20 bp, Artificial Sequence
  Description of Artificial Sequence: Synthetic oligonucleotide
  Target: SCN10A; (+) strand; PAM type: YTN; PAM sequence: CTG
tgctgaggtccgtgtggaca

SEQ ID NO: 62060 - DNA, 20 bp, Artificial Sequence
  Description of Artificial Sequence: Synthetic oligonucleotide
  Target: SCN10A; (+) strand; PAM type: YTN; PAM sequence: CTG
aggtccgtgtggacaatcac

SEQ ID NO: 62061 - DNA, 20 bp, Artificial Sequence
  Description of Artificial Sequence: Synthetic oligonucleotide
  Target: SCN10A; (+) strand; PAM type: YTN; PAM sequence: CTG
ccctgtgccagggcactggg

SEQ ID NO: 62062 - DNA, 20 bp, Artificial Sequence
  Description of Artificial Sequence: Synthetic oligonucleotide
  Target: SCN10A; (+) strand; PAM type: YTN; PAM sequence: CTG
tgccagggcactgggcacct

SEQ ID NO: 62063 - DNA, 20 bp, Artificial Sequence
  Description of Artificial Sequence: Synthetic oligonucleotide
  Target: SCN10A; (+) strand; PAM type: YTN; PAM sequence: CTG
ggcacctgcagccgctgtca

SEQ ID NO: 62064 - DNA, 20 bp, Artificial Sequence
  Description of Artificial Sequence: Synthetic oligonucleotide
  Target: SCN10A; (+) strand; PAM type: YTN; PAM sequence: CTG
cagccgctgtcacacagttc

SEQ ID NO: 62065 - DNA, 20 bp, Artificial Sequence
  Description of Artificial Sequence: Synthetic oligonucleotide
  Target: SCN10A; (+) strand; PAM type: YTN; PAM sequence: CTG
tcacacagttccccctccac

SEQ ID NO: 62066 - DNA, 20 bp, Artificial Sequence
  Description of Artificial Sequence: Synthetic oligonucleotide
  Target: SCN10A; (+) strand; PAM type: YTN; PAM sequence: TTC
cccctccacccaggatggca

SEQ ID NO: 62067 - DNA, 20 bp, Artificial Sequence
  Description of Artificial Sequence: Synthetic oligonucleotide
  Target: SCN10A; (+) strand; PAM type: YTN; PAM sequence: CTC
cacccaggatggcagaccag

SEQ ID NO: 62068 - DNA, 20 bp, Artificial Sequence
  Description of Artificial Sequence: Synthetic oligonucleotide
  Target: SCN10A; (+) strand; PAM type: YTN; PAM sequence: CTG
ccccgaaactctcttctccc

SEQ ID NO: 62069 - DNA, 20 bp, Artificial Sequence
  Description of Artificial Sequence: Synthetic oligonucleotide
  Target: SCN10A; (+) strand; PAM type: YTN; PAM sequence: CTC
tcttctcccttggctttgcg

SEQ ID NO: 62070 - DNA, 20 bp, Artificial Sequence
  Description of Artificial Sequence: Synthetic oligonucleotide
  Target: SCN10A; (+) strand; PAM type: YTN; PAM sequence: CTC
ttctcccttggctttgcgtc

SEQ ID NO: 62071 - DNA, 20 bp, Artificial Sequence
  Description of Artificial Sequence: Synthetic oligonucleotide
  Target: SCN10A; (+) strand; PAM type: YTN; PAM sequence: CTT
ctcccttggctttgcgtcat

SEQ ID NO: 62072 - DNA, 20 bp, Artificial Sequence
  Description of Artificial Sequence: Synthetic oligonucleotide
  Target: SCN10A; (+) strand; PAM type: YTN; PAM sequence: TTC
tcccttggctttgcgtcatt

SEQ ID NO: 62073 - DNA, 20 bp, Artificial Sequence
  Description of Artificial Sequence: Synthetic oligonucleotide
  Target: SCN10A; (+) strand; PAM type: YTN; PAM sequence: CTC
ccttggctttgcgtcattgc

SEQ ID NO: 62074 - DNA, 20 bp, Artificial Sequence
  Description of Artificial Sequence: Synthetic oligonucleotide
  Target: SCN10A; (+) strand; PAM type: YTN; PAM sequence: CTT
ggctttgcgtcattgccacc

SEQ ID NO: 62075 - DNA, 20 bp, Artificial Sequence
  Description of Artificial Sequence: Synthetic oligonucleotide
  Target: SCN10A; (+) strand; PAM type: YTN; PAM sequence: TTG
gctttgcgtcattgccaccc

SEQ ID NO: 62076 - DNA, 20 bp, Artificial Sequence
  Description of Artificial Sequence: Synthetic oligonucleotide
  Target: SCN10A; (+) strand; PAM type: YTN; PAM sequence: CTT
tgcgtcattgccaccctagt

SEQ ID NO: 62077 - DNA, 20 bp, Artificial Sequence
  Description of Artificial Sequence: Synthetic oligonucleotide
  Target: SCN10A; (+) strand; PAM type: YTN; PAM sequence: TTT
gcgtcattgccaccctagtt

SEQ ID NO: 62078 - DNA, 20 bp, Artificial Sequence
  Description of Artificial Sequence: Synthetic oligonucleotide
  Target: SCN10A; (+) strand; PAM type: YTN; PAM sequence: TTG
cgtcattgccaccctagttt

SEQ ID NO: 62079 - DNA, 20 bp, Artificial Sequence
  Description of Artificial Sequence: Synthetic oligonucleotide
  Target: SCN10A; (+) strand; PAM type: YTN; PAM sequence: TTG
ccaccctagttttcctccca

SEQ ID NO: 62080 - DNA, 20 bp, Artificial Sequence
  Description of Artificial Sequence: Synthetic oligonucleotide
  Target: SCN10A; (+) strand; PAM type: YTN; PAM sequence: CTA
gttttcctcccacctctcag

SEQ ID NO: 62081 - DNA, 20 bp, Artificial Sequence
  Description of Artificial Sequence: Synthetic oligonucleotide
  Target: SCN10A; (+) strand; PAM type: YTN; PAM sequence: TTT
tcctcccacctctcagatcc

SEQ ID NO: 62082 - DNA, 20 bp, Artificial Sequence
  Description of Artificial Sequence: Synthetic oligonucleotide
  Target: SCN10A; (+) strand; PAM type: YTN; PAM sequence: TTT
cctcccacctctcagatcct

SEQ ID NO: 62083 - DNA, 20 bp, Artificial Sequence
  Description of Artificial Sequence: Synthetic oligonucleotide
  Target: SCN10A; (+) strand; PAM type: YTN; PAM sequence: TTC
ctcccacctctcagatcctg

SEQ ID NO: 62084 - DNA, 20 bp, Artificial Sequence
  Description of Artificial Sequence: Synthetic oligonucleotide
  Target: SCN10A; (+) strand; PAM type: YTN; PAM sequence: CTC
ccacctctcagatcctgcct

SEQ ID NO: 62085 - DNA, 20 bp, Artificial Sequence
  Description of Artificial Sequence: Synthetic oligonucleotide
  Target: SCN10A; (+) strand; PAM type: YTN; PAM sequence: CTC
tcagatcctgcctcgtcccg

SEQ ID NO: 62086 - DNA, 20 bp, Artificial Sequence
  Description of Artificial Sequence: Synthetic oligonucleotide
  Target: SCN10A; (+) strand; PAM type: YTN; PAM sequence: CTC
agatcctgcctcgtcccgca

SEQ ID NO: 62087 - DNA, 20 bp, Artificial Sequence
  Description of Artificial Sequence: Synthetic oligonucleotide
  Target: SCN10A; (+) strand; PAM type: YTN; PAM sequence: CTG
cctcgtcccgcacctgtgct

SEQ ID NO: 62088 - DNA, 20 bp, Artificial Sequence
  Description of Artificial Sequence: Synthetic oligonucleotide
  Target: SCN10A; (+) strand; PAM type: YTN; PAM sequence: CTC
gtcccgcacctgtgctcctc

SEQ ID NO: 62089 - DNA, 20 bp, Artificial Sequence
  Description of Artificial Sequence: Synthetic oligonucleotide
  Target: SCN10A; (+) strand; PAM type: YTN; PAM sequence: CTG
tgctcctccctaaagctgag

SEQ ID NO: 62090 - DNA, 20 bp, Artificial Sequence
  Description of Artificial Sequence: Synthetic oligonucleotide
  Target: SCN10A; (+) strand; PAM type: YTN; PAM sequence: CTC
ctccctaaagctgaggccat

SEQ ID NO: 62091 - DNA, 20 bp, Artificial Sequence
  Description of Artificial Sequence: Synthetic oligonucleotide
  Target: SCN10A; (+) strand; PAM type: YTN; PAM sequence: CTC
cctaaagctgaggccatgca

SEQ ID NO: 62092 - DNA, 20 bp, Artificial Sequence
  Description of Artificial Sequence: Synthetic oligonucleotide
  Target: SCN10A; (+) strand; PAM type: YTN; PAM sequence: CTA
aagctgaggccatgcaccga

SEQ ID NO: 62093 - DNA, 20 bp, Artificial Sequence
  Description of Artificial Sequence: Synthetic oligonucleotide
  Target: SCN10A; (+) strand; PAM type: YTN; PAM sequence: CTG
aggccatgcaccgagcagtt

SEQ ID NO: 62094 - DNA, 20 bp, Artificial Sequence
  Description of Artificial Sequence: Synthetic oligonucleotide
  Target: SCN10A; (+) strand; PAM type: YTN; PAM sequence: TTT
tgtcacccttcctggacaat

SEQ ID NO: 62095 - DNA, 20 bp, Artificial Sequence
  Description of Artificial Sequence: Synthetic oligonucleotide
  Target: SCN10A; (+) strand; PAM type: YTN; PAM sequence: TTT
gtcacccttcctggacaatc

SEQ ID NO: 62096 - DNA, 20 bp, Artificial Sequence
  Description of Artificial Sequence: Synthetic oligonucleotide
  Target: SCN10A; (+) strand; PAM type: YTN; PAM sequence: TTG
tcacccttcctggacaatct

SEQ ID NO: 62097 - DNA, 20 bp, Artificial Sequence
  Description of Artificial Sequence: Synthetic oligonucleotide
  Target: SCN10A; (+) strand; PAM type: YTN; PAM sequence: CTT
cctggacaatctggcattta

SEQ ID NO: 62098 - DNA, 20 bp, Artificial Sequence
  Description of Artificial Sequence: Synthetic oligonucleotide
  Target: SCN10A; (+) strand; PAM type: YTN; PAM sequence: TTC
ctggacaatctggcatttag

SEQ ID NO: 62099 - DNA, 20 bp, Artificial Sequence
  Description of Artificial Sequence: Synthetic oligonucleotide
  Target: SCN10A; (+) strand; PAM type: YTN; PAM sequence: CTG
gacaatctggcatttagatg

SEQ ID NO: 62100 - DNA, 20 bp, Artificial Sequence
  Description of Artificial Sequence: Synthetic oligonucleotide
  Target: SCN10A; (+) strand; PAM type: YTN; PAM sequence: CTG
gcatttagatggaggcctag

SEQ ID NO: 62101 - DNA, 20 bp, Artificial Sequence
  Description of Artificial Sequence: Synthetic oligonucleotide
  Target: SCN10A; (+) strand; PAM type: YTN; PAM sequence: TTT
agatggaggcctagatattt

SEQ ID NO: 62102 - DNA, 20 bp, Artificial Sequence
  Description of Artificial Sequence: Synthetic oligonucleotide
  Target: SCN10A; (+) strand; PAM type: YTN; PAM sequence: TTA
gatggaggcctagatattta

SEQ ID NO: 62103 - DNA, 20 bp, Artificial Sequence
  Description of Artificial Sequence: Synthetic oligonucleotide
  Target: SCN10A; (+) strand; PAM type: YTN; PAM sequence: CTA
gatatttagtaggttgtttt

SEQ ID NO: 62104 - DNA, 20 bp, Artificial Sequence
  Description of Artificial Sequence: Synthetic oligonucleotide
  Target: SCN10A; (+) strand; PAM type: YTN; PAM sequence: TTT
agtaggttgtttttagagag

SEQ ID NO: 62105 - DNA, 20 bp, Artificial Sequence
  Description of Artificial Sequence: Synthetic oligonucleotide
  Target: SCN10A; (+) strand; PAM type: YTN; PAM sequence: TTA
gtaggttgtttttagagagt

SEQ ID NO: 62106 - DNA, 20 bp, Artificial Sequence
  Description of Artificial Sequence: Synthetic oligonucleotide
  Target: SCN10A; (+) strand; PAM type: YTN; PAM sequence: TTG
tttttagagagtaaatgaca

SEQ ID NO: 62107 - DNA, 20 bp, Artificial Sequence
  Description of Artificial Sequence: Synthetic oligonucleotide
  Target: SCN10A; (+) strand; PAM type: YTN; PAM sequence: TTT
ttagagagtaaatgacacat

SEQ ID NO: 62108 - DNA, 20 bp, Artificial Sequence
  Description of Artificial Sequence: Synthetic oligonucleotide
  Target: SCN10A; (+) strand; PAM type: YTN; PAM sequence: TTT
tagagagtaaatgacacatg

SEQ ID NO: 62109 - DNA, 20 bp, Artificial Sequence
  Description of Artificial Sequence: Synthetic oligonucleotide
  Target: SCN10A; (+) strand; PAM type: YTN; PAM sequence: TTT
agagagtaaatgacacatga

SEQ ID NO: 62110 - DNA, 20 bp, Artificial Sequence
  Description of Artificial Sequence: Synthetic oligonucleotide
  Target: SCN10A; (+) strand; PAM type: YTN; PAM sequence: TTA
gagagtaaatgacacatgag

SEQ ID NO: 62111 - DNA, 20 bp, Artificial Sequence
  Description of Artificial Sequence: Synthetic oligonucleotide
  Target: SCN10A; (+) strand; PAM type: YTN; PAM sequence: CTG
cagccgtgaatcggaagagc

SEQ ID NO: 62112 - DNA, 20 bp, Artificial Sequence
  Description of Artificial Sequence: Synthetic oligonucleotide
  Target: SCN10A; (+) strand; PAM type: YTN; PAM sequence: CTG
tagtcctagcccttcaacta

SEQ ID NO: 62113 - DNA, 20 bp, Artificial Sequence
  Description of Artificial Sequence: Synthetic oligonucleotide
  Target: SCN10A; (+) strand; PAM type: YTN; PAM sequence: CTA
gcccttcaactaattagctg

SEQ ID NO: 62114 - DNA, 20 bp, Artificial Sequence
  Description of Artificial Sequence: Synthetic oligonucleotide
  Target: SCN10A; (+) strand; PAM type: YTN; PAM sequence: CTT
caactaattagctgccaccc

SEQ ID NO: 62115 - DNA, 20 bp, Artificial Sequence
  Description of Artificial Sequence: Synthetic oligonucleotide
  Target: SCN10A; (+) strand; PAM type: YTN; PAM sequence: TTC
aactaattagctgccaccct

SEQ ID NO: 62116 - DNA, 20 bp, Artificial Sequence
  Description of Artificial Sequence: Synthetic oligonucleotide
  Target: SCN10A; (+) strand; PAM type: YTN; PAM sequence: CTA
attagctgccaccctgaact

SEQ ID NO: 62117 - DNA, 20 bp, Artificial Sequence
  Description of Artificial Sequence: Synthetic oligonucleotide
  Target: SCN10A; (+) strand; PAM type: YTN; PAM sequence: TTA
gctgccaccctgaactctct

SEQ ID NO: 62118 - DNA, 20 bp, Artificial Sequence
  Description of Artificial Sequence: Synthetic oligonucleotide
  Target: SCN10A; (+) strand; PAM type: YTN; PAM sequence: CTG
ccaccctgaactctctattc

SEQ ID NO: 62119 - DNA, 20 bp, Artificial Sequence
  Description of Artificial Sequence: Synthetic oligonucleotide
  Target: SCN10A; (+) strand; PAM type: YTN; PAM sequence: CTG
aactctctattcccagccct

SEQ ID NO: 62120 - DNA, 20 bp, Artificial Sequence
  Description of Artificial Sequence: Synthetic oligonucleotide
  Target: SCN10A; (+) strand; PAM type: YTN; PAM sequence: CTC
tctattcccagcccttcaac

SEQ ID NO: 62121 - DNA, 20 bp, Artificial Sequence
  Description of Artificial Sequence: Synthetic oligonucleotide
  Target: SCN10A; (+) strand; PAM type: YTN; PAM sequence: CTC
tattcccagcccttcaacta

SEQ ID NO: 62122 - DNA, 20 bp, Artificial Sequence
  Description of Artificial Sequence: Synthetic oligonucleotide
  Target: SCN10A; (+) strand; PAM type: YTN; PAM sequence: CTA
ttcccagcccttcaactaat

SEQ ID NO: 62123 - DNA, 20 bp, Artificial Sequence
  Description of Artificial Sequence: Synthetic oligonucleotide
  Target: SCN10A; (+) strand; PAM type: YTN; PAM sequence: TTC
ccagcccttcaactaattac

SEQ ID NO: 62124 - DNA, 20 bp, Artificial Sequence
  Description of Artificial Sequence: Synthetic oligonucleotide
  Target: SCN10A; (+) strand; PAM type: YTN; PAM sequence: CTT
caactaattacctgaagccc

SEQ ID NO: 62125 - DNA, 20 bp, Artificial Sequence
  Description of Artificial Sequence: Synthetic oligonucleotide
  Target: SCN10A; (+) strand; PAM type: YTN; PAM sequence: TTC
aactaattacctgaagcccc

SEQ ID NO: 62126 - DNA, 20 bp, Artificial Sequence
  Description of Artificial Sequence: Synthetic oligonucleotide
  Target: SCN10A; (+) strand; PAM type: YTN; PAM sequence: CTA
attacctgaagcccctcatg

SEQ ID NO: 62127 - DNA, 20 bp, Artificial Sequence
  Description of Artificial Sequence: Synthetic oligonucleotide
  Target: SCN10A; (+) strand; PAM type: YTN; PAM sequence: TTA
cctgaagcccctcatgcctt

SEQ ID NO: 62128 - DNA, 20 bp, Artificial Sequence
  Description of Artificial Sequence: Synthetic oligonucleotide
  Target: SCN10A; (+) strand; PAM type: YTN; PAM sequence: CTG
aagcccctcatgcctttggg

SEQ ID NO: 62129 - DNA, 20 bp, Artificial Sequence
  Description of Artificial Sequence: Synthetic oligonucleotide
  Target: SCN10A; (+) strand; PAM type: YTN; PAM sequence: CTC
atgcctttgggctttgactt

SEQ ID NO: 62130 - DNA, 20 bp, Artificial Sequence
  Description of Artificial Sequence: Synthetic oligonucleotide
  Target: SCN10A; (+) strand; PAM type: YTN; PAM sequence: CTT
tgggctttgacttcctcatt

SEQ ID NO: 62131 - DNA, 20 bp, Artificial Sequence
  Description of Artificial Sequence: Synthetic oligonucleotide
  Target: SCN10A; (+) strand; PAM type: YTN; PAM sequence: TTT
gggctttgacttcctcattt

SEQ ID NO: 62132 - DNA, 20 bp, Artificial Sequence
  Description of Artificial Sequence: Synthetic oligonucleotide
  Target: SCN10A; (+) strand; PAM type: YTN; PAM sequence: TTG
ggctttgacttcctcattta

SEQ ID NO: 62133 - DNA, 20 bp, Artificial Sequence
  Description of Artificial Sequence: Synthetic oligonucleotide
  Target: SCN10A; (+) strand; PAM type: YTN; PAM sequence: CTT
tgacttcctcatttagaaaa

SEQ ID NO: 62134 - DNA, 20 bp, Artificial Sequence
  Description of Artificial Sequence: Synthetic oligonucleotide
  Target: SCN10A; (+) strand; PAM type: YTN; PAM sequence: TTT
gacttcctcatttagaaaat

SEQ ID NO: 62135 - DNA, 20 bp, Artificial Sequence
  Description of Artificial Sequence: Synthetic oligonucleotide
  Target: SCN10A; (+) strand; PAM type: YTN; PAM sequence: TTG
acttcctcatttagaaaatg

SEQ ID NO: 62136 - DNA, 20 bp, Artificial Sequence
  Description of Artificial Sequence: Synthetic oligonucleotide
  Target: SCN10A; (+) strand; PAM type: YTN; PAM sequence: CTT
cctcatttagaaaatgcaaa

SEQ ID NO: 62137 - DNA, 20 bp, Artificial Sequence
  Description of Artificial Sequence: Synthetic oligonucleotide
  Target: SCN10A; (+) strand; PAM type: YTN; PAM sequence: TTC
ctcatttagaaaatgcaaac

SEQ ID NO: 62138 - DNA, 20 bp, Artificial Sequence
  Description of Artificial Sequence: Synthetic oligonucleotide
  Target: SCN10A; (+) strand; PAM type: YTN; PAM sequence: CTC
atttagaaaatgcaaacaac

SEQ ID NO: 62139 - DNA, 20 bp, Artificial Sequence
  Description of Artificial Sequence: Synthetic oligonucleotide
  Target: SCN10A; (+) strand; PAM type: YTN; PAM sequence: TTT
agaaaatgcaaacaactgag

SEQ ID NO: 62140 - DNA, 20 bp, Artificial Sequence
  Description of Artificial Sequence: Synthetic oligonucleotide
  Target: SCN10A; (+) strand; PAM type: YTN; PAM sequence: TTA
gaaaatgcaaacaactgagg

SEQ ID NO: 62141 - DNA, 20 bp, Artificial Sequence
  Description of Artificial Sequence: Synthetic oligonucleotide
  Target: SCN10A; (+) strand; PAM type: YTN; PAM sequence: CTG
aggatgttaagttccttcct

SEQ ID NO: 62142 - DNA, 20 bp, Artificial Sequence
  Description of Artificial Sequence: Synthetic oligonucleotide
  Target: SCN10A; (+) strand; PAM type: YTN; PAM sequence: TTA
agttccttcctgtgtctatg

SEQ ID NO: 62143 - DNA, 20 bp, Artificial Sequence
  Description of Artificial Sequence: Synthetic oligonucleotide
  Target: SCN10A; (+) strand; PAM type: YTN; PAM sequence: TTC
cttcctgtgtctatgtctac

SEQ ID NO: 62144 - DNA, 20 bp, Artificial Sequence
  Description of Artificial Sequence: Synthetic oligonucleotide
  Target: SCN10A; (+) strand; PAM type: YTN; PAM sequence: CTT
cctgtgtctatgtctacctt

SEQ ID NO: 62145 - DNA, 20 bp, Artificial Sequence
  Description of Artificial Sequence: Synthetic oligonucleotide
  Target: SCN10A; (+) strand; PAM type: YTN; PAM sequence: TTC
ctgtgtctatgtctaccttg

SEQ ID NO: 62146 - DNA, 20 bp, Artificial Sequence
  Description of Artificial Sequence: Synthetic oligonucleotide
  Target: SCN10A; (+) strand; PAM type: YTN; PAM sequence: CTG
tgtctatgtctaccttggtc

SEQ ID NO: 62147 - DNA, 20 bp, Artificial Sequence
  Description of Artificial Sequence: Synthetic oligonucleotide
  Target: SCN10A; (+) strand; PAM type: YTN; PAM sequence: CTA
tgtctaccttggtctattgg

SEQ ID NO: 62148 - DNA, 20 bp, Artificial Sequence
  Description of Artificial Sequence: Synthetic oligonucleotide
  Target: SCN10A; (+) strand; PAM type: YTN; PAM sequence: CTA
ccttggtctattggcggagt

SEQ ID NO: 62149 - DNA, 20 bp, Artificial Sequence
  Description of Artificial Sequence: Synthetic oligonucleotide
  Target: SCN10A; (+) strand; PAM type: YTN; PAM sequence: CTT
ggtctattggcggagtagtt

SEQ ID NO: 62150 - DNA, 20 bp, Artificial Sequence
  Description of Artificial Sequence: Synthetic oligonucleotide
  Target: SCN10A; (+) strand; PAM type: YTN; PAM sequence: TTG
gtctattggcggagtagttg

SEQ ID NO: 62151 - DNA, 20 bp, Artificial Sequence
  Description of Artificial Sequence: Synthetic oligonucleotide
  Target: SCN10A; (+) strand; PAM type: YTN; PAM sequence: CTA
ttggcggagtagttgagatt

SEQ ID NO: 62152 - DNA, 20 bp, Artificial Sequence
  Description of Artificial Sequence: Synthetic oligonucleotide
  Target: SCN10A; (+) strand; PAM type: YTN; PAM sequence: TTG
gcggagtagttgagattgtg

SEQ ID NO: 62153 - DNA, 20 bp, Artificial Sequence
  Description of Artificial Sequence: Synthetic oligonucleotide
  Target: SCN10A; (+) strand; PAM type: YTN; PAM sequence: TTG
agattgtgtaaggagcttaa

SEQ ID NO: 62154 - DNA, 20 bp, Artificial Sequence
  Description of Artificial Sequence: Synthetic oligonucleotide
  Target: SCN10A; (+) strand; PAM type: YTN; PAM sequence: TTG
tgtaaggagcttaagccaca

SEQ ID NO: 62155 - DNA, 20 bp, Artificial Sequence
  Description of Artificial Sequence: Synthetic oligonucleotide
  Target: SCN10A; (+) strand; PAM type: YTN; PAM sequence: CTT
aagccacagtacagagagaa

SEQ ID NO: 62156 - DNA, 20 bp, Artificial Sequence
  Description of Artificial Sequence: Synthetic oligonucleotide
  Target: SCN10A; (+) strand; PAM type: YTN; PAM sequence: TTA
agccacagtacagagagaac

SEQ ID NO: 62157 - DNA, 20 bp, Artificial Sequence
  Description of Artificial Sequence: Synthetic oligonucleotide
  Target: SCN10A; (+) strand; PAM type: YTN; PAM sequence: CTT
ccttctttgctctacaaagc

SEQ ID NO: 62158 - DNA, 20 bp, Artificial Sequence
  Description of Artificial Sequence: Synthetic oligonucleotide
  Target: SCN10A; (+) strand; PAM type: YTN; PAM sequence: TTC
cttctttgctctacaaagcc

SEQ ID NO: 62159 - DNA, 20 bp, Artificial Sequence
  Description of Artificial Sequence: Synthetic oligonucleotide
  Target: SCN10A; (+) strand; PAM type: YTN; PAM sequence: CTT
ctttgctctacaaagcccag

SEQ ID NO: 62160 - DNA, 20 bp, Artificial Sequence
  Description of Artificial Sequence: Synthetic oligonucleotide
  Target: SCN10A; (+) strand; PAM type: YTN; PAM sequence: TTC
tttgctctacaaagcccagt

SEQ ID NO: 62161 - DNA, 20 bp, Artificial Sequence
  Description of Artificial Sequence: Synthetic oligonucleotide
  Target: SCN10A; (+) strand; PAM type: YTN; PAM sequence: CTT
tgctctacaaagcccagtat

SEQ ID NO: 62162 - DNA, 20 bp, Artificial Sequence
  Description of Artificial Sequence: Synthetic oligonucleotide
  Target: SCN10A; (+) strand; PAM type: YTN; PAM sequence: TTT
gctctacaaagcccagtatt

SEQ ID NO: 62163 - DNA, 20 bp, Artificial Sequence
  Description of Artificial Sequence: Synthetic oligonucleotide
  Target: SCN10A; (+) strand; PAM type: YTN; PAM sequence: TTG
ctctacaaagcccagtattc

SEQ ID NO: 62164 - DNA, 20 bp, Artificial Sequence
  Description of Artificial Sequence: Synthetic oligonucleotide
  Target: SCN10A; (+) strand; PAM type: YTN; PAM sequence: CTC
tacaaagcccagtattcagc

SEQ ID NO: 62165 - DNA, 20 bp, Artificial Sequence
  Description of Artificial Sequence: Synthetic oligonucleotide
  Target: SCN10A; (+) strand; PAM type: YTN; PAM sequence: CTA
caaagcccagtattcagcca

SEQ ID NO: 62166 - DNA, 20 bp, Artificial Sequence
  Description of Artificial Sequence: Synthetic oligonucleotide
  Target: SCN10A; (+) strand; PAM type: YTN; PAM sequence: TTC
agccagggccttagagatgt

SEQ ID NO: 62167 - DNA, 20 bp, Artificial Sequence
  Description of Artificial Sequence: Synthetic oligonucleotide
  Target: SCN10A; (+) strand; PAM type: YTN; PAM sequence: CTT
agagatgtctcccaactctg

SEQ ID NO: 62168 - DNA, 20 bp, Artificial Sequence
  Description of Artificial Sequence: Synthetic oligonucleotide
  Target: SCN10A; (+) strand; PAM type: YTN; PAM sequence: TTA
gagatgtctcccaactctga

SEQ ID NO: 62169 - DNA, 20 bp, Artificial Sequence
  Description of Artificial Sequence: Synthetic oligonucleotide
  Target: SCN10A; (+) strand; PAM type: YTN; PAM sequence: CTC
ccaactctgaatctctattc

SEQ ID NO: 62170 - DNA, 20 bp, Artificial Sequence
  Description of Artificial Sequence: Synthetic oligonucleotide
  Target: SCN10A; (+) strand; PAM type: YTN; PAM sequence: CTC
tgaatctctattcccataag

SEQ ID NO: 62171 - DNA, 20 bp, Artificial Sequence
  Description of Artificial Sequence: Synthetic oligonucleotide
  Target: SCN10A; (+) strand; PAM type: YTN; PAM sequence: CTG
aatctctattcccataaggc

SEQ ID NO: 62172 - DNA, 20 bp, Artificial Sequence
  Description of Artificial Sequence: Synthetic oligonucleotide
  Target: SCN10A; (+) strand; PAM type: YTN; PAM sequence: CTC
tattcccataaggccttgtt

SEQ ID NO: 62173 - DNA, 20 bp, Artificial Sequence
  Description of Artificial Sequence: Synthetic oligonucleotide
  Target: SCN10A; (+) strand; PAM type: YTN; PAM sequence: CTA
ttcccataaggccttgttat

SEQ ID NO: 62174 - DNA, 20 bp, Artificial Sequence
  Description of Artificial Sequence: Synthetic oligonucleotide
  Target: SCN10A; (+) strand; PAM type: YTN; PAM sequence: TTC
ccataaggccttgttattca

SEQ ID NO: 62175 - DNA, 20 bp, Artificial Sequence
  Description of Artificial Sequence: Synthetic oligonucleotide
  Target: SCN10A; (+) strand; PAM type: YTN; PAM sequence: CTT
gttattcaaagtgtgggtca

SEQ ID NO: 62176 - DNA, 20 bp, Artificial Sequence
  Description of Artificial Sequence: Synthetic oligonucleotide
  Target: SCN10A; (+) strand; PAM type: YTN; PAM sequence: TTG
ttattcaaagtgtgggtcac

SEQ ID NO: 62177 - DNA, 20 bp, Artificial Sequence
  Description of Artificial Sequence: Synthetic oligonucleotide
  Target: SCN10A; (+) strand; PAM type: YTN; PAM sequence: TTA
ttcaaagtgtgggtcactga

SEQ ID NO: 62178 - DNA, 20 bp, Artificial Sequence
  Description of Artificial Sequence: Synthetic oligonucleotide
  Target: SCN10A; (+) strand; PAM type: YTN; PAM sequence: TTC
aaagtgtgggtcactgaggg

SEQ ID NO: 62179 - DNA, 20 bp, Artificial Sequence
  Description of Artificial Sequence: Synthetic oligonucleotide
  Target: SCN10A; (+) strand; PAM type: YTN; PAM sequence: CTG
agggcagtgcaagcatcacc

SEQ ID NO: 62180 - DNA, 20 bp, Artificial Sequence
  Description of Artificial Sequence: Synthetic oligonucleotide
  Target: SCN10A; (+) strand; PAM type: YTN; PAM sequence: CTG
ggagcttgttagaaatgcaa

SEQ ID NO: 62181 - DNA, 20 bp, Artificial Sequence
  Description of Artificial Sequence: Synthetic oligonucleotide
  Target: SCN10A; (+) strand; PAM type: YTN; PAM sequence: CTT
gttagaaatgcaaattctca

SEQ ID NO: 62182 - DNA, 20 bp, Artificial Sequence
  Description of Artificial Sequence: Synthetic oligonucleotide
  Target: SCN10A; (+) strand; PAM type: YTN; PAM sequence: TTG
ttagaaatgcaaattctcag

SEQ ID NO: 62183 - DNA, 20 bp, Artificial Sequence
  Description of Artificial Sequence: Synthetic oligonucleotide
  Target: SCN10A; (+) strand; PAM type: YTN; PAM sequence: TTA
gaaatgcaaattctcaggcc

SEQ ID NO: 62184 - DNA, 20 bp, Artificial Sequence
  Description of Artificial Sequence: Synthetic oligonucleotide
  Target: SCN10A; (+) strand; PAM type: YTN; PAM sequence: TTC
tcaggccctgccacagattt

SEQ ID NO: 62185 - DNA, 20 bp, Artificial Sequence
  Description of Artificial Sequence: Synthetic oligonucleotide
  Target: SCN10A; (+) strand; PAM type: YTN; PAM sequence: CTC
aggccctgccacagatttat

SEQ ID NO: 62186 - DNA, 20 bp, Artificial Sequence
  Description of Artificial Sequence: Synthetic oligonucleotide
  Target: SCN10A; (+) strand; PAM type: YTN; PAM sequence: CTG
ccacagatttatggaatgag

SEQ ID NO: 62187 - DNA, 20 bp, Artificial Sequence
  Description of Artificial Sequence: Synthetic oligonucleotide
  Target: SCN10A; (+) strand; PAM type: YTN; PAM sequence: TTT
atggaatgagaatctgcatt

SEQ ID NO: 62188 - DNA, 20 bp, Artificial Sequence
  Description of Artificial Sequence: Synthetic oligonucleotide
  Target: SCN10A; (+) strand; PAM type: YTN; PAM sequence: TTA
tggaatgagaatctgcattt

SEQ ID NO: 62189 - DNA, 20 bp, Artificial Sequence
  Description of Artificial Sequence: Synthetic oligonucleotide
  Target: SCN10A; (+) strand; PAM type: YTN; PAM sequence: CTG
catttgaacaagctcctggg

SEQ ID NO: 62190 - DNA, 20 bp, Artificial Sequence
  Description of Artificial Sequence: Synthetic oligonucleotide
  Target: SCN10A; (+) strand; PAM type: YTN; PAM sequence: TTT
gaacaagctcctgggagatt

SEQ ID NO: 62191 - DNA, 20 bp, Artificial Sequence
  Description of Artificial Sequence: Synthetic oligonucleotide
  Target: SCN10A; (+) strand; PAM type: YTN; PAM sequence: TTG
aacaagctcctgggagatta

SEQ ID NO: 62192 - DNA, 20 bp, Artificial Sequence
  Description of Artificial Sequence: Synthetic oligonucleotide
  Target: SCN10A; (+) strand; PAM type: YTN; PAM sequence: CTC
ctgggagattaaattttgag

SEQ ID NO: 62193 - DNA, 20 bp, Artificial Sequence
  Description of Artificial Sequence: Synthetic oligonucleotide
  Target: SCN10A; (+) strand; PAM type: YTN; PAM sequence: CTG
ggagattaaattttgagaag

SEQ ID NO: 62194 - DNA, 20 bp, Artificial Sequence
  Description of Artificial Sequence: Synthetic oligonucleotide
  Target: SCN10A; (+) strand; PAM type: YTN; PAM sequence: TTA
aattttgagaagtgctattg

SEQ ID NO: 62195 - DNA, 20 bp, Artificial Sequence
  Description of Artificial Sequence: Synthetic oligonucleotide
  Target: SCN10A; (+) strand; PAM type: YTN; PAM sequence: TTT
tgagaagtgctattgtaatg

SEQ ID NO: 62196 - DNA, 20 bp, Artificial Sequence
  Description of Artificial Sequence: Synthetic oligonucleotide
  Target: SCN10A; (+) strand; PAM type: YTN; PAM sequence: TTT
gagaagtgctattgtaatga

SEQ ID NO: 62197 - DNA, 20 bp, Artificial Sequence
  Description of Artificial Sequence: Synthetic oligonucleotide
  Target: SCN10A; (+) strand; PAM type: YTN; PAM sequence: TTG
agaagtgctattgtaatgat

SEQ ID NO: 62198 - DNA, 20 bp, Artificial Sequence
  Description of Artificial Sequence: Synthetic oligonucleotide
  Target: SCN10A; (+) strand; PAM type: YTN; PAM sequence: CTA
ttgtaatgattttctgtgag

SEQ ID NO: 62199 - DNA, 20 bp, Artificial Sequence
  Description of Artificial Sequence: Synthetic oligonucleotide
  Target: SCN10A; (+) strand; PAM type: YTN; PAM sequence: TTG
taatgattttctgtgagctt

SEQ ID NO: 62200 - DNA, 20 bp, Artificial Sequence
  Description of Artificial Sequence: Synthetic oligonucleotide
  Target: SCN10A; (+) strand; PAM type: YTN; PAM sequence: TTT
tctgtgagctttaaaggagt

SEQ ID NO: 62201 - DNA, 20 bp, Artificial Sequence
  Description of Artificial Sequence: Synthetic oligonucleotide
  Target: SCN10A; (+) strand; PAM type: YTN; PAM sequence: TTT
ctgtgagctttaaaggagta

SEQ ID NO: 62202 - DNA, 20 bp, Artificial Sequence
  Description of Artificial Sequence: Synthetic oligonucleotide
  Target: SCN10A; (+) strand; PAM type: YTN; PAM sequence: TTC
tgtgagctttaaaggagtaa

SEQ ID NO: 62203 - DNA, 20 bp, Artificial Sequence
  Description of Artificial Sequence: Synthetic oligonucleotide
  Target: SCN10A; (+) strand; PAM type: YTN; PAM sequence: CTG
tgagctttaaaggagtaatt

SEQ ID NO: 62204 - DNA, 20 bp, Artificial Sequence
  Description of Artificial Sequence: Synthetic oligonucleotide
  Target: SCN10A; (+) strand; PAM type: YTN; PAM sequence: CTT
taaaggagtaattagtagca

SEQ ID NO: 62205 - DNA, 20 bp, Artificial Sequence
  Description of Artificial Sequence: Synthetic oligonucleotide
  Target: SCN10A; (+) strand; PAM type: YTN; PAM sequence: TTT
aaaggagtaattagtagcat

SEQ ID NO: 62206 - DNA, 20 bp, Artificial Sequence
  Description of Artificial Sequence: Synthetic oligonucleotide
  Target: SCN10A; (+) strand; PAM type: YTN; PAM sequence: TTA
aaggagtaattagtagcatt

SEQ ID NO: 62207 - DNA, 20 bp, Artificial Sequence
  Description of Artificial Sequence: Synthetic oligonucleotide
  Target: SCN10A; (+) strand; PAM type: YTN; PAM sequence: TTA
gtagcatttggaagtggttt

SEQ ID NO: 62208 - DNA, 20 bp, Artificial Sequence
  Description of Artificial Sequence: Synthetic oligonucleotide
  Target: SCN10A; (+) strand; PAM type: YTN; PAM sequence: TTT
ggaagtggtttgataaggaa

SEQ ID NO: 62209 - DNA, 20 bp, Artificial Sequence
  Description of Artificial Sequence: Synthetic oligonucleotide
  Target: SCN10A; (+) strand; PAM type: YTN; PAM sequence: TTG
gaagtggtttgataaggaaa

SEQ ID NO: 62210 - DNA, 20 bp, Artificial Sequence
  Description of Artificial Sequence: Synthetic oligonucleotide
  Target: SCN10A; (+) strand; PAM type: YTN; PAM sequence: TTT
gataaggaaagatagtcctt

SEQ ID NO: 62211 - DNA, 20 bp, Artificial Sequence
  Description of Artificial Sequence: Synthetic oligonucleotide
  Target: SCN10A; (+) strand; PAM type: YTN; PAM sequence: TTG
ataaggaaagatagtccttt

SEQ ID NO: 62212 - DNA, 20 bp, Artificial Sequence
  Description of Artificial Sequence: Synthetic oligonucleotide
  Target: SCN10A; (+) strand; PAM type: YTN; PAM sequence: CTT
tttgtattgtaggccttcag

SEQ ID NO: 62213 - DNA, 20 bp, Artificial Sequence
  Description of Artificial Sequence: Synthetic oligonucleotide
  Target: SCN10A; (+) strand; PAM type: YTN; PAM sequence: TTT
ttgtattgtaggccttcaga

SEQ ID NO: 62214 - DNA, 20 bp, Artificial Sequence
  Description of Artificial Sequence: Synthetic oligonucleotide
  Target: SCN10A; (+) strand; PAM type: YTN; PAM sequence: TTT
tgtattgtaggccttcagag

SEQ ID NO: 62215 - DNA, 20 bp, Artificial Sequence
  Description of Artificial Sequence: Synthetic oligonucleotide
  Target: SCN10A; (+) strand; PAM type: YTN; PAM sequence: TTT
gtattgtaggccttcagaga

SEQ ID NO: 62216 - DNA, 20 bp, Artificial Sequence
  Description of Artificial Sequence: Synthetic oligonucleotide
  Target: SCN10A; (+) strand; PAM type: YTN; PAM sequence: TTG
tattgtaggccttcagagaa

SEQ ID NO: 62217 - DNA, 20 bp, Artificial Sequence
  Description of Artificial Sequence: Synthetic oligonucleotide
  Target: SCN10A; (+) strand; PAM type: YTN; PAM sequence: TTG
taggccttcagagaaggccg

SEQ ID NO: 62218 - DNA, 20 bp, Artificial Sequence
  Description of Artificial Sequence: Synthetic oligonucleotide
  Target: SCN10A; (+) strand; PAM type: YTN; PAM sequence: CTT
cagagaaggccgtgtgttgg

SEQ ID NO: 62219 - DNA, 20 bp, Artificial Sequence
  Description of Artificial Sequence: Synthetic oligonucleotide
  Target: SCN10A; (+) strand; PAM type: YTN; PAM sequence: TTC
agagaaggccgtgtgttggg

SEQ ID NO: 62220 - DNA, 20 bp, Artificial Sequence
  Description of Artificial Sequence: Synthetic oligonucleotide
  Target: SCN10A; (+) strand; PAM type: YTN; PAM sequence: TTG
gggaggtcagagggtgggaa

SEQ ID NO: 62221 - DNA, 20 bp, Artificial Sequence
  Description of Artificial Sequence: Synthetic oligonucleotide
  Target: SCN10A; (+) strand; PAM type: YTN; PAM sequence: CTT
cgggattaaataagggcaaa

SEQ ID NO: 62222 - DNA, 20 bp, Artificial Sequence
  Description of Artificial Sequence: Synthetic oligonucleotide
  Target: SCN10A; (+) strand; PAM type: YTN; PAM sequence: TTC
gggattaaataagggcaaag

SEQ ID NO: 62223 - DNA, 20 bp, Artificial Sequence
  Description of Artificial Sequence: Synthetic oligonucleotide
  Target: SCN10A; (+) strand; PAM type: YTN; PAM sequence: TTA
aataagggcaaagctgggtt

SEQ ID NO: 62224 - DNA, 20 bp, Artificial Sequence
  Description of Artificial Sequence: Synthetic oligonucleotide
  Target: SCN10A; (+) strand; PAM type: YTN; PAM sequence: CTG
ggttttgctactgacaagtt

SEQ ID NO: 62225 - DNA, 20 bp, Artificial Sequence
  Description of Artificial Sequence: Synthetic oligonucleotide
  Target: SCN10A; (+) strand; PAM type: YTN; PAM sequence: TTT
tgctactgacaagttgggtg

SEQ ID NO: 62226 - DNA, 20 bp, Artificial Sequence
  Description of Artificial Sequence: Synthetic oligonucleotide
  Target: SCN10A; (+) strand; PAM type: YTN; PAM sequence: TTT
gctactgacaagttgggtga

SEQ ID NO: 62227 - DNA, 20 bp, Artificial Sequence
  Description of Artificial Sequence: Synthetic oligonucleotide
  Target: SCN10A; (+) strand; PAM type: YTN; PAM sequence: TTG
ctactgacaagttgggtgac

SEQ ID NO: 62228 - DNA, 20 bp, Artificial Sequence
  Description of Artificial Sequence: Synthetic oligonucleotide
  Target: SCN10A; (+) strand; PAM type: YTN; PAM sequence: CTA
ctgacaagttgggtgacctt

SEQ ID NO: 62229 - DNA, 20 bp, Artificial Sequence
  Description of Artificial Sequence: Synthetic oligonucleotide
  Target: SCN10A; (+) strand; PAM type: YTN; PAM sequence: CTG
acaagttgggtgaccttgga

SEQ ID NO: 62230 - DNA, 20 bp, Artificial Sequence
  Description of Artificial Sequence: Synthetic oligonucleotide
  Target: SCN10A; (+) strand; PAM type: YTN; PAM sequence: TTG
ggtgaccttggacaagcctt

SEQ ID NO: 62231 - DNA, 20 bp, Artificial Sequence
  Description of Artificial Sequence: Synthetic oligonucleotide
  Target: SCN10A; (+) strand; PAM type: YTN; PAM sequence: CTT
ggacaagccttttaaacatt

SEQ ID NO: 62232 - DNA, 20 bp, Artificial Sequence
  Description of Artificial Sequence: Synthetic oligonucleotide
  Target: SCN10A; (+) strand; PAM type: YTN; PAM sequence: TTG
gacaagccttttaaacattt

SEQ ID NO: 62233 - DNA, 20 bp, Artificial Sequence
  Description of Artificial Sequence: Synthetic oligonucleotide
  Target: SCN10A; (+) strand; PAM type: YTN; PAM sequence: CTT
ttaaacattttgagtgtcag

SEQ ID NO: 62234 - DNA, 20 bp, Artificial Sequence
  Description of Artificial Sequence: Synthetic oligonucleotide
  Target: SCN10A; (+) strand; PAM type: YTN; PAM sequence: TTT
taaacattttgagtgtcagt

SEQ ID NO: 62235 - DNA, 20 bp, Artificial Sequence
  Description of Artificial Sequence: Synthetic oligonucleotide
  Target: SCN10A; (+) strand; PAM type: YTN; PAM sequence: TTT
aaacattttgagtgtcagtt

SEQ ID NO: 62236 - DNA, 20 bp, Artificial Sequence
  Description of Artificial Sequence: Synthetic oligonucleotide
  Target: SCN10A; (+) strand; PAM type: YTN; PAM sequence: TTA
aacattttgagtgtcagttt

SEQ ID NO: 62237 - DNA, 20 bp, Artificial Sequence
  Description of Artificial Sequence: Synthetic oligonucleotide
  Target: SCN10A; (+) strand; PAM type: YTN; PAM sequence: TTT
tgagtgtcagtttccccatc

SEQ ID NO: 62238 - DNA, 20 bp, Artificial Sequence
  Description of Artificial Sequence: Synthetic oligonucleotide
  Target: SCN10A; (+) strand; PAM type: YTN; PAM sequence: TTT
gagtgtcagtttccccatct

SEQ ID NO: 62239 - DNA, 20 bp, Artificial Sequence
  Description of Artificial Sequence: Synthetic oligonucleotide
  Target: SCN10A; (+) strand; PAM type: YTN; PAM sequence: TTG
agtgtcagtttccccatcta

SEQ ID NO: 62240 - DNA, 20 bp, Artificial Sequence
  Description of Artificial Sequence: Synthetic oligonucleotide
  Target: SCN10A; (+) strand; PAM type: YTN; PAM sequence: TTT
ccccatctatatagtgggag

SEQ ID NO: 62241 - DNA, 20 bp, Artificial Sequence
  Description of Artificial Sequence: Synthetic oligonucleotide
  Target: SCN10A; (+) strand; PAM type: YTN; PAM sequence: TTC
cccatctatatagtgggagg

SEQ ID NO: 62242 - DNA, 20 bp, Artificial Sequence
  Description of Artificial Sequence: Synthetic oligonucleotide
  Target: SCN10A; (+) strand; PAM type: YTN; PAM sequence: CTA
tatagtgggaggcatacact

SEQ ID NO: 62243 - DNA, 20 bp, Artificial Sequence
  Description of Artificial Sequence: Synthetic oligonucleotide
  Target: SCN10A; (+) strand; PAM type: YTN; PAM sequence: CTC
actcactcaaatgcttgcag

SEQ ID NO: 62244 - DNA, 20 bp, Artificial Sequence
  Description of Artificial Sequence: Synthetic oligonucleotide
  Target: SCN10A; (+) strand; PAM type: YTN; PAM sequence: CTC
actcaaatgcttgcagccag

SEQ ID NO: 62245 - DNA, 20 bp, Artificial Sequence
  Description of Artificial Sequence: Synthetic oligonucleotide
  Target: SCN10A; (+) strand; PAM type: YTN; PAM sequence: CTC
aaatgcttgcagccaggttt

SEQ ID NO: 62246 - DNA, 20 bp, Artificial Sequence
  Description of Artificial Sequence: Synthetic oligonucleotide
  Target: SCN10A; (+) strand; PAM type: YTN; PAM sequence: CTT
gcagccaggtttggcaggcc

SEQ ID NO: 62247 - DNA, 20 bp, Artificial Sequence
  Description of Artificial Sequence: Synthetic oligonucleotide
  Target: SCN10A; (+) strand; PAM type: YTN; PAM sequence: TTG
cagccaggtttggcaggcca

SEQ ID NO: 62248 - DNA, 20 bp, Artificial Sequence
  Description of Artificial Sequence: Synthetic oligonucleotide
  Target: SCN10A; (+) strand; PAM type: YTN; PAM sequence: TTT
ggcaggccatggcacgggca

SEQ ID NO: 62249 - DNA, 20 bp, Artificial Sequence
  Description of Artificial Sequence: Synthetic oligonucleotide
  Target: SCN10A; (+) strand; PAM type: YTN; PAM sequence: TTG
gcaggccatggcacgggcac

SEQ ID NO: 62250 - DNA, 20 bp, Artificial Sequence
  Description of Artificial Sequence: Synthetic oligonucleotide
  Target: SCN10A; (+) strand; PAM type: YTN; PAM sequence: CTT
gaacacctcccatgctctgc

SEQ ID NO: 62251 - DNA, 20 bp, Artificial Sequence
  Description of Artificial Sequence: Synthetic oligonucleotide
  Target: SCN10A; (+) strand; PAM type: YTN; PAM sequence: TTG
aacacctcccatgctctgct

SEQ ID NO: 62252 - DNA, 20 bp, Artificial Sequence
  Description of Artificial Sequence: Synthetic oligonucleotide
  Target: SCN10A; (+) strand; PAM type: YTN; PAM sequence: CTC
ccatgctctgctgctaagag

SEQ ID NO: 62253 - DNA, 20 bp, Artificial Sequence
  Description of Artificial Sequence: Synthetic oligonucleotide
  Target: SCN10A; (+) strand; PAM type: YTN; PAM sequence: CTC
tgctgctaagaggggccctc

SEQ ID NO: 62254 - DNA, 20 bp, Artificial Sequence
  Description of Artificial Sequence: Synthetic oligonucleotide
  Target: SCN10A; (+) strand; PAM type: YTN; PAM sequence: CTG
ctgctaagaggggccctcgc

SEQ ID NO: 62255 - DNA, 20 bp, Artificial Sequence
  Description of Artificial Sequence: Synthetic oligonucleotide
  Target: SCN10A; (+) strand; PAM type: YTN; PAM sequence: CTG
ctaagaggggccctcgccct

SEQ ID NO: 62256 - DNA, 20 bp, Artificial Sequence
  Description of Artificial Sequence: Synthetic oligonucleotide
  Target: SCN10A; (+) strand; PAM type: YTN; PAM sequence: CTA
agaggggccctcgccctggg

SEQ ID NO: 62257 - DNA, 20 bp, Artificial Sequence
  Description of Artificial Sequence: Synthetic oligonucleotide
  Target: SCN10A; (+) strand; PAM type: YTN; PAM sequence: CTC
gccctgggctgcagctctcc

SEQ ID NO: 62258 - DNA, 20 bp, Artificial Sequence
  Description of Artificial Sequence: Synthetic oligonucleotide
  Target: SCN10A; (+) strand; PAM type: YTN; PAM sequence: CTG
ggctgcagctctccttctag

SEQ ID NO: 62259 - DNA, 20 bp, Artificial Sequence
  Description of Artificial Sequence: Synthetic oligonucleotide
  Target: SCN10A; (+) strand; PAM type: YTN; PAM sequence: CTG
cagctctccttctagtgaca

SEQ ID NO: 62260 - DNA, 20 bp, Artificial Sequence
  Description of Artificial Sequence: Synthetic oligonucleotide
  Target: SCN10A; (+) strand; PAM type: YTN; PAM sequence: CTC
tccttctagtgacaaggttg

SEQ ID NO: 62261 - DNA, 20 bp, Artificial Sequence
  Description of Artificial Sequence: Synthetic oligonucleotide
  Target: SCN10A; (+) strand; PAM type: YTN; PAM sequence: CTC
cttctagtgacaaggttggg

SEQ ID NO: 62262 - DNA, 20 bp, Artificial Sequence
  Description of Artificial Sequence: Synthetic oligonucleotide
  Target: SCN10A; (+) strand; PAM type: YTN; PAM sequence: CTT
ctagtgacaaggttggggac

SEQ ID NO: 62263 - DNA, 20 bp, Artificial Sequence
  Description of Artificial Sequence: Synthetic oligonucleotide
  Target: SCN10A; (+) strand; PAM type: YTN; PAM sequence: TTC
tagtgacaaggttggggact

SEQ ID NO: 62264 - DNA, 20 bp, Artificial Sequence
  Description of Artificial Sequence: Synthetic oligonucleotide
  Target: SCN10A; (+) strand; PAM type: YTN; PAM sequence: CTA
gtgacaaggttggggacttt

SEQ ID NO: 62265 - DNA, 20 bp, Artificial Sequence
  Description of Artificial Sequence: Synthetic oligonucleotide
  Target: SCN10A; (+) strand; PAM type: YTN; PAM sequence: TTG
gggactttcagctcagtagt

SEQ ID NO: 62266 - DNA, 20 bp, Artificial Sequence
  Description of Artificial Sequence: Synthetic oligonucleotide
  Target: SCN10A; (+) strand; PAM type: YTN; PAM sequence: CTT
tcagctcagtagtcaggaga

SEQ ID NO: 62267 - DNA, 20 bp, Artificial Sequence
  Description of Artificial Sequence: Synthetic oligonucleotide
  Target: SCN10A; (+) strand; PAM type: YTN; PAM sequence: TTT
cagctcagtagtcaggagaa

SEQ ID NO: 62268 - DNA, 20 bp, Artificial Sequence
  Description of Artificial Sequence: Synthetic oligonucleotide
  Target: SCN10A; (+) strand; PAM type: YTN; PAM sequence: TTC
agctcagtagtcaggagaac

SEQ ID NO: 62269 - DNA, 20 bp, Artificial Sequence
  Description of Artificial Sequence: Synthetic oligonucleotide
  Target: SCN10A; (+) strand; PAM type: YTN; PAM sequence: CTC
agtagtcaggagaacccact

SEQ ID NO: 62270 - DNA, 20 bp, Artificial Sequence
  Description of Artificial Sequence: Synthetic oligonucleotide
  Target: SCN10A; (+) strand; PAM type: YTN; PAM sequence: CTG
atgcagctccagggcctttg

SEQ ID NO: 62271 - DNA, 20 bp, Artificial Sequence
  Description of Artificial Sequence: Synthetic oligonucleotide
  Target: SCN10A; (+) strand; PAM type: YTN; PAM sequence: CTC
cagggcctttggattgtagg

SEQ ID NO: 62272 - DNA, 20 bp, Artificial Sequence
  Description of Artificial Sequence: Synthetic oligonucleotide
  Target: SCN10A; (+) strand; PAM type: YTN; PAM sequence: CTT
tggattgtaggagattccta

SEQ ID NO: 62273 - DNA, 20 bp, Artificial Sequence
  Description of Artificial Sequence: Synthetic oligonucleotide
  Target: SCN10A; (+) strand; PAM type: YTN; PAM sequence: TTT
ggattgtaggagattcctat

SEQ ID NO: 62274 - DNA, 20 bp, Artificial Sequence
  Description of Artificial Sequence: Synthetic oligonucleotide
  Target: SCN10A; (+) strand; PAM type: YTN; PAM sequence: TTG
gattgtaggagattcctatc

SEQ ID NO: 62275 - DNA, 20 bp, Artificial Sequence
  Description of Artificial Sequence: Synthetic oligonucleotide
  Target: SCN10A; (+) strand; PAM type: YTN; PAM sequence: TTG
taggagattcctatctggag

SEQ ID NO: 62276 - DNA, 20 bp, Artificial Sequence
  Description of Artificial Sequence: Synthetic oligonucleotide
  Target: SCN10A; (+) strand; PAM type: YTN; PAM sequence: TTC
ctatctggaggatttggggg

SEQ ID NO: 62277 - DNA, 20 bp, Artificial Sequence
  Description of Artificial Sequence: Synthetic oligonucleotide
  Target: SCN10A; (+) strand; PAM type: YTN; PAM sequence: CTA
tctggaggatttgggggcag

SEQ ID NO: 62278 - DNA, 20 bp, Artificial Sequence
  Description of Artificial Sequence: Synthetic oligonucleotide
  Target: SCN10A; (+) strand; PAM type: YTN; PAM sequence: CTG
gaggatttgggggcagggac

SEQ ID NO: 62279 - DNA, 20 bp, Artificial Sequence
  Description of Artificial Sequence: Synthetic oligonucleotide
  Target: SCN10A; (+) strand; PAM type: YTN; PAM sequence: TTT
gggggcagggactatgcctc

SEQ ID NO: 62280 - DNA, 20 bp, Artificial Sequence
  Description of Artificial Sequence: Synthetic oligonucleotide
  Target: SCN10A; (+) strand; PAM type: YTN; PAM sequence: TTG
ggggcagggactatgcctcc

SEQ ID NO: 62281 - DNA, 20 bp, Artificial Sequence
  Description of Artificial Sequence: Synthetic oligonucleotide
  Target: SCN10A; (+) strand; PAM type: YTN; PAM sequence: CTA
tgcctccccttaccagagat

SEQ ID NO: 62282 - DNA, 20 bp, Artificial Sequence
  Description of Artificial Sequence: Synthetic oligonucleotide
  Target: SCN10A; (+) strand; PAM type: YTN; PAM sequence: CTC
cccttaccagagatccactg

SEQ ID NO: 62283 - DNA, 20 bp, Artificial Sequence
  Description of Artificial Sequence: Synthetic oligonucleotide
  Target: SCN10A; (+) strand; PAM type: YTN; PAM sequence: CTT
accagagatccactgctgag

SEQ ID NO: 62284 - DNA, 20 bp, Artificial Sequence
  Description of Artificial Sequence: Synthetic oligonucleotide
  Target: SCN10A; (+) strand; PAM type: YTN; PAM sequence: TTA
ccagagatccactgctgagc

SEQ ID NO: 62285 - DNA, 20 bp, Artificial Sequence
  Description of Artificial Sequence: Synthetic oligonucleotide
  Target: SCN10A; (+) strand; PAM type: YTN; PAM sequence: CTG
ctgagcaggatcatgaagat

SEQ ID NO: 62286 - DNA, 20 bp, Artificial Sequence
  Description of Artificial Sequence: Synthetic oligonucleotide
  Target: SCN10A; (+) strand; PAM type: YTN; PAM sequence: CTG
agcaggatcatgaagatgat

SEQ ID NO: 62287 - DNA, 20 bp, Artificial Sequence
  Description of Artificial Sequence: Synthetic oligonucleotide
  Target: SCN10A; (+) strand; PAM type: YTN; PAM sequence: CTC
tcaaaccagctgtgctccac

SEQ ID NO: 62288 - DNA, 20 bp, Artificial Sequence
  Description of Artificial Sequence: Synthetic oligonucleotide
  Target: SCN10A; (+) strand; PAM type: YTN; PAM sequence: CTC
aaaccagctgtgctccacga

SEQ ID NO: 62289 - DNA, 20 bp, Artificial Sequence
  Description of Artificial Sequence: Synthetic oligonucleotide
  Target: SCN10A; (+) strand; PAM type: YTN; PAM sequence: CTG
tgctccacgatacggtagca

SEQ ID NO: 62290 - DNA, 20 bp, Artificial Sequence
  Description of Artificial Sequence: Synthetic oligonucleotide
  Target: SCN10A; (+) strand; PAM type: YTN; PAM sequence: CTC
cacgatacggtagcaagtct

SEQ ID NO: 62291 - DNA, 20 bp, Artificial Sequence
  Description of Artificial Sequence: Synthetic oligonucleotide
  Target: SCN10A; (+) strand; PAM type: YTN; PAM sequence: CTT
gcgcacctgccagcccacat

SEQ ID NO: 62292 - DNA, 20 bp, Artificial Sequence
  Description of Artificial Sequence: Synthetic oligonucleotide
  Target: SCN10A; (+) strand; PAM type: YTN; PAM sequence: TTG
cgcacctgccagcccacatc

SEQ ID NO: 62293 - DNA, 20 bp, Artificial Sequence
  Description of Artificial Sequence: Synthetic oligonucleotide
  Target: SCN10A; (+) strand; PAM type: YTN; PAM sequence: CTG
ccagcccacatcccatggac

SEQ ID NO: 62294 - DNA, 20 bp, Artificial Sequence
  Description of Artificial Sequence: Synthetic oligonucleotide
  Target: SCN10A; (+) strand; PAM type: YTN; PAM sequence: CTC
ttggtggtatccagtttgca

SEQ ID NO: 62295 - DNA, 20 bp, Artificial Sequence
  Description of Artificial Sequence: Synthetic oligonucleotide
  Target: SCN10A; (+) strand; PAM type: YTN; PAM sequence: CTT
ggtggtatccagtttgcagc

SEQ ID NO: 62296 - DNA, 20 bp, Artificial Sequence
  Description of Artificial Sequence: Synthetic oligonucleotide
  Target: SCN10A; (+) strand; PAM type: YTN; PAM sequence: TTG
gtggtatccagtttgcagca

SEQ ID NO: 62297 - DNA, 20 bp, Artificial Sequence
  Description of Artificial Sequence: Synthetic oligonucleotide
  Target: SCN10A; (+) strand; PAM type: YTN; PAM sequence: TTT
gcagcagggacagtggcgaa

SEQ ID NO: 62298 - DNA, 20 bp, Artificial Sequence
  Description of Artificial Sequence: Synthetic oligonucleotide
  Target: SCN10A; (+) strand; PAM type: YTN; PAM sequence: TTG
cagcagggacagtggcgaat

SEQ ID NO: 62299 - DNA, 20 bp, Artificial Sequence
  Description of Artificial Sequence: Synthetic oligonucleotide
  Target: SCN10A; (+) strand; PAM type: YTN; PAM sequence: CTG
tggggagaggtgactgatgg

SEQ ID NO: 62300 - DNA, 20 bp, Artificial Sequence
  Description of Artificial Sequence: Synthetic oligonucleotide
  Target: SCN10A; (+) strand; PAM type: YTN; PAM sequence: CTG
atggtgggtgatggccagtg

SEQ ID NO: 62301 - DNA, 20 bp, Artificial Sequence
  Description of Artificial Sequence: Synthetic oligonucleotide
  Target: SCN10A; (+) strand; PAM type: YTN; PAM sequence: TTT
ctgctcctgctgcagagaaa

SEQ ID NO: 62302 - DNA, 20 bp, Artificial Sequence
  Description of Artificial Sequence: Synthetic oligonucleotide
  Target: SCN10A; (+) strand; PAM type: YTN; PAM sequence: TTC
tgctcctgctgcagagaaac

SEQ ID NO: 62303 - DNA, 20 bp, Artificial Sequence
  Description of Artificial Sequence: Synthetic oligonucleotide
  Target: SCN10A; (+) strand; PAM type: YTN; PAM sequence: CTG
ctcctgctgcagagaaacca

SEQ ID NO: 62304 - DNA, 20 bp, Artificial Sequence
  Description of Artificial Sequence: Synthetic oligonucleotide
  Target: SCN10A; (+) strand; PAM type: YTN; PAM sequence: CTC
ctgctgcagagaaaccattc

SEQ ID NO: 62305 - DNA, 20 bp, Artificial Sequence
  Description of Artificial Sequence: Synthetic oligonucleotide
  Target: SCN10A; (+) strand; PAM type: YTN; PAM sequence: CTG
ctgcagagaaaccattctgc

SEQ ID NO: 62306 - DNA, 20 bp, Artificial Sequence
  Description of Artificial Sequence: Synthetic oligonucleotide
  Target: SCN10A; (+) strand; PAM type: YTN; PAM sequence: CTG
cagagaaaccattctgctag

SEQ ID NO: 62307 - DNA, 20 bp, Artificial Sequence
  Description of Artificial Sequence: Synthetic oligonucleotide
  Target: SCN10A; (+) strand; PAM type: YTN; PAM sequence: TTC
tgctaggaaacccacttgtc

SEQ ID NO: 62308 - DNA, 20 bp, Artificial Sequence
  Description of Artificial Sequence: Synthetic oligonucleotide
  Target: SCN10A; (+) strand; PAM type: YTN; PAM sequence: CTG
ctaggaaacccacttgtcat

SEQ ID NO: 62309 - DNA, 20 bp, Artificial Sequence
  Description of Artificial Sequence: Synthetic oligonucleotide
  Target: SCN10A; (+) strand; PAM type: YTN; PAM sequence: CTA
ggaaacccacttgtcatgcc

SEQ ID NO: 62310 - DNA, 20 bp, Artificial Sequence
  Description of Artificial Sequence: Synthetic oligonucleotide
  Target: SCN10A; (+) strand; PAM type: YTN; PAM sequence: CTT
gtcatgcccttggaaaaaaa

SEQ ID NO: 62311 - DNA, 20 bp, Artificial Sequence
  Description of Artificial Sequence: Synthetic oligonucleotide
  Target: SCN10A; (+) strand; PAM type: YTN; PAM sequence: TTG
tcatgcccttggaaaaaaat

SEQ ID NO: 62312 - DNA, 20 bp, Artificial Sequence
  Description of Artificial Sequence: Synthetic oligonucleotide
  Target: SCN10A; (+) strand; PAM type: YTN; PAM sequence: CTT
ggaaaaaaattctttcctgg

SEQ ID NO: 62313 - DNA, 20 bp, Artificial Sequence
  Description of Artificial Sequence: Synthetic oligonucleotide
  Target: SCN10A; (+) strand; PAM type: YTN; PAM sequence: TTG
gaaaaaaattctttcctgga

SEQ ID NO: 62314 - DNA, 20 bp, Artificial Sequence
  Description of Artificial Sequence: Synthetic oligonucleotide
  Target: SCN10A; (+) strand; PAM type: YTN; PAM sequence: TTC
tttcctggaatatgggtgaa

SEQ ID NO: 62315 - DNA, 20 bp, Artificial Sequence
  Description of Artificial Sequence: Synthetic oligonucleotide
  Target: SCN10A; (+) strand; PAM type: YTN; PAM sequence: CTT
tcctggaatatgggtgaaga

SEQ ID NO: 62316 - DNA, 20 bp, Artificial Sequence
  Description of Artificial Sequence: Synthetic oligonucleotide
  Target: SCN10A; (+) strand; PAM type: YTN; PAM sequence: TTT
cctggaatatgggtgaagag

SEQ ID NO: 62317 - DNA, 20 bp, Artificial Sequence
  Description of Artificial Sequence: Synthetic oligonucleotide
  Target: SCN10A; (+) strand; PAM type: YTN; PAM sequence: TTC
ctggaatatgggtgaagagg

SEQ ID NO: 62318 - DNA, 20 bp, Artificial Sequence
  Description of Artificial Sequence: Synthetic oligonucleotide
  Target: SCN10A; (+) strand; PAM type: YTN; PAM sequence: CTG
gaatatgggtgaagaggggt

SEQ ID NO: 62319 - DNA, 20 bp, Artificial Sequence
  Description of Artificial Sequence: Synthetic oligonucleotide
  Target: SCN10A; (+) strand; PAM type: YTN; PAM sequence: CTT
ccagggagtccctcaatcca

SEQ ID NO: 62320 - DNA, 20 bp, Artificial Sequence
  Description of Artificial Sequence: Synthetic oligonucleotide
  Target: SCN10A; (+) strand; PAM type: YTN; PAM sequence: TTC
cagggagtccctcaatccag

SEQ ID NO: 62321 - DNA, 20 bp, Artificial Sequence
  Description of Artificial Sequence: Synthetic oligonucleotide
  Target: SCN10A; (+) strand; PAM type: YTN; PAM sequence: CTC
aatccagaccaacaggtgtt

SEQ ID NO: 62322 - DNA, 20 bp, Artificial Sequence
  Description of Artificial Sequence: Synthetic oligonucleotide
  Target: SCN10A; (+) strand; PAM type: YTN; PAM sequence: TTC
ctctccatcatcagtcttgc

SEQ ID NO: 62323 - DNA, 20 bp, Artificial Sequence
  Description of Artificial Sequence: Synthetic oligonucleotide
  Target: SCN10A; (+) strand; PAM type: YTN; PAM sequence: CTC
tccatcatcagtcttgccca

SEQ ID NO: 62324 - DNA, 20 bp, Artificial Sequence
  Description of Artificial Sequence: Synthetic oligonucleotide
  Target: SCN10A; (+) strand; PAM type: YTN; PAM sequence: CTC
catcatcagtcttgcccact

SEQ ID NO: 62325 - DNA, 20 bp, Artificial Sequence
  Description of Artificial Sequence: Synthetic oligonucleotide
  Target: SCN10A; (+) strand; PAM type: YTN; PAM sequence: CTT
gcccactctgatgtttttcc

SEQ ID NO: 62326 - DNA, 20 bp, Artificial Sequence
  Description of Artificial Sequence: Synthetic oligonucleotide
  Target: SCN10A; (+) strand; PAM type: YTN; PAM sequence: TTG
cccactctgatgtttttcct

SEQ ID NO: 62327 - DNA, 20 bp, Artificial Sequence
  Description of Artificial Sequence: Synthetic oligonucleotide
  Target: SCN10A; (+) strand; PAM type: YTN; PAM sequence: CTC
tgatgtttttcctagccata

SEQ ID NO: 62328 - DNA, 20 bp, Artificial Sequence
  Description of Artificial Sequence: Synthetic oligonucleotide
  Target: SCN10A; (+) strand; PAM type: YTN; PAM sequence: CTG
atgtttttcctagccatatc

SEQ ID NO: 62329 - DNA, 20 bp, Artificial Sequence
  Description of Artificial Sequence: Synthetic oligonucleotide
  Target: SCN10A; (+) strand; PAM type: YTN; PAM sequence: TTT
ttcctagccatatccttctt

SEQ ID NO: 62330 - DNA, 20 bp, Artificial Sequence
  Description of Artificial Sequence: Synthetic oligonucleotide
  Target: SCN10A; (+) strand; PAM type: YTN; PAM sequence: TTT
tcctagccatatccttctta

SEQ ID NO: 62331 - DNA, 20 bp, Artificial Sequence
  Description of Artificial Sequence: Synthetic oligonucleotide
  Target: SCN10A; (+) strand; PAM type: YTN; PAM sequence: TTT
cctagccatatccttcttac

SEQ ID NO: 62332 - DNA, 20 bp, Artificial Sequence
  Description of Artificial Sequence: Synthetic oligonucleotide
  Target: SCN10A; (+) strand; PAM type: YTN; PAM sequence: TTC
ctagccatatccttcttaca

SEQ ID NO: 62333 - DNA, 20 bp, Artificial Sequence
  Description of Artificial Sequence: Synthetic oligonucleotide
  Target: SCN10A; (+) strand; PAM type: YTN; PAM sequence: CTA
gccatatccttcttacagat

SEQ ID NO: 62334 - DNA, 20 bp, Artificial Sequence
  Description of Artificial Sequence: Synthetic oligonucleotide
  Target: SCN10A; (+) strand; PAM type: YTN; PAM sequence: CTT
cttacagatgacaccagtgg

SEQ ID NO: 62335 - DNA, 20 bp, Artificial Sequence
  Description of Artificial Sequence: Synthetic oligonucleotide
  Target: SCN10A; (+) strand; PAM type: YTN; PAM sequence: TTC
ttacagatgacaccagtggt

SEQ ID NO: 62336 - DNA, 20 bp, Artificial Sequence
  Description of Artificial Sequence: Synthetic oligonucleotide
  Target: SCN10A; (+) strand; PAM type: YTN; PAM sequence: CTT
acagatgacaccagtggtcc

SEQ ID NO: 62337 - DNA, 20 bp, Artificial Sequence
  Description of Artificial Sequence: Synthetic oligonucleotide
  Target: SCN10A; (+) strand; PAM type: YTN; PAM sequence: TTA
cagatgacaccagtggtccc

SEQ ID NO: 62338 - DNA, 20 bp, Artificial Sequence
  Description of Artificial Sequence: Synthetic oligonucleotide
  Target: SCN10A; (+) strand; PAM type: YTN; PAM sequence: CTG
tccttctgcccacctatacc

SEQ ID NO: 62339 - DNA, 20 bp, Artificial Sequence
  Description of Artificial Sequence: Synthetic oligonucleotide
  Target: SCN10A; (+) strand; PAM type: YTN; PAM sequence: CTT
ctgcccacctatacctggaa

SEQ ID NO: 62340 - DNA, 20 bp, Artificial Sequence
  Description of Artificial Sequence: Synthetic oligonucleotide
  Target: SCN10A; (+) strand; PAM type: YTN; PAM sequence: TTC
tgcccacctatacctggaaa

SEQ ID NO: 62341 - DNA, 20 bp, Artificial Sequence
  Description of Artificial Sequence: Synthetic oligonucleotide
  Target: SCN10A; (+) strand; PAM type: YTN; PAM sequence: CTG
cccacctatacctggaaaac

SEQ ID NO: 62342 - DNA, 20 bp, Artificial Sequence
  Description of Artificial Sequence: Synthetic oligonucleotide
  Target: SCN10A; (+) strand; PAM type: YTN; PAM sequence: CTA
tacctggaaaacagacaagc

SEQ ID NO: 62343 - DNA, 20 bp, Artificial Sequence
  Description of Artificial Sequence: Synthetic oligonucleotide
  Target: SCN10A; (+) strand; PAM type: YTN; PAM sequence: CTG
gaaaacagacaagctacggc

SEQ ID NO: 62344 - DNA, 20 bp, Artificial Sequence
  Description of Artificial Sequence: Synthetic oligonucleotide
  Target: SCN10A; (+) strand; PAM type: YTN; PAM sequence: CTA
cggcgtatgagcctgggggt

SEQ ID NO: 62345 - DNA, 20 bp, Artificial Sequence
  Description of Artificial Sequence: Synthetic oligonucleotide
  Target: SCN10A; (+) strand; PAM type: YTN; PAM sequence: CTG
ggggtgcctgagggggatat

SEQ ID NO: 62346 - DNA, 20 bp, Artificial Sequence
  Description of Artificial Sequence: Synthetic oligonucleotide
  Target: SCN10A; (+) strand; PAM type: YTN; PAM sequence: CTG
agggggatatgctccaagcc

SEQ ID NO: 62347 - DNA, 20 bp, Artificial Sequence
  Description of Artificial Sequence: Synthetic oligonucleotide
  Target: SCN10A; (+) strand; PAM type: YTN; PAM sequence: CTC
caagcccaagctgaactgag

SEQ ID NO: 62348 - DNA, 20 bp, Artificial Sequence
  Description of Artificial Sequence: Synthetic oligonucleotide
  Target: SCN10A; (+) strand; PAM type: YTN; PAM sequence: CTG
aactgagggccacgacgtgg

SEQ ID NO: 62349 - DNA, 20 bp, Artificial Sequence
  Description of Artificial Sequence: Synthetic oligonucleotide
  Target: SCN10A; (+) strand; PAM type: YTN; PAM sequence: CTG
agggccacgacgtggctggg

SEQ ID NO: 62350 - DNA, 20 bp, Artificial Sequence
  Description of Artificial Sequence: Synthetic oligonucleotide
  Target: SCN10A; (+) strand; PAM type: YTN; PAM sequence: CTG
ggatggggattgggtccagc

SEQ ID NO: 62351 - DNA, 20 bp, Artificial Sequence
  Description of Artificial Sequence: Synthetic oligonucleotide
  Target: SCN10A; (+) strand; PAM type: YTN; PAM sequence: TTG
ggtccagcccagctcagccc

SEQ ID NO: 62352 - DNA, 20 bp, Artificial Sequence
  Description of Artificial Sequence: Synthetic oligonucleotide
  Target: SCN10A; (+) strand; PAM type: YTN; PAM sequence: CTC
agcccagcccagggtcaaat

SEQ ID NO: 62353 - DNA, 20 bp, Artificial Sequence
  Description of Artificial Sequence: Synthetic oligonucleotide
  Target: SCN10A; (+) strand; PAM type: YTN; PAM sequence: CTA
ttaataaaaactcaagtatt

SEQ ID NO: 62354 - DNA, 20 bp, Artificial Sequence
  Description of Artificial Sequence: Synthetic oligonucleotide
  Target: SCN10A; (+) strand; PAM type: YTN; PAM sequence: TTA
ataaaaactcaagtatttaa

SEQ ID NO: 62355 - DNA, 20 bp, Artificial Sequence
  Description of Artificial Sequence: Synthetic oligonucleotide
  Target: SCN10A; (+) strand; PAM type: YTN; PAM sequence: CTC
aagtatttaaaaaatttttc

SEQ ID NO: 62356 - DNA, 20 bp, Artificial Sequence
  Description of Artificial Sequence: Synthetic oligonucleotide
  Target: SCN10A; (+) strand; PAM type: YTN; PAM sequence: TTT
aaaaaatttttctttgtatt

SEQ ID NO: 62357 - DNA, 20 bp, Artificial Sequence
  Description of Artificial Sequence: Synthetic oligonucleotide
  Target: SCN10A; (+) strand; PAM type: YTN; PAM sequence: TTA
aaaaatttttctttgtattt

SEQ ID NO: 62358 - DNA, 20 bp, Artificial Sequence
  Description of Artificial Sequence: Synthetic oligonucleotide
  Target: SCN10A; (+) strand; PAM type: YTN; PAM sequence: TTT
ttctttgtatttttagaaag

SEQ ID NO: 62359 - DNA, 20 bp, Artificial Sequence
  Description of Artificial Sequence: Synthetic oligonucleotide
  Target: SCN10A; (+) strand; PAM type: YTN; PAM sequence: TTT
tctttgtatttttagaaagc

SEQ ID NO: 62360 - DNA, 20 bp, Artificial Sequence
  Description of Artificial Sequence: Synthetic oligonucleotide
  Target: SCN10A; (+) strand; PAM type: YTN; PAM sequence: TTT
ctttgtatttttagaaagca

SEQ ID NO: 62361 - DNA, 20 bp, Artificial Sequence
  Description of Artificial Sequence: Synthetic oligonucleotide
  Target: SCN10A; (+) strand; PAM type: YTN; PAM sequence: TTC
tttgtatttttagaaagcat

SEQ ID NO: 62362 - DNA, 20 bp, Artificial Sequence
  Description of Artificial Sequence: Synthetic oligonucleotide
  Target: SCN10A; (+) strand; PAM type: YTN; PAM sequence: CTT
tgtatttttagaaagcattg

SEQ ID NO: 62363 - DNA, 20 bp, Artificial Sequence
  Description of Artificial Sequence: Synthetic oligonucleotide
  Target: SCN10A; (+) strand; PAM type: YTN; PAM sequence: TTT
gtatttttagaaagcattga

SEQ ID NO: 62364 - DNA, 20 bp, Artificial Sequence
  Description of Artificial Sequence: Synthetic oligonucleotide
  Target: SCN10A; (+) strand; PAM type: YTN; PAM sequence: TTG
tatttttagaaagcattgag

SEQ ID NO: 62365 - DNA, 20 bp, Artificial Sequence
  Description of Artificial Sequence: Synthetic oligonucleotide
  Target: SCN10A; (+) strand; PAM type: YTN; PAM sequence: TTT
ttagaaagcattgaggccac

SEQ ID NO: 62366 - DNA, 20 bp, Artificial Sequence
  Description of Artificial Sequence: Synthetic oligonucleotide
  Target: SCN10A; (+) strand; PAM type: YTN; PAM sequence: TTT
tagaaagcattgaggccaca

SEQ ID NO: 62367 - DNA, 20 bp, Artificial Sequence
  Description of Artificial Sequence: Synthetic oligonucleotide
  Target: SCN10A; (+) strand; PAM type: YTN; PAM sequence: TTT
agaaagcattgaggccacaa

SEQ ID NO: 62368 - DNA, 20 bp, Artificial Sequence
  Description of Artificial Sequence: Synthetic oligonucleotide
  Target: SCN10A; (+) strand; PAM type: YTN; PAM sequence: TTA
gaaagcattgaggccacaat

SEQ ID NO: 62369 - DNA, 20 bp, Artificial Sequence
  Description of Artificial Sequence: Synthetic oligonucleotide
  Target: SCN10A; (+) strand; PAM type: YTN; PAM sequence: TTG
aggccacaattccctttata

SEQ ID NO: 62370 - DNA, 20 bp, Artificial Sequence
  Description of Artificial Sequence: Synthetic oligonucleotide
  Target: SCN10A; (+) strand; PAM type: YTN; PAM sequence: TTC
cctttatagaatggactctt

SEQ ID NO: 62371 - DNA, 20 bp, Artificial Sequence
  Description of Artificial Sequence: Synthetic oligonucleotide
  Target: SCN10A; (+) strand; PAM type: YTN; PAM sequence: CTT
tatagaatggactcttgatt

SEQ ID NO: 62372 - DNA, 20 bp, Artificial Sequence
  Description of Artificial Sequence: Synthetic oligonucleotide
  Target: SCN10A; (+) strand; PAM type: YTN; PAM sequence: TTT
atagaatggactcttgattc

SEQ ID NO: 62373 - DNA, 20 bp, Artificial Sequence
  Description of Artificial Sequence: Synthetic oligonucleotide
  Target: SCN10A; (+) strand; PAM type: YTN; PAM sequence: TTA
tagaatggactcttgattca

SEQ ID NO: 62374 - DNA, 20 bp, Artificial Sequence
  Description of Artificial Sequence: Synthetic oligonucleotide
  Target: SCN10A; (+) strand; PAM type: YTN; PAM sequence: CTC
ttgattcattcattgcacaa

SEQ ID NO: 62375 - DNA, 20 bp, Artificial Sequence
  Description of Artificial Sequence: Synthetic oligonucleotide
  Target: SCN10A; (+) strand; PAM type: YTN; PAM sequence: CTT
gattcattcattgcacaaat

SEQ ID NO: 62376 - DNA, 20 bp, Artificial Sequence
  Description of Artificial Sequence: Synthetic oligonucleotide
  Target: SCN10A; (+) strand; PAM type: YTN; PAM sequence: TTG
attcattcattgcacaaata

SEQ ID NO: 62377 - DNA, 20 bp, Artificial Sequence
  Description of Artificial Sequence: Synthetic oligonucleotide
  Target: SCN10A; (+) strand; PAM type: YTN; PAM sequence: TTC
attcattgcacaaatattta

SEQ ID NO: 62378 - DNA, 20 bp, Artificial Sequence
  Description of Artificial Sequence: Synthetic oligonucleotide
  Target: SCN10A; (+) strand; PAM type: YTN; PAM sequence: TTC
attgcacaaatatttattga

SEQ ID NO: 62379 - DNA, 20 bp, Artificial Sequence
  Description of Artificial Sequence: Synthetic oligonucleotide
  Target: SCN10A; (+) strand; PAM type: YTN; PAM sequence: TTG
cacaaatatttattgagaat

SEQ ID NO: 62380 - DNA, 20 bp, Artificial Sequence
  Description of Artificial Sequence: Synthetic oligonucleotide
  Target: SCN10A; (+) strand; PAM type: YTN; PAM sequence: TTT
attgagaatgtaatgtgcct

SEQ ID NO: 62381 - DNA, 20 bp, Artificial Sequence
  Description of Artificial Sequence: Synthetic oligonucleotide
  Target: SCN10A; (+) strand; PAM type: YTN; PAM sequence: TTA
ttgagaatgtaatgtgcctc

SEQ ID NO: 62382 - DNA, 20 bp, Artificial Sequence
  Description of Artificial Sequence: Synthetic oligonucleotide
  Target: SCN10A; (+) strand; PAM type: YTN; PAM sequence: TTG
agaatgtaatgtgcctcact

SEQ ID NO: 62383 - DNA, 20 bp, Artificial Sequence
  Description of Artificial Sequence: Synthetic oligonucleotide
  Target: SCN10A; (+) strand; PAM type: YTN; PAM sequence: CTC
actgttctaaacactgagag

SEQ ID NO: 62384 - DNA, 20 bp, Artificial Sequence
  Description of Artificial Sequence: Synthetic oligonucleotide
  Target: SCN10A; (+) strand; PAM type: YTN; PAM sequence: CTG
ttctaaacactgagaggaaa

SEQ ID NO: 62385 - DNA, 20 bp, Artificial Sequence
  Description of Artificial Sequence: Synthetic oligonucleotide
  Target: SCN10A; (+) strand; PAM type: YTN; PAM sequence: TTC
taaacactgagaggaaagat

SEQ ID NO: 62386 - DNA, 20 bp, Artificial Sequence
  Description of Artificial Sequence: Synthetic oligonucleotide
  Target: SCN10A; (+) strand; PAM type: YTN; PAM sequence: CTA
aacactgagaggaaagatga

SEQ ID NO: 62387 - DNA, 20 bp, Artificial Sequence
  Description of Artificial Sequence: Synthetic oligonucleotide
  Target: SCN10A; (+) strand; PAM type: YTN; PAM sequence: CTG
agaggaaagatgactaagac

SEQ ID NO: 62388 - DNA, 20 bp, Artificial Sequence
  Description of Artificial Sequence: Synthetic oligonucleotide
  Target: SCN10A; (+) strand; PAM type: YTN; PAM sequence: CTA
agacacaggttctgcttttg

SEQ ID NO: 62389 - DNA, 20 bp, Artificial Sequence
  Description of Artificial Sequence: Synthetic oligonucleotide
  Target: SCN10A; (+) strand; PAM type: YTN; PAM sequence: TTC
tgcttttgagagctaaacaa

SEQ ID NO: 62390 - DNA, 20 bp, Artificial Sequence
  Description of Artificial Sequence: Synthetic oligonucleotide
  Target: SCN10A; (+) strand; PAM type: YTN; PAM sequence: CTG
cttttgagagctaaacaaaa

SEQ ID NO: 62391 - DNA, 20 bp, Artificial Sequence
  Description of Artificial Sequence: Synthetic oligonucleotide
  Target: SCN10A; (+) strand; PAM type: YTN; PAM sequence: CTT
ttgagagctaaacaaaagat

SEQ ID NO: 62392 - DNA, 20 bp, Artificial Sequence
  Description of Artificial Sequence: Synthetic oligonucleotide
  Target: SCN10A; (+) strand; PAM type: YTN; PAM sequence: TTT
tgagagctaaacaaaagatt

SEQ ID NO: 62393 - DNA, 20 bp, Artificial Sequence
  Description of Artificial Sequence: Synthetic oligonucleotide
  Target: SCN10A; (+) strand; PAM type: YTN; PAM sequence: TTT
gagagctaaacaaaagattg

SEQ ID NO: 62394 - DNA, 20 bp, Artificial Sequence
  Description of Artificial Sequence: Synthetic oligonucleotide
  Target: SCN10A; (+) strand; PAM type: YTN; PAM sequence: TTG
agagctaaacaaaagattga

SEQ ID NO: 62395 - DNA, 20 bp, Artificial Sequence
  Description of Artificial Sequence: Synthetic oligonucleotide
  Target: SCN10A; (+) strand; PAM type: YTN; PAM sequence: CTA
aacaaaagattgagggaagc

SEQ ID NO: 62396 - DNA, 20 bp, Artificial Sequence
  Description of Artificial Sequence: Synthetic oligonucleotide
  Target: SCN10A; (+) strand; PAM type: YTN; PAM sequence: TTG
agggaagcagatacatcatg

SEQ ID NO: 62397 - DNA, 20 bp, Artificial Sequence
  Description of Artificial Sequence: Synthetic oligonucleotide
  Target: SCN10A; (+) strand; PAM type: YTN; PAM sequence: CTT
cctctgggtccttcatggtc

SEQ ID NO: 62398 - DNA, 20 bp, Artificial Sequence
  Description of Artificial Sequence: Synthetic oligonucleotide
  Target: SCN10A; (+) strand; PAM type: YTN; PAM sequence: TTC
ctctgggtccttcatggtcc

SEQ ID NO: 62399 - DNA, 20 bp, Artificial Sequence
  Description of Artificial Sequence: Synthetic oligonucleotide
  Target: SCN10A; (+) strand; PAM type: YTN; PAM sequence: CTC
tgggtccttcatggtccaaa

SEQ ID NO: 62400 - DNA, 20 bp, Artificial Sequence
  Description of Artificial Sequence: Synthetic oligonucleotide
  Target: SCN10A; (+) strand; PAM type: YTN; PAM sequence: CTG
ggtccttcatggtccaaatc

SEQ ID NO: 62401 - DNA, 20 bp, Artificial Sequence
  Description of Artificial Sequence: Synthetic oligonucleotide
  Target: SCN10A; (+) strand; PAM type: YTN; PAM sequence: CTT
catggtccaaatcaagagtt

SEQ ID NO: 62402 - DNA, 20 bp, Artificial Sequence
  Description of Artificial Sequence: Synthetic oligonucleotide
  Target: SCN10A; (+) strand; PAM type: YTN; PAM sequence: TTC
atggtccaaatcaagagttt

SEQ ID NO: 62403 - DNA, 20 bp, Artificial Sequence
  Description of Artificial Sequence: Synthetic oligonucleotide
  Target: SCN10A; (+) strand; PAM type: YTN; PAM sequence: TTT
tcagtggtgtttatggtggt

SEQ ID NO: 62404 - DNA, 20 bp, Artificial Sequence
  Description of Artificial Sequence: Synthetic oligonucleotide
  Target: SCN10A; (+) strand; PAM type: YTN; PAM sequence: TTT
cagtggtgtttatggtggtg

SEQ ID NO: 62405 - DNA, 20 bp, Artificial Sequence
  Description of Artificial Sequence: Synthetic oligonucleotide
  Target: SCN10A; (+) strand; PAM type: YTN; PAM sequence: TTC
agtggtgtttatggtggtga

SEQ ID NO: 62406 - DNA, 20 bp, Artificial Sequence
  Description of Artificial Sequence: Synthetic oligonucleotide
  Target: SCN10A; (+) strand; PAM type: YTN; PAM sequence: TTT
atggtggtgactacgtttcc

SEQ ID NO: 62407 - DNA, 20 bp, Artificial Sequence
  Description of Artificial Sequence: Synthetic oligonucleotide
  Target: SCN10A; (+) strand; PAM type: YTN; PAM sequence: TTA
tggtggtgactacgtttccc

SEQ ID NO: 62408 - DNA, 20 bp, Artificial Sequence
  Description of Artificial Sequence: Synthetic oligonucleotide
  Target: SCN10A; (+) strand; PAM type: YTN; PAM sequence: CTA
cgtttccccctttcaactca

SEQ ID NO: 62409 - DNA, 20 bp, Artificial Sequence
  Description of Artificial Sequence: Synthetic oligonucleotide
  Target: SCN10A; (+) strand; PAM type: YTN; PAM sequence: TTT
ccccctttcaactcaagagg

SEQ ID NO: 62410 - DNA, 20 bp, Artificial Sequence
  Description of Artificial Sequence: Synthetic oligonucleotide
  Target: SCN10A; (+) strand; PAM type: YTN; PAM sequence: TTC
cccctttcaactcaagaggg

SEQ ID NO: 62411 - DNA, 20 bp, Artificial Sequence
  Description of Artificial Sequence: Synthetic oligonucleotide
  Target: SCN10A; (+) strand; PAM type: YTN; PAM sequence: CTT
tcaactcaagagggctggtt

SEQ ID NO: 62412 - DNA, 20 bp, Artificial Sequence
  Description of Artificial Sequence: Synthetic oligonucleotide
  Target: SCN10A; (+) strand; PAM type: YTN; PAM sequence: TTT
caactcaagagggctggttt

SEQ ID NO: 62413 - DNA, 20 bp, Artificial Sequence
  Description of Artificial Sequence: Synthetic oligonucleotide
  Target: SCN10A; (+) strand; PAM type: YTN; PAM sequence: TTC
aactcaagagggctggttta

SEQ ID NO: 62414 - DNA, 20 bp, Artificial Sequence
  Description of Artificial Sequence: Synthetic oligonucleotide
  Target: SCN10A; (+) strand; PAM type: YTN; PAM sequence: CTC
aagagggctggtttagaact

SEQ ID NO: 62415 - DNA, 20 bp, Artificial Sequence
  Description of Artificial Sequence: Synthetic oligonucleotide
  Target: SCN10A; (+) strand; PAM type: YTN; PAM sequence: CTG
gtttagaactcacggagggg

SEQ ID NO: 62416 - DNA, 20 bp, Artificial Sequence
  Description of Artificial Sequence: Synthetic oligonucleotide
  Target: SCN10A; (+) strand; PAM type: YTN; PAM sequence: TTT
agaactcacggaggggtttt

SEQ ID NO: 62417 - DNA, 20 bp, Artificial Sequence
  Description of Artificial Sequence: Synthetic oligonucleotide
  Target: SCN10A; (+) strand; PAM type: YTN; PAM sequence: TTA
gaactcacggaggggttttt

SEQ ID NO: 62418 - DNA, 20 bp, Artificial Sequence
  Description of Artificial Sequence: Synthetic oligonucleotide
  Target: SCN10A; (+) strand; PAM type: YTN; PAM sequence: CTC
acggaggggtttttgagggt

SEQ ID NO: 62419 - DNA, 20 bp, Artificial Sequence
  Description of Artificial Sequence: Synthetic oligonucleotide
  Target: SCN10A; (+) strand; PAM type: YTN; PAM sequence: TTT
ttgagggtaaagaggaaggc

SEQ ID NO: 62420 - DNA, 20 bp, Artificial Sequence
  Description of Artificial Sequence: Synthetic oligonucleotide
  Target: SCN10A; (+) strand; PAM type: YTN; PAM sequence: TTT
tgagggtaaagaggaaggcc

SEQ ID NO: 62421 - DNA, 20 bp, Artificial Sequence
  Description of Artificial Sequence: Synthetic oligonucleotide
  Target: SCN10A; (+) strand; PAM type: YTN; PAM sequence: TTT
gagggtaaagaggaaggccc

SEQ ID NO: 62422 - DNA, 20 bp, Artificial Sequence
  Description of Artificial Sequence: Synthetic oligonucleotide
  Target: SCN10A; (+) strand; PAM type: YTN; PAM sequence: TTG
agggtaaagaggaaggccca

SEQ ID NO: 62423 - DNA, 20 bp, Artificial Sequence
  Description of Artificial Sequence: Synthetic oligonucleotide
  Target: SCN10A; (+) strand; PAM type: YTN; PAM sequence: CTC
tccgtagtgtctgatagggc

SEQ ID NO: 62424 - DNA, 20 bp, Artificial Sequence
  Description of Artificial Sequence: Synthetic oligonucleotide
  Target: SCN10A; (+) strand; PAM type: YTN; PAM sequence: CTC
cgtagtgtctgatagggcat

SEQ ID NO: 62425 - DNA, 20 bp, Artificial Sequence
  Description of Artificial Sequence: Synthetic oligonucleotide
  Target: SCN10A; (+) strand; PAM type: YTN; PAM sequence: CTG
atagggcatgagatgcagat

SEQ ID NO: 62426 - DNA, 20 bp, Artificial Sequence
  Description of Artificial Sequence: Synthetic oligonucleotide
  Target: SCN10A; (+) strand; PAM type: YTN; PAM sequence: CTG
ctgccacctggggcatgtgt

SEQ ID NO: 62427 - DNA, 20 bp, Artificial Sequence
  Description of Artificial Sequence: Synthetic oligonucleotide
  Target: SCN10A; (+) strand; PAM type: YTN; PAM sequence: CTG
ccacctggggcatgtgtgtc

SEQ ID NO: 62428 - DNA, 20 bp, Artificial Sequence
  Description of Artificial Sequence: Synthetic oligonucleotide
  Target: SCN10A; (+) strand; PAM type: YTN; PAM sequence: CTG
gggcatgtgtgtctgatgcg

SEQ ID NO: 62429 - DNA, 20 bp, Artificial Sequence
  Description of Artificial Sequence: Synthetic oligonucleotide
  Target: SCN10A; (+) strand; PAM type: YTN; PAM sequence: CTG
atgcgggcgccctcaagcct

SEQ ID NO: 62430 - DNA, 20 bp, Artificial Sequence
  Description of Artificial Sequence: Synthetic oligonucleotide
  Target: SCN10A; (+) strand; PAM type: YTN; PAM sequence: CTC
aagcctgggagtgaggcagc

SEQ ID NO: 62431 - DNA, 20 bp, Artificial Sequence
  Description of Artificial Sequence: Synthetic oligonucleotide
  Target: SCN10A; (+) strand; PAM type: YTN; PAM sequence: CTG
ggagtgaggcagcaagtggg

SEQ ID NO: 62432 - DNA, 20 bp, Artificial Sequence
  Description of Artificial Sequence: Synthetic oligonucleotide
  Target: SCN10A; (+) strand; PAM type: YTN; PAM sequence: CTT
gtttgtcttctgtggatccc

SEQ ID NO: 62433 - DNA, 20 bp, Artificial Sequence
  Description of Artificial Sequence: Synthetic oligonucleotide
  Target: SCN10A; (+) strand; PAM type: YTN; PAM sequence: TTG
tttgtcttctgtggatccca

SEQ ID NO: 62434 - DNA, 20 bp, Artificial Sequence
  Description of Artificial Sequence: Synthetic oligonucleotide
  Target: SCN10A; (+) strand; PAM type: YTN; PAM sequence: TTT
gtcttctgtggatcccaggt

SEQ ID NO: 62435 - DNA, 20 bp, Artificial Sequence
  Description of Artificial Sequence: Synthetic oligonucleotide
  Target: SCN10A; (+) strand; PAM type: YTN; PAM sequence: TTG
tcttctgtggatcccaggtg

SEQ ID NO: 62436 - DNA, 20 bp, Artificial Sequence
  Description of Artificial Sequence: Synthetic oligonucleotide
  Target: SCN10A; (+) strand; PAM type: YTN; PAM sequence: CTT
ctgtggatcccaggtgagtg

SEQ ID NO: 62437 - DNA, 20 bp, Artificial Sequence
  Description of Artificial Sequence: Synthetic oligonucleotide
  Target: SCN10A; (+) strand; PAM type: YTN; PAM sequence: TTC
tgtggatcccaggtgagtgt

SEQ ID NO: 62438 - DNA, 20 bp, Artificial Sequence
  Description of Artificial Sequence: Synthetic oligonucleotide
  Target: SCN10A; (+) strand; PAM type: YTN; PAM sequence: CTG
tggatcccaggtgagtgttc

SEQ ID NO: 62439 - DNA, 20 bp, Artificial Sequence
  Description of Artificial Sequence: Synthetic oligonucleotide
  Target: SCN10A; (+) strand; PAM type: YTN; PAM sequence: TTC
gctcaactggattctggccc

SEQ ID NO: 62440 - DNA, 20 bp, Artificial Sequence
  Description of Artificial Sequence: Synthetic oligonucleotide
  Target: SCN10A; (+) strand; PAM type: YTN; PAM sequence: CTC
aactggattctggccctaat

SEQ ID NO: 62441 - DNA, 20 bp, Artificial Sequence
  Description of Artificial Sequence: Synthetic oligonucleotide
  Target: SCN10A; (+) strand; PAM type: YTN; PAM sequence: CTG
gattctggccctaattaaca

SEQ ID NO: 62442 - DNA, 20 bp, Artificial Sequence
  Description of Artificial Sequence: Synthetic oligonucleotide
  Target: SCN10A; (+) strand; PAM type: YTN; PAM sequence: TTC
tggccctaattaacatcagt

SEQ ID NO: 62443 - DNA, 20 bp, Artificial Sequence
  Description of Artificial Sequence: Synthetic oligonucleotide
  Target: SCN10A; (+) strand; PAM type: YTN; PAM sequence: CTG
gccctaattaacatcagtgt

SEQ ID NO: 62444 - DNA, 20 bp, Artificial Sequence
  Description of Artificial Sequence: Synthetic oligonucleotide
  Target: SCN10A; (+) strand; PAM type: YTN; PAM sequence: CTA
attaacatcagtgtgagggg

SEQ ID NO: 62445 - DNA, 20 bp, Artificial Sequence
  Description of Artificial Sequence: Synthetic oligonucleotide
  Target: SCN10A; (+) strand; PAM type: YTN; PAM sequence: TTA
acatcagtgtgagggggcct

SEQ ID NO: 62446 - DNA, 20 bp, Artificial Sequence
  Description of Artificial Sequence: Synthetic oligonucleotide
  Target: SCN10A; (+) strand; PAM type: YTN; PAM sequence: CTG
tggctgtcccttcaccttct

SEQ ID NO: 62447 - DNA, 20 bp, Artificial Sequence
  Description of Artificial Sequence: Synthetic oligonucleotide
  Target: SCN10A; (+) strand; PAM type: YTN; PAM sequence: CTG
tcccttcaccttctgtgaag

SEQ ID NO: 62448 - DNA, 20 bp, Artificial Sequence
  Description of Artificial Sequence: Synthetic oligonucleotide
  Target: SCN10A; (+) strand; PAM type: YTN; PAM sequence: CTT
caccttctgtgaagcagtca

SEQ ID NO: 62449 - DNA, 20 bp, Artificial Sequence
  Description of Artificial Sequence: Synthetic oligonucleotide
  Target: SCN10A; (+) strand; PAM type: YTN; PAM sequence: TTC
accttctgtgaagcagtcat

SEQ ID NO: 62450 - DNA, 20 bp, Artificial Sequence
  Description of Artificial Sequence: Synthetic oligonucleotide
  Target: SCN10A; (+) strand; PAM type: YTN; PAM sequence: CTT
ctgtgaagcagtcatctggt

SEQ ID NO: 62451 - DNA, 20 bp, Artificial Sequence
  Description of Artificial Sequence: Synthetic oligonucleotide
  Target: SCN10A; (+) strand; PAM type: YTN; PAM sequence: TTC
tgtgaagcagtcatctggtt

SEQ ID NO: 62452 - DNA, 20 bp, Artificial Sequence
  Description of Artificial Sequence: Synthetic oligonucleotide
  Target: SCN10A; (+) strand; PAM type: YTN; PAM sequence: CTG
tgaagcagtcatctggttct

SEQ ID NO: 62453 - DNA, 20 bp, Artificial Sequence
  Description of Artificial Sequence: Synthetic oligonucleotide
  Target: SCN10A; (+) strand; PAM type: YTN; PAM sequence: CTG
gttcttccaggtcatctgcc

SEQ ID NO: 62454 - DNA, 20 bp, Artificial Sequence
  Description of Artificial Sequence: Synthetic oligonucleotide
  Target: SCN10A; (+) strand; PAM type: YTN; PAM sequence: TTC
ttccaggtcatctgccagct

SEQ ID NO: 62455 - DNA, 20 bp, Artificial Sequence
  Description of Artificial Sequence: Synthetic oligonucleotide
  Target: SCN10A; (+) strand; PAM type: YTN; PAM sequence: CTT
ccaggtcatctgccagctca

SEQ ID NO: 62456 - DNA, 20 bp, Artificial Sequence
  Description of Artificial Sequence: Synthetic oligonucleotide
  Target: SCN10A; (+) strand; PAM type: YTN; PAM sequence: TTC
caggtcatctgccagctcag

SEQ ID NO: 62457 - DNA, 20 bp, Artificial Sequence
  Description of Artificial Sequence: Synthetic oligonucleotide
  Target: SCN10A; (+) strand; PAM type: YTN; PAM sequence: CTG
ccagctcagggatcttcctc

SEQ ID NO: 62458 - DNA, 20 bp, Artificial Sequence
  Description of Artificial Sequence: Synthetic oligonucleotide
  Target: SCN10A; (+) strand; PAM type: YTN; PAM sequence: CTC
agggatcttcctcaggattt

SEQ ID NO: 62459 - DNA, 20 bp, Artificial Sequence
  Description of Artificial Sequence: Synthetic oligonucleotide
  Target: SCN10A; (+) strand; PAM type: YTN; PAM sequence: CTT
cctcaggatttcctcaggat

SEQ ID NO: 62460 - DNA, 20 bp, Artificial Sequence
  Description of Artificial Sequence: Synthetic oligonucleotide
  Target: SCN10A; (+) strand; PAM type: YTN; PAM sequence: TTC
ctcaggatttcctcaggatc

SEQ ID NO: 62461 - DNA, 20 bp, Artificial Sequence
  Description of Artificial Sequence: Synthetic oligonucleotide
  Target: SCN10A; (+) strand; PAM type: YTN; PAM sequence: CTC
aggatttcctcaggatctag

SEQ ID NO: 62462 - DNA, 20 bp, Artificial Sequence
  Description of Artificial Sequence: Synthetic oligonucleotide
  Target: SCN10A; (+) strand; PAM type: YTN; PAM sequence: TTT
cctcaggatctaggcagtcc

SEQ ID NO: 62463 - DNA, 20 bp, Artificial Sequence
  Description of Artificial Sequence: Synthetic oligonucleotide
  Target: SCN10A; (+) strand; PAM type: YTN; PAM sequence: TTC
ctcaggatctaggcagtcca

SEQ ID NO: 62464 - DNA, 20 bp, Artificial Sequence
  Description of Artificial Sequence: Synthetic oligonucleotide
  Target: SCN10A; (+) strand; PAM type: YTN; PAM sequence: CTC
aggatctaggcagtccaccg

SEQ ID NO: 62465 - DNA, 20 bp, Artificial Sequence
  Description of Artificial Sequence: Synthetic oligonucleotide
  Target: SCN10A; (+) strand; PAM type: YTN; PAM sequence: CTA
ggcagtccaccgtgctgccc

SEQ ID NO: 62466 - DNA, 20 bp, Artificial Sequence
  Description of Artificial Sequence: Synthetic oligonucleotide
  Target: SCN10A; (+) strand; PAM type: YTN; PAM sequence: CTG
ccctcagaggagcttgtgtc

SEQ ID NO: 62467 - DNA, 20 bp, Artificial Sequence
  Description of Artificial Sequence: Synthetic oligonucleotide
  Target: SCN10A; (+) strand; PAM type: YTN; PAM sequence: CTC
agaggagcttgtgtcgtcca

SEQ ID NO: 62468 - DNA, 20 bp, Artificial Sequence
  Description of Artificial Sequence: Synthetic oligonucleotide
  Target: SCN10A; (+) strand; PAM type: YTN; PAM sequence: CTT
gtgtcgtccactccctgcag

SEQ ID NO: 62469 - DNA, 20 bp, Artificial Sequence
  Description of Artificial Sequence: Synthetic oligonucleotide
  Target: SCN10A; (+) strand; PAM type: YTN; PAM sequence: TTG
tgtcgtccactccctgcagg

SEQ ID NO: 62470 - DNA, 20 bp, Artificial Sequence
  Description of Artificial Sequence: Synthetic oligonucleotide
  Target: SCN10A; (+) strand; PAM type: YTN; PAM sequence: CTC
cctgcaggggagaagcccag

SEQ ID NO: 62471 - DNA, 20 bp, Artificial Sequence
  Description of Artificial Sequence: Synthetic oligonucleotide
  Target: SCN10A; (+) strand; PAM type: YTN; PAM sequence: CTG
caggggagaagcccagggca

SEQ ID NO: 62472 - DNA, 20 bp, Artificial Sequence
  Description of Artificial Sequence: Synthetic oligonucleotide
  Target: SCN10A; (+) strand; PAM type: YTN; PAM sequence: CTC
gtctctccgcggggcccggg

SEQ ID NO: 62473 - DNA, 20 bp, Artificial Sequence
  Description of Artificial Sequence: Synthetic oligonucleotide
  Target: SCN10A; (+) strand; PAM type: YTN; PAM sequence: CTC
tccgcggggcccggggaatt

SEQ ID NO: 62474 - DNA, 20 bp, Artificial Sequence
  Description of Artificial Sequence: Synthetic oligonucleotide
  Target: SCN10A; (+) strand; PAM type: YTN; PAM sequence: CTC
cgcggggcccggggaattgc

SEQ ID NO: 62475 - DNA, 20 bp, Artificial Sequence
  Description of Artificial Sequence: Synthetic oligonucleotide
  Target: SCN10A; (+) strand; PAM type: YTN; PAM sequence: TTG
cacacggtcactgcaggttc

SEQ ID NO: 62476 - DNA, 20 bp, Artificial Sequence
  Description of Artificial Sequence: Synthetic oligonucleotide
  Target: SCN10A; (+) strand; PAM type: YTN; PAM sequence: CTG
caggttcaactgcacccatg

SEQ ID NO: 62477 - DNA, 20 bp, Artificial Sequence
  Description of Artificial Sequence: Synthetic oligonucleotide
  Target: SCN10A; (+) strand; PAM type: YTN; PAM sequence: TTC
aactgcacccatgtttggtg

SEQ ID NO: 62478 - DNA, 20 bp, Artificial Sequence
  Description of Artificial Sequence: Synthetic oligonucleotide
  Target: SCN10A; (+) strand; PAM type: YTN; PAM sequence: CTG
cacccatgtttggtgcctcg

SEQ ID NO: 62479 - DNA, 20 bp, Artificial Sequence
  Description of Artificial Sequence: Synthetic oligonucleotide
  Target: SCN10A; (+) strand; PAM type: YTN; PAM sequence: TTT
ggtgcctcgccagctgaggc

SEQ ID NO: 62480 - DNA, 20 bp, Artificial Sequence
  Description of Artificial Sequence: Synthetic oligonucleotide
  Target: SCN10A; (+) strand; PAM type: YTN; PAM sequence: TTG
gtgcctcgccagctgaggcc

SEQ ID NO: 62481 - DNA, 20 bp, Artificial Sequence
  Description of Artificial Sequence: Synthetic oligonucleotide
  Target: SCN10A; (+) strand; PAM type: YTN; PAM sequence: CTC
gccagctgaggcctggaaca

SEQ ID NO: 62482 - DNA, 20 bp, Artificial Sequence
  Description of Artificial Sequence: Synthetic oligonucleotide
  Target: SCN10A; (+) strand; PAM type: YTN; PAM sequence: CTG
aggcctggaacactgctctt

SEQ ID NO: 62483 - DNA, 20 bp, Artificial Sequence
  Description of Artificial Sequence: Synthetic oligonucleotide
  Target: SCN10A; (+) strand; PAM type: YTN; PAM sequence: CTG
gaacactgctcttctccctg

SEQ ID NO: 62484 - DNA, 20 bp, Artificial Sequence
  Description of Artificial Sequence: Synthetic oligonucleotide
  Target: SCN10A; (+) strand; PAM type: YTN; PAM sequence: CTG
ctcttctccctggagcccca

SEQ ID NO: 62485 - DNA, 20 bp, Artificial Sequence
  Description of Artificial Sequence: Synthetic oligonucleotide
  Target: SCN10A; (+) strand; PAM type: YTN; PAM sequence: CTC
ttctccctggagccccagag

SEQ ID NO: 62486 - DNA, 20 bp, Artificial Sequence
  Description of Artificial Sequence: Synthetic oligonucleotide
  Target: SCN10A; (+) strand; PAM type: YTN; PAM sequence: CTT
ctccctggagccccagaggc

SEQ ID NO: 62487 - DNA, 20 bp, Artificial Sequence
  Description of Artificial Sequence: Synthetic oligonucleotide
  Target: SCN10A; (+) strand; PAM type: YTN; PAM sequence: TTC
tccctggagccccagaggct

SEQ ID NO: 62488 - DNA, 20 bp, Artificial Sequence
  Description of Artificial Sequence: Synthetic oligonucleotide
  Target: SCN10A; (+) strand; PAM type: YTN; PAM sequence: CTC
cctggagccccagaggctta

SEQ ID NO: 62489 - DNA, 20 bp, Artificial Sequence
  Description of Artificial Sequence: Synthetic oligonucleotide
  Target: SCN10A; (+) strand; PAM type: YTN; PAM sequence: CTG
gagccccagaggcttagctg

SEQ ID NO: 62490 - DNA, 20 bp, Artificial Sequence
  Description of Artificial Sequence: Synthetic oligonucleotide
  Target: SCN10A; (+) strand; PAM type: YTN; PAM sequence: CTT
agctgtgtgagactgtaaac

SEQ ID NO: 62491 - DNA, 20 bp, Artificial Sequence
  Description of Artificial Sequence: Synthetic oligonucleotide
  Target: SCN10A; (+) strand; PAM type: YTN; PAM sequence: TTA
gctgtgtgagactgtaaacc

SEQ ID NO: 62492 - DNA, 20 bp, Artificial Sequence
  Description of Artificial Sequence: Synthetic oligonucleotide
  Target: SCN10A; (+) strand; PAM type: YTN; PAM sequence: CTG
tgtgagactgtaaaccttcg

SEQ ID NO: 62493 - DNA, 20 bp, Artificial Sequence
  Description of Artificial Sequence: Synthetic oligonucleotide
  Target: SCN10A; (+) strand; PAM type: YTN; PAM sequence: CTG
taaaccttcggggcccctga

SEQ ID NO: 62494 - DNA, 20 bp, Artificial Sequence
  Description of Artificial Sequence: Synthetic oligonucleotide
  Target: SCN10A; (+) strand; PAM type: YTN; PAM sequence: CTT
cggggcccctgatggagtgc

SEQ ID NO: 62495 - DNA, 20 bp, Artificial Sequence
  Description of Artificial Sequence: Synthetic oligonucleotide
  Target: SCN10A; (+) strand; PAM type: YTN; PAM sequence: TTC
ggggcccctgatggagtgct

SEQ ID NO: 62496 - DNA, 20 bp, Artificial Sequence
  Description of Artificial Sequence: Synthetic oligonucleotide
  Target: SCN10A; (+) strand; PAM type: YTN; PAM sequence: CTG
atggagtgctggcaatggcc

SEQ ID NO: 62497 - DNA, 20 bp, Artificial Sequence
  Description of Artificial Sequence: Synthetic oligonucleotide
  Target: SCN10A; (+) strand; PAM type: YTN; PAM sequence: CTG
gcaatggcccgagacaccgt

SEQ ID NO: 62498 - DNA, 20 bp, Artificial Sequence
  Description of Artificial Sequence: Synthetic oligonucleotide
  Target: SCN10A; (+) strand; PAM type: YTN; PAM sequence: TTA
cacccataacgactctcagc

SEQ ID NO: 62499 - DNA, 20 bp, Artificial Sequence
  Description of Artificial Sequence: Synthetic oligonucleotide
  Target: SCN10A; (+) strand; PAM type: YTN; PAM sequence: CTC
tcagcattcactgggcttga

SEQ ID NO: 62500 - DNA, 20 bp, Artificial Sequence
  Description of Artificial Sequence: Synthetic oligonucleotide
  Target: SCN10A; (+) strand; PAM type: YTN; PAM sequence: CTC
agcattcactgggcttgaat

SEQ ID NO: 62501 - DNA, 20 bp, Artificial Sequence
  Description of Artificial Sequence: Synthetic oligonucleotide
  Target: SCN10A; (+) strand; PAM type: YTN; PAM sequence: TTC
actgggcttgaatatttaat

SEQ ID NO: 62502 - DNA, 20 bp, Artificial Sequence
  Description of Artificial Sequence: Synthetic oligonucleotide
  Target: SCN10A; (+) strand; PAM type: YTN; PAM sequence: CTG
ggcttgaatatttaatcatg

SEQ ID NO: 62503 - DNA, 20 bp, Artificial Sequence
  Description of Artificial Sequence: Synthetic oligonucleotide
  Target: SCN10A; (+) strand; PAM type: YTN; PAM sequence: CTT
gaatatttaatcatggagta

SEQ ID NO: 62504 - DNA, 20 bp, Artificial Sequence
  Description of Artificial Sequence: Synthetic oligonucleotide
  Target: SCN10A; (+) strand; PAM type: YTN; PAM sequence: TTG
aatatttaatcatggagtaa

SEQ ID NO: 62505 - DNA, 20 bp, Artificial Sequence
  Description of Artificial Sequence: Synthetic oligonucleotide
  Target: SCN10A; (+) strand; PAM type: YTN; PAM sequence: TTT
aatcatggagtaatgctgca

SEQ ID NO: 62506 - DNA, 20 bp, Artificial Sequence
  Description of Artificial Sequence: Synthetic oligonucleotide
  Target: SCN10A; (+) strand; PAM type: YTN; PAM sequence: TTA
atcatggagtaatgctgcag

SEQ ID NO: 62507 - DNA, 20 bp, Artificial Sequence
  Description of Artificial Sequence: Synthetic oligonucleotide
  Target: SCN10A; (+) strand; PAM type: YTN; PAM sequence: CTG
caggggcctgctgccctcct

SEQ ID NO: 62508 - DNA, 20 bp, Artificial Sequence
  Description of Artificial Sequence: Synthetic oligonucleotide
  Target: SCN10A; (+) strand; PAM type: YTN; PAM sequence: CTG
ctgccctcctggcagctcca

SEQ ID NO: 62509 - DNA, 20 bp, Artificial Sequence
  Description of Artificial Sequence: Synthetic oligonucleotide
  Target: SCN10A; (+) strand; PAM type: YTN; PAM sequence: CTG
ccctcctggcagctccagcc

SEQ ID NO: 62510 - DNA, 20 bp, Artificial Sequence
  Description of Artificial Sequence: Synthetic oligonucleotide
  Target: SCN10A; (+) strand; PAM type: YTN; PAM sequence: CTC
ctggcagctccagccctata

SEQ ID NO: 62511 - DNA, 20 bp, Artificial Sequence
  Description of Artificial Sequence: Synthetic oligonucleotide
  Target: SCN10A; (+) strand; PAM type: YTN; PAM sequence: CTG
gcagctccagccctataatg

SEQ ID NO: 62512 - DNA, 20 bp, Artificial Sequence
  Description of Artificial Sequence: Synthetic oligonucleotide
  Target: SCN10A; (+) strand; PAM type: YTN; PAM sequence: CTC
cagccctataatgtctccag

SEQ ID NO: 62513 - DNA, 20 bp, Artificial Sequence
  Description of Artificial Sequence: Synthetic oligonucleotide
  Target: SCN10A; (+) strand; PAM type: YTN; PAM sequence: CTA
taatgtctccagatgaattc

SEQ ID NO: 62514 - DNA, 20 bp, Artificial Sequence
  Description of Artificial Sequence: Synthetic oligonucleotide
  Target: SCN10A; (+) strand; PAM type: YTN; PAM sequence: CTC
cagatgaattcaattagggg

SEQ ID NO: 62515 - DNA, 20 bp, Artificial Sequence
  Description of Artificial Sequence: Synthetic oligonucleotide
  Target: SCN10A; (+) strand; PAM type: YTN; PAM sequence: TTC
aattaggggttgaagttgct

SEQ ID NO: 62516 - DNA, 20 bp, Artificial Sequence
  Description of Artificial Sequence: Synthetic oligonucleotide
  Target: SCN10A; (+) strand; PAM type: YTN; PAM sequence: TTA
ggggttgaagttgctctcat

SEQ ID NO: 62517 - DNA, 20 bp, Artificial Sequence
  Description of Artificial Sequence: Synthetic oligonucleotide
  Target: SCN10A; (+) strand; PAM type: YTN; PAM sequence: TTG
aagttgctctcatattagta

SEQ ID NO: 62518 - DNA, 20 bp, Artificial Sequence
  Description of Artificial Sequence: Synthetic oligonucleotide
  Target: SCN10A; (+) strand; PAM type: YTN; PAM sequence: TTG
ctctcatattagtaaacctg

SEQ ID NO: 62519 - DNA, 20 bp, Artificial Sequence
  Description of Artificial Sequence: Synthetic oligonucleotide
  Target: SCN10A; (+) strand; PAM type: YTN; PAM sequence: CTC
tcatattagtaaacctgata

SEQ ID NO: 62520 - DNA, 20 bp, Artificial Sequence
  Description of Artificial Sequence: Synthetic oligonucleotide
  Target: SCN10A; (+) strand; PAM type: YTN; PAM sequence: CTC
atattagtaaacctgatagc

SEQ ID NO: 62521 - DNA, 20 bp, Artificial Sequence
  Description of Artificial Sequence: Synthetic oligonucleotide
  Target: SCN10A; (+) strand; PAM type: YTN; PAM sequence: TTA
gtaaacctgatagctttgct

SEQ ID NO: 62522 - DNA, 20 bp, Artificial Sequence
  Description of Artificial Sequence: Synthetic oligonucleotide
  Target: SCN10A; (+) strand; PAM type: YTN; PAM sequence: CTG
atagctttgctaatggaccc

SEQ ID NO: 62523 - DNA, 20 bp, Artificial Sequence
  Description of Artificial Sequence: Synthetic oligonucleotide
  Target: SCN10A; (+) strand; PAM type: YTN; PAM sequence: CTT
tgctaatggacccaaatggt

SEQ ID NO: 62524 - DNA, 20 bp, Artificial Sequence
  Description of Artificial Sequence: Synthetic oligonucleotide
  Target: SCN10A; (+) strand; PAM type: YTN; PAM sequence: TTT
gctaatggacccaaatggtg

SEQ ID NO: 62525 - DNA, 20 bp, Artificial Sequence
  Description of Artificial Sequence: Synthetic oligonucleotide
  Target: SCN10A; (+) strand; PAM type: YTN; PAM sequence: TTG
ctaatggacccaaatggtgg

SEQ ID NO: 62526 - DNA, 20 bp, Artificial Sequence
  Description of Artificial Sequence: Synthetic oligonucleotide
  Target: SCN10A; (+) strand; PAM type: YTN; PAM sequence: CTA
atggacccaaatggtggggc

SEQ ID NO: 62527 - DNA, 20 bp, Artificial Sequence
  Description of Artificial Sequence: Synthetic oligonucleotide
  Target: SCN10A; (+) strand; PAM type: YTN; PAM sequence: TTT
gtcgctgtcaggcccctcct

SEQ ID NO: 62528 - DNA, 20 bp, Artificial Sequence
  Description of Artificial Sequence: Synthetic oligonucleotide
  Target: SCN10A; (+) strand; PAM type: YTN; PAM sequence: TTG
tcgctgtcaggcccctcctg

SEQ ID NO: 62529 - DNA, 20 bp, Artificial Sequence
  Description of Artificial Sequence: Synthetic oligonucleotide
  Target: SCN10A; (+) strand; PAM type: YTN; PAM sequence: CTG
tcaggcccctcctgcctagc

SEQ ID NO: 62530 - DNA, 20 bp, Artificial Sequence
  Description of Artificial Sequence: Synthetic oligonucleotide
  Target: SCN10A; (+) strand; PAM type: YTN; PAM sequence: CTC
ctgcctagccggggtcatgg

SEQ ID NO: 62531 - DNA, 20 bp, Artificial Sequence
  Description of Artificial Sequence: Synthetic oligonucleotide
  Target: SCN10A; (+) strand; PAM type: YTN; PAM sequence: CTG
cctagccggggtcatggaca

SEQ ID NO: 62532 - DNA, 20 bp, Artificial Sequence
  Description of Artificial Sequence: Synthetic oligonucleotide
  Target: SCN10A; (+) strand; PAM type: YTN; PAM sequence: CTA
gccggggtcatggacaagaa

SEQ ID NO: 62533 - DNA, 20 bp, Artificial Sequence
  Description of Artificial Sequence: Synthetic oligonucleotide
  Target: SCN10A; (+) strand; PAM type: YTN; PAM sequence: TTG
tgtactgaaaacattgagta

SEQ ID NO: 62534 - DNA, 20 bp, Artificial Sequence
  Description of Artificial Sequence: Synthetic oligonucleotide
  Target: SCN10A; (+) strand; PAM type: YTN; PAM sequence: CTG
aaaacattgagtagggacaa

SEQ ID NO: 62535 - DNA, 20 bp, Artificial Sequence
  Description of Artificial Sequence: Synthetic oligonucleotide
  Target: SCN10A; (+) strand; PAM type: YTN; PAM sequence: TTG
agtagggacaactagccagg

SEQ ID NO: 62536 - DNA, 20 bp, Artificial Sequence
  Description of Artificial Sequence: Synthetic oligonucleotide
  Target: SCN10A; (+) strand; PAM type: YTN; PAM sequence: CTA
gccaggggagtccttggaac

SEQ ID NO: 62537 - DNA, 20 bp, Artificial Sequence
  Description of Artificial Sequence: Synthetic oligonucleotide
  Target: SCN10A; (+) strand; PAM type: YTN; PAM sequence: CTT
ggaacatttgggaagaagca

SEQ ID NO: 62538 - DNA, 20 bp, Artificial Sequence
  Description of Artificial Sequence: Synthetic oligonucleotide
  Target: SCN10A; (+) strand; PAM type: YTN; PAM sequence: TTG
gaacatttgggaagaagcat

SEQ ID NO: 62539 - DNA, 20 bp, Artificial Sequence
  Description of Artificial Sequence: Synthetic oligonucleotide
  Target: SCN10A; (+) strand; PAM type: YTN; PAM sequence: TTT
gggaagaagcatgacatcca

SEQ ID NO: 62540 - DNA, 20 bp, Artificial Sequence
  Description of Artificial Sequence: Synthetic oligonucleotide
  Target: SCN10A; (+) strand; PAM type: YTN; PAM sequence: TTG
ggaagaagcatgacatccac

SEQ ID NO: 62541 - DNA, 20 bp, Artificial Sequence
  Description of Artificial Sequence: Synthetic oligonucleotide
  Target: SCN10A; (+) strand; PAM type: YTN; PAM sequence: CTC
acccagtgggaaccaagcgg

SEQ ID NO: 62542 - DNA, 20 bp, Artificial Sequence
  Description of Artificial Sequence: Synthetic oligonucleotide
  Target: SCN10A; (+) strand; PAM type: YTN; PAM sequence: CTT
ctgttcacccacagccccca

SEQ ID NO: 62543 - DNA, 20 bp, Artificial Sequence
  Description of Artificial Sequence: Synthetic oligonucleotide
  Target: SCN10A; (+) strand; PAM type: YTN; PAM sequence: TTC
tgttcacccacagcccccaa

SEQ ID NO: 62544 - DNA, 20 bp, Artificial Sequence
  Description of Artificial Sequence: Synthetic oligonucleotide
  Target: SCN10A; (+) strand; PAM type: YTN; PAM sequence: CTG
ttcacccacagcccccaaat

SEQ ID NO: 62545 - DNA, 20 bp, Artificial Sequence
  Description of Artificial Sequence: Synthetic oligonucleotide
  Target: SCN10A; (+) strand; PAM type: YTN; PAM sequence: TTC
acccacagcccccaaatccc

SEQ ID NO: 62546 - DNA, 20 bp, Artificial Sequence
  Description of Artificial Sequence: Synthetic oligonucleotide
  Target: SCN10A; (+) strand; PAM type: YTN; PAM sequence: CTC
cctcttatcttaccctgctg

SEQ ID NO: 62547 - DNA, 20 bp, Artificial Sequence
  Description of Artificial Sequence: Synthetic oligonucleotide
  Target: SCN10A; (+) strand; PAM type: YTN; PAM sequence: CTC
ttatcttaccctgctgtggt

SEQ ID NO: 62548 - DNA, 20 bp, Artificial Sequence
  Description of Artificial Sequence: Synthetic oligonucleotide
  Target: SCN10A; (+) strand; PAM type: YTN; PAM sequence: CTT
atcttaccctgctgtggtca

SEQ ID NO: 62549 - DNA, 20 bp, Artificial Sequence
  Description of Artificial Sequence: Synthetic oligonucleotide
  Target: SCN10A; (+) strand; PAM type: YTN; PAM sequence: TTA
tcttaccctgctgtggtcag

SEQ ID NO: 62550 - DNA, 20 bp, Artificial Sequence
  Description of Artificial Sequence: Synthetic oligonucleotide
  Target: SCN10A; (+) strand; PAM type: YTN; PAM sequence: CTT
accctgctgtggtcagcctt

SEQ ID NO: 62551 - DNA, 20 bp, Artificial Sequence
  Description of Artificial Sequence: Synthetic oligonucleotide
  Target: SCN10A; (+) strand; PAM type: YTN; PAM sequence: TTA
ccctgctgtggtcagccttg

SEQ ID NO: 62552 - DNA, 20 bp, Artificial Sequence
  Description of Artificial Sequence: Synthetic oligonucleotide
  Target: SCN10A; (+) strand; PAM type: YTN; PAM sequence: CTG
ctgtggtcagccttgcctag

SEQ ID NO: 62553 - DNA, 20 bp, Artificial Sequence
  Description of Artificial Sequence: Synthetic oligonucleotide
  Target: SCN10A; (+) strand; PAM type: YTN; PAM sequence: CTG
tggtcagccttgcctagggc

SEQ ID NO: 62554 - DNA, 20 bp, Artificial Sequence
  Description of Artificial Sequence: Synthetic oligonucleotide
  Target: SCN10A; (+) strand; PAM type: YTN; PAM sequence: CTT
gcctagggcacacagccagt

SEQ ID NO: 62555 - DNA, 20 bp, Artificial Sequence
  Description of Artificial Sequence: Synthetic oligonucleotide
  Target: SCN10A; (+) strand; PAM type: YTN; PAM sequence: TTG
cctagggcacacagccagta

SEQ ID NO: 62556 - DNA, 20 bp, Artificial Sequence
  Description of Artificial Sequence: Synthetic oligonucleotide
  Target: SCN10A; (+) strand; PAM type: YTN; PAM sequence: CTA
gggcacacagccagtagctg

SEQ ID NO: 62557 - DNA, 20 bp, Artificial Sequence
  Description of Artificial Sequence: Synthetic oligonucleotide
  Target: SCN10A; (+) strand; PAM type: YTN; PAM sequence: CTG
acattcttcaagctgaaggg

SEQ ID NO: 62558 - DNA, 20 bp, Artificial Sequence
  Description of Artificial Sequence: Synthetic oligonucleotide
  Target: SCN10A; (+) strand; PAM type: YTN; PAM sequence: TTC
ttcaagctgaagggcttgat

SEQ ID NO: 62559 - DNA, 20 bp, Artificial Sequence
  Description of Artificial Sequence: Synthetic oligonucleotide
  Target: SCN10A; (+) strand; PAM type: YTN; PAM sequence: CTT
caagctgaagggcttgataa

SEQ ID NO: 62560 - DNA, 20 bp, Artificial Sequence
  Description of Artificial Sequence: Synthetic oligonucleotide
  Target: SCN10A; (+) strand; PAM type: YTN; PAM sequence: TTC
aagctgaagggcttgataac

SEQ ID NO: 62561 - DNA, 20 bp, Artificial Sequence
  Description of Artificial Sequence: Synthetic oligonucleotide
  Target: SCN10A; (+) strand; PAM type: YTN; PAM sequence: CTG
aagggcttgataactttggg

SEQ ID NO: 62562 - DNA, 20 bp, Artificial Sequence
  Description of Artificial Sequence: Synthetic oligonucleotide
  Target: SCN10A; (+) strand; PAM type: YTN; PAM sequence: CTT
gataactttggggatgaatt

SEQ ID NO: 62563 - DNA, 20 bp, Artificial Sequence
  Description of Artificial Sequence: Synthetic oligonucleotide
  Target: SCN10A; (+) strand; PAM type: YTN; PAM sequence: TTG
ataactttggggatgaatta

SEQ ID NO: 62564 - DNA, 20 bp, Artificial Sequence
  Description of Artificial Sequence: Synthetic oligonucleotide
  Target: SCN10A; (+) strand; PAM type: YTN; PAM sequence: CTT
tggggatgaattatgacttc

SEQ ID NO: 62565 - DNA, 20 bp, Artificial Sequence
  Description of Artificial Sequence: Synthetic oligonucleotide
  Target: SCN10A; (+) strand; PAM type: YTN; PAM sequence: TTT
ggggatgaattatgacttcc

SEQ ID NO: 62566 - DNA, 20 bp, Artificial Sequence
  Description of Artificial Sequence: Synthetic oligonucleotide
  Target: SCN10A; (+) strand; PAM type: YTN; PAM sequence: TTG
gggatgaattatgacttcct

SEQ ID NO: 62567 - DNA, 20 bp, Artificial Sequence
  Description of Artificial Sequence: Synthetic oligonucleotide
  Target: SCN10A; (+) strand; PAM type: YTN; PAM sequence: TTA
tgacttccttatctctgttg

SEQ ID NO: 62568 - DNA, 20 bp, Artificial Sequence
  Description of Artificial Sequence: Synthetic oligonucleotide
  Target: SCN10A; (+) strand; PAM type: YTN; PAM sequence: CTT
ccttatctctgttgagccca

SEQ ID NO: 62569 - DNA, 20 bp, Artificial Sequence
  Description of Artificial Sequence: Synthetic oligonucleotide
  Target: SCN10A; (+) strand; PAM type: YTN; PAM sequence: TTC
cttatctctgttgagcccag

SEQ ID NO: 62570 - DNA, 20 bp, Artificial Sequence
  Description of Artificial Sequence: Synthetic oligonucleotide
  Target: SCN10A; (+) strand; PAM type: YTN; PAM sequence: CTT
atctctgttgagcccagtgc

SEQ ID NO: 62571 - DNA, 20 bp, Artificial Sequence
  Description of Artificial Sequence: Synthetic oligonucleotide
  Target: SCN10A; (+) strand; PAM type: YTN; PAM sequence: TTA
tctctgttgagcccagtgcc

SEQ ID NO: 62572 - DNA, 20 bp, Artificial Sequence
  Description of Artificial Sequence: Synthetic oligonucleotide
  Target: SCN10A; (+) strand; PAM type: YTN; PAM sequence: CTC
tgttgagcccagtgcctgtc

SEQ ID NO: 62573 - DNA, 20 bp, Artificial Sequence
  Description of Artificial Sequence: Synthetic oligonucleotide
  Target: SCN10A; (+) strand; PAM type: YTN; PAM sequence: CTG
ttgagcccagtgcctgtcac

SEQ ID NO: 62574 - DNA, 20 bp, Artificial Sequence
  Description of Artificial Sequence: Synthetic oligonucleotide
  Target: SCN10A; (+) strand; PAM type: YTN; PAM sequence: TTG
agcccagtgcctgtcacaaa

SEQ ID NO: 62575 - DNA, 20 bp, Artificial Sequence
  Description of Artificial Sequence: Synthetic oligonucleotide
  Target: SCN10A; (+) strand; PAM type: YTN; PAM sequence: CTG
tcacaaagtcagcactcagt

SEQ ID NO: 62576 - DNA, 20 bp, Artificial Sequence
  Description of Artificial Sequence: Synthetic oligonucleotide
  Target: SCN10A; (+) strand; PAM type: YTN; PAM sequence: CTC
agtggctaggtgtcaaatta

SEQ ID NO: 62577 - DNA, 20 bp, Artificial Sequence
  Description of Artificial Sequence: Synthetic oligonucleotide
  Target: SCN10A; (+) strand; PAM type: YTN; PAM sequence: CTA
ggtgtcaaattaaattcttg

SEQ ID NO: 62578 - DNA, 20 bp, Artificial Sequence
  Description of Artificial Sequence: Synthetic oligonucleotide
  Target: SCN10A; (+) strand; PAM type: YTN; PAM sequence: TTA
aattcttgaattgaaggcag

SEQ ID NO: 62579 - DNA, 20 bp, Artificial Sequence
  Description of Artificial Sequence: Synthetic oligonucleotide
  Target: SCN10A; (+) strand; PAM type: YTN; PAM sequence: TTC
ttgaattgaaggcagtgtta

SEQ ID NO: 62580 - DNA, 20 bp, Artificial Sequence
  Description of Artificial Sequence: Synthetic oligonucleotide
  Target: SCN10A; (+) strand; PAM type: YTN; PAM sequence: CTT
gaattgaaggcagtgttatt

SEQ ID NO: 62581 - DNA, 20 bp, Artificial Sequence
  Description of Artificial Sequence: Synthetic oligonucleotide
  Target: SCN10A; (+) strand; PAM type: YTN; PAM sequence: TTG
aattgaaggcagtgttatta

SEQ ID NO: 62582 - DNA, 20 bp, Artificial Sequence
  Description of Artificial Sequence: Synthetic oligonucleotide
  Target: SCN10A; (+) strand; PAM type: YTN; PAM sequence: TTG
aaggcagtgttattaaagat

SEQ ID NO: 62583 - DNA, 20 bp, Artificial Sequence
  Description of Artificial Sequence: Synthetic oligonucleotide
  Target: SCN10A; (+) strand; PAM type: YTN; PAM sequence: TTA
ttaaagatgctaaactttta

SEQ ID NO: 62584 - DNA, 20 bp, Artificial Sequence
  Description of Artificial Sequence: Synthetic oligonucleotide
  Target: SCN10A; (+) strand; PAM type: YTN; PAM sequence: TTA
aagatgctaaacttttatag

SEQ ID NO: 62585 - DNA, 20 bp, Artificial Sequence
  Description of Artificial Sequence: Synthetic oligonucleotide
  Target: SCN10A; (+) strand; PAM type: YTN; PAM sequence: CTA
aacttttatagatgcctctt

SEQ ID NO: 62586 - DNA, 20 bp, Artificial Sequence
  Description of Artificial Sequence: Synthetic oligonucleotide
  Target: SCN10A; (+) strand; PAM type: YTN; PAM sequence: CTT
ttatagatgcctctttccct

SEQ ID NO: 62587 - DNA, 20 bp, Artificial Sequence
  Description of Artificial Sequence: Synthetic oligonucleotide
  Target: SCN10A; (+) strand; PAM type: YTN; PAM sequence: TTT
tatagatgcctctttcccta

SEQ ID NO: 62588 - DNA, 20 bp, Artificial Sequence
  Description of Artificial Sequence: Synthetic oligonucleotide
  Target: SCN10A; (+) strand; PAM type: YTN; PAM sequence: TTT
atagatgcctctttccctat

SEQ ID NO: 62589 - DNA, 20 bp, Artificial Sequence
  Description of Artificial Sequence: Synthetic oligonucleotide
  Target: SCN10A; (+) strand; PAM type: YTN; PAM sequence: TTA
tagatgcctctttccctata

SEQ ID NO: 62590 - DNA, 20 bp, Artificial Sequence
  Description of Artificial Sequence: Synthetic oligonucleotide
  Target: SCN10A; (+) strand; PAM type: YTN; PAM sequence: CTC
tttccctatagcttgtttcc

SEQ ID NO: 62591 - DNA, 20 bp, Artificial Sequence
  Description of Artificial Sequence: Synthetic oligonucleotide
  Target: SCN10A; (+) strand; PAM type: YTN; PAM sequence: CTT
tccctatagcttgtttcctt

SEQ ID NO: 62592 - DNA, 20 bp, Artificial Sequence
  Description of Artificial Sequence: Synthetic oligonucleotide
  Target: SCN10A; (+) strand; PAM type: YTN; PAM sequence: TTT
ccctatagcttgtttccttc

SEQ ID NO: 62593 - DNA, 20 bp, Artificial Sequence
  Description of Artificial Sequence: Synthetic oligonucleotide
  Target: SCN10A; (+) strand; PAM type: YTN; PAM sequence: TTC
cctatagcttgtttccttca

SEQ ID NO: 62594 - DNA, 20 bp, Artificial Sequence
  Description of Artificial Sequence: Synthetic oligonucleotide
  Target: SCN10A; (+) strand; PAM type: YTN; PAM sequence: CTA
tagcttgtttccttcaagat

SEQ ID NO: 62595 - DNA, 20 bp, Artificial Sequence
  Description of Artificial Sequence: Synthetic oligonucleotide
  Target: SCN10A; (+) strand; PAM type: YTN; PAM sequence: CTT
gtttccttcaagatttgtaa

SEQ ID NO: 62596 - DNA, 20 bp, Artificial Sequence
  Description of Artificial Sequence: Synthetic oligonucleotide
  Target: SCN10A; (+) strand; PAM type: YTN; PAM sequence: TTG
tttccttcaagatttgtaag

SEQ ID NO: 62597 - DNA, 20 bp, Artificial Sequence
  Description of Artificial Sequence: Synthetic oligonucleotide
  Target: SCN10A; (+) strand; PAM type: YTN; PAM sequence: TTT
ccttcaagatttgtaagtga

SEQ ID NO: 62598 - DNA, 20 bp, Artificial Sequence
  Description of Artificial Sequence: Synthetic oligonucleotide
  Target: SCN10A; (+) strand; PAM type: YTN; PAM sequence: TTC
cttcaagatttgtaagtgaa

SEQ ID NO: 62599 - DNA, 20 bp, Artificial Sequence
  Description of Artificial Sequence: Synthetic oligonucleotide
  Target: SCN10A; (+) strand; PAM type: YTN; PAM sequence: CTT
caagatttgtaagtgaaacc

SEQ ID NO: 62600 - DNA, 20 bp, Artificial Sequence
  Description of Artificial Sequence: Synthetic oligonucleotide
  Target: SCN10A; (+) strand; PAM type: YTN; PAM sequence: TTC
aagatttgtaagtgaaacca

SEQ ID NO: 62601 - DNA, 20 bp, Artificial Sequence
  Description of Artificial Sequence: Synthetic oligonucleotide
  Target: SCN10A; (+) strand; PAM type: YTN; PAM sequence: TTT
gtaagtgaaaccacatttat

SEQ ID NO: 62602 - DNA, 20 bp, Artificial Sequence
  Description of Artificial Sequence: Synthetic oligonucleotide
  Target: SCN10A; (+) strand; PAM type: YTN; PAM sequence: TTG
taagtgaaaccacatttatt

SEQ ID NO: 62603 - DNA, 20 bp, Artificial Sequence
  Description of Artificial Sequence: Synthetic oligonucleotide
  Target: SCN10A; (+) strand; PAM type: YTN; PAM sequence: TTT
atttttaccttgtataagac

SEQ ID NO: 62604 - DNA, 20 bp, Artificial Sequence
  Description of Artificial Sequence: Synthetic oligonucleotide
  Target: SCN10A; (+) strand; PAM type: YTN; PAM sequence: TTA
tttttaccttgtataagaca

SEQ ID NO: 62605 - DNA, 20 bp, Artificial Sequence
  Description of Artificial Sequence: Synthetic oligonucleotide
  Target: SCN10A; (+) strand; PAM type: YTN; PAM sequence: TTT
ttaccttgtataagacaatc

SEQ ID NO: 62606 - DNA, 20 bp, Artificial Sequence
  Description of Artificial Sequence: Synthetic oligonucleotide
  Target: SCN10A; (+) strand; PAM type: YTN; PAM sequence: TTT
taccttgtataagacaatcc

SEQ ID NO: 62607 - DNA, 20 bp, Artificial Sequence
  Description of Artificial Sequence: Synthetic oligonucleotide
  Target: SCN10A; (+) strand; PAM type: YTN; PAM sequence: TTT
accttgtataagacaatcct

SEQ ID NO: 62608 - DNA, 20 bp, Artificial Sequence
  Description of Artificial Sequence: Synthetic oligonucleotide
  Target: SCN10A; (+) strand; PAM type: YTN; PAM sequence: TTA
ccttgtataagacaatccta

SEQ ID NO: 62609 - DNA, 20 bp, Artificial Sequence
  Description of Artificial Sequence: Synthetic oligonucleotide
  Target: SCN10A; (+) strand; PAM type: YTN; PAM sequence: CTT
gtataagacaatcctaaacc

SEQ ID NO: 62610 - DNA, 20 bp, Artificial Sequence
  Description of Artificial Sequence: Synthetic oligonucleotide
  Target: SCN10A; (+) strand; PAM type: YTN; PAM sequence: TTG
tataagacaatcctaaacct

SEQ ID NO: 62611 - DNA, 20 bp, Artificial Sequence
  Description of Artificial Sequence: Synthetic oligonucleotide
  Target: SCN10A; (+) strand; PAM type: YTN; PAM sequence: CTA
aacctctaatcttccagctc

SEQ ID NO: 62612 - DNA, 20 bp, Artificial Sequence
  Description of Artificial Sequence: Synthetic oligonucleotide
  Target: SCN10A; (+) strand; PAM type: YTN; PAM sequence: CTC
taatcttccagctcagtctc

SEQ ID NO: 62613 - DNA, 20 bp, Artificial Sequence
  Description of Artificial Sequence: Synthetic oligonucleotide
  Target: SCN10A; (+) strand; PAM type: YTN; PAM sequence: CTA
atcttccagctcagtctctg

SEQ ID NO: 62614 - DNA, 20 bp, Artificial Sequence
  Description of Artificial Sequence: Synthetic oligonucleotide
  Target: SCN10A; (+) strand; PAM type: YTN; PAM sequence: CTT
ccagctcagtctctgtgagg

SEQ ID NO: 62615 - DNA, 20 bp, Artificial Sequence
  Description of Artificial Sequence: Synthetic oligonucleotide
  Target: SCN10A; (+) strand; PAM type: YTN; PAM sequence: TTC
cagctcagtctctgtgaggc

SEQ ID NO: 62616 - DNA, 20 bp, Artificial Sequence
  Description of Artificial Sequence: Synthetic oligonucleotide
  Target: SCN10A; (+) strand; PAM type: YTN; PAM sequence: CTC
agtctctgtgaggctgtcac

SEQ ID NO: 62617 - DNA, 20 bp, Artificial Sequence
  Description of Artificial Sequence: Synthetic oligonucleotide
  Target: SCN10A; (+) strand; PAM type: YTN; PAM sequence: CTC
tgtgaggctgtcacttcact

SEQ ID NO: 62618 - DNA, 20 bp, Artificial Sequence
  Description of Artificial Sequence: Synthetic oligonucleotide
  Target: SCN10A; (+) strand; PAM type: YTN; PAM sequence: CTG
tgaggctgtcacttcactac

SEQ ID NO: 62619 - DNA, 20 bp, Artificial Sequence
  Description of Artificial Sequence: Synthetic oligonucleotide
  Target: SCN10A; (+) strand; PAM type: YTN; PAM sequence: CTG
tcacttcactactcacctat

SEQ ID NO: 62620 - DNA, 20 bp, Artificial Sequence
  Description of Artificial Sequence: Synthetic oligonucleotide
  Target: SCN10A; (+) strand; PAM type: YTN; PAM sequence: CTT
cactactcacctatagagag

SEQ ID NO: 62621 - DNA, 20 bp, Artificial Sequence
  Description of Artificial Sequence: Synthetic oligonucleotide
  Target: SCN10A; (+) strand; PAM type: YTN; PAM sequence: TTC
actactcacctatagagagc

SEQ ID NO: 62622 - DNA, 20 bp, Artificial Sequence
  Description of Artificial Sequence: Synthetic oligonucleotide
  Target: SCN10A; (+) strand; PAM type: YTN; PAM sequence: CTA
ctcacctatagagagcctct

SEQ ID NO: 62623 - DNA, 20 bp, Artificial Sequence
  Description of Artificial Sequence: Synthetic oligonucleotide
  Target: SCN10A; (+) strand; PAM type: YTN; PAM sequence: CTC
acctatagagagcctctccc

SEQ ID NO: 62624 - DNA, 20 bp, Artificial Sequence
  Description of Artificial Sequence: Synthetic oligonucleotide
  Target: SCN10A; (+) strand; PAM type: YTN; PAM sequence: CTA
tagagagcctctccctagcc

SEQ ID NO: 62625 - DNA, 20 bp, Artificial Sequence
  Description of Artificial Sequence: Synthetic oligonucleotide
  Target: SCN10A; (+) strand; PAM type: YTN; PAM sequence: CTC
tccctagccccaggctactt

SEQ ID NO: 62626 - DNA, 20 bp, Artificial Sequence
  Description of Artificial Sequence: Synthetic oligonucleotide
  Target: SCN10A; (+) strand; PAM type: YTN; PAM sequence: CTC
cctagccccaggctactttt

SEQ ID NO: 62627 - DNA, 20 bp, Artificial Sequence
  Description of Artificial Sequence: Synthetic oligonucleotide
  Target: SCN10A; (+) strand; PAM type: YTN; PAM sequence: CTA
gccccaggctacttttgcct

SEQ ID NO: 62628 - DNA, 20 bp, Artificial Sequence
  Description of Artificial Sequence: Synthetic oligonucleotide
  Target: SCN10A; (+) strand; PAM type: YTN; PAM sequence: CTA
cttttgcctagagaaaatga

SEQ ID NO: 62629 - DNA, 20 bp, Artificial Sequence
  Description of Artificial Sequence: Synthetic oligonucleotide
  Target: SCN10A; (+) strand; PAM type: YTN; PAM sequence: CTT
ttgcctagagaaaatgatgt

SEQ ID NO: 62630 - DNA, 20 bp, Artificial Sequence
  Description of Artificial Sequence: Synthetic oligonucleotide
  Target: SCN10A; (+) strand; PAM type: YTN; PAM sequence: TTT
tgcctagagaaaatgatgtg

SEQ ID NO: 62631 - DNA, 20 bp, Artificial Sequence
  Description of Artificial Sequence: Synthetic oligonucleotide
  Target: SCN10A; (+) strand; PAM type: YTN; PAM sequence: TTT
gcctagagaaaatgatgtgg

SEQ ID NO: 62632 - DNA, 20 bp, Artificial Sequence
  Description of Artificial Sequence: Synthetic oligonucleotide
  Target: SCN10A; (+) strand; PAM type: YTN; PAM sequence: TTG
cctagagaaaatgatgtgga

SEQ ID NO: 62633 - DNA, 20 bp, Artificial Sequence
  Description of Artificial Sequence: Synthetic oligonucleotide
  Target: SCN10A; (+) strand; PAM type: YTN; PAM sequence: CTA
gagaaaatgatgtggacaaa

SEQ ID NO: 62634 - DNA, 20 bp, Artificial Sequence
  Description of Artificial Sequence: Synthetic oligonucleotide
  Target: SCN10A; (+) strand; PAM type: YTN; PAM sequence: CTT
cttcatctgtgagcacctcc

SEQ ID NO: 62635 - DNA, 20 bp, Artificial Sequence
  Description of Artificial Sequence: Synthetic oligonucleotide
  Target: SCN10A; (+) strand; PAM type: YTN; PAM sequence: TTC
ttcatctgtgagcacctcca

SEQ ID NO: 62636 - DNA, 20 bp, Artificial Sequence
  Description of Artificial Sequence: Synthetic oligonucleotide
  Target: SCN10A; (+) strand; PAM type: YTN; PAM sequence: CTT
catctgtgagcacctccaac

SEQ ID NO: 62637 - DNA, 20 bp, Artificial Sequence
  Description of Artificial Sequence: Synthetic oligonucleotide
  Target: SCN10A; (+) strand; PAM type: YTN; PAM sequence: TTC
atctgtgagcacctccaact

SEQ ID NO: 62638 - DNA, 20 bp, Artificial Sequence
  Description of Artificial Sequence: Synthetic oligonucleotide
  Target: SCN10A; (+) strand; PAM type: YTN; PAM sequence: CTG
tgagcacctccaactcttat

SEQ ID NO: 62639 - DNA, 20 bp, Artificial Sequence
  Description of Artificial Sequence: Synthetic oligonucleotide
  Target: SCN10A; (+) strand; PAM type: YTN; PAM sequence: CTC
caactcttatttgctggctc

SEQ ID NO: 62640 - DNA, 20 bp, Artificial Sequence
  Description of Artificial Sequence: Synthetic oligonucleotide
  Target: SCN10A; (+) strand; PAM type: YTN; PAM sequence: CTC
ttatttgctggctctgaaag

SEQ ID NO: 62641 - DNA, 20 bp, Artificial Sequence
  Description of Artificial Sequence: Synthetic oligonucleotide
  Target: SCN10A; (+) strand; PAM type: YTN; PAM sequence: CTT
atttgctggctctgaaagat

SEQ ID NO: 62642 - DNA, 20 bp, Artificial Sequence
  Description of Artificial Sequence: Synthetic oligonucleotide
  Target: SCN10A; (+) strand; PAM type: YTN; PAM sequence: TTA
tttgctggctctgaaagata

SEQ ID NO: 62643 - DNA, 20 bp, Artificial Sequence
  Description of Artificial Sequence: Synthetic oligonucleotide
  Target: SCN10A; (+) strand; PAM type: YTN; PAM sequence: TTT
gctggctctgaaagatattt

SEQ ID NO: 62644 - DNA, 20 bp, Artificial Sequence
  Description of Artificial Sequence: Synthetic oligonucleotide
  Target: SCN10A; (+) strand; PAM type: YTN; PAM sequence: TTG
ctggctctgaaagatatttg

SEQ ID NO: 62645 - DNA, 20 bp, Artificial Sequence
  Description of Artificial Sequence: Synthetic oligonucleotide
  Target: SCN10A; (+) strand; PAM type: YTN; PAM sequence: CTG
gctctgaaagatatttgact

SEQ ID NO: 62646 - DNA, 20 bp, Artificial Sequence
  Description of Artificial Sequence: Synthetic oligonucleotide
  Target: SCN10A; (+) strand; PAM type: YTN; PAM sequence: CTC
tgaaagatatttgactttct

SEQ ID NO: 62647 - DNA, 20 bp, Artificial Sequence
  Description of Artificial Sequence: Synthetic oligonucleotide
  Target: SCN10A; (+) strand; PAM type: YTN; PAM sequence: CTG
aaagatatttgactttcttt

SEQ ID NO: 62648 - DNA, 20 bp, Artificial Sequence
  Description of Artificial Sequence: Synthetic oligonucleotide
  Target: SCN10A; (+) strand; PAM type: YTN; PAM sequence: TTT
gactttctttgtgcgttgtc

SEQ ID NO: 62649 - DNA, 20 bp, Artificial Sequence
  Description of Artificial Sequence: Synthetic oligonucleotide
  Target: SCN10A; (+) strand; PAM type: YTN; PAM sequence: TTG
actttctttgtgcgttgtct

SEQ ID NO: 62650 - DNA, 20 bp, Artificial Sequence
  Description of Artificial Sequence: Synthetic oligonucleotide
  Target: SCN10A; (+) strand; PAM type: YTN; PAM sequence: CTT
tctttgtgcgttgtctttcg

SEQ ID NO: 62651 - DNA, 20 bp, Artificial Sequence
  Description of Artificial Sequence: Synthetic oligonucleotide
  Target: SCN10A; (+) strand; PAM type: YTN; PAM sequence: TTT
ctttgtgcgttgtctttcgt

SEQ ID NO: 62652 - DNA, 20 bp, Artificial Sequence
  Description of Artificial Sequence: Synthetic oligonucleotide
  Target: SCN10A; (+) strand; PAM type: YTN; PAM sequence: TTC
tttgtgcgttgtctttcgtt

SEQ ID NO: 62653 - DNA, 20 bp, Artificial Sequence
  Description of Artificial Sequence: Synthetic oligonucleotide
  Target: SCN10A; (+) strand; PAM type: YTN; PAM sequence: CTT
tgtgcgttgtctttcgtttc

SEQ ID NO: 62654 - DNA, 20 bp, Artificial Sequence
  Description of Artificial Sequence: Synthetic oligonucleotide
  Target: SCN10A; (+) strand; PAM type: YTN; PAM sequence: TTT
gtgcgttgtctttcgtttcc

SEQ ID NO: 62655 - DNA, 20 bp, Artificial Sequence
  Description of Artificial Sequence: Synthetic oligonucleotide
  Target: SCN10A; (+) strand; PAM type: YTN; PAM sequence: TTG
tgcgttgtctttcgtttcct

SEQ ID NO: 62656 - DNA, 20 bp, Artificial Sequence
  Description of Artificial Sequence: Synthetic oligonucleotide
  Target: SCN10A; (+) strand; PAM type: YTN; PAM sequence: TTG
tctttcgtttccttttttct

SEQ ID NO: 62657 - DNA, 20 bp, Artificial Sequence
  Description of Artificial Sequence: Synthetic oligonucleotide
  Target: SCN10A; (+) strand; PAM type: YTN; PAM sequence: CTT
tcgtttccttttttcttggc

SEQ ID NO: 62658 - DNA, 20 bp, Artificial Sequence
  Description of Artificial Sequence: Synthetic oligonucleotide
  Target: SCN10A; (+) strand; PAM type: YTN; PAM sequence: TTT
cgtttccttttttcttggct

SEQ ID NO: 62659 - DNA, 20 bp, Artificial Sequence
  Description of Artificial Sequence: Synthetic oligonucleotide
  Target: SCN10A; (+) strand; PAM type: YTN; PAM sequence: TTC
gtttccttttttcttggctg

SEQ ID NO: 62660 - DNA, 20 bp, Artificial Sequence
  Description of Artificial Sequence: Synthetic oligonucleotide
  Target: SCN10A; (+) strand; PAM type: YTN; PAM sequence: TTT
ccttttttcttggctgtcat

SEQ ID NO: 62661 - DNA, 20 bp, Artificial Sequence
  Description of Artificial Sequence: Synthetic oligonucleotide
  Target: SCN10A; (+) strand; PAM type: YTN; PAM sequence: TTC
cttttttcttggctgtcatt

SEQ ID NO: 62662 - DNA, 20 bp, Artificial Sequence
  Description of Artificial Sequence: Synthetic oligonucleotide
  Target: SCN10A; (+) strand; PAM type: YTN; PAM sequence: CTT
ttttcttggctgtcatttcc

SEQ ID NO: 62663 - DNA, 20 bp, Artificial Sequence
  Description of Artificial Sequence: Synthetic oligonucleotide
  Target: SCN10A; (+) strand; PAM type: YTN; PAM sequence: TTT
tttcttggctgtcatttcct

SEQ ID NO: 62664 - DNA, 20 bp, Artificial Sequence
  Description of Artificial Sequence: Synthetic oligonucleotide
  Target: SCN10A; (+) strand; PAM type: YTN; PAM sequence: TTT
ttcttggctgtcatttcctg

SEQ ID NO: 62665 - DNA, 20 bp, Artificial Sequence
  Description of Artificial Sequence: Synthetic oligonucleotide
  Target: SCN10A; (+) strand; PAM type: YTN; PAM sequence: TTT
tcttggctgtcatttcctgg

SEQ ID NO: 62666 - DNA, 20 bp, Artificial Sequence
  Description of Artificial Sequence: Synthetic oligonucleotide
  Target: SCN10A; (+) strand; PAM type: YTN; PAM sequence: TTT
cttggctgtcatttcctggg

SEQ ID NO: 62667 - DNA, 20 bp, Artificial Sequence
  Description of Artificial Sequence: Synthetic oligonucleotide
  Target: SCN10A; (+) strand; PAM type: YTN; PAM sequence: TTC
ttggctgtcatttcctgggc

SEQ ID NO: 62668 - DNA, 20 bp, Artificial Sequence
  Description of Artificial Sequence: Synthetic oligonucleotide
  Target: SCN10A; (+) strand; PAM type: YTN; PAM sequence: CTT
ggctgtcatttcctgggcac

SEQ ID NO: 62669 - DNA, 20 bp, Artificial Sequence
  Description of Artificial Sequence: Synthetic oligonucleotide
  Target: SCN10A; (+) strand; PAM type: YTN; PAM sequence: TTG
gctgtcatttcctgggcact

SEQ ID NO: 62670 - DNA, 20 bp, Artificial Sequence
  Description of Artificial Sequence: Synthetic oligonucleotide
  Target: SCN10A; (+) strand; PAM type: YTN; PAM sequence: CTG
tcatttcctgggcacttact

SEQ ID NO: 62671 - DNA, 20 bp, Artificial Sequence
  Description of Artificial Sequence: Synthetic oligonucleotide
  Target: SCN10A; (+) strand; PAM type: YTN; PAM sequence: TTT
cctgggcacttactttgtct

SEQ ID NO: 62672 - DNA, 20 bp, Artificial Sequence
  Description of Artificial Sequence: Synthetic oligonucleotide
  Target: SCN10A; (+) strand; PAM type: YTN; PAM sequence: TTC
ctgggcacttactttgtctc

SEQ ID NO: 62673 - DNA, 20 bp, Artificial Sequence
  Description of Artificial Sequence: Synthetic oligonucleotide
  Target: SCN10A; (+) strand; PAM type: YTN; PAM sequence: CTG
ggcacttactttgtctcagg

SEQ ID NO: 62674 - DNA, 20 bp, Artificial Sequence
  Description of Artificial Sequence: Synthetic oligonucleotide
  Target: SCN10A; (+) strand; PAM type: YTN; PAM sequence: CTT
actttgtctcaggcaggacc

SEQ ID NO: 62675 - DNA, 20 bp, Artificial Sequence
  Description of Artificial Sequence: Synthetic oligonucleotide
  Target: SCN10A; (+) strand; PAM type: YTN; PAM sequence: TTA
ctttgtctcaggcaggacct

SEQ ID NO: 62676 - DNA, 20 bp, Artificial Sequence
  Description of Artificial Sequence: Synthetic oligonucleotide
  Target: SCN10A; (+) strand; PAM type: YTN; PAM sequence: CTT
tgtctcaggcaggacctaaa

SEQ ID NO: 62677 - DNA, 20 bp, Artificial Sequence
  Description of Artificial Sequence: Synthetic oligonucleotide
  Target: SCN10A; (+) strand; PAM type: YTN; PAM sequence: TTT
gtctcaggcaggacctaaac

SEQ ID NO: 62678 - DNA, 20 bp, Artificial Sequence
  Description of Artificial Sequence: Synthetic oligonucleotide
  Target: SCN10A; (+) strand; PAM type: YTN; PAM sequence: TTG
tctcaggcaggacctaaaca

SEQ ID NO: 62679 - DNA, 20 bp, Artificial Sequence
  Description of Artificial Sequence: Synthetic oligonucleotide
  Target: SCN10A; (+) strand; PAM type: YTN; PAM sequence: CTC
aggcaggacctaaacatttg

SEQ ID NO: 62680 - DNA, 20 bp, Artificial Sequence
  Description of Artificial Sequence: Synthetic oligonucleotide
  Target: SCN10A; (+) strand; PAM type: YTN; PAM sequence: CTA
aacatttgacaagcagcatc

SEQ ID NO: 62681 - DNA, 20 bp, Artificial Sequence
  Description of Artificial Sequence: Synthetic oligonucleotide
  Target: SCN10A; (+) strand; PAM type: YTN; PAM sequence: TTT
gacaagcagcatctcattta

SEQ ID NO: 62682 - DNA, 20 bp, Artificial Sequence
  Description of Artificial Sequence: Synthetic oligonucleotide
  Target: SCN10A; (+) strand; PAM type: YTN; PAM sequence: TTG
acaagcagcatctcatttaa

SEQ ID NO: 62683 - DNA, 20 bp, Artificial Sequence
  Description of Artificial Sequence: Synthetic oligonucleotide
  Target: SCN10A; (+) strand; PAM type: YTN; PAM sequence: CTC
atttaagcttcaaaataatc

SEQ ID NO: 62684 - DNA, 20 bp, Artificial Sequence
  Description of Artificial Sequence: Synthetic oligonucleotide
  Target: SCN10A; (+) strand; PAM type: YTN; PAM sequence: TTT
aagcttcaaaataatcctac

SEQ ID NO: 62685 - DNA, 20 bp, Artificial Sequence
  Description of Artificial Sequence: Synthetic oligonucleotide
  Target: SCN10A; (+) strand; PAM type: YTN; PAM sequence: TTA
agcttcaaaataatcctacc

SEQ ID NO: 62686 - DNA, 20 bp, Artificial Sequence
  Description of Artificial Sequence: Synthetic oligonucleotide
  Target: SCN10A; (+) strand; PAM type: YTN; PAM sequence: CTT
caaaataatcctaccaagta

SEQ ID NO: 62687 - DNA, 20 bp, Artificial Sequence
  Description of Artificial Sequence: Synthetic oligonucleotide
  Target: SCN10A; (+) strand; PAM type: YTN; PAM sequence: TTC
aaaataatcctaccaagtag

SEQ ID NO: 62688 - DNA, 20 bp, Artificial Sequence
  Description of Artificial Sequence: Synthetic oligonucleotide
  Target: SCN10A; (+) strand; PAM type: YTN; PAM sequence: CTA
ccaagtaggcattaccattc

SEQ ID NO: 62689 - DNA, 20 bp, Artificial Sequence
  Description of Artificial Sequence: Synthetic oligonucleotide
  Target: SCN10A; (+) strand; PAM type: YTN; PAM sequence: TTA
ccattcagtttcatagatga

SEQ ID NO: 62690 - DNA, 20 bp, Artificial Sequence
  Description of Artificial Sequence: Synthetic oligonucleotide
  Target: SCN10A; (+) strand; PAM type: YTN; PAM sequence: TTC
agtttcatagatgaataaat

SEQ ID NO: 62691 - DNA, 20 bp, Artificial Sequence
  Description of Artificial Sequence: Synthetic oligonucleotide
  Target: SCN10A; (+) strand; PAM type: YTN; PAM sequence: TTT
catagatgaataaatggcgg

SEQ ID NO: 62692 - DNA, 20 bp, Artificial Sequence
  Description of Artificial Sequence: Synthetic oligonucleotide
  Target: SCN10A; (+) strand; PAM type: YTN; PAM sequence: TTC
atagatgaataaatggcggc

SEQ ID NO: 62693 - DNA, 20 bp, Artificial Sequence
  Description of Artificial Sequence: Synthetic oligonucleotide
  Target: SCN10A; (+) strand; PAM type: YTN; PAM sequence: CTC
agagaggtttgggaactgat

SEQ ID NO: 62694 - DNA, 20 bp, Artificial Sequence
  Description of Artificial Sequence: Synthetic oligonucleotide
  Target: SCN10A; (+) strand; PAM type: YTN; PAM sequence: TTT
gggaactgatcttaggtccc

SEQ ID NO: 62695 - DNA, 20 bp, Artificial Sequence
  Description of Artificial Sequence: Synthetic oligonucleotide
  Target: SCN10A; (+) strand; PAM type: YTN; PAM sequence: TTG
ggaactgatcttaggtccca

SEQ ID NO: 62696 - DNA, 20 bp, Artificial Sequence
  Description of Artificial Sequence: Synthetic oligonucleotide
  Target: SCN10A; (+) strand; PAM type: YTN; PAM sequence: CTG
atcttaggtcccacagcttg

SEQ ID NO: 62697 - DNA, 20 bp, Artificial Sequence
  Description of Artificial Sequence: Synthetic oligonucleotide
  Target: SCN10A; (+) strand; PAM type: YTN; PAM sequence: CTT
aggtcccacagcttgtggag

SEQ ID NO: 62698 - DNA, 20 bp, Artificial Sequence
  Description of Artificial Sequence: Synthetic oligonucleotide
  Target: SCN10A; (+) strand; PAM type: YTN; PAM sequence: TTA
ggtcccacagcttgtggagt

SEQ ID NO: 62699 - DNA, 20 bp, Artificial Sequence
  Description of Artificial Sequence: Synthetic oligonucleotide
  Target: SCN10A; (+) strand; PAM type: YTN; PAM sequence: CTT
gtggagtctcactctttctt

SEQ ID NO: 62700 - DNA, 20 bp, Artificial Sequence
  Description of Artificial Sequence: Synthetic oligonucleotide
  Target: SCN10A; (+) strand; PAM type: YTN; PAM sequence: TTG
tggagtctcactctttcttt

SEQ ID NO: 62701 - DNA, 20 bp, Artificial Sequence
  Description of Artificial Sequence: Synthetic oligonucleotide
  Target: SCN10A; (+) strand; PAM type: YTN; PAM sequence: CTC
actctttctttctataccta

SEQ ID NO: 62702 - DNA, 20 bp, Artificial Sequence
  Description of Artificial Sequence: Synthetic oligonucleotide
  Target: SCN10A; (+) strand; PAM type: YTN; PAM sequence: CTC
tttctttctatacctagaac

SEQ ID NO: 62703 - DNA, 20 bp, Artificial Sequence
  Description of Artificial Sequence: Synthetic oligonucleotide
  Target: SCN10A; (+) strand; PAM type: YTN; PAM sequence: CTT
tctttctatacctagaacca

SEQ ID NO: 62704 - DNA, 20 bp, Artificial Sequence
  Description of Artificial Sequence: Synthetic oligonucleotide
  Target: SCN10A; (+) strand; PAM type: YTN; PAM sequence: TTT
ctttctatacctagaaccac

SEQ ID NO: 62705 - DNA, 20 bp, Artificial Sequence
  Description of Artificial Sequence: Synthetic oligonucleotide
  Target: SCN10A; (+) strand; PAM type: YTN; PAM sequence: TTC
tttctatacctagaaccacc

SEQ ID NO: 62706 - DNA, 20 bp, Artificial Sequence
  Description of Artificial Sequence: Synthetic oligonucleotide
  Target: SCN10A; (+) strand; PAM type: YTN; PAM sequence: CTT
tctatacctagaaccaccct

SEQ ID NO: 62707 - DNA, 20 bp, Artificial Sequence
  Description of Artificial Sequence: Synthetic oligonucleotide
  Target: SCN10A; (+) strand; PAM type: YTN; PAM sequence: TTT
ctatacctagaaccaccctg

SEQ ID NO: 62708 - DNA, 20 bp, Artificial Sequence
  Description of Artificial Sequence: Synthetic oligonucleotide
  Target: SCN10A; (+) strand; PAM type: YTN; PAM sequence: TTC
tatacctagaaccaccctgg

SEQ ID NO: 62709 - DNA, 20 bp, Artificial Sequence
  Description of Artificial Sequence: Synthetic oligonucleotide
  Target: SCN10A; (+) strand; PAM type: YTN; PAM sequence: CTA
tacctagaaccaccctggag

SEQ ID NO: 62710 - DNA, 20 bp, Artificial Sequence
  Description of Artificial Sequence: Synthetic oligonucleotide
  Target: SCN10A; (+) strand; PAM type: YTN; PAM sequence: CTA
gaaccaccctggagtgagat

SEQ ID NO: 62711 - DNA, 20 bp, Artificial Sequence
  Description of Artificial Sequence: Synthetic oligonucleotide
  Target: SCN10A; (+) strand; PAM type: YTN; PAM sequence: CTG
gagtgagattgtggcaatgg

SEQ ID NO: 62712 - DNA, 20 bp, Artificial Sequence
  Description of Artificial Sequence: Synthetic oligonucleotide
  Target: SCN10A; (+) strand; PAM type: YTN; PAM sequence: TTG
tggcaatggtatatggtgaa

SEQ ID NO: 62713 - DNA, 20 bp, Artificial Sequence
  Description of Artificial Sequence: Synthetic oligonucleotide
  Target: SCN10A; (+) strand; PAM type: YTN; PAM sequence: TTG
aaattgtgcggattagccgg

SEQ ID NO: 62714 - DNA, 20 bp, Artificial Sequence
  Description of Artificial Sequence: Synthetic oligonucleotide
  Target: SCN10A; (+) strand; PAM type: YTN; PAM sequence: TTG
tgcggattagccggaggttg

SEQ ID NO: 62715 - DNA, 20 bp, Artificial Sequence
  Description of Artificial Sequence: Synthetic oligonucleotide
  Target: SCN10A; (+) strand; PAM type: YTN; PAM sequence: TTA
gccggaggttgggagggact

SEQ ID NO: 62716 - DNA, 20 bp, Artificial Sequence
  Description of Artificial Sequence: Synthetic oligonucleotide
  Target: SCN10A; (+) strand; PAM type: YTN; PAM sequence: TTG
ggagggactttaaaaattcc

SEQ ID NO: 62717 - DNA, 20 bp, Artificial Sequence
  Description of Artificial Sequence: Synthetic oligonucleotide
  Target: SCN10A; (+) strand; PAM type: YTN; PAM sequence: CTT
taaaaattcccaggataaga

SEQ ID NO: 62718 - DNA, 20 bp, Artificial Sequence
  Description of Artificial Sequence: Synthetic oligonucleotide
  Target: SCN10A; (+) strand; PAM type: YTN; PAM sequence: TTT
aaaaattcccaggataagaa

SEQ ID NO: 62719 - DNA, 20 bp, Artificial Sequence
  Description of Artificial Sequence: Synthetic oligonucleotide
  Target: SCN10A; (+) strand; PAM type: YTN; PAM sequence: TTA
aaaattcccaggataagaaa

SEQ ID NO: 62720 - DNA, 20 bp, Artificial Sequence
  Description of Artificial Sequence: Synthetic oligonucleotide
  Target: SCN10A; (+) strand; PAM type: YTN; PAM sequence: TTC
ccaggataagaaatgaggtt

SEQ ID NO: 62721 - DNA, 20 bp, Artificial Sequence
  Description of Artificial Sequence: Synthetic oligonucleotide
  Target: SCN10A; (+) strand; PAM type: YTN; PAM sequence: TTA
tgtgattgagtgcagtctgg

SEQ ID NO: 62722 - DNA, 20 bp, Artificial Sequence
  Description of Artificial Sequence: Synthetic oligonucleotide
  Target: SCN10A; (+) strand; PAM type: YTN; PAM sequence: TTG
agtgcagtctggaatacccc

SEQ ID NO: 62723 - DNA, 20 bp, Artificial Sequence
  Description of Artificial Sequence: Synthetic oligonucleotide
  Target: SCN10A; (+) strand; PAM type: YTN; PAM sequence: CTG
gaataccccaccttcaccgc

SEQ ID NO: 62724 - DNA, 20 bp, Artificial Sequence
  Description of Artificial Sequence: Synthetic oligonucleotide
  Target: SCN10A; (+) strand; PAM type: YTN; PAM sequence: CTT
caccgccaccctccagcctc

SEQ ID NO: 62725 - DNA, 20 bp, Artificial Sequence
  Description of Artificial Sequence: Synthetic oligonucleotide
  Target: SCN10A; (+) strand; PAM type: YTN; PAM sequence: TTC
accgccaccctccagcctct

SEQ ID NO: 62726 - DNA, 20 bp, Artificial Sequence
  Description of Artificial Sequence: Synthetic oligonucleotide
  Target: SCN10A; (+) strand; PAM type: YTN; PAM sequence: CTC
cagcctctaccagcccactg

SEQ ID NO: 62727 - DNA, 20 bp, Artificial Sequence
  Description of Artificial Sequence: Synthetic oligonucleotide
  Target: SCN10A; (+) strand; PAM type: YTN; PAM sequence: CTC
taccagcccactgctcagtg

SEQ ID NO: 62728 - DNA, 20 bp, Artificial Sequence
  Description of Artificial Sequence: Synthetic oligonucleotide
  Target: SCN10A; (+) strand; PAM type: YTN; PAM sequence: CTA
ccagcccactgctcagtgtc

SEQ ID NO: 62729 - DNA, 20 bp, Artificial Sequence
  Description of Artificial Sequence: Synthetic oligonucleotide
  Target: SCN10A; (+) strand; PAM type: YTN; PAM sequence: CTG
ctcagtgtctggctggctgt

SEQ ID NO: 62730 - DNA, 20 bp, Artificial Sequence
  Description of Artificial Sequence: Synthetic oligonucleotide
  Target: SCN10A; (+) strand; PAM type: YTN; PAM sequence: CTC
agtgtctggctggctgtcca

SEQ ID NO: 62731 - DNA, 20 bp, Artificial Sequence
  Description of Artificial Sequence: Synthetic oligonucleotide
  Target: SCN10A; (+) strand; PAM type: YTN; PAM sequence: CTG
gctggctgtccaacctctcc

SEQ ID NO: 62732 - DNA, 20 bp, Artificial Sequence
  Description of Artificial Sequence: Synthetic oligonucleotide
  Target: SCN10A; (+) strand; PAM type: YTN; PAM sequence: CTG
gctgtccaacctctccagga

SEQ ID NO: 62733 - DNA, 20 bp, Artificial Sequence
  Description of Artificial Sequence: Synthetic oligonucleotide
  Target: SCN10A; (+) strand; PAM type: YTN; PAM sequence: CTG
tccaacctctccaggaagct

SEQ ID NO: 62734 - DNA, 20 bp, Artificial Sequence
  Description of Artificial Sequence: Synthetic oligonucleotide
  Target: SCN10A; (+) strand; PAM type: YTN; PAM sequence: CTC
tccaggaagctgacatacct

SEQ ID NO: 62735 - DNA, 20 bp, Artificial Sequence
  Description of Artificial Sequence: Synthetic oligonucleotide
  Target: SCN10A; (+) strand; PAM type: YTN; PAM sequence: CTC
caggaagctgacatacctac

SEQ ID NO: 62736 - DNA, 20 bp, Artificial Sequence
  Description of Artificial Sequence: Synthetic oligonucleotide
  Target: SCN10A; (+) strand; PAM type: YTN; PAM sequence: CTG
acatacctacctcagcaggg

SEQ ID NO: 62737 - DNA, 20 bp, Artificial Sequence
  Description of Artificial Sequence: Synthetic oligonucleotide
  Target: SCN10A; (+) strand; PAM type: YTN; PAM sequence: CTA
cctcagcagggacctgagga

SEQ ID NO: 62738 - DNA, 20 bp, Artificial Sequence
  Description of Artificial Sequence: Synthetic oligonucleotide
  Target: SCN10A; (+) strand; PAM type: YTN; PAM sequence: CTC
agcagggacctgaggaacag

SEQ ID NO: 62739 - DNA, 20 bp, Artificial Sequence
  Description of Artificial Sequence: Synthetic oligonucleotide
  Target: SCN10A; (+) strand; PAM type: YTN; PAM sequence: CTG
aggaacagactcatctttcc

SEQ ID NO: 62740 - DNA, 20 bp, Artificial Sequence
  Description of Artificial Sequence: Synthetic oligonucleotide
  Target: SCN10A; (+) strand; PAM type: YTN; PAM sequence: CTC
atctttccacgtctcaccca

SEQ ID NO: 62741 - DNA, 20 bp, Artificial Sequence
  Description of Artificial Sequence: Synthetic oligonucleotide
  Target: SCN10A; (+) strand; PAM type: YTN; PAM sequence: CTT
tccacgtctcacccagggat

SEQ ID NO: 62742 - DNA, 20 bp, Artificial Sequence
  Description of Artificial Sequence: Synthetic oligonucleotide
  Target: SCN10A; (+) strand; PAM type: YTN; PAM sequence: TTT
ccacgtctcacccagggatg

SEQ ID NO: 62743 - DNA, 20 bp, Artificial Sequence
  Description of Artificial Sequence: Synthetic oligonucleotide
  Target: SCN10A; (+) strand; PAM type: YTN; PAM sequence: TTC
cacgtctcacccagggatgg

SEQ ID NO: 62744 - DNA, 20 bp, Artificial Sequence
  Description of Artificial Sequence: Synthetic oligonucleotide
  Target: SCN10A; (+) strand; PAM type: YTN; PAM sequence: CTC
acccagggatggagccaggt

SEQ ID NO: 62745 - DNA, 20 bp, Artificial Sequence
  Description of Artificial Sequence: Synthetic oligonucleotide
  Target: SCN10A; (+) strand; PAM type: YTN; PAM sequence: CTC
agaagatgttccagtgcctg

SEQ ID NO: 62746 - DNA, 20 bp, Artificial Sequence
  Description of Artificial Sequence: Synthetic oligonucleotide
  Target: SCN10A; (+) strand; PAM type: YTN; PAM sequence: TTC
cagtgcctgggctcctgggt

SEQ ID NO: 62747 - DNA, 20 bp, Artificial Sequence
  Description of Artificial Sequence: Synthetic oligonucleotide
  Target: SCN10A; (+) strand; PAM type: YTN; PAM sequence: CTG
ggctcctgggtgtcaggtgg

SEQ ID NO: 62748 - DNA, 20 bp, Artificial Sequence
  Description of Artificial Sequence: Synthetic oligonucleotide
  Target: SCN10A; (+) strand; PAM type: YTN; PAM sequence: CTC
ctgggtgtcaggtggtcccc

SEQ ID NO: 62749 - DNA, 20 bp, Artificial Sequence
  Description of Artificial Sequence: Synthetic oligonucleotide
  Target: SCN10A; (+) strand; PAM type: YTN; PAM sequence: CTG
ggtgtcaggtggtccccaca

SEQ ID NO: 62750 - DNA, 20 bp, Artificial Sequence
  Description of Artificial Sequence: Synthetic oligonucleotide
  Target: SCN10A; (+) strand; PAM type: YTN; PAM sequence: CTC
tcgacttgctgcagctgctc

SEQ ID NO: 62751 - DNA, 20 bp, Artificial Sequence
  Description of Artificial Sequence: Synthetic oligonucleotide
  Target: SCN10A; (+) strand; PAM type: YTN; PAM sequence: CTC
gacttgctgcagctgctcct

SEQ ID NO: 62752 - DNA, 20 bp, Artificial Sequence
  Description of Artificial Sequence: Synthetic oligonucleotide
  Target: SCN10A; (+) strand; PAM type: YTN; PAM sequence: CTT
gctgcagctgctcctgctag

SEQ ID NO: 62753 - DNA, 20 bp, Artificial Sequence
  Description of Artificial Sequence: Synthetic oligonucleotide
  Target: SCN10A; (+) strand; PAM type: YTN; PAM sequence: TTG
ctgcagctgctcctgctagt

SEQ ID NO: 62754 - DNA, 20 bp, Artificial Sequence
  Description of Artificial Sequence: Synthetic oligonucleotide
  Target: SCN10A; (+) strand; PAM type: YTN; PAM sequence: CTG
cagctgctcctgctagtgag

SEQ ID NO: 62755 - DNA, 20 bp, Artificial Sequence
  Description of Artificial Sequence: Synthetic oligonucleotide
  Target: SCN10A; (+) strand; PAM type: YTN; PAM sequence: CTG
ctcctgctagtgagagaggg

SEQ ID NO: 62756 - DNA, 20 bp, Artificial Sequence
  Description of Artificial Sequence: Synthetic oligonucleotide
  Target: SCN10A; (+) strand; PAM type: YTN; PAM sequence: CTC
ctgctagtgagagagggtcc

SEQ ID NO: 62757 - DNA, 20 bp, Artificial Sequence
  Description of Artificial Sequence: Synthetic oligonucleotide
  Target: SCN10A; (+) strand; PAM type: YTN; PAM sequence: CTG
ctagtgagagagggtcccaa

SEQ ID NO: 62758 - DNA, 20 bp, Artificial Sequence
  Description of Artificial Sequence: Synthetic oligonucleotide
  Target: SCN10A; (+) strand; PAM type: YTN; PAM sequence: CTA
gtgagagagggtcccaactg

SEQ ID NO: 62759 - DNA, 20 bp, Artificial Sequence
  Description of Artificial Sequence: Synthetic oligonucleotide
  Target: SCN10A; (+) strand; PAM type: YTN; PAM sequence: CTG
ggtgcctggccccaccctta

SEQ ID NO: 62760 - DNA, 20 bp, Artificial Sequence
  Description of Artificial Sequence: Synthetic oligonucleotide
  Target: SCN10A; (+) strand; PAM type: YTN; PAM sequence: CTG
gccccacccttagatgacca

SEQ ID NO: 62761 - DNA, 20 bp, Artificial Sequence
  Description of Artificial Sequence: Synthetic oligonucleotide
  Target: SCN10A; (+) strand; PAM type: YTN; PAM sequence: CTT
agatgaccagttctaaattt

SEQ ID NO: 62762 - DNA, 20 bp, Artificial Sequence
  Description of Artificial Sequence: Synthetic oligonucleotide
  Target: SCN10A; (+) strand; PAM type: YTN; PAM sequence: TTA
gatgaccagttctaaatttg

SEQ ID NO: 62763 - DNA, 20 bp, Artificial Sequence
  Description of Artificial Sequence: Synthetic oligonucleotide
  Target: SCN10A; (+) strand; PAM type: YTN; PAM sequence: TTC
taaatttgaagggatcttgc

SEQ ID NO: 62764 - DNA, 20 bp, Artificial Sequence
  Description of Artificial Sequence: Synthetic oligonucleotide
  Target: SCN10A; (+) strand; PAM type: YTN; PAM sequence: CTA
aatttgaagggatcttgcac

SEQ ID NO: 62765 - DNA, 20 bp, Artificial Sequence
  Description of Artificial Sequence: Synthetic oligonucleotide
  Target: SCN10A; (+) strand; PAM type: YTN; PAM sequence: TTT
gaagggatcttgcacatcac

SEQ ID NO: 62766 - DNA, 20 bp, Artificial Sequence
  Description of Artificial Sequence: Synthetic oligonucleotide
  Target: SCN10A; (+) strand; PAM type: YTN; PAM sequence: TTG
aagggatcttgcacatcaca

SEQ ID NO: 62767 - DNA, 20 bp, Artificial Sequence
  Description of Artificial Sequence: Synthetic oligonucleotide
  Target: SCN10A; (+) strand; PAM type: YTN; PAM sequence: CTT
gcacatcacaggctgccaga

SEQ ID NO: 62768 - DNA, 20 bp, Artificial Sequence
  Description of Artificial Sequence: Synthetic oligonucleotide
  Target: SCN10A; (+) strand; PAM type: YTN; PAM sequence: TTG
cacatcacaggctgccagag

SEQ ID NO: 62769 - DNA, 20 bp, Artificial Sequence
  Description of Artificial Sequence: Synthetic oligonucleotide
  Target: SCN10A; (+) strand; PAM type: YTN; PAM sequence: CTG
ccagagccaagagtttcata

SEQ ID NO: 62770 - DNA, 20 bp, Artificial Sequence
  Description of Artificial Sequence: Synthetic oligonucleotide
  Target: SCN10A; (+) strand; PAM type: YTN; PAM sequence: TTT
catatatgcaactcatgtac

SEQ ID NO: 62771 - DNA, 20 bp, Artificial Sequence
  Description of Artificial Sequence: Synthetic oligonucleotide
  Target: SCN10A; (+) strand; PAM type: YTN; PAM sequence: TTC
atatatgcaactcatgtaca

SEQ ID NO: 62772 - DNA, 20 bp, Artificial Sequence
  Description of Artificial Sequence: Synthetic oligonucleotide
  Target: SCN10A; (+) strand; PAM type: YTN; PAM sequence: CTC
atgtacatacatatatacat

SEQ ID NO: 62773 - DNA, 20 bp, Artificial Sequence
  Description of Artificial Sequence: Synthetic oligonucleotide
  Target: SCN10A; (+) strand; PAM type: YTN; PAM sequence: CTA
tagctagatagacctatgtt

SEQ ID NO: 62774 - DNA, 20 bp, Artificial Sequence
  Description of Artificial Sequence: Synthetic oligonucleotide
  Target: SCN10A; (+) strand; PAM type: YTN; PAM sequence: CTA
gatagacctatgttttatcc

SEQ ID NO: 62775 - DNA, 20 bp, Artificial Sequence
  Description of Artificial Sequence: Synthetic oligonucleotide
  Target: SCN10A; (+) strand; PAM type: YTN; PAM sequence: CTA
tgttttatccttgggctcca

SEQ ID NO: 62776 - DNA, 20 bp, Artificial Sequence
  Description of Artificial Sequence: Synthetic oligonucleotide
  Target: SCN10A; (+) strand; PAM type: YTN; PAM sequence: TTT
tatccttgggctccattaat

SEQ ID NO: 62777 - DNA, 20 bp, Artificial Sequence
  Description of Artificial Sequence: Synthetic oligonucleotide
  Target: SCN10A; (+) strand; PAM type: YTN; PAM sequence: TTT
atccttgggctccattaatt

SEQ ID NO: 62778 - DNA, 20 bp, Artificial Sequence
  Description of Artificial Sequence: Synthetic oligonucleotide
  Target: SCN10A; (+) strand; PAM type: YTN; PAM sequence: TTA
tccttgggctccattaatta

SEQ ID NO: 62779 - DNA, 20 bp, Artificial Sequence
  Description of Artificial Sequence: Synthetic oligonucleotide
  Target: SCN10A; (+) strand; PAM type: YTN; PAM sequence: CTT
gggctccattaattataaga

SEQ ID NO: 62780 - DNA, 20 bp, Artificial Sequence
  Description of Artificial Sequence: Synthetic oligonucleotide
  Target: SCN10A; (+) strand; PAM type: YTN; PAM sequence: TTG
ggctccattaattataagat

SEQ ID NO: 62781 - DNA, 20 bp, Artificial Sequence
  Description of Artificial Sequence: Synthetic oligonucleotide
  Target: SCN10A; (+) strand; PAM type: YTN; PAM sequence: CTC
cattaattataagatgtgtg

SEQ ID NO: 62782 - DNA, 20 bp, Artificial Sequence
  Description of Artificial Sequence: Synthetic oligonucleotide
  Target: SCN10A; (+) strand; PAM type: YTN; PAM sequence: TTA
attataagatgtgtgacctt

SEQ ID NO: 62783 - DNA, 20 bp, Artificial Sequence
  Description of Artificial Sequence: Synthetic oligonucleotide
  Target: SCN10A; (+) strand; PAM type: YTN; PAM sequence: TTA
taagatgtgtgaccttaggc

SEQ ID NO: 62784 - DNA, 20 bp, Artificial Sequence
  Description of Artificial Sequence: Synthetic oligonucleotide
  Target: SCN10A; (+) strand; PAM type: YTN; PAM sequence: CTT
aggcaagttgtttaacctct

SEQ ID NO: 62785 - DNA, 20 bp, Artificial Sequence
  Description of Artificial Sequence: Synthetic oligonucleotide
  Target: SCN10A; (+) strand; PAM type: YTN; PAM sequence: TTA
ggcaagttgtttaacctctc

SEQ ID NO: 62786 - DNA, 20 bp, Artificial Sequence
  Description of Artificial Sequence: Synthetic oligonucleotide
  Target: SCN10A; (+) strand; PAM type: YTN; PAM sequence: TTG
tttaacctctctaatcttca

SEQ ID NO: 62787 - DNA, 20 bp, Artificial Sequence
  Description of Artificial Sequence: Synthetic oligonucleotide
  Target: SCN10A; (+) strand; PAM type: YTN; PAM sequence: TTT
aacctctctaatcttcattt

SEQ ID NO: 62788 - DNA, 20 bp, Artificial Sequence
  Description of Artificial Sequence: Synthetic oligonucleotide
  Target: SCN10A; (+) strand; PAM type: YTN; PAM sequence: TTA
acctctctaatcttcatttt

SEQ ID NO: 62789 - DNA, 20 bp, Artificial Sequence
  Description of Artificial Sequence: Synthetic oligonucleotide
  Target: SCN10A; (+) strand; PAM type: YTN; PAM sequence: CTC
tctaatcttcatttttccca

SEQ ID NO: 62790 - DNA, 20 bp, Artificial Sequence
  Description of Artificial Sequence: Synthetic oligonucleotide
  Target: SCN10A; (+) strand; PAM type: YTN; PAM sequence: CTC
taatcttcatttttcccagc

SEQ ID NO: 62791 - DNA, 20 bp, Artificial Sequence
  Description of Artificial Sequence: Synthetic oligonucleotide
  Target: SCN10A; (+) strand; PAM type: YTN; PAM sequence: CTA
atcttcatttttcccagctt

SEQ ID NO: 62792 - DNA, 20 bp, Artificial Sequence
  Description of Artificial Sequence: Synthetic oligonucleotide
  Target: SCN10A; (+) strand; PAM type: YTN; PAM sequence: CTT
catttttcccagcttcaaaa

SEQ ID NO: 62793 - DNA, 20 bp, Artificial Sequence
  Description of Artificial Sequence: Synthetic oligonucleotide
  Target: SCN10A; (+) strand; PAM type: YTN; PAM sequence: TTC
atttttcccagcttcaaaat

SEQ ID NO: 62794 - DNA, 20 bp, Artificial Sequence
  Description of Artificial Sequence: Synthetic oligonucleotide
  Target: SCN10A; (+) strand; PAM type: YTN; PAM sequence: TTT
ttcccagcttcaaaattgaa

SEQ ID NO: 62795 - DNA, 20 bp, Artificial Sequence
  Description of Artificial Sequence: Synthetic oligonucleotide
  Target: SCN10A; (+) strand; PAM type: YTN; PAM sequence: TTT
tcccagcttcaaaattgaaa

SEQ ID NO: 62796 - DNA, 20 bp, Artificial Sequence
  Description of Artificial Sequence: Synthetic oligonucleotide
  Target: SCN10A; (+) strand; PAM type: YTN; PAM sequence: TTT
cccagcttcaaaattgaaaa

SEQ ID NO: 62797 - DNA, 20 bp, Artificial Sequence
  Description of Artificial Sequence: Synthetic oligonucleotide
  Target: SCN10A; (+) strand; PAM type: YTN; PAM sequence: TTC
ccagcttcaaaattgaaaag

SEQ ID NO: 62798 - DNA, 20 bp, Artificial Sequence
  Description of Artificial Sequence: Synthetic oligonucleotide
  Target: SCN10A; (+) strand; PAM type: YTN; PAM sequence: CTT
caaaattgaaaaggctagat

SEQ ID NO: 62799 - DNA, 20 bp, Artificial Sequence
  Description of Artificial Sequence: Synthetic oligonucleotide
  Target: SCN10A; (+) strand; PAM type: YTN; PAM sequence: TTC
aaaattgaaaaggctagatc

SEQ ID NO: 62800 - DNA, 20 bp, Artificial Sequence
  Description of Artificial Sequence: Synthetic oligonucleotide
  Target: SCN10A; (+) strand; PAM type: YTN; PAM sequence: TTG
aaaaggctagatctgcatca

SEQ ID NO: 62801 - DNA, 20 bp, Artificial Sequence
  Description of Artificial Sequence: Synthetic oligonucleotide
  Target: SCN10A; (+) strand; PAM type: YTN; PAM sequence: CTA
gatctgcatcattcagctgt

SEQ ID NO: 62802 - DNA, 20 bp, Artificial Sequence
  Description of Artificial Sequence: Synthetic oligonucleotide
  Target: SCN10A; (+) strand; PAM type: YTN; PAM sequence: CTG
catcattcagctgttttgat

SEQ ID NO: 62803 - DNA, 20 bp, Artificial Sequence
  Description of Artificial Sequence: Synthetic oligonucleotide
  Target: SCN10A; (+) strand; PAM type: YTN; PAM sequence: TTC
agctgttttgatgactaaat

SEQ ID NO: 62804 - DNA, 20 bp, Artificial Sequence
  Description of Artificial Sequence: Synthetic oligonucleotide
  Target: SCN10A; (+) strand; PAM type: YTN; PAM sequence: CTG
ttttgatgactaaatatgtt

SEQ ID NO: 62805 - DNA, 20 bp, Artificial Sequence
  Description of Artificial Sequence: Synthetic oligonucleotide
  Target: SCN10A; (+) strand; PAM type: YTN; PAM sequence: TTT
tgatgactaaatatgttagc

SEQ ID NO: 62806 - DNA, 20 bp, Artificial Sequence
  Description of Artificial Sequence: Synthetic oligonucleotide
  Target: SCN10A; (+) strand; PAM type: YTN; PAM sequence: TTT
gatgactaaatatgttagcg

SEQ ID NO: 62807 - DNA, 20 bp, Artificial Sequence
  Description of Artificial Sequence: Synthetic oligonucleotide
  Target: SCN10A; (+) strand; PAM type: YTN; PAM sequence: TTG
atgactaaatatgttagcgc

SEQ ID NO: 62808 - DNA, 20 bp, Artificial Sequence
  Description of Artificial Sequence: Synthetic oligonucleotide
  Target: SCN10A; (+) strand; PAM type: YTN; PAM sequence: CTA
aatatgttagcgcttgtaaa

SEQ ID NO: 62809 - DNA, 20 bp, Artificial Sequence
  Description of Artificial Sequence: Synthetic oligonucleotide
  Target: SCN10A; (+) strand; PAM type: YTN; PAM sequence: TTA
gcgcttgtaaaacactttgc

SEQ ID NO: 62810 - DNA, 20 bp, Artificial Sequence
  Description of Artificial Sequence: Synthetic oligonucleotide
  Target: SCN10A; (+) strand; PAM type: YTN; PAM sequence: CTT
gtaaaacactttgcacgaag

SEQ ID NO: 62811 - DNA, 20 bp, Artificial Sequence
  Description of Artificial Sequence: Synthetic oligonucleotide
  Target: SCN10A; (+) strand; PAM type: YTN; PAM sequence: TTG
taaaacactttgcacgaagt

SEQ ID NO: 62812 - DNA, 20 bp, Artificial Sequence
  Description of Artificial Sequence: Synthetic oligonucleotide
  Target: SCN10A; (+) strand; PAM type: YTN; PAM sequence: CTT
tgcacgaagtgcttggctca

SEQ ID NO: 62813 - DNA, 20 bp, Artificial Sequence
  Description of Artificial Sequence: Synthetic oligonucleotide
  Target: SCN10A; (+) strand; PAM type: YTN; PAM sequence: TTT
gcacgaagtgcttggctcaa

SEQ ID NO: 62814 - DNA, 20 bp, Artificial Sequence
  Description of Artificial Sequence: Synthetic oligonucleotide
  Target: SCN10A; (+) strand; PAM type: YTN; PAM sequence: TTG
cacgaagtgcttggctcaat

SEQ ID NO: 62815 - DNA, 20 bp, Artificial Sequence
  Description of Artificial Sequence: Synthetic oligonucleotide
  Target: SCN10A; (+) strand; PAM type: YTN; PAM sequence: CTT
ggctcaatagattttagcca

SEQ ID NO: 62816 - DNA, 20 bp, Artificial Sequence
  Description of Artificial Sequence: Synthetic oligonucleotide
  Target: SCN10A; (+) strand; PAM type: YTN; PAM sequence: TTG
gctcaatagattttagccat

SEQ ID NO: 62817 - DNA, 20 bp, Artificial Sequence
  Description of Artificial Sequence: Synthetic oligonucleotide
  Target: SCN10A; (+) strand; PAM type: YTN; PAM sequence: CTC
aatagattttagccatgacc

SEQ ID NO: 62818 - DNA, 20 bp, Artificial Sequence
  Description of Artificial Sequence: Synthetic oligonucleotide
  Target: SCN10A; (+) strand; PAM type: YTN; PAM sequence: TTT
tagccatgaccattgttatt

SEQ ID NO: 62819 - DNA, 20 bp, Artificial Sequence
  Description of Artificial Sequence: Synthetic oligonucleotide
  Target: SCN10A; (+) strand; PAM type: YTN; PAM sequence: TTT
agccatgaccattgttattt

SEQ ID NO: 62820 - DNA, 20 bp, Artificial Sequence
  Description of Artificial Sequence: Synthetic oligonucleotide
  Target: SCN10A; (+) strand; PAM type: YTN; PAM sequence: TTA
gccatgaccattgttatttg

SEQ ID NO: 62821 - DNA, 20 bp, Artificial Sequence
  Description of Artificial Sequence: Synthetic oligonucleotide
  Target: SCN10A; (+) strand; PAM type: YTN; PAM sequence: TTG
ttatttgtccagaggtcaaa

SEQ ID NO: 62822 - DNA, 20 bp, Artificial Sequence
  Description of Artificial Sequence: Synthetic oligonucleotide
  Target: SCN10A; (+) strand; PAM type: YTN; PAM sequence: TTA
tttgtccagaggtcaaaatt

SEQ ID NO: 62823 - DNA, 20 bp, Artificial Sequence
  Description of Artificial Sequence: Synthetic oligonucleotide
  Target: SCN10A; (+) strand; PAM type: YTN; PAM sequence: TTT
gtccagaggtcaaaattgta

SEQ ID NO: 62824 - DNA, 20 bp, Artificial Sequence
  Description of Artificial Sequence: Synthetic oligonucleotide
  Target: SCN10A; (+) strand; PAM type: YTN; PAM sequence: TTG
tccagaggtcaaaattgtag

SEQ ID NO: 62825 - DNA, 20 bp, Artificial Sequence
  Description of Artificial Sequence: Synthetic oligonucleotide
  Target: SCN10A; (+) strand; PAM type: YTN; PAM sequence: TTG
tagggaacttggccacctgg

SEQ ID NO: 62826 - DNA, 20 bp, Artificial Sequence
  Description of Artificial Sequence: Synthetic oligonucleotide
  Target: SCN10A; (+) strand; PAM type: YTN; PAM sequence: CTT
ggccacctggagctccctaa

SEQ ID NO: 62827 - DNA, 20 bp, Artificial Sequence
  Description of Artificial Sequence: Synthetic oligonucleotide
  Target: SCN10A; (+) strand; PAM type: YTN; PAM sequence: TTG
gccacctggagctccctaag

SEQ ID NO: 62828 - DNA, 20 bp, Artificial Sequence
  Description of Artificial Sequence: Synthetic oligonucleotide
  Target: SCN10A; (+) strand; PAM type: YTN; PAM sequence: CTG
gagctccctaagagccccaa

SEQ ID NO: 62829 - DNA, 20 bp, Artificial Sequence
  Description of Artificial Sequence: Synthetic oligonucleotide
  Target: SCN10A; (+) strand; PAM type: YTN; PAM sequence: CTC
cctaagagccccaaagtaac

SEQ ID NO: 62830 - DNA, 20 bp, Artificial Sequence
  Description of Artificial Sequence: Synthetic oligonucleotide
  Target: SCN10A; (+) strand; PAM type: YTN; PAM sequence: CTA
agagccccaaagtaactgaa

SEQ ID NO: 62831 - DNA, 20 bp, Artificial Sequence
  Description of Artificial Sequence: Synthetic oligonucleotide
  Target: SCN10A; (+) strand; PAM type: YTN; PAM sequence: CTG
aaaatgcttctgagtggcag

SEQ ID NO: 62832 - DNA, 20 bp, Artificial Sequence
  Description of Artificial Sequence: Synthetic oligonucleotide
  Target: SCN10A; (+) strand; PAM type: YTN; PAM sequence: CTT
ctgagtggcagacagctgtc

SEQ ID NO: 62833 - DNA, 20 bp, Artificial Sequence
  Description of Artificial Sequence: Synthetic oligonucleotide
  Target: SCN10A; (+) strand; PAM type: YTN; PAM sequence: TTC
tgagtggcagacagctgtca

SEQ ID NO: 62834 - DNA, 20 bp, Artificial Sequence
  Description of Artificial Sequence: Synthetic oligonucleotide
  Target: SCN10A; (+) strand; PAM type: YTN; PAM sequence: CTG
agtggcagacagctgtcaca

SEQ ID NO: 62835 - DNA, 20 bp, Artificial Sequence
  Description of Artificial Sequence: Synthetic oligonucleotide
  Target: SCN10A; (+) strand; PAM type: YTN; PAM sequence: CTG
tcacagagttcatgctctct

SEQ ID NO: 62836 - DNA, 20 bp, Artificial Sequence
  Description of Artificial Sequence: Synthetic oligonucleotide
  Target: SCN10A; (+) strand; PAM type: YTN; PAM sequence: TTC
atgctctctgctgttaccta

SEQ ID NO: 62837 - DNA, 20 bp, Artificial Sequence
  Description of Artificial Sequence: Synthetic oligonucleotide
  Target: SCN10A; (+) strand; PAM type: YTN; PAM sequence: CTC
tctgctgttacctagacaaa

SEQ ID NO: 62838 - DNA, 20 bp, Artificial Sequence
  Description of Artificial Sequence: Synthetic oligonucleotide
  Target: SCN10A; (+) strand; PAM type: YTN; PAM sequence: CTC
tgctgttacctagacaaagg

SEQ ID NO: 62839 - DNA, 20 bp, Artificial Sequence
  Description of Artificial Sequence: Synthetic oligonucleotide
  Target: SCN10A; (+) strand; PAM type: YTN; PAM sequence: CTG
ctgttacctagacaaaggca

SEQ ID NO: 62840 - DNA, 20 bp, Artificial Sequence
  Description of Artificial Sequence: Synthetic oligonucleotide
  Target: SCN10A; (+) strand; PAM type: YTN; PAM sequence: CTG
ttacctagacaaaggcatgt

SEQ ID NO: 62841 - DNA, 20 bp, Artificial Sequence
  Description of Artificial Sequence: Synthetic oligonucleotide
  Target: SCN10A; (+) strand; PAM type: YTN; PAM sequence: TTA
cctagacaaaggcatgtaaa

SEQ ID NO: 62842 - DNA, 20 bp, Artificial Sequence
  Description of Artificial Sequence: Synthetic oligonucleotide
  Target: SCN10A; (+) strand; PAM type: YTN; PAM sequence: CTA
gacaaaggcatgtaaaatat

SEQ ID NO: 62843 - DNA, 20 bp, Artificial Sequence
  Description of Artificial Sequence: Synthetic oligonucleotide
  Target: SCN10A; (+) strand; PAM type: YTN; PAM sequence: CTG
ataacagcagctgctggaac

SEQ ID NO: 62844 - DNA, 20 bp, Artificial Sequence
  Description of Artificial Sequence: Synthetic oligonucleotide
  Target: SCN10A; (+) strand; PAM type: YTN; PAM sequence: CTG
ctggaacacaagtgacgact

SEQ ID NO: 62845 - DNA, 20 bp, Artificial Sequence
  Description of Artificial Sequence: Synthetic oligonucleotide
  Target: SCN10A; (+) strand; PAM type: YTN; PAM sequence: CTG
gaacacaagtgacgactgca

SEQ ID NO: 62846 - DNA, 20 bp, Artificial Sequence
  Description of Artificial Sequence: Synthetic oligonucleotide
  Target: SCN10A; (+) strand; PAM type: YTN; PAM sequence: CTG
cagggaagaaggctatggga

SEQ ID NO: 62847 - DNA, 20 bp, Artificial Sequence
  Description of Artificial Sequence: Synthetic oligonucleotide
  Target: SCN10A; (+) strand; PAM type: YTN; PAM sequence: CTA
tgggagagctacagactcaa

SEQ ID NO: 62848 - DNA, 20 bp, Artificial Sequence
  Description of Artificial Sequence: Synthetic oligonucleotide
  Target: SCN10A; (+) strand; PAM type: YTN; PAM sequence: CTA
cagactcaaagcacagcttt

SEQ ID NO: 62849 - DNA, 20 bp, Artificial Sequence
  Description of Artificial Sequence: Synthetic oligonucleotide
  Target: SCN10A; (+) strand; PAM type: YTN; PAM sequence: CTC
aaagcacagcttttctggac

SEQ ID NO: 62850 - DNA, 20 bp, Artificial Sequence
  Description of Artificial Sequence: Synthetic oligonucleotide
  Target: SCN10A; (+) strand; PAM type: YTN; PAM sequence: CTT
ttctggaccacttagtaacc

SEQ ID NO: 62851 - DNA, 20 bp, Artificial Sequence
  Description of Artificial Sequence: Synthetic oligonucleotide
  Target: SCN10A; (+) strand; PAM type: YTN; PAM sequence: TTT
tctggaccacttagtaacct

SEQ ID NO: 62852 - DNA, 20 bp, Artificial Sequence
  Description of Artificial Sequence: Synthetic oligonucleotide
  Target: SCN10A; (+) strand; PAM type: YTN; PAM sequence: TTT
ctggaccacttagtaacctg

SEQ ID NO: 62853 - DNA, 20 bp, Artificial Sequence
  Description of Artificial Sequence: Synthetic oligonucleotide
  Target: SCN10A; (+) strand; PAM type: YTN; PAM sequence: TTC
tggaccacttagtaacctgg

SEQ ID NO: 62854 - DNA, 20 bp, Artificial Sequence
  Description of Artificial Sequence: Synthetic oligonucleotide
  Target: SCN10A; (+) strand; PAM type: YTN; PAM sequence: CTG
gaccacttagtaacctggcc

SEQ ID NO: 62855 - DNA, 20 bp, Artificial Sequence
  Description of Artificial Sequence: Synthetic oligonucleotide
  Target: SCN10A; (+) strand; PAM type: YTN; PAM sequence: CTT
agtaacctggccagcagccc

SEQ ID NO: 62856 - DNA, 20 bp, Artificial Sequence
  Description of Artificial Sequence: Synthetic oligonucleotide
  Target: SCN10A; (+) strand; PAM type: YTN; PAM sequence: TTA
gtaacctggccagcagccct

SEQ ID NO: 62857 - DNA, 20 bp, Artificial Sequence
  Description of Artificial Sequence: Synthetic oligonucleotide
  Target: SCN10A; (+) strand; PAM type: YTN; PAM sequence: CTG
gccagcagccctgcatgttc

SEQ ID NO: 62858 - DNA, 20 bp, Artificial Sequence
  Description of Artificial Sequence: Synthetic oligonucleotide
  Target: SCN10A; (+) strand; PAM type: YTN; PAM sequence: CTG
catgttcctgaggcctcaca

SEQ ID NO: 62859 - DNA, 20 bp, Artificial Sequence
  Description of Artificial Sequence: Synthetic oligonucleotide
  Target: SCN10A; (+) strand; PAM type: YTN; PAM sequence: TTC
ctgaggcctcacagggttcc

SEQ ID NO: 62860 - DNA, 20 bp, Artificial Sequence
  Description of Artificial Sequence: Synthetic oligonucleotide
  Target: SCN10A; (+) strand; PAM type: YTN; PAM sequence: CTG
aggcctcacagggttccctg

SEQ ID NO: 62861 - DNA, 20 bp, Artificial Sequence
  Description of Artificial Sequence: Synthetic oligonucleotide
  Target: SCN10A; (+) strand; PAM type: YTN; PAM sequence: CTC
acagggttccctgccttccc

SEQ ID NO: 62862 - DNA, 20 bp, Artificial Sequence
  Description of Artificial Sequence: Synthetic oligonucleotide
  Target: SCN10A; (+) strand; PAM type: YTN; PAM sequence: TTC
cctgccttcccacgttgggc

SEQ ID NO: 62863 - DNA, 20 bp, Artificial Sequence
  Description of Artificial Sequence: Synthetic oligonucleotide
  Target: SCN10A; (+) strand; PAM type: YTN; PAM sequence: CTG
ccttcccacgttgggcagag

SEQ ID NO: 62864 - DNA, 20 bp, Artificial Sequence
  Description of Artificial Sequence: Synthetic oligonucleotide
  Target: SCN10A; (+) strand; PAM type: YTN; PAM sequence: CTT
cccacgttgggcagaggtga

SEQ ID NO: 62865 - DNA, 20 bp, Artificial Sequence
  Description of Artificial Sequence: Synthetic oligonucleotide
  Target: SCN10A; (+) strand; PAM type: YTN; PAM sequence: TTC
ccacgttgggcagaggtgaa

SEQ ID NO: 62866 - DNA, 20 bp, Artificial Sequence
  Description of Artificial Sequence: Synthetic oligonucleotide
  Target: SCN10A; (+) strand; PAM type: YTN; PAM sequence: TTG
ggcagaggtgaatgccctga

SEQ ID NO: 62867 - DNA, 20 bp, Artificial Sequence
  Description of Artificial Sequence: Synthetic oligonucleotide
  Target: SCN10A; (+) strand; PAM type: YTN; PAM sequence: CTG
agttactgagaagaggttag

SEQ ID NO: 62868 - DNA, 20 bp, Artificial Sequence
  Description of Artificial Sequence: Synthetic oligonucleotide
  Target: SCN10A; (+) strand; PAM type: YTN; PAM sequence: TTA
ctgagaagaggttagcgagg

SEQ ID NO: 62869 - DNA, 20 bp, Artificial Sequence
  Description of Artificial Sequence: Synthetic oligonucleotide
  Target: SCN10A; (+) strand; PAM type: YTN; PAM sequence: CTG
agaagaggttagcgagggtt

SEQ ID NO: 62870 - DNA, 20 bp, Artificial Sequence
  Description of Artificial Sequence: Synthetic oligonucleotide
  Target: SCN10A; (+) strand; PAM type: YTN; PAM sequence: TTA
gcgagggttgatataccagc

SEQ ID NO: 62871 - DNA, 20 bp, Artificial Sequence
  Description of Artificial Sequence: Synthetic oligonucleotide
  Target: SCN10A; (+) strand; PAM type: YTN; PAM sequence: TTG
atataccagcttaaggtagt

SEQ ID NO: 62872 - DNA, 20 bp, Artificial Sequence
  Description of Artificial Sequence: Synthetic oligonucleotide
  Target: SCN10A; (+) strand; PAM type: YTN; PAM sequence: CTT
aaggtagtaaggaatagtgc

SEQ ID NO: 62873 - DNA, 20 bp, Artificial Sequence
  Description of Artificial Sequence: Synthetic oligonucleotide
  Target: SCN10A; (+) strand; PAM type: YTN; PAM sequence: TTA
aggtagtaaggaatagtgcc

SEQ ID NO: 62874 - DNA, 20 bp, Artificial Sequence
  Description of Artificial Sequence: Synthetic oligonucleotide
  Target: SCN10A; (+) strand; PAM type: YTN; PAM sequence: TTT
aaaaatatatattatcaaat

SEQ ID NO: 62875 - DNA, 20 bp, Artificial Sequence
  Description of Artificial Sequence: Synthetic oligonucleotide
  Target: SCN10A; (+) strand; PAM type: YTN; PAM sequence: TTA
aaaatatatattatcaaatg

SEQ ID NO: 62876 - DNA, 20 bp, Artificial Sequence
  Description of Artificial Sequence: Synthetic oligonucleotide
  Target: SCN10A; (+) strand; PAM type: YTN; PAM sequence: TTA
tcaaatggctcaaatgtgct

SEQ ID NO: 62877 - DNA, 20 bp, Artificial Sequence
  Description of Artificial Sequence: Synthetic oligonucleotide
  Target: SCN10A; (+) strand; PAM type: YTN; PAM sequence: CTC
aaatgtgctttaaattagtt

SEQ ID NO: 62878 - DNA, 20 bp, Artificial Sequence
  Description of Artificial Sequence: Synthetic oligonucleotide
  Target: SCN10A; (+) strand; PAM type: YTN; PAM sequence: CTT
taaattagttggtgccaaaa

SEQ ID NO: 62879 - DNA, 20 bp, Artificial Sequence
  Description of Artificial Sequence: Synthetic oligonucleotide
  Target: SCN10A; (+) strand; PAM type: YTN; PAM sequence: TTT
aaattagttggtgccaaaag

SEQ ID NO: 62880 - DNA, 20 bp, Artificial Sequence
  Description of Artificial Sequence: Synthetic oligonucleotide
  Target: SCN10A; (+) strand; PAM type: YTN; PAM sequence: TTA
aattagttggtgccaaaagg

SEQ ID NO: 62881 - DNA, 20 bp, Artificial Sequence
  Description of Artificial Sequence: Synthetic oligonucleotide
  Target: SCN10A; (+) strand; PAM type: YTN; PAM sequence: TTA
gttggtgccaaaaggagcgt

SEQ ID NO: 62882 - DNA, 20 bp, Artificial Sequence
  Description of Artificial Sequence: Synthetic oligonucleotide
  Target: SCN10A; (+) strand; PAM type: YTN; PAM sequence: TTG
gtgccaaaaggagcgtgtca

SEQ ID NO: 62883 - DNA, 20 bp, Artificial Sequence
  Description of Artificial Sequence: Synthetic oligonucleotide
  Target: SCN10A; (+) strand; PAM type: YTN; PAM sequence: TTT
ccctgtgataccacttgtgg

SEQ ID NO: 62884 - DNA, 20 bp, Artificial Sequence
  Description of Artificial Sequence: Synthetic oligonucleotide
  Target: SCN10A; (+) strand; PAM type: YTN; PAM sequence: TTC
cctgtgataccacttgtggg

SEQ ID NO: 62885 - DNA, 20 bp, Artificial Sequence
  Description of Artificial Sequence: Synthetic oligonucleotide
  Target: SCN10A; (+) strand; PAM type: YTN; PAM sequence: CTG
tgataccacttgtggggaaa

SEQ ID NO: 62886 - DNA, 20 bp, Artificial Sequence
  Description of Artificial Sequence: Synthetic oligonucleotide
  Target: SCN10A; (+) strand; PAM type: YTN; PAM sequence: CTT
gtggggaaaagctggctaaa

SEQ ID NO: 62887 - DNA, 20 bp, Artificial Sequence
  Description of Artificial Sequence: Synthetic oligonucleotide
  Target: SCN10A; (+) strand; PAM type: YTN; PAM sequence: TTG
tggggaaaagctggctaaat

SEQ ID NO: 62888 - DNA, 20 bp, Artificial Sequence
  Description of Artificial Sequence: Synthetic oligonucleotide
  Target: SCN10A; (+) strand; PAM type: YTN; PAM sequence: CTG
gctaaatgagtcacataaga

SEQ ID NO: 62889 - DNA, 20 bp, Artificial Sequence
  Description of Artificial Sequence: Synthetic oligonucleotide
  Target: SCN10A; (+) strand; PAM type: YTN; PAM sequence: CTA
aatgagtcacataagaatca

SEQ ID NO: 62890 - DNA, 20 bp, Artificial Sequence
  Description of Artificial Sequence: Synthetic oligonucleotide
  Target: SCN10A; (+) strand; PAM type: YTN; PAM sequence: CTT
cttaggatgctggtaaagat

SEQ ID NO: 62891 - DNA, 20 bp, Artificial Sequence
  Description of Artificial Sequence: Synthetic oligonucleotide
  Target: SCN10A; (+) strand; PAM type: YTN; PAM sequence: TTC
ttaggatgctggtaaagatt

SEQ ID NO: 62892 - DNA, 20 bp, Artificial Sequence
  Description of Artificial Sequence: Synthetic oligonucleotide
  Target: SCN10A; (+) strand; PAM type: YTN; PAM sequence: CTT
aggatgctggtaaagattag

SEQ ID NO: 62893 - DNA, 20 bp, Artificial Sequence
  Description of Artificial Sequence: Synthetic oligonucleotide
  Target: SCN10A; (+) strand; PAM type: YTN; PAM sequence: TTA
ggatgctggtaaagattaga

SEQ ID NO: 62894 - DNA, 20 bp, Artificial Sequence
  Description of Artificial Sequence: Synthetic oligonucleotide
  Target: SCN10A; (+) strand; PAM type: YTN; PAM sequence: CTG
gtaaagattagatgagcctt

SEQ ID NO: 62895 - DNA, 20 bp, Artificial Sequence
  Description of Artificial Sequence: Synthetic oligonucleotide
  Target: SCN10A; (+) strand; PAM type: YTN; PAM sequence: TTA
gatgagccttgctcttggac

SEQ ID NO: 62896 - DNA, 20 bp, Artificial Sequence
  Description of Artificial Sequence: Synthetic oligonucleotide
  Target: SCN10A; (+) strand; PAM type: YTN; PAM sequence: CTT
gctcttggacaacatcctgt

SEQ ID NO: 62897 - DNA, 20 bp, Artificial Sequence
  Description of Artificial Sequence: Synthetic oligonucleotide
  Target: SCN10A; (+) strand; PAM type: YTN; PAM sequence: TTG
ctcttggacaacatcctgtt

SEQ ID NO: 62898 - DNA, 20 bp, Artificial Sequence
  Description of Artificial Sequence: Synthetic oligonucleotide
  Target: SCN10A; (+) strand; PAM type: YTN; PAM sequence: CTC
ttggacaacatcctgttctt

SEQ ID NO: 62899 - DNA, 20 bp, Artificial Sequence
  Description of Artificial Sequence: Synthetic oligonucleotide
  Target: SCN10A; (+) strand; PAM type: YTN; PAM sequence: CTT
ggacaacatcctgttcttag

SEQ ID NO: 62900 - DNA, 20 bp, Artificial Sequence
  Description of Artificial Sequence: Synthetic oligonucleotide
  Target: SCN10A; (+) strand; PAM type: YTN; PAM sequence: TTG
gacaacatcctgttcttaga

SEQ ID NO: 62901 - DNA, 20 bp, Artificial Sequence
  Description of Artificial Sequence: Synthetic oligonucleotide
  Target: SCN10A; (+) strand; PAM type: YTN; PAM sequence: CTG
ttcttagagaaatctcatta

SEQ ID NO: 62902 - DNA, 20 bp, Artificial Sequence
  Description of Artificial Sequence: Synthetic oligonucleotide
  Target: SCN10A; (+) strand; PAM type: YTN; PAM sequence: TTC
ttagagaaatctcattagca

SEQ ID NO: 62903 - DNA, 20 bp, Artificial Sequence
  Description of Artificial Sequence: Synthetic oligonucleotide
  Target: SCN10A; (+) strand; PAM type: YTN; PAM sequence: CTT
agagaaatctcattagcatc

SEQ ID NO: 62904 - DNA, 20 bp, Artificial Sequence
  Description of Artificial Sequence: Synthetic oligonucleotide
  Target: SCN10A; (+) strand; PAM type: YTN; PAM sequence: TTA
gagaaatctcattagcatct

SEQ ID NO: 62905 - DNA, 20 bp, Artificial Sequence
  Description of Artificial Sequence: Synthetic oligonucleotide
  Target: SCN10A; (+) strand; PAM type: YTN; PAM sequence: CTC
attagcatctcatgcacaga

SEQ ID NO: 62906 - DNA, 20 bp, Artificial Sequence
  Description of Artificial Sequence: Synthetic oligonucleotide
  Target: SCN10A; (+) strand; PAM type: YTN; PAM sequence: TTA
gcatctcatgcacagagcct

SEQ ID NO: 62907 - DNA, 20 bp, Artificial Sequence
  Description of Artificial Sequence: Synthetic oligonucleotide
  Target: SCN10A; (+) strand; PAM type: YTN; PAM sequence: CTC
atgcacagagcctgggttgg

SEQ ID NO: 62908 - DNA, 20 bp, Artificial Sequence
  Description of Artificial Sequence: Synthetic oligonucleotide
  Target: SCN10A; (+) strand; PAM type: YTN; PAM sequence: CTG
ggttgggcagagcgcatggg

SEQ ID NO: 62909 - DNA, 20 bp, Artificial Sequence
  Description of Artificial Sequence: Synthetic oligonucleotide
  Target: SCN10A; (+) strand; PAM type: YTN; PAM sequence: TTG
ggcagagcgcatgggacagc

SEQ ID NO: 62910 - DNA, 20 bp, Artificial Sequence
  Description of Artificial Sequence: Synthetic oligonucleotide
  Target: SCN10A; (+) strand; PAM type: YTN; PAM sequence: CTG
tgtgaaagacaatccccaag

SEQ ID NO: 62911 - DNA, 20 bp, Artificial Sequence
  Description of Artificial Sequence: Synthetic oligonucleotide
  Target: SCN10A; (+) strand; PAM type: YTN; PAM sequence: CTC
aaggtggccttttgctcacc

SEQ ID NO: 62912 - DNA, 20 bp, Artificial Sequence
  Description of Artificial Sequence: Synthetic oligonucleotide
  Target: SCN10A; (+) strand; PAM type: YTN; PAM sequence: CTT
ttgctcacctgctgcccccc

SEQ ID NO: 62913 - DNA, 20 bp, Artificial Sequence
  Description of Artificial Sequence: Synthetic oligonucleotide
  Target: SCN10A; (+) strand; PAM type: YTN; PAM sequence: TTT
tgctcacctgctgcccccca

SEQ ID NO: 62914 - DNA, 20 bp, Artificial Sequence
  Description of Artificial Sequence: Synthetic oligonucleotide
  Target: SCN10A; (+) strand; PAM type: YTN; PAM sequence: TTT
gctcacctgctgccccccac

SEQ ID NO: 62915 - DNA, 20 bp, Artificial Sequence
  Description of Artificial Sequence: Synthetic oligonucleotide
  Target: SCN10A; (+) strand; PAM type: YTN; PAM sequence: TTG
ctcacctgctgccccccact

SEQ ID NO: 62916 - DNA, 20 bp, Artificial Sequence
  Description of Artificial Sequence: Synthetic oligonucleotide
  Target: SCN10A; (+) strand; PAM type: YTN; PAM sequence: CTC
acctgctgccccccactccc

SEQ ID NO: 62917 - DNA, 20 bp, Artificial Sequence
  Description of Artificial Sequence: Synthetic oligonucleotide
  Target: SCN10A; (+) strand; PAM type: YTN; PAM sequence: CTG
ctgccccccactccctgttt

SEQ ID NO: 62918 - DNA, 20 bp, Artificial Sequence
  Description of Artificial Sequence: Synthetic oligonucleotide
  Target: SCN10A; (+) strand; PAM type: YTN; PAM sequence: CTG
ccccccactccctgtttgtc

SEQ ID NO: 62919 - DNA, 20 bp, Artificial Sequence
  Description of Artificial Sequence: Synthetic oligonucleotide
  Target: SCN10A; (+) strand; PAM type: YTN; PAM sequence: CTC
cctgtttgtctgcctgggga

SEQ ID NO: 62920 - DNA, 20 bp, Artificial Sequence
  Description of Artificial Sequence: Synthetic oligonucleotide
  Target: SCN10A; (+) strand; PAM type: YTN; PAM sequence: CTG
tttgtctgcctggggaattc

SEQ ID NO: 62921 - DNA, 20 bp, Artificial Sequence
  Description of Artificial Sequence: Synthetic oligonucleotide
  Target: SCN10A; (+) strand; PAM type: YTN; PAM sequence: TTT
gtctgcctggggaattctga

SEQ ID NO: 62922 - DNA, 20 bp, Artificial Sequence
  Description of Artificial Sequence: Synthetic oligonucleotide
  Target: SCN10A; (+) strand; PAM type: YTN; PAM sequence: TTG
tctgcctggggaattctgac

SEQ ID NO: 62923 - DNA, 20 bp, Artificial Sequence
  Description of Artificial Sequence: Synthetic oligonucleotide
  Target: SCN10A; (+) strand; PAM type: YTN; PAM sequence: CTG
cctggggaattctgactttt

SEQ ID NO: 62924 - DNA, 20 bp, Artificial Sequence
  Description of Artificial Sequence: Synthetic oligonucleotide
  Target: SCN10A; (+) strand; PAM type: YTN; PAM sequence: CTG
gggaattctgactttttctt

SEQ ID NO: 62925 - DNA, 20 bp, Artificial Sequence
  Description of Artificial Sequence: Synthetic oligonucleotide
  Target: SCN10A; (+) strand; PAM type: YTN; PAM sequence: TTC
tgactttttcttccaggccc

SEQ ID NO: 62926 - DNA, 20 bp, Artificial Sequence
  Description of Artificial Sequence: Synthetic oligonucleotide
  Target: SCN10A; (+) strand; PAM type: YTN; PAM sequence: CTG
actttttcttccaggccctg

SEQ ID NO: 62927 - DNA, 20 bp, Artificial Sequence
  Description of Artificial Sequence: Synthetic oligonucleotide
  Target: SCN10A; (+) strand; PAM type: YTN; PAM sequence: CTT
tttcttccaggccctgctca

SEQ ID NO: 62928 - DNA, 20 bp, Artificial Sequence
  Description of Artificial Sequence: Synthetic oligonucleotide
  Target: SCN10A; (+) strand; PAM type: YTN; PAM sequence: TTT
ttcttccaggccctgctcaa

SEQ ID NO: 62929 - DNA, 20 bp, Artificial Sequence
  Description of Artificial Sequence: Synthetic oligonucleotide
  Target: SCN10A; (+) strand; PAM type: YTN; PAM sequence: TTT
tcttccaggccctgctcaaa

SEQ ID NO: 62930 - DNA, 20 bp, Artificial Sequence
  Description of Artificial Sequence: Synthetic oligonucleotide
  Target: SCN10A; (+) strand; PAM type: YTN; PAM sequence: TTT
cttccaggccctgctcaaac

SEQ ID NO: 62931 - DNA, 20 bp, Artificial Sequence
  Description of Artificial Sequence: Synthetic oligonucleotide
  Target: SCN10A; (+) strand; PAM type: YTN; PAM sequence: TTC
ttccaggccctgctcaaacg

SEQ ID NO: 62932 - DNA, 20 bp, Artificial Sequence
  Description of Artificial Sequence: Synthetic oligonucleotide
  Target: SCN10A; (+) strand; PAM type: YTN; PAM sequence: CTT
ccaggccctgctcaaacgcc

SEQ ID NO: 62933 - DNA, 20 bp, Artificial Sequence
  Description of Artificial Sequence: Synthetic oligonucleotide
  Target: SCN10A; (+) strand; PAM type: YTN; PAM sequence: TTC
caggccctgctcaaacgcca

SEQ ID NO: 62934 - DNA, 20 bp, Artificial Sequence
  Description of Artificial Sequence: Synthetic oligonucleotide
  Target: SCN10A; (+) strand; PAM type: YTN; PAM sequence: CTG
ctcaaacgccaactcctctg

SEQ ID NO: 62935 - DNA, 20 bp, Artificial Sequence
  Description of Artificial Sequence: Synthetic oligonucleotide
  Target: SCN10A; (+) strand; PAM type: YTN; PAM sequence: CTC
aaacgccaactcctctggaa

SEQ ID NO: 62936 - DNA, 20 bp, Artificial Sequence
  Description of Artificial Sequence: Synthetic oligonucleotide
  Target: SCN10A; (+) strand; PAM type: YTN; PAM sequence: CTC
ctctggaaagcttggcatgg

SEQ ID NO: 62937 - DNA, 20 bp, Artificial Sequence
  Description of Artificial Sequence: Synthetic oligonucleotide
  Target: SCN10A; (+) strand; PAM type: YTN; PAM sequence: CTC
tggaaagcttggcatggttt

SEQ ID NO: 62938 - DNA, 20 bp, Artificial Sequence
  Description of Artificial Sequence: Synthetic oligonucleotide
  Target: SCN10A; (+) strand; PAM type: YTN; PAM sequence: CTG
gaaagcttggcatggtttaa

SEQ ID NO: 62939 - DNA, 20 bp, Artificial Sequence
  Description of Artificial Sequence: Synthetic oligonucleotide
  Target: SCN10A; (+) strand; PAM type: YTN; PAM sequence: CTT
ggcatggtttaaacttcttt

SEQ ID NO: 62940 - DNA, 20 bp, Artificial Sequence
  Description of Artificial Sequence: Synthetic oligonucleotide
  Target: SCN10A; (+) strand; PAM type: YTN; PAM sequence: TTG
gcatggtttaaacttcttta

SEQ ID NO: 62941 - DNA, 20 bp, Artificial Sequence
  Description of Artificial Sequence: Synthetic oligonucleotide
  Target: SCN10A; (+) strand; PAM type: YTN; PAM sequence: TTT
aaacttctttatgtcaaggt

SEQ ID NO: 62942 - DNA, 20 bp, Artificial Sequence
  Description of Artificial Sequence: Synthetic oligonucleotide
  Target: SCN10A; (+) strand; PAM type: YTN; PAM sequence: TTA
aacttctttatgtcaaggtc

SEQ ID NO: 62943 - DNA, 20 bp, Artificial Sequence
  Description of Artificial Sequence: Synthetic oligonucleotide
  Target: SCN10A; (+) strand; PAM type: YTN; PAM sequence: CTT
ctttatgtcaaggtctcctc

SEQ ID NO: 62944 - DNA, 20 bp, Artificial Sequence
  Description of Artificial Sequence: Synthetic oligonucleotide
  Target: SCN10A; (+) strand; PAM type: YTN; PAM sequence: TTC
tttatgtcaaggtctcctct

SEQ ID NO: 62945 - DNA, 20 bp, Artificial Sequence
  Description of Artificial Sequence: Synthetic oligonucleotide
  Target: SCN10A; (+) strand; PAM type: YTN; PAM sequence: CTT
tatgtcaaggtctcctctgc

SEQ ID NO: 62946 - DNA, 20 bp, Artificial Sequence
  Description of Artificial Sequence: Synthetic oligonucleotide
  Target: SCN10A; (+) strand; PAM type: YTN; PAM sequence: TTT
atgtcaaggtctcctctgca

SEQ ID NO: 62947 - DNA, 20 bp, Artificial Sequence
  Description of Artificial Sequence: Synthetic oligonucleotide
  Target: SCN10A; (+) strand; PAM type: YTN; PAM sequence: TTA
tgtcaaggtctcctctgcat

SEQ ID NO: 62948 - DNA, 20 bp, Artificial Sequence
  Description of Artificial Sequence: Synthetic oligonucleotide
  Target: SCN10A; (+) strand; PAM type: YTN; PAM sequence: CTC
ctctgcatttcccttttgcc

SEQ ID NO: 62949 - DNA, 20 bp, Artificial Sequence
  Description of Artificial Sequence: Synthetic oligonucleotide
  Target: SCN10A; (+) strand; PAM type: YTN; PAM sequence: CTC
tgcatttcccttttgccctt

SEQ ID NO: 62950 - DNA, 20 bp, Artificial Sequence
  Description of Artificial Sequence: Synthetic oligonucleotide
  Target: SCN10A; (+) strand; PAM type: YTN; PAM sequence: CTG
catttcccttttgccctttg

SEQ ID NO: 62951 - DNA, 20 bp, Artificial Sequence
  Description of Artificial Sequence: Synthetic oligonucleotide
  Target: SCN10A; (+) strand; PAM type: YTN; PAM sequence: TTT
cccttttgccctttgtcact

SEQ ID NO: 62952 - DNA, 20 bp, Artificial Sequence
  Description of Artificial Sequence: Synthetic oligonucleotide
  Target: SCN10A; (+) strand; PAM type: YTN; PAM sequence: TTC
ccttttgccctttgtcactc

SEQ ID NO: 62953 - DNA, 20 bp, Artificial Sequence
  Description of Artificial Sequence: Synthetic oligonucleotide
  Target: SCN10A; (+) strand; PAM type: YTN; PAM sequence: CTT
ttgccctttgtcactcaagc

SEQ ID NO: 62954 - DNA, 20 bp, Artificial Sequence
  Description of Artificial Sequence: Synthetic oligonucleotide
  Target: SCN10A; (+) strand; PAM type: YTN; PAM sequence: TTT
tgccctttgtcactcaagcc

SEQ ID NO: 62955 - DNA, 20 bp, Artificial Sequence
  Description of Artificial Sequence: Synthetic oligonucleotide
  Target: SCN10A; (+) strand; PAM type: YTN; PAM sequence: TTT
gccctttgtcactcaagccc

SEQ ID NO: 62956 - DNA, 20 bp, Artificial Sequence
  Description of Artificial Sequence: Synthetic oligonucleotide
  Target: SCN10A; (+) strand; PAM type: YTN; PAM sequence: TTG
ccctttgtcactcaagccct

SEQ ID NO: 62957 - DNA, 20 bp, Artificial Sequence
  Description of Artificial Sequence: Synthetic oligonucleotide
  Target: SCN10A; (+) strand; PAM type: YTN; PAM sequence: CTT
tgtcactcaagccctgaagc

SEQ ID NO: 62958 - DNA, 20 bp, Artificial Sequence
  Description of Artificial Sequence: Synthetic oligonucleotide
  Target: SCN10A; (+) strand; PAM type: YTN; PAM sequence: TTT
gtcactcaagccctgaagcc

SEQ ID NO: 62959 - DNA, 20 bp, Artificial Sequence
  Description of Artificial Sequence: Synthetic oligonucleotide
  Target: SCN10A; (+) strand; PAM type: YTN; PAM sequence: TTG
tcactcaagccctgaagccc

SEQ ID NO: 62960 - DNA, 20 bp, Artificial Sequence
  Description of Artificial Sequence: Synthetic oligonucleotide
  Target: SCN10A; (+) strand; PAM type: YTN; PAM sequence: CTC
aagccctgaagcccctcccc

SEQ ID NO: 62961 - DNA, 20 bp, Artificial Sequence
  Description of Artificial Sequence: Synthetic oligonucleotide
  Target: SCN10A; (+) strand; PAM type: YTN; PAM sequence: CTG
aagcccctccccactgcctg

SEQ ID NO: 62962 - DNA, 20 bp, Artificial Sequence
  Description of Artificial Sequence: Synthetic oligonucleotide
  Target: SCN10A; (+) strand; PAM type: YTN; PAM sequence: CTC
cccactgcctgtggctgtcc

SEQ ID NO: 62963 - DNA, 20 bp, Artificial Sequence
  Description of Artificial Sequence: Synthetic oligonucleotide
  Target: SCN10A; (+) strand; PAM type: YTN; PAM sequence: CTG
cctgtggctgtcccttgggg

SEQ ID NO: 62964 - DNA, 20 bp, Artificial Sequence
  Description of Artificial Sequence: Synthetic oligonucleotide
  Target: SCN10A; (+) strand; PAM type: YTN; PAM sequence: CTG
tggctgtcccttggggataa

SEQ ID NO: 62965 - DNA, 20 bp, Artificial Sequence
  Description of Artificial Sequence: Synthetic oligonucleotide
  Target: SCN10A; (+) strand; PAM type: YTN; PAM sequence: CTG
tcccttggggataactctta

SEQ ID NO: 62966 - DNA, 20 bp, Artificial Sequence
  Description of Artificial Sequence: Synthetic oligonucleotide
  Target: SCN10A; (+) strand; PAM type: YTN; PAM sequence: CTT
ggggataactcttacctgtc

SEQ ID NO: 62967 - DNA, 20 bp, Artificial Sequence
  Description of Artificial Sequence: Synthetic oligonucleotide
  Target: SCN10A; (+) strand; PAM type: YTN; PAM sequence: TTG
gggataactcttacctgtcc

SEQ ID NO: 62968 - DNA, 20 bp, Artificial Sequence
  Description of Artificial Sequence: Synthetic oligonucleotide
  Target: SCN10A; (+) strand; PAM type: YTN; PAM sequence: CTC
ttacctgtcctttggggatc

SEQ ID NO: 62969 - DNA, 20 bp, Artificial Sequence
  Description of Artificial Sequence: Synthetic oligonucleotide
  Target: SCN10A; (+) strand; PAM type: YTN; PAM sequence: CTT
acctgtcctttggggatcac

SEQ ID NO: 62970 - DNA, 20 bp, Artificial Sequence
  Description of Artificial Sequence: Synthetic oligonucleotide
  Target: SCN10A; (+) strand; PAM type: YTN; PAM sequence: TTA
cctgtcctttggggatcact

SEQ ID NO: 62971 - DNA, 20 bp, Artificial Sequence
  Description of Artificial Sequence: Synthetic oligonucleotide
  Target: SCN10A; (+) strand; PAM type: YTN; PAM sequence: CTG
tcctttggggatcacttcct

SEQ ID NO: 62972 - DNA, 20 bp, Artificial Sequence
  Description of Artificial Sequence: Synthetic oligonucleotide
  Target: SCN10A; (+) strand; PAM type: YTN; PAM sequence: CTT
tggggatcacttcctgctgg

SEQ ID NO: 62973 - DNA, 20 bp, Artificial Sequence
  Description of Artificial Sequence: Synthetic oligonucleotide
  Target: SCN10A; (+) strand; PAM type: YTN; PAM sequence: TTT
ggggatcacttcctgctgga

SEQ ID NO: 62974 - DNA, 20 bp, Artificial Sequence
  Description of Artificial Sequence: Synthetic oligonucleotide
  Target: SCN10A; (+) strand; PAM type: YTN; PAM sequence: TTG
gggatcacttcctgctggaa

SEQ ID NO: 62975 - DNA, 20 bp, Artificial Sequence
  Description of Artificial Sequence: Synthetic oligonucleotide
  Target: SCN10A; (+) strand; PAM type: YTN; PAM sequence: CTT
cctgctggaagctctgagca

SEQ ID NO: 62976 - DNA, 20 bp, Artificial Sequence
  Description of Artificial Sequence: Synthetic oligonucleotide
  Target: SCN10A; (+) strand; PAM type: YTN; PAM sequence: TTC
ctgctggaagctctgagcat

SEQ ID NO: 62977 - DNA, 20 bp, Artificial Sequence
  Description of Artificial Sequence: Synthetic oligonucleotide
  Target: SCN10A; (+) strand; PAM type: YTN; PAM sequence: CTG
ctggaagctctgagcatctt

SEQ ID NO: 62978 - DNA, 20 bp, Artificial Sequence
  Description of Artificial Sequence: Synthetic oligonucleotide
  Target: SCN10A; (+) strand; PAM type: YTN; PAM sequence: CTG
gaagctctgagcatcttccc

SEQ ID NO: 62979 - DNA, 20 bp, Artificial Sequence
  Description of Artificial Sequence: Synthetic oligonucleotide
  Target: SCN10A; (+) strand; PAM type: YTN; PAM sequence: CTC
tgagcatcttccccaccatc

SEQ ID NO: 62980 - DNA, 20 bp, Artificial Sequence
  Description of Artificial Sequence: Synthetic oligonucleotide
  Target: SCN10A; (+) strand; PAM type: YTN; PAM sequence: CTG
agcatcttccccaccatcat

SEQ ID NO: 62981 - DNA, 20 bp, Artificial Sequence
  Description of Artificial Sequence: Synthetic oligonucleotide
  Target: SCN10A; (+) strand; PAM type: YTN; PAM sequence: CTT
ccccaccatcatcctccaag

SEQ ID NO: 62982 - DNA, 20 bp, Artificial Sequence
  Description of Artificial Sequence: Synthetic oligonucleotide
  Target: SCN10A; (+) strand; PAM type: YTN; PAM sequence: TTC
cccaccatcatcctccaagt

SEQ ID NO: 62983 - DNA, 20 bp, Artificial Sequence
  Description of Artificial Sequence: Synthetic oligonucleotide
  Target: SCN10A; (+) strand; PAM type: YTN; PAM sequence: CTC
caagtcatcaagatcagatt

SEQ ID NO: 62984 - DNA, 20 bp, Artificial Sequence
  Description of Artificial Sequence: Synthetic oligonucleotide
  Target: SCN10A; (+) strand; PAM type: YTN; PAM sequence: TTC
accctcagcaatgggcacag

SEQ ID NO: 62985 - DNA, 20 bp, Artificial Sequence
  Description of Artificial Sequence: Synthetic oligonucleotide
  Target: SCN10A; (+) strand; PAM type: YTN; PAM sequence: CTC
agcaatgggcacagagaccc

SEQ ID NO: 62986 - DNA, 20 bp, Artificial Sequence
  Description of Artificial Sequence: Synthetic oligonucleotide
  Target: SCN10A; (+) strand; PAM type: YTN; PAM sequence: TTA
gcgatgaagtcactgtgctc

SEQ ID NO: 62987 - DNA, 20 bp, Artificial Sequence
  Description of Artificial Sequence: Synthetic oligonucleotide
  Target: SCN10A; (+) strand; PAM type: YTN; PAM sequence: CTG
tgctcatccctggggcctct

SEQ ID NO: 62988 - DNA, 20 bp, Artificial Sequence
  Description of Artificial Sequence: Synthetic oligonucleotide
  Target: SCN10A; (+) strand; PAM type: YTN; PAM sequence: CTC
atccctggggcctctgggag

SEQ ID NO: 62989 - DNA, 20 bp, Artificial Sequence
  Description of Artificial Sequence: Synthetic oligonucleotide
  Target: SCN10A; (+) strand; PAM type: YTN; PAM sequence: CTG
gggcctctgggagcttggag

SEQ ID NO: 62990 - DNA, 20 bp, Artificial Sequence
  Description of Artificial Sequence: Synthetic oligonucleotide
  Target: SCN10A; (+) strand; PAM type: YTN; PAM sequence: CTC
tgggagcttggagccctcca

SEQ ID NO: 62991 - DNA, 20 bp, Artificial Sequence
  Description of Artificial Sequence: Synthetic oligonucleotide
  Target: SCN10A; (+) strand; PAM type: YTN; PAM sequence: CTG
ggagcttggagccctccaga

SEQ ID NO: 62992 - DNA, 20 bp, Artificial Sequence
  Description of Artificial Sequence: Synthetic oligonucleotide
  Target: SCN10A; (+) strand; PAM type: YTN; PAM sequence: CTT
ggagccctccagagctcccc

SEQ ID NO: 62993 - DNA, 20 bp, Artificial Sequence
  Description of Artificial Sequence: Synthetic oligonucleotide
  Target: SCN10A; (+) strand; PAM type: YTN; PAM sequence: TTG
gagccctccagagctccccc

SEQ ID NO: 62994 - DNA, 20 bp, Artificial Sequence
  Description of Artificial Sequence: Synthetic oligonucleotide
  Target: SCN10A; (+) strand; PAM type: YTN; PAM sequence: CTC
cagagctccccctggcagtg

SEQ ID NO: 62995 - DNA, 20 bp, Artificial Sequence
  Description of Artificial Sequence: Synthetic oligonucleotide
  Target: SCN10A; (+) strand; PAM type: YTN; PAM sequence: CTC
cccctggcagtgttggcagc

SEQ ID NO: 62996 - DNA, 20 bp, Artificial Sequence
  Description of Artificial Sequence: Synthetic oligonucleotide
  Target: SCN10A; (+) strand; PAM type: YTN; PAM sequence: CTG
gcagtgttggcagcaatgtg

SEQ ID NO: 62997 - DNA, 20 bp, Artificial Sequence
  Description of Artificial Sequence: Synthetic oligonucleotide
  Target: SCN10A; (+) strand; PAM type: YTN; PAM sequence: TTG
gcagcaatgtggttctcagc

SEQ ID NO: 62998 - DNA, 20 bp, Artificial Sequence
  Description of Artificial Sequence: Synthetic oligonucleotide
  Target: SCN10A; (+) strand; PAM type: YTN; PAM sequence: TTC
tcagccttggagctggagag

SEQ ID NO: 62999 - DNA, 20 bp, Artificial Sequence
  Description of Artificial Sequence: Synthetic oligonucleotide
  Target: SCN10A; (+) strand; PAM type: YTN; PAM sequence: CTC
agccttggagctggagagtg

SEQ ID NO: 63000 - DNA, 20 bp, Artificial Sequence
  Description of Artificial Sequence: Synthetic oligonucleotide
  Target: SCN10A; (+) strand; PAM type: YTN; PAM sequence: CTT
ggagctggagagtgggagtt

SEQ ID NO: 63001 - DNA, 20 bp, Artificial Sequence
  Description of Artificial Sequence: Synthetic oligonucleotide
  Target: SCN10A; (+) strand; PAM type: YTN; PAM sequence: TTG
gagctggagagtgggagttt

SEQ ID NO: 63002 - DNA, 20 bp, Artificial Sequence
  Description of Artificial Sequence: Synthetic oligonucleotide
  Target: SCN10A; (+) strand; PAM type: YTN; PAM sequence: CTG
gagagtgggagtttcaccac

SEQ ID NO: 63003 - DNA, 20 bp, Artificial Sequence
  Description of Artificial Sequence: Synthetic oligonucleotide
  Target: SCN10A; (+) strand; PAM type: YTN; PAM sequence: TTT
caccaccagctcaggctctg

SEQ ID NO: 63004 - DNA, 20 bp, Artificial Sequence
  Description of Artificial Sequence: Synthetic oligonucleotide
  Target: SCN10A; (+) strand; PAM type: YTN; PAM sequence: TTC
accaccagctcaggctctgc

SEQ ID NO: 63005 - DNA, 20 bp, Artificial Sequence
  Description of Artificial Sequence: Synthetic oligonucleotide
  Target: SCN10A; (+) strand; PAM type: YTN; PAM sequence: CTC
aggctctgccttgggctggg

SEQ ID NO: 63006 - DNA, 20 bp, Artificial Sequence
  Description of Artificial Sequence: Synthetic oligonucleotide
  Target: SCN10A; (+) strand; PAM type: YTN; PAM sequence: CTC
tgccttgggctgggggaatg

SEQ ID NO: 63007 - DNA, 20 bp, Artificial Sequence
  Description of Artificial Sequence: Synthetic oligonucleotide
  Target: SCN10A; (+) strand; PAM type: YTN; PAM sequence: CTG
ccttgggctgggggaatggg

SEQ ID NO: 63008 - DNA, 20 bp, Artificial Sequence
  Description of Artificial Sequence: Synthetic oligonucleotide
  Target: SCN10A; (+) strand; PAM type: YTN; PAM sequence: CTT
gggctgggggaatgggcagg

SEQ ID NO: 63009 - DNA, 20 bp, Artificial Sequence
  Description of Artificial Sequence: Synthetic oligonucleotide
  Target: SCN10A; (+) strand; PAM type: YTN; PAM sequence: TTG
ggctgggggaatgggcagga

SEQ ID NO: 63010 - DNA, 20 bp, Artificial Sequence
  Description of Artificial Sequence: Synthetic oligonucleotide
  Target: SCN10A; (+) strand; PAM type: YTN; PAM sequence: CTG
ggggaatgggcaggacctgc

SEQ ID NO: 63011 - DNA, 20 bp, Artificial Sequence
  Description of Artificial Sequence: Synthetic oligonucleotide
  Target: SCN10A; (+) strand; PAM type: YTN; PAM sequence: CTG
ctgaagaagctgcaaagagc

SEQ ID NO: 63012 - DNA, 20 bp, Artificial Sequence
  Description of Artificial Sequence: Synthetic oligonucleotide
  Target: SCN10A; (+) strand; PAM type: YTN; PAM sequence: CTG
aagaagctgcaaagagcctg

SEQ ID NO: 63013 - DNA, 20 bp, Artificial Sequence
  Description of Artificial Sequence: Synthetic oligonucleotide
  Target: SCN10A; (+) strand; PAM type: YTN; PAM sequence: CTG
caaagagcctgtttggtacg

SEQ ID NO: 63014 - DNA, 20 bp, Artificial Sequence
  Description of Artificial Sequence: Synthetic oligonucleotide
  Target: SCN10A; (+) strand; PAM type: YTN; PAM sequence: CTG
tttggtacgatggccaaaga

SEQ ID NO: 63015 - DNA, 20 bp, Artificial Sequence
  Description of Artificial Sequence: Synthetic oligonucleotide
  Target: SCN10A; (+) strand; PAM type: YTN; PAM sequence: TTT
ggtacgatggccaaagacct

SEQ ID NO: 63016 - DNA, 20 bp, Artificial Sequence
  Description of Artificial Sequence: Synthetic oligonucleotide
  Target: SCN10A; (+) strand; PAM type: YTN; PAM sequence: TTG
gtacgatggccaaagacctg

SEQ ID NO: 63017 - DNA, 20 bp, Artificial Sequence
  Description of Artificial Sequence: Synthetic oligonucleotide
  Target: SCN10A; (+) strand; PAM type: YTN; PAM sequence: CTG
gatccgtgccagggccacct

SEQ ID NO: 63018 - DNA, 20 bp, Artificial Sequence
  Description of Artificial Sequence: Synthetic oligonucleotide
  Target: SCN10A; (+) strand; PAM type: YTN; PAM sequence: CTG
caggttgttcacctccccat

SEQ ID NO: 63019 - DNA, 20 bp, Artificial Sequence
  Description of Artificial Sequence: Synthetic oligonucleotide
  Target: SCN10A; (+) strand; PAM type: YTN; PAM sequence: TTG
ttcacctccccatcgtcctc

SEQ ID NO: 63020 - DNA, 20 bp, Artificial Sequence
  Description of Artificial Sequence: Synthetic oligonucleotide
  Target: SCN10A; (+) strand; PAM type: YTN; PAM sequence: TTC
acctccccatcgtcctccgg

SEQ ID NO: 63021 - DNA, 20 bp, Artificial Sequence
  Description of Artificial Sequence: Synthetic oligonucleotide
  Target: SCN10A; (+) strand; PAM type: YTN; PAM sequence: CTC
cccatcgtcctccggggctg

SEQ ID NO: 63022 - DNA, 20 bp, Artificial Sequence
  Description of Artificial Sequence: Synthetic oligonucleotide
  Target: SCN10A; (+) strand; PAM type: YTN; PAM sequence: CTC
cggggctgtgaggttgtcag

SEQ ID NO: 63023 - DNA, 20 bp, Artificial Sequence
  Description of Artificial Sequence: Synthetic oligonucleotide
  Target: SCN10A; (+) strand; PAM type: YTN; PAM sequence: CTG
tgaggttgtcagcactgaaa

SEQ ID NO: 63024 - DNA, 20 bp, Artificial Sequence
  Description of Artificial Sequence: Synthetic oligonucleotide
  Target: SCN10A; (+) strand; PAM type: YTN; PAM sequence: TTG
tcagcactgaaagagttcaa

SEQ ID NO: 63025 - DNA, 20 bp, Artificial Sequence
  Description of Artificial Sequence: Synthetic oligonucleotide
  Target: SCN10A; (+) strand; PAM type: YTN; PAM sequence: CTG
aaagagttcaatagcagggc

SEQ ID NO: 63026 - DNA, 20 bp, Artificial Sequence
  Description of Artificial Sequence: Synthetic oligonucleotide
  Target: SCN10A; (+) strand; PAM type: YTN; PAM sequence: TTC
aatagcagggcgatgaacag

SEQ ID NO: 63027 - DNA, 20 bp, Artificial Sequence
  Description of Artificial Sequence: Synthetic oligonucleotide
  Target: SCN10A; (+) strand; PAM type: YTN; PAM sequence: TTA
agcacctgaagagaaggaat

SEQ ID NO: 63028 - DNA, 20 bp, Artificial Sequence
  Description of Artificial Sequence: Synthetic oligonucleotide
  Target: SCN10A; (+) strand; PAM type: YTN; PAM sequence: CTG
aagagaaggaatggaaggga

SEQ ID NO: 63029 - DNA, 20 bp, Artificial Sequence
  Description of Artificial Sequence: Synthetic oligonucleotide
  Target: SCN10A; (+) strand; PAM type: YTN; PAM sequence: TTG
atcaatctctaagctgagcc

SEQ ID NO: 63030 - DNA, 20 bp, Artificial Sequence
  Description of Artificial Sequence: Synthetic oligonucleotide
  Target: SCN10A; (+) strand; PAM type: YTN; PAM sequence: CTC
taagctgagccccacattgg

SEQ ID NO: 63031 - DNA, 20 bp, Artificial Sequence
  Description of Artificial Sequence: Synthetic oligonucleotide
  Target: SCN10A; (+) strand; PAM type: YTN; PAM sequence: CTA
agctgagccccacattggcc

SEQ ID NO: 63032 - DNA, 20 bp, Artificial Sequence
  Description of Artificial Sequence: Synthetic oligonucleotide
  Target: SCN10A; (+) strand; PAM type: YTN; PAM sequence: CTG
agccccacattggcctaccg

SEQ ID NO: 63033 - DNA, 20 bp, Artificial Sequence
  Description of Artificial Sequence: Synthetic oligonucleotide
  Target: SCN10A; (+) strand; PAM type: YTN; PAM sequence: TTG
gcctaccgggttagcagctg

SEQ ID NO: 63034 - DNA, 20 bp, Artificial Sequence
  Description of Artificial Sequence: Synthetic oligonucleotide
  Target: SCN10A; (+) strand; PAM type: YTN; PAM sequence: CTA
ccgggttagcagctggctgg

SEQ ID NO: 63035 - DNA, 20 bp, Artificial Sequence
  Description of Artificial Sequence: Synthetic oligonucleotide
  Target: SCN10A; (+) strand; PAM type: YTN; PAM sequence: TTA
gcagctggctggcaagacag

SEQ ID NO: 63036 - DNA, 20 bp, Artificial Sequence
  Description of Artificial Sequence: Synthetic oligonucleotide
  Target: SCN10A; (+) strand; PAM type: YTN; PAM sequence: CTG
gctggcaagacagccacggc

SEQ ID NO: 63037 - DNA, 20 bp, Artificial Sequence
  Description of Artificial Sequence: Synthetic oligonucleotide
  Target: SCN10A; (+) strand; PAM type: YTN; PAM sequence: CTG
gcaagacagccacggcctgg

SEQ ID NO: 63038 - DNA, 20 bp, Artificial Sequence
  Description of Artificial Sequence: Synthetic oligonucleotide
  Target: SCN10A; (+) strand; PAM type: YTN; PAM sequence: CTG
ggcctcttcctgcccacccg

SEQ ID NO: 63039 - DNA, 20 bp, Artificial Sequence
  Description of Artificial Sequence: Synthetic oligonucleotide
  Target: SCN10A; (+) strand; PAM type: YTN; PAM sequence: CTC
ttcctgcccacccgggatgc

SEQ ID NO: 63040 - DNA, 20 bp, Artificial Sequence
  Description of Artificial Sequence: Synthetic oligonucleotide
  Target: SCN10A; (+) strand; PAM type: YTN; PAM sequence: CTT
cctgcccacccgggatgctg

SEQ ID NO: 63041 - DNA, 20 bp, Artificial Sequence
  Description of Artificial Sequence: Synthetic oligonucleotide
  Target: SCN10A; (+) strand; PAM type: YTN; PAM sequence: TTC
ctgcccacccgggatgctgt

SEQ ID NO: 63042 - DNA, 20 bp, Artificial Sequence
  Description of Artificial Sequence: Synthetic oligonucleotide
  Target: SCN10A; (+) strand; PAM type: YTN; PAM sequence: CTG
cccacccgggatgctgtccc

SEQ ID NO: 63043 - DNA, 20 bp, Artificial Sequence
  Description of Artificial Sequence: Synthetic oligonucleotide
  Target: SCN10A; (+) strand; PAM type: YTN; PAM sequence: CTG
tcccttttgggggaatggac

SEQ ID NO: 63044 - DNA, 20 bp, Artificial Sequence
  Description of Artificial Sequence: Synthetic oligonucleotide
  Target: SCN10A; (+) strand; PAM type: YTN; PAM sequence: CTT
ttgggggaatggactttctg

SEQ ID NO: 63045 - DNA, 20 bp, Artificial Sequence
  Description of Artificial Sequence: Synthetic oligonucleotide
  Target: SCN10A; (+) strand; PAM type: YTN; PAM sequence: TTT
tgggggaatggactttctga

SEQ ID NO: 63046 - DNA, 20 bp, Artificial Sequence
  Description of Artificial Sequence: Synthetic oligonucleotide
  Target: SCN10A; (+) strand; PAM type: YTN; PAM sequence: TTT
gggggaatggactttctgag

SEQ ID NO: 63047 - DNA, 20 bp, Artificial Sequence
  Description of Artificial Sequence: Synthetic oligonucleotide
  Target: SCN10A; (+) strand; PAM type: YTN; PAM sequence: TTG
ggggaatggactttctgaga

SEQ ID NO: 63048 - DNA, 20 bp, Artificial Sequence
  Description of Artificial Sequence: Synthetic oligonucleotide
  Target: SCN10A; (+) strand; PAM type: YTN; PAM sequence: CTT
tctgagagcagttgagggaa

SEQ ID NO: 63049 - DNA, 20 bp, Artificial Sequence
  Description of Artificial Sequence: Synthetic oligonucleotide
  Target: SCN10A; (+) strand; PAM type: YTN; PAM sequence: TTT
ctgagagcagttgagggaaa

SEQ ID NO: 63050 - DNA, 20 bp, Artificial Sequence
  Description of Artificial Sequence: Synthetic oligonucleotide
  Target: SCN10A; (+) strand; PAM type: YTN; PAM sequence: TTC
tgagagcagttgagggaaag

SEQ ID NO: 63051 - DNA, 20 bp, Artificial Sequence
  Description of Artificial Sequence: Synthetic oligonucleotide
  Target: SCN10A; (+) strand; PAM type: YTN; PAM sequence: CTG
agagcagttgagggaaagtt

SEQ ID NO: 63052 - DNA, 20 bp, Artificial Sequence
  Description of Artificial Sequence: Synthetic oligonucleotide
  Target: SCN10A; (+) strand; PAM type: YTN; PAM sequence: TTG
agggaaagtttggggatgtc

SEQ ID NO: 63053 - DNA, 20 bp, Artificial Sequence
  Description of Artificial Sequence: Synthetic oligonucleotide
  Target: SCN10A; (+) strand; PAM type: YTN; PAM sequence: TTT
ggggatgtcctggagtgacc

SEQ ID NO: 63054 - DNA, 20 bp, Artificial Sequence
  Description of Artificial Sequence: Synthetic oligonucleotide
  Target: SCN10A; (+) strand; PAM type: YTN; PAM sequence: TTG
gggatgtcctggagtgaccc

SEQ ID NO: 63055 - DNA, 20 bp, Artificial Sequence
  Description of Artificial Sequence: Synthetic oligonucleotide
  Target: SCN10A; (+) strand; PAM type: YTN; PAM sequence: CTG
gagtgacccgcctcagtgga

SEQ ID NO: 63056 - DNA, 20 bp, Artificial Sequence
  Description of Artificial Sequence: Synthetic oligonucleotide
  Target: SCN10A; (+) strand; PAM type: YTN; PAM sequence: CTC
agtggacgaggcttggaagc

SEQ ID NO: 63057 - DNA, 20 bp, Artificial Sequence
  Description of Artificial Sequence: Synthetic oligonucleotide
  Target: SCN10A; (+) strand; PAM type: YTN; PAM sequence: CTT
ggaagcatattttccaccat

SEQ ID NO: 63058 - DNA, 20 bp, Artificial Sequence
  Description of Artificial Sequence: Synthetic oligonucleotide
  Target: SCN10A; (+) strand; PAM type: YTN; PAM sequence: TTG
gaagcatattttccaccata

SEQ ID NO: 63059 - DNA, 20 bp, Artificial Sequence
  Description of Artificial Sequence: Synthetic oligonucleotide
  Target: SCN10A; (+) strand; PAM type: YTN; PAM sequence: TTT
tccaccataaaggaggagcc

SEQ ID NO: 63060 - DNA, 20 bp, Artificial Sequence
  Description of Artificial Sequence: Synthetic oligonucleotide
  Target: SCN10A; (+) strand; PAM type: YTN; PAM sequence: TTT
ccaccataaaggaggagccc

SEQ ID NO: 63061 - DNA, 20 bp, Artificial Sequence
  Description of Artificial Sequence: Synthetic oligonucleotide
  Target: SCN10A; (+) strand; PAM type: YTN; PAM sequence: TTC
caccataaaggaggagcccc

SEQ ID NO: 63062 - DNA, 20 bp, Artificial Sequence
  Description of Artificial Sequence: Synthetic oligonucleotide
  Target: SCN10A; (+) strand; PAM type: YTN; PAM sequence: CTG
agcagagggacatttaggga

SEQ ID NO: 63063 - DNA, 20 bp, Artificial Sequence
  Description of Artificial Sequence: Synthetic oligonucleotide
  Target: SCN10A; (+) strand; PAM type: YTN; PAM sequence: TTT
agggacaacagagagaaggc

SEQ ID NO: 63064 - DNA, 20 bp, Artificial Sequence
  Description of Artificial Sequence: Synthetic oligonucleotide
  Target: SCN10A; (+) strand; PAM type: YTN; PAM sequence: TTA
gggacaacagagagaaggca

SEQ ID NO: 63065 - DNA, 20 bp, Artificial Sequence
  Description of Artificial Sequence: Synthetic oligonucleotide
  Target: SCN10A; (+) strand; PAM type: YTN; PAM sequence: CTT
cctgcaaccaccctcatgtg

SEQ ID NO: 63066 - DNA, 20 bp, Artificial Sequence
  Description of Artificial Sequence: Synthetic oligonucleotide
  Target: SCN10A; (+) strand; PAM type: YTN; PAM sequence: TTC
ctgcaaccaccctcatgtgc

SEQ ID NO: 63067 - DNA, 20 bp, Artificial Sequence
  Description of Artificial Sequence: Synthetic oligonucleotide
  Target: SCN10A; (+) strand; PAM type: YTN; PAM sequence: CTG
caaccaccctcatgtgccaa

SEQ ID NO: 63068 - DNA, 20 bp, Artificial Sequence
  Description of Artificial Sequence: Synthetic oligonucleotide
  Target: SCN10A; (+) strand; PAM type: YTN; PAM sequence: CTC
atgtgccaaagccctgggct

SEQ ID NO: 63069 - DNA, 20 bp, Artificial Sequence
  Description of Artificial Sequence: Synthetic oligonucleotide
  Target: SCN10A; (+) strand; PAM type: YTN; PAM sequence: CTG
ggctctgttcctgactctgg

SEQ ID NO: 63070 - DNA, 20 bp, Artificial Sequence
  Description of Artificial Sequence: Synthetic oligonucleotide
  Target: SCN10A; (+) strand; PAM type: YTN; PAM sequence: CTC
tgttcctgactctggaatcc

SEQ ID NO: 63071 - DNA, 20 bp, Artificial Sequence
  Description of Artificial Sequence: Synthetic oligonucleotide
  Target: SCN10A; (+) strand; PAM type: YTN; PAM sequence: CTG
ttcctgactctggaatcctg

SEQ ID NO: 63072 - DNA, 20 bp, Artificial Sequence
  Description of Artificial Sequence: Synthetic oligonucleotide
  Target: SCN10A; (+) strand; PAM type: YTN; PAM sequence: TTC
ctgactctggaatcctgggc

SEQ ID NO: 63073 - DNA, 20 bp, Artificial Sequence
  Description of Artificial Sequence: Synthetic oligonucleotide
  Target: SCN10A; (+) strand; PAM type: YTN; PAM sequence: CTG
actctggaatcctgggcaca

SEQ ID NO: 63074 - DNA, 20 bp, Artificial Sequence
  Description of Artificial Sequence: Synthetic oligonucleotide
  Target: SCN10A; (+) strand; PAM type: YTN; PAM sequence: CTC
tggaatcctgggcacatctt

SEQ ID NO: 63075 - DNA, 20 bp, Artificial Sequence
  Description of Artificial Sequence: Synthetic oligonucleotide
  Target: SCN10A; (+) strand; PAM type: YTN; PAM sequence: CTG
gaatcctgggcacatcttgc

SEQ ID NO: 63076 - DNA, 20 bp, Artificial Sequence
  Description of Artificial Sequence: Synthetic oligonucleotide
  Target: SCN10A; (+) strand; PAM type: YTN; PAM sequence: CTG
ggcacatcttgctgcttcca

SEQ ID NO: 63077 - DNA, 20 bp, Artificial Sequence
  Description of Artificial Sequence: Synthetic oligonucleotide
  Target: SCN10A; (+) strand; PAM type: YTN; PAM sequence: CTT
gctgcttccagttcttcact

SEQ ID NO: 63078 - DNA, 20 bp, Artificial Sequence
  Description of Artificial Sequence: Synthetic oligonucleotide
  Target: SCN10A; (+) strand; PAM type: YTN; PAM sequence: TTG
ctgcttccagttcttcactt

SEQ ID NO: 63079 - DNA, 20 bp, Artificial Sequence
  Description of Artificial Sequence: Synthetic oligonucleotide
  Target: SCN10A; (+) strand; PAM type: YTN; PAM sequence: CTG
cttccagttcttcacttgag

SEQ ID NO: 63080 - DNA, 20 bp, Artificial Sequence
  Description of Artificial Sequence: Synthetic oligonucleotide
  Target: SCN10A; (+) strand; PAM type: YTN; PAM sequence: CTT
ccagttcttcacttgagagc

SEQ ID NO: 63081 - DNA, 20 bp, Artificial Sequence
  Description of Artificial Sequence: Synthetic oligonucleotide
  Target: SCN10A; (+) strand; PAM type: YTN; PAM sequence: TTC
cagttcttcacttgagagca

SEQ ID NO: 63082 - DNA, 20 bp, Artificial Sequence
  Description of Artificial Sequence: Synthetic oligonucleotide
  Target: SCN10A; (+) strand; PAM type: YTN; PAM sequence: TTC
ttcacttgagagcagatgaa

SEQ ID NO: 63083 - DNA, 20 bp, Artificial Sequence
  Description of Artificial Sequence: Synthetic oligonucleotide
  Target: SCN10A; (+) strand; PAM type: YTN; PAM sequence: CTT
cacttgagagcagatgaaga

SEQ ID NO: 63084 - DNA, 20 bp, Artificial Sequence
  Description of Artificial Sequence: Synthetic oligonucleotide
  Target: SCN10A; (+) strand; PAM type: YTN; PAM sequence: TTC
acttgagagcagatgaagag

SEQ ID NO: 63085 - DNA, 20 bp, Artificial Sequence
  Description of Artificial Sequence: Synthetic oligonucleotide
  Target: SCN10A; (+) strand; PAM type: YTN; PAM sequence: CTT
gagagcagatgaagagcggt

SEQ ID NO: 63086 - DNA, 20 bp, Artificial Sequence
  Description of Artificial Sequence: Synthetic oligonucleotide
  Target: SCN10A; (+) strand; PAM type: YTN; PAM sequence: TTG
agagcagatgaagagcggtt

SEQ ID NO: 63087 - DNA, 20 bp, Artificial Sequence
  Description of Artificial Sequence: Synthetic oligonucleotide
  Target: SCN10A; (+) strand; PAM type: YTN; PAM sequence: TTG
tgaagacaaaatgatatgag

SEQ ID NO: 63088 - DNA, 20 bp, Artificial Sequence
  Description of Artificial Sequence: Synthetic oligonucleotide
  Target: SCN10A; (+) strand; PAM type: YTN; PAM sequence: CTC
agaggggtaaacttcctgtc

SEQ ID NO: 63089 - DNA, 20 bp, Artificial Sequence
  Description of Artificial Sequence: Synthetic oligonucleotide
  Target: SCN10A; (+) strand; PAM type: YTN; PAM sequence: CTT
cctgtctgagggtgaggggc

SEQ ID NO: 63090 - DNA, 20 bp, Artificial Sequence
  Description of Artificial Sequence: Synthetic oligonucleotide
  Target: SCN10A; (+) strand; PAM type: YTN; PAM sequence: TTC
ctgtctgagggtgaggggca

SEQ ID NO: 63091 - DNA, 20 bp, Artificial Sequence
  Description of Artificial Sequence: Synthetic oligonucleotide
  Target: SCN10A; (+) strand; PAM type: YTN; PAM sequence: CTG
tctgagggtgaggggcatct

SEQ ID NO: 63092 - DNA, 20 bp, Artificial Sequence
  Description of Artificial Sequence: Synthetic oligonucleotide
  Target: SCN10A; (+) strand; PAM type: YTN; PAM sequence: CTG
agggtgaggggcatctgtgg

SEQ ID NO: 63093 - DNA, 20 bp, Artificial Sequence
  Description of Artificial Sequence: Synthetic oligonucleotide
  Target: SCN10A; (+) strand; PAM type: YTN; PAM sequence: CTG
tggctctgcagggatggtgg

SEQ ID NO: 63094 - DNA, 20 bp, Artificial Sequence
  Description of Artificial Sequence: Synthetic oligonucleotide
  Target: SCN10A; (+) strand; PAM type: YTN; PAM sequence: CTC
tgcagggatggtgggctcag

SEQ ID NO: 63095 - DNA, 20 bp, Artificial Sequence
  Description of Artificial Sequence: Synthetic oligonucleotide
  Target: SCN10A; (+) strand; PAM type: YTN; PAM sequence: CTG
cagggatggtgggctcagcc

SEQ ID NO: 63096 - DNA, 20 bp, Artificial Sequence
  Description of Artificial Sequence: Synthetic oligonucleotide
  Target: SCN10A; (+) strand; PAM type: YTN; PAM sequence: CTC
agcctggaagaacagagttt

SEQ ID NO: 63097 - DNA, 20 bp, Artificial Sequence
  Description of Artificial Sequence: Synthetic oligonucleotide
  Target: SCN10A; (+) strand; PAM type: YTN; PAM sequence: CTG
gaagaacagagtttctggga

SEQ ID NO: 63098 - DNA, 20 bp, Artificial Sequence
  Description of Artificial Sequence: Synthetic oligonucleotide
  Target: SCN10A; (+) strand; PAM type: YTN; PAM sequence: TTT
ctgggatgcaggcagaggca

SEQ ID NO: 63099 - DNA, 20 bp, Artificial Sequence
  Description of Artificial Sequence: Synthetic oligonucleotide
  Target: SCN10A; (+) strand; PAM type: YTN; PAM sequence: TTC
tgggatgcaggcagaggcat

SEQ ID NO: 63100 - DNA, 20 bp, Artificial Sequence
  Description of Artificial Sequence: Synthetic oligonucleotide
  Target: SCN10A; (+) strand; PAM type: YTN; PAM sequence: CTG
ggatgcaggcagaggcatcc

SEQ ID NO: 63101 - DNA, 20 bp, Artificial Sequence
  Description of Artificial Sequence: Synthetic oligonucleotide
  Target: SCN10A; (+) strand; PAM type: YTN; PAM sequence: CTG
gctcaggcaccagggtggaa

SEQ ID NO: 63102 - DNA, 20 bp, Artificial Sequence
  Description of Artificial Sequence: Synthetic oligonucleotide
  Target: SCN10A; (+) strand; PAM type: YTN; PAM sequence: CTC
aggcaccagggtggaaaaga

SEQ ID NO: 63103 - DNA, 20 bp, Artificial Sequence
  Description of Artificial Sequence: Synthetic oligonucleotide
  Target: SCN10A; (+) strand; PAM type: YTN; PAM sequence: CTA
aagagtctggatttgttgtt

SEQ ID NO: 63104 - DNA, 20 bp, Artificial Sequence
  Description of Artificial Sequence: Synthetic oligonucleotide
  Target: SCN10A; (+) strand; PAM type: YTN; PAM sequence: CTG
gatttgttgttgcttccctt

SEQ ID NO: 63105 - DNA, 20 bp, Artificial Sequence
  Description of Artificial Sequence: Synthetic oligonucleotide
  Target: SCN10A; (+) strand; PAM type: YTN; PAM sequence: TTT
gttgttgcttcccttttctt

SEQ ID NO: 63106 - DNA, 20 bp, Artificial Sequence
  Description of Artificial Sequence: Synthetic oligonucleotide
  Target: SCN10A; (+) strand; PAM type: YTN; PAM sequence: TTG
ttgttgcttcccttttcttg

SEQ ID NO: 63107 - DNA, 20 bp, Artificial Sequence
  Description of Artificial Sequence: Synthetic oligonucleotide
  Target: SCN10A; (+) strand; PAM type: YTN; PAM sequence: TTG
ttgcttcccttttcttggtt

SEQ ID NO: 63108 - DNA, 20 bp, Artificial Sequence
  Description of Artificial Sequence: Synthetic oligonucleotide
  Target: SCN10A; (+) strand; PAM type: YTN; PAM sequence: TTG
cttcccttttcttggtttag

SEQ ID NO: 63109 - DNA, 20 bp, Artificial Sequence
  Description of Artificial Sequence: Synthetic oligonucleotide
  Target: SCN10A; (+) strand; PAM type: YTN; PAM sequence: CTT
cccttttcttggtttagctt

SEQ ID NO: 63110 - DNA, 20 bp, Artificial Sequence
  Description of Artificial Sequence: Synthetic oligonucleotide
  Target: SCN10A; (+) strand; PAM type: YTN; PAM sequence: TTC
ccttttcttggtttagcttt

SEQ ID NO: 63111 - DNA, 20 bp, Artificial Sequence
  Description of Artificial Sequence: Synthetic oligonucleotide
  Target: SCN10A; (+) strand; PAM type: YTN; PAM sequence: CTT
ttcttggtttagctttcttc

SEQ ID NO: 63112 - DNA, 20 bp, Artificial Sequence
  Description of Artificial Sequence: Synthetic oligonucleotide
  Target: SCN10A; (+) strand; PAM type: YTN; PAM sequence: TTT
tcttggtttagctttcttct

SEQ ID NO: 63113 - DNA, 20 bp, Artificial Sequence
  Description of Artificial Sequence: Synthetic oligonucleotide
  Target: SCN10A; (+) strand; PAM type: YTN; PAM sequence: TTT
cttggtttagctttcttctg

SEQ ID NO: 63114 - DNA, 20 bp, Artificial Sequence
  Description of Artificial Sequence: Synthetic oligonucleotide
  Target: SCN10A; (+) strand; PAM type: YTN; PAM sequence: TTC
ttggtttagctttcttctgt

SEQ ID NO: 63115 - DNA, 20 bp, Artificial Sequence
  Description of Artificial Sequence: Synthetic oligonucleotide
  Target: SCN10A; (+) strand; PAM type: YTN; PAM sequence: CTT
ggtttagctttcttctgtct

SEQ ID NO: 63116 - DNA, 20 bp, Artificial Sequence
  Description of Artificial Sequence: Synthetic oligonucleotide
  Target: SCN10A; (+) strand; PAM type: YTN; PAM sequence: TTG
gtttagctttcttctgtcta

SEQ ID NO: 63117 - DNA, 20 bp, Artificial Sequence
  Description of Artificial Sequence: Synthetic oligonucleotide
  Target: SCN10A; (+) strand; PAM type: YTN; PAM sequence: TTT
agctttcttctgtctataaa

SEQ ID NO: 63118 - DNA, 20 bp, Artificial Sequence
  Description of Artificial Sequence: Synthetic oligonucleotide
  Target: SCN10A; (+) strand; PAM type: YTN; PAM sequence: TTA
gctttcttctgtctataaaa

SEQ ID NO: 63119 - DNA, 20 bp, Artificial Sequence
  Description of Artificial Sequence: Synthetic oligonucleotide
  Target: SCN10A; (+) strand; PAM type: YTN; PAM sequence: CTT
tcttctgtctataaaactca

SEQ ID NO: 63120 - DNA, 20 bp, Artificial Sequence
  Description of Artificial Sequence: Synthetic oligonucleotide
  Target: SCN10A; (+) strand; PAM type: YTN; PAM sequence: TTT
cttctgtctataaaactcat

SEQ ID NO: 63121 - DNA, 20 bp, Artificial Sequence
  Description of Artificial Sequence: Synthetic oligonucleotide
  Target: SCN10A; (+) strand; PAM type: YTN; PAM sequence: TTC
ttctgtctataaaactcatg

SEQ ID NO: 63122 - DNA, 20 bp, Artificial Sequence
  Description of Artificial Sequence: Synthetic oligonucleotide
  Target: SCN10A; (+) strand; PAM type: YTN; PAM sequence: CTT
ctgtctataaaactcatgag

SEQ ID NO: 63123 - DNA, 20 bp, Artificial Sequence
  Description of Artificial Sequence: Synthetic oligonucleotide
  Target: SCN10A; (+) strand; PAM type: YTN; PAM sequence: TTC
tgtctataaaactcatgagg

SEQ ID NO: 63124 - DNA, 20 bp, Artificial Sequence
  Description of Artificial Sequence: Synthetic oligonucleotide
  Target: SCN10A; (+) strand; PAM type: YTN; PAM sequence: CTG
tctataaaactcatgaggaa

SEQ ID NO: 63125 - DNA, 20 bp, Artificial Sequence
  Description of Artificial Sequence: Synthetic oligonucleotide
  Target: SCN10A; (+) strand; PAM type: YTN; PAM sequence: CTA
taaaactcatgaggaaagaa

SEQ ID NO: 63126 - DNA, 20 bp, Artificial Sequence
  Description of Artificial Sequence: Synthetic oligonucleotide
  Target: SCN10A; (+) strand; PAM type: YTN; PAM sequence: CTC
atgaggaaagaacccaagtt

SEQ ID NO: 63127 - DNA, 20 bp, Artificial Sequence
  Description of Artificial Sequence: Synthetic oligonucleotide
  Target: SCN10A; (+) strand; PAM type: YTN; PAM sequence: TTG
gttgatgtccagggcaataa

SEQ ID NO: 63128 - DNA, 20 bp, Artificial Sequence
  Description of Artificial Sequence: Synthetic oligonucleotide
  Target: SCN10A; (+) strand; PAM type: YTN; PAM sequence: TTG
atgtccagggcaataagaaa

SEQ ID NO: 63129 - DNA, 20 bp, Artificial Sequence
  Description of Artificial Sequence: Synthetic oligonucleotide
  Target: SCN10A; (+) strand; PAM type: YTN; PAM sequence: CTT
ctggaagactgcatcctccc

SEQ ID NO: 63130 - DNA, 20 bp, Artificial Sequence
  Description of Artificial Sequence: Synthetic oligonucleotide
  Target: SCN10A; (+) strand; PAM type: YTN; PAM sequence: TTC
tggaagactgcatcctccca

SEQ ID NO: 63131 - DNA, 20 bp, Artificial Sequence
  Description of Artificial Sequence: Synthetic oligonucleotide
  Target: SCN10A; (+) strand; PAM type: YTN; PAM sequence: CTG
gaagactgcatcctcccaca

SEQ ID NO: 63132 - DNA, 20 bp, Artificial Sequence
  Description of Artificial Sequence: Synthetic oligonucleotide
  Target: SCN10A; (+) strand; PAM type: YTN; PAM sequence: CTG
catcctcccacacaaccagt

SEQ ID NO: 63133 - DNA, 20 bp, Artificial Sequence
  Description of Artificial Sequence: Synthetic oligonucleotide
  Target: SCN10A; (+) strand; PAM type: YTN; PAM sequence: CTC
ccacacaaccagtcagtccc

SEQ ID NO: 63134 - DNA, 20 bp, Artificial Sequence
  Description of Artificial Sequence: Synthetic oligonucleotide
  Target: SCN10A; (+) strand; PAM type: YTN; PAM sequence: CTG
agggcagggggccaggctgg

SEQ ID NO: 63135 - DNA, 20 bp, Artificial Sequence
  Description of Artificial Sequence: Synthetic oligonucleotide
  Target: SCN10A; (+) strand; PAM type: YTN; PAM sequence: CTG
gggcggagaaggggtattgg

SEQ ID NO: 63136 - DNA, 20 bp, Artificial Sequence
  Description of Artificial Sequence: Synthetic oligonucleotide
  Target: SCN10A; (+) strand; PAM type: YTN; PAM sequence: TTG
gggcttattggcaagtgagt

SEQ ID NO: 63137 - DNA, 20 bp, Artificial Sequence
  Description of Artificial Sequence: Synthetic oligonucleotide
  Target: SCN10A; (+) strand; PAM type: YTN; PAM sequence: CTT
attggcaagtgagtctccag

SEQ ID NO: 63138 - DNA, 20 bp, Artificial Sequence
  Description of Artificial Sequence: Synthetic oligonucleotide
  Target: SCN10A; (+) strand; PAM type: YTN; PAM sequence: TTA
ttggcaagtgagtctccaga

SEQ ID NO: 63139 - DNA, 20 bp, Artificial Sequence
  Description of Artificial Sequence: Synthetic oligonucleotide
  Target: SCN10A; (+) strand; PAM type: YTN; PAM sequence: TTG
gcaagtgagtctccagaggg

SEQ ID NO: 63140 - DNA, 20 bp, Artificial Sequence
  Description of Artificial Sequence: Synthetic oligonucleotide
  Target: SCN10A; (+) strand; PAM type: YTN; PAM sequence: CTC
cagaggggcttcctccaaac

SEQ ID NO: 63141 - DNA, 20 bp, Artificial Sequence
  Description of Artificial Sequence: Synthetic oligonucleotide
  Target: SCN10A; (+) strand; PAM type: YTN; PAM sequence: CTT
cctccaaacatggagtagat

SEQ ID NO: 63142 - DNA, 20 bp, Artificial Sequence
  Description of Artificial Sequence: Synthetic oligonucleotide
  Target: SCN10A; (+) strand; PAM type: YTN; PAM sequence: TTC
ctccaaacatggagtagatt

SEQ ID NO: 63143 - DNA, 20 bp, Artificial Sequence
  Description of Artificial Sequence: Synthetic oligonucleotide
  Target: SCN10A; (+) strand; PAM type: YTN; PAM sequence: CTC
caaacatggagtagattttg

SEQ ID NO: 63144 - DNA, 20 bp, Artificial Sequence
  Description of Artificial Sequence: Synthetic oligonucleotide
  Target: SCN10A; (+) strand; PAM type: YTN; PAM sequence: TTT
tgttattatttctgtggcct

SEQ ID NO: 63145 - DNA, 20 bp, Artificial Sequence
  Description of Artificial Sequence: Synthetic oligonucleotide
  Target: SCN10A; (+) strand; PAM type: YTN; PAM sequence: TTT
gttattatttctgtggcctt

SEQ ID NO: 63146 - DNA, 20 bp, Artificial Sequence
  Description of Artificial Sequence: Synthetic oligonucleotide
  Target: SCN10A; (+) strand; PAM type: YTN; PAM sequence: TTG
ttattatttctgtggccttg

SEQ ID NO: 63147 - DNA, 20 bp, Artificial Sequence
  Description of Artificial Sequence: Synthetic oligonucleotide
  Target: SCN10A; (+) strand; PAM type: YTN; PAM sequence: TTA
ttatttctgtggccttggat

SEQ ID NO: 63148 - DNA, 20 bp, Artificial Sequence
  Description of Artificial Sequence: Synthetic oligonucleotide
  Target: SCN10A; (+) strand; PAM type: YTN; PAM sequence: TTA
tttctgtggccttggatgtt

SEQ ID NO: 63149 - DNA, 20 bp, Artificial Sequence
  Description of Artificial Sequence: Synthetic oligonucleotide
  Target: SCN10A; (+) strand; PAM type: YTN; PAM sequence: TTT
ctgtggccttggatgttgtc

SEQ ID NO: 63150 - DNA, 20 bp, Artificial Sequence
  Description of Artificial Sequence: Synthetic oligonucleotide
  Target: SCN10A; (+) strand; PAM type: YTN; PAM sequence: TTC
tgtggccttggatgttgtcc

SEQ ID NO: 63151 - DNA, 20 bp, Artificial Sequence
  Description of Artificial Sequence: Synthetic oligonucleotide
  Target: SCN10A; (+) strand; PAM type: YTN; PAM sequence: CTG
tggccttggatgttgtccgt

SEQ ID NO: 63152 - DNA, 20 bp, Artificial Sequence
  Description of Artificial Sequence: Synthetic oligonucleotide
  Target: SCN10A; (+) strand; PAM type: YTN; PAM sequence: CTT
ggatgttgtccgtgacccat

SEQ ID NO: 63153 - DNA, 20 bp, Artificial Sequence
  Description of Artificial Sequence: Synthetic oligonucleotide
  Target: SCN10A; (+) strand; PAM type: YTN; PAM sequence: TTG
gatgttgtccgtgacccatt

SEQ ID NO: 63154 - DNA, 20 bp, Artificial Sequence
  Description of Artificial Sequence: Synthetic oligonucleotide
  Target: SCN10A; (+) strand; PAM type: YTN; PAM sequence: TTG
tccgtgacccattgtgcccc

SEQ ID NO: 63155 - DNA, 20 bp, Artificial Sequence
  Description of Artificial Sequence: Synthetic oligonucleotide
  Target: SCN10A; (+) strand; PAM type: YTN; PAM sequence: TTG
tgccccctccctgcagcctc

SEQ ID NO: 63156 - DNA, 20 bp, Artificial Sequence
  Description of Artificial Sequence: Synthetic oligonucleotide
  Target: SCN10A; (+) strand; PAM type: YTN; PAM sequence: CTC
cctgcagcctctccccctgc

SEQ ID NO: 63157 - DNA, 20 bp, Artificial Sequence
  Description of Artificial Sequence: Synthetic oligonucleotide
  Target: SCN10A; (+) strand; PAM type: YTN; PAM sequence: CTG
cagcctctccccctgctccc

SEQ ID NO: 63158 - DNA, 20 bp, Artificial Sequence
  Description of Artificial Sequence: Synthetic oligonucleotide
  Target: SCN10A; (+) strand; PAM type: YTN; PAM sequence: CTC
tccccctgctcccagctagg

SEQ ID NO: 63159 - DNA, 20 bp, Artificial Sequence
  Description of Artificial Sequence: Synthetic oligonucleotide
  Target: SCN10A; (+) strand; PAM type: YTN; PAM sequence: CTC
cccctgctcccagctaggac

SEQ ID NO: 63160 - DNA, 20 bp, Artificial Sequence
  Description of Artificial Sequence: Synthetic oligonucleotide
  Target: SCN10A; (+) strand; PAM type: YTN; PAM sequence: CTG
ctcccagctaggacctgtgc

SEQ ID NO: 63161 - DNA, 20 bp, Artificial Sequence
  Description of Artificial Sequence: Synthetic oligonucleotide
  Target: SCN10A; (+) strand; PAM type: YTN; PAM sequence: CTC
ccagctaggacctgtgcagc

SEQ ID NO: 63162 - DNA, 20 bp, Artificial Sequence
  Description of Artificial Sequence: Synthetic oligonucleotide
  Target: SCN10A; (+) strand; PAM type: YTN; PAM sequence: CTA
ggacctgtgcagcttggaga

SEQ ID NO: 63163 - DNA, 20 bp, Artificial Sequence
  Description of Artificial Sequence: Synthetic oligonucleotide
  Target: SCN10A; (+) strand; PAM type: YTN; PAM sequence: CTG
tgcagcttggagaaatcagt

SEQ ID NO: 63164 - DNA, 20 bp, Artificial Sequence
  Description of Artificial Sequence: Synthetic oligonucleotide
  Target: SCN10A; (+) strand; PAM type: YTN; PAM sequence: CTT
ggagaaatcagtcagctctt

SEQ ID NO: 63165 - DNA, 20 bp, Artificial Sequence
  Description of Artificial Sequence: Synthetic oligonucleotide
  Target: SCN10A; (+) strand; PAM type: YTN; PAM sequence: TTG
gagaaatcagtcagctctta

SEQ ID NO: 63166 - DNA, 20 bp, Artificial Sequence
  Description of Artificial Sequence: Synthetic oligonucleotide
  Target: SCN10A; (+) strand; PAM type: YTN; PAM sequence: CTC
ttacttccctgaataaaaat

SEQ ID NO: 63167 - DNA, 20 bp, Artificial Sequence
  Description of Artificial Sequence: Synthetic oligonucleotide
  Target: SCN10A; (+) strand; PAM type: YTN; PAM sequence: CTT
acttccctgaataaaaatgt

SEQ ID NO: 63168 - DNA, 20 bp, Artificial Sequence
  Description of Artificial Sequence: Synthetic oligonucleotide
  Target: SCN10A; (+) strand; PAM type: YTN; PAM sequence: TTA
cttccctgaataaaaatgtt

SEQ ID NO: 63169 - DNA, 20 bp, Artificial Sequence
  Description of Artificial Sequence: Synthetic oligonucleotide
  Target: SCN10A; (+) strand; PAM type: YTN; PAM sequence: CTT
ccctgaataaaaatgttttc

SEQ ID NO: 63170 - DNA, 20 bp, Artificial Sequence
  Description of Artificial Sequence: Synthetic oligonucleotide
  Target: SCN10A; (+) strand; PAM type: YTN; PAM sequence: TTC
cctgaataaaaatgttttct

SEQ ID NO: 63171 - DNA, 20 bp, Artificial Sequence
  Description of Artificial Sequence: Synthetic oligonucleotide
  Target: SCN10A; (+) strand; PAM type: YTN; PAM sequence: CTG
aataaaaatgttttctgagc

SEQ ID NO: 63172 - DNA, 20 bp, Artificial Sequence
  Description of Artificial Sequence: Synthetic oligonucleotide
  Target: SCN10A; (+) strand; PAM type: YTN; PAM sequence: TTT
tctgagccccctcagattgg

SEQ ID NO: 63173 - DNA, 20 bp, Artificial Sequence
  Description of Artificial Sequence: Synthetic oligonucleotide
  Target: SCN10A; (+) strand; PAM type: YTN; PAM sequence: TTT
ctgagccccctcagattggg

SEQ ID NO: 63174 - DNA, 20 bp, Artificial Sequence
  Description of Artificial Sequence: Synthetic oligonucleotide
  Target: SCN10A; (+) strand; PAM type: YTN; PAM sequence: TTC
tgagccccctcagattgggg

SEQ ID NO: 63175 - DNA, 20 bp, Artificial Sequence
  Description of Artificial Sequence: Synthetic oligonucleotide
  Target: SCN10A; (+) strand; PAM type: YTN; PAM sequence: CTG
agccccctcagattggggaa

SEQ ID NO: 63176 - DNA, 20 bp, Artificial Sequence
  Description of Artificial Sequence: Synthetic oligonucleotide
  Target: SCN10A; (+) strand; PAM type: YTN; PAM sequence: CTC
agattggggaaggacatttt

SEQ ID NO: 63177 - DNA, 20 bp, Artificial Sequence
  Description of Artificial Sequence: Synthetic oligonucleotide
  Target: SCN10A; (+) strand; PAM type: YTN; PAM sequence: TTG
gggaaggacatttttccttt

SEQ ID NO: 63178 - DNA, 20 bp, Artificial Sequence
  Description of Artificial Sequence: Synthetic oligonucleotide
  Target: SCN10A; (+) strand; PAM type: YTN; PAM sequence: TTT
ttcctttaacagctaataga

SEQ ID NO: 63179 - DNA, 20 bp, Artificial Sequence
  Description of Artificial Sequence: Synthetic oligonucleotide
  Target: SCN10A; (+) strand; PAM type: YTN; PAM sequence: TTT
tcctttaacagctaatagac

SEQ ID NO: 63180 - DNA, 20 bp, Artificial Sequence
  Description of Artificial Sequence: Synthetic oligonucleotide
  Target: SCN10A; (+) strand; PAM type: YTN; PAM sequence: TTT
cctttaacagctaatagaca

SEQ ID NO: 63181 - DNA, 20 bp, Artificial Sequence
  Description of Artificial Sequence: Synthetic oligonucleotide
  Target: SCN10A; (+) strand; PAM type: YTN; PAM sequence: TTC
ctttaacagctaatagacac

SEQ ID NO: 63182 - DNA, 20 bp, Artificial Sequence
  Description of Artificial Sequence: Synthetic oligonucleotide
  Target: SCN10A; (+) strand; PAM type: YTN; PAM sequence: CTT
taacagctaatagacaccgt

SEQ ID NO: 63183 - DNA, 20 bp, Artificial Sequence
  Description of Artificial Sequence: Synthetic oligonucleotide
  Target: SCN10A; (+) strand; PAM type: YTN; PAM sequence: TTT
aacagctaatagacaccgtt

SEQ ID NO: 63184 - DNA, 20 bp, Artificial Sequence
  Description of Artificial Sequence: Synthetic oligonucleotide
  Target: SCN10A; (+) strand; PAM type: YTN; PAM sequence: TTA
acagctaatagacaccgttt

SEQ ID NO: 63185 - DNA, 20 bp, Artificial Sequence
  Description of Artificial Sequence: Synthetic oligonucleotide
  Target: SCN10A; (+) strand; PAM type: YTN; PAM sequence: CTA
atagacaccgtttattgagt

SEQ ID NO: 63186 - DNA, 20 bp, Artificial Sequence
  Description of Artificial Sequence: Synthetic oligonucleotide
  Target: SCN10A; (+) strand; PAM type: YTN; PAM sequence: TTT
attgagttcctgcctcagcc

SEQ ID NO: 63187 - DNA, 20 bp, Artificial Sequence
  Description of Artificial Sequence: Synthetic oligonucleotide
  Target: SCN10A; (+) strand; PAM type: YTN; PAM sequence: TTA
ttgagttcctgcctcagccc

SEQ ID NO: 63188 - DNA, 20 bp, Artificial Sequence
  Description of Artificial Sequence: Synthetic oligonucleotide
  Target: SCN10A; (+) strand; PAM type: YTN; PAM sequence: TTG
agttcctgcctcagcccaga

SEQ ID NO: 63189 - DNA, 20 bp, Artificial Sequence
  Description of Artificial Sequence: Synthetic oligonucleotide
  Target: SCN10A; (+) strand; PAM type: YTN; PAM sequence: TTC
ctgcctcagcccagacattg

SEQ ID NO: 63190 - DNA, 20 bp, Artificial Sequence
  Description of Artificial Sequence: Synthetic oligonucleotide
  Target: SCN10A; (+) strand; PAM type: YTN; PAM sequence: CTG
cctcagcccagacattgcat

SEQ ID NO: 63191 - DNA, 20 bp, Artificial Sequence
  Description of Artificial Sequence: Synthetic oligonucleotide
  Target: SCN10A; (+) strand; PAM type: YTN; PAM sequence: CTC
agcccagacattgcattagg

SEQ ID NO: 63192 - DNA, 20 bp, Artificial Sequence
  Description of Artificial Sequence: Synthetic oligonucleotide
  Target: SCN10A; (+) strand; PAM type: YTN; PAM sequence: TTG
cattaggcaatttgcatatg

SEQ ID NO: 63193 - DNA, 20 bp, Artificial Sequence
  Description of Artificial Sequence: Synthetic oligonucleotide
  Target: SCN10A; (+) strand; PAM type: YTN; PAM sequence: TTA
ggcaatttgcatatgtcatc

SEQ ID NO: 63194 - DNA, 20 bp, Artificial Sequence
  Description of Artificial Sequence: Synthetic oligonucleotide
  Target: SCN10A; (+) strand; PAM type: YTN; PAM sequence: TTT
gcatatgtcatctcctgtca

SEQ ID NO: 63195 - DNA, 20 bp, Artificial Sequence
  Description of Artificial Sequence: Synthetic oligonucleotide
  Target: SCN10A; (+) strand; PAM type: YTN; PAM sequence: TTG
catatgtcatctcctgtcat

SEQ ID NO: 63196 - DNA, 20 bp, Artificial Sequence
  Description of Artificial Sequence: Synthetic oligonucleotide
  Target: SCN10A; (+) strand; PAM type: YTN; PAM sequence: CTC
ctgtcatttaattctcccag

SEQ ID NO: 63197 - DNA, 20 bp, Artificial Sequence
  Description of Artificial Sequence: Synthetic oligonucleotide
  Target: SCN10A; (+) strand; PAM type: YTN; PAM sequence: CTG
tcatttaattctcccagtaa

SEQ ID NO: 63198 - DNA, 20 bp, Artificial Sequence
  Description of Artificial Sequence: Synthetic oligonucleotide
  Target: SCN10A; (+) strand; PAM type: YTN; PAM sequence: TTT
aattctcccagtaaacccat

SEQ ID NO: 63199 - DNA, 20 bp, Artificial Sequence
  Description of Artificial Sequence: Synthetic oligonucleotide
  Target: SCN10A; (+) strand; PAM type: YTN; PAM sequence: TTA
attctcccagtaaacccatg

SEQ ID NO: 63200 - DNA, 20 bp, Artificial Sequence
  Description of Artificial Sequence: Synthetic oligonucleotide
  Target: SCN10A; (+) strand; PAM type: YTN; PAM sequence: TTC
tcccagtaaacccatgagta

SEQ ID NO: 63201 - DNA, 20 bp, Artificial Sequence
  Description of Artificial Sequence: Synthetic oligonucleotide
  Target: SCN10A; (+) strand; PAM type: YTN; PAM sequence: CTC
ccagtaaacccatgagtaag

SEQ ID NO: 63202 - DNA, 20 bp, Artificial Sequence
  Description of Artificial Sequence: Synthetic oligonucleotide
  Target: SCN10A; (+) strand; PAM type: YTN; PAM sequence: TTA
ttttcttgattttaaggaaa

SEQ ID NO: 63203 - DNA, 20 bp, Artificial Sequence
  Description of Artificial Sequence: Synthetic oligonucleotide
  Target: SCN10A; (+) strand; PAM type: YTN; PAM sequence: TTT
tcttgattttaaggaaatta

SEQ ID NO: 63204 - DNA, 20 bp, Artificial Sequence
  Description of Artificial Sequence: Synthetic oligonucleotide
  Target: SCN10A; (+) strand; PAM type: YTN; PAM sequence: TTT
cttgattttaaggaaattag

SEQ ID NO: 63205 - DNA, 20 bp, Artificial Sequence
  Description of Artificial Sequence: Synthetic oligonucleotide
  Target: SCN10A; (+) strand; PAM type: YTN; PAM sequence: TTC
ttgattttaaggaaattaga

SEQ ID NO: 63206 - DNA, 20 bp, Artificial Sequence
  Description of Artificial Sequence: Synthetic oligonucleotide
  Target: SCN10A; (+) strand; PAM type: YTN; PAM sequence: CTT
gattttaaggaaattagatc

SEQ ID NO: 63207 - DNA, 20 bp, Artificial Sequence
  Description of Artificial Sequence: Synthetic oligonucleotide
  Target: SCN10A; (+) strand; PAM type: YTN; PAM sequence: TTG
attttaaggaaattagatct

SEQ ID NO: 63208 - DNA, 20 bp, Artificial Sequence
  Description of Artificial Sequence: Synthetic oligonucleotide
  Target: SCN10A; (+) strand; PAM type: YTN; PAM sequence: TTT
taaggaaattagatcttgag

SEQ ID NO: 63209 - DNA, 20 bp, Artificial Sequence
  Description of Artificial Sequence: Synthetic oligonucleotide
  Target: SCN10A; (+) strand; PAM type: YTN; PAM sequence: TTT
aaggaaattagatcttgagg

SEQ ID NO: 63210 - DNA, 20 bp, Artificial Sequence
  Description of Artificial Sequence: Synthetic oligonucleotide
  Target: SCN10A; (+) strand; PAM type: YTN; PAM sequence: TTA
aggaaattagatcttgagga

SEQ ID NO: 63211 - DNA, 20 bp, Artificial Sequence
  Description of Artificial Sequence: Synthetic oligonucleotide
  Target: SCN10A; (+) strand; PAM type: YTN; PAM sequence: TTA
gatcttgaggagattaagtc

SEQ ID NO: 63212 - DNA, 20 bp, Artificial Sequence
  Description of Artificial Sequence: Synthetic oligonucleotide
  Target: SCN10A; (+) strand; PAM type: YTN; PAM sequence: CTT
gaggagattaagtctcttgc

SEQ ID NO: 63213 - DNA, 20 bp, Artificial Sequence
  Description of Artificial Sequence: Synthetic oligonucleotide
  Target: SCN10A; (+) strand; PAM type: YTN; PAM sequence: TTG
aggagattaagtctcttgcc

SEQ ID NO: 63214 - DNA, 20 bp, Artificial Sequence
  Description of Artificial Sequence: Synthetic oligonucleotide
  Target: SCN10A; (+) strand; PAM type: YTN; PAM sequence: TTA
agtctcttgcctggggtcac

SEQ ID NO: 63215 - DNA, 20 bp, Artificial Sequence
  Description of Artificial Sequence: Synthetic oligonucleotide
  Target: SCN10A; (+) strand; PAM type: YTN; PAM sequence: CTC
ttgcctggggtcacccacct

SEQ ID NO: 63216 - DNA, 20 bp, Artificial Sequence
  Description of Artificial Sequence: Synthetic oligonucleotide
  Target: SCN10A; (+) strand; PAM type: YTN; PAM sequence: CTT
gcctggggtcacccacctag

SEQ ID NO: 63217 - DNA, 20 bp, Artificial Sequence
  Description of Artificial Sequence: Synthetic oligonucleotide
  Target: SCN10A; (+) strand; PAM type: YTN; PAM sequence: TTG
cctggggtcacccacctagt

SEQ ID NO: 63218 - DNA, 20 bp, Artificial Sequence
  Description of Artificial Sequence: Synthetic oligonucleotide
  Target: SCN10A; (+) strand; PAM type: YTN; PAM sequence: CTG
gggtcacccacctagtaaat

SEQ ID NO: 63219 - DNA, 20 bp, Artificial Sequence
  Description of Artificial Sequence: Synthetic oligonucleotide
  Target: SCN10A; (+) strand; PAM type: YTN; PAM sequence: CTA
gtaaatggtggagcagagat

SEQ ID NO: 63220 - DNA, 20 bp, Artificial Sequence
  Description of Artificial Sequence: Synthetic oligonucleotide
  Target: SCN10A; (+) strand; PAM type: YTN; PAM sequence: TTC
tacaccaggtctttcttttc

SEQ ID NO: 63221 - DNA, 20 bp, Artificial Sequence
  Description of Artificial Sequence: Synthetic oligonucleotide
  Target: SCN10A; (+) strand; PAM type: YTN; PAM sequence: CTA
caccaggtctttcttttcta

SEQ ID NO: 63222 - DNA, 20 bp, Artificial Sequence
  Description of Artificial Sequence: Synthetic oligonucleotide
  Target: SCN10A; (+) strand; PAM type: YTN; PAM sequence: CTT
tcttttctaatcatatgttc

SEQ ID NO: 63223 - DNA, 20 bp, Artificial Sequence
  Description of Artificial Sequence: Synthetic oligonucleotide
  Target: SCN10A; (+) strand; PAM type: YTN; PAM sequence: TTT
cttttctaatcatatgttct

SEQ ID NO: 63224 - DNA, 20 bp, Artificial Sequence
  Description of Artificial Sequence: Synthetic oligonucleotide
  Target: SCN10A; (+) strand; PAM type: YTN; PAM sequence: TTC
ttttctaatcatatgttctc

SEQ ID NO: 63225 - DNA, 20 bp, Artificial Sequence
  Description of Artificial Sequence: Synthetic oligonucleotide
  Target: SCN10A; (+) strand; PAM type: YTN; PAM sequence: CTT
ttctaatcatatgttctcat

SEQ ID NO: 63226 - DNA, 20 bp, Artificial Sequence
  Description of Artificial Sequence: Synthetic oligonucleotide
  Target: SCN10A; (+) strand; PAM type: YTN; PAM sequence: TTT
tctaatcatatgttctcatt

SEQ ID NO: 63227 - DNA, 20 bp, Artificial Sequence
  Description of Artificial Sequence: Synthetic oligonucleotide
  Target: SCN10A; (+) strand; PAM type: YTN; PAM sequence: TTT
ctaatcatatgttctcattc

SEQ ID NO: 63228 - DNA, 20 bp, Artificial Sequence
  Description of Artificial Sequence: Synthetic oligonucleotide
  Target: SCN10A; (+) strand; PAM type: YTN; PAM sequence: TTC
taatcatatgttctcattcc

SEQ ID NO: 63229 - DNA, 20 bp, Artificial Sequence
  Description of Artificial Sequence: Synthetic oligonucleotide
  Target: SCN10A; (+) strand; PAM type: YTN; PAM sequence: CTA
atcatatgttctcattcctg

SEQ ID NO: 63230 - DNA, 20 bp, Artificial Sequence
  Description of Artificial Sequence: Synthetic oligonucleotide
  Target: SCN10A; (+) strand; PAM type: YTN; PAM sequence: TTC
tcattcctgcaagtcagact

SEQ ID NO: 63231 - DNA, 20 bp, Artificial Sequence
  Description of Artificial Sequence: Synthetic oligonucleotide
  Target: SCN10A; (+) strand; PAM type: YTN; PAM sequence: CTC
attcctgcaagtcagactgc

SEQ ID NO: 63232 - DNA, 20 bp, Artificial Sequence
  Description of Artificial Sequence: Synthetic oligonucleotide
  Target: SCN10A; (+) strand; PAM type: YTN; PAM sequence: TTC
ctgcaagtcagactgcctcc

SEQ ID NO: 63233 - DNA, 20 bp, Artificial Sequence
  Description of Artificial Sequence: Synthetic oligonucleotide
  Target: SCN10A; (+) strand; PAM type: YTN; PAM sequence: CTG
caagtcagactgcctcccaa

SEQ ID NO: 63234 - DNA, 20 bp, Artificial Sequence
  Description of Artificial Sequence: Synthetic oligonucleotide
  Target: SCN10A; (+) strand; PAM type: YTN; PAM sequence: CTG
cctcccaaggcacacttctt

SEQ ID NO: 63235 - DNA, 20 bp, Artificial Sequence
  Description of Artificial Sequence: Synthetic oligonucleotide
  Target: SCN10A; (+) strand; PAM type: YTN; PAM sequence: CTC
ccaaggcacacttcttgtaa

SEQ ID NO: 63236 - DNA, 20 bp, Artificial Sequence
  Description of Artificial Sequence: Synthetic oligonucleotide
  Target: SCN10A; (+) strand; PAM type: YTN; PAM sequence: CTT
cttgtaatgaatcccacatg

SEQ ID NO: 63237 - DNA, 20 bp, Artificial Sequence
  Description of Artificial Sequence: Synthetic oligonucleotide
  Target: SCN10A; (+) strand; PAM type: YTN; PAM sequence: TTC
ttgtaatgaatcccacatga

SEQ ID NO: 63238 - DNA, 20 bp, Artificial Sequence
  Description of Artificial Sequence: Synthetic oligonucleotide
  Target: SCN10A; (+) strand; PAM type: YTN; PAM sequence: CTT
gtaatgaatcccacatgaat

SEQ ID NO: 63239 - DNA, 20 bp, Artificial Sequence
  Description of Artificial Sequence: Synthetic oligonucleotide
  Target: SCN10A; (+) strand; PAM type: YTN; PAM sequence: TTG
taatgaatcccacatgaatt

SEQ ID NO: 63240 - DNA, 20 bp, Artificial Sequence
  Description of Artificial Sequence: Synthetic oligonucleotide
  Target: SCN10A; (+) strand; PAM type: YTN; PAM sequence: TTT
gaaaagtttgaagacttttc

SEQ ID NO: 63241 - DNA, 20 bp, Artificial Sequence
  Description of Artificial Sequence: Synthetic oligonucleotide
  Target: SCN10A; (+) strand; PAM type: YTN; PAM sequence: TTG
aaaagtttgaagacttttca

SEQ ID NO: 63242 - DNA, 20 bp, Artificial Sequence
  Description of Artificial Sequence: Synthetic oligonucleotide
  Target: SCN10A; (+) strand; PAM type: YTN; PAM sequence: TTT
gaagacttttcaaccagaga

SEQ ID NO: 63243 - DNA, 20 bp, Artificial Sequence
  Description of Artificial Sequence: Synthetic oligonucleotide
  Target: SCN10A; (+) strand; PAM type: YTN; PAM sequence: TTG
aagacttttcaaccagagaa

SEQ ID NO: 63244 - DNA, 20 bp, Artificial Sequence
  Description of Artificial Sequence: Synthetic oligonucleotide
  Target: SCN10A; (+) strand; PAM type: YTN; PAM sequence: CTT
ttcaaccagagaagtacaat

SEQ ID NO: 63245 - DNA, 20 bp, Artificial Sequence
  Description of Artificial Sequence: Synthetic oligonucleotide
  Target: SCN10A; (+) strand; PAM type: YTN; PAM sequence: TTT
tcaaccagagaagtacaatc

SEQ ID NO: 63246 - DNA, 20 bp, Artificial Sequence
  Description of Artificial Sequence: Synthetic oligonucleotide
  Target: SCN10A; (+) strand; PAM type: YTN; PAM sequence: TTT
caaccagagaagtacaatct

SEQ ID NO: 63247 - DNA, 20 bp, Artificial Sequence
  Description of Artificial Sequence: Synthetic oligonucleotide
  Target: SCN10A; (+) strand; PAM type: YTN; PAM sequence: TTC
aaccagagaagtacaatctg

SEQ ID NO: 63248 - DNA, 20 bp, Artificial Sequence
  Description of Artificial Sequence: Synthetic oligonucleotide
  Target: SCN10A; (+) strand; PAM type: YTN; PAM sequence: CTG
ggcataaaaatgcagatcaa

SEQ ID NO: 63249 - DNA, 20 bp, Artificial Sequence
  Description of Artificial Sequence: Synthetic oligonucleotide
  Target: SCN10A; (+) strand; PAM type: YTN; PAM sequence: CTT
tttcagataacccagaagcc

SEQ ID NO: 63250 - DNA, 20 bp, Artificial Sequence
  Description of Artificial Sequence: Synthetic oligonucleotide
  Target: SCN10A; (+) strand; PAM type: YTN; PAM sequence: TTT
ttcagataacccagaagcct

SEQ ID NO: 63251 - DNA, 20 bp, Artificial Sequence
  Description of Artificial Sequence: Synthetic oligonucleotide
  Target: SCN10A; (+) strand; PAM type: YTN; PAM sequence: TTT
tcagataacccagaagcctt

SEQ ID NO: 63252 - DNA, 20 bp, Artificial Sequence
  Description of Artificial Sequence: Synthetic oligonucleotide
  Target: SCN10A; (+) strand; PAM type: YTN; PAM sequence: TTT
cagataacccagaagccttc

SEQ ID NO: 63253 - DNA, 20 bp, Artificial Sequence
  Description of Artificial Sequence: Synthetic oligonucleotide
  Target: SCN10A; (+) strand; PAM type: YTN; PAM sequence: TTC
agataacccagaagccttct

SEQ ID NO: 63254 - DNA, 20 bp, Artificial Sequence
  Description of Artificial Sequence: Synthetic oligonucleotide
  Target: SCN10A; (+) strand; PAM type: YTN; PAM sequence: CTT
ctcctttccccaggagacag

SEQ ID NO: 63255 - DNA, 20 bp, Artificial Sequence
  Description of Artificial Sequence: Synthetic oligonucleotide
  Target: SCN10A; (+) strand; PAM type: YTN; PAM sequence: TTC
tcctttccccaggagacagt

SEQ ID NO: 63256 - DNA, 20 bp, Artificial Sequence
  Description of Artificial Sequence: Synthetic oligonucleotide
  Target: SCN10A; (+) strand; PAM type: YTN; PAM sequence: CTC
ctttccccaggagacagtgc

SEQ ID NO: 63257 - DNA, 20 bp, Artificial Sequence
  Description of Artificial Sequence: Synthetic oligonucleotide
  Target: SCN10A; (+) strand; PAM type: YTN; PAM sequence: CTT
tccccaggagacagtgcccc

SEQ ID NO: 63258 - DNA, 20 bp, Artificial Sequence
  Description of Artificial Sequence: Synthetic oligonucleotide
  Target: SCN10A; (+) strand; PAM type: YTN; PAM sequence: TTT
ccccaggagacagtgccccc

SEQ ID NO: 63259 - DNA, 20 bp, Artificial Sequence
  Description of Artificial Sequence: Synthetic oligonucleotide
  Target: SCN10A; (+) strand; PAM type: YTN; PAM sequence: TTC
cccaggagacagtgccccca

SEQ ID NO: 63260 - DNA, 20 bp, Artificial Sequence
  Description of Artificial Sequence: Synthetic oligonucleotide
  Target: SCN10A; (+) strand; PAM type: YTN; PAM sequence: TTC
accactcaccaccaggttcc

SEQ ID NO: 63261 - DNA, 20 bp, Artificial Sequence
  Description of Artificial Sequence: Synthetic oligonucleotide
  Target: SCN10A; (+) strand; PAM type: YTN; PAM sequence: CTC
accaccaggttccctagcac

SEQ ID NO: 63262 - DNA, 20 bp, Artificial Sequence
  Description of Artificial Sequence: Synthetic oligonucleotide
  Target: SCN10A; (+) strand; PAM type: YTN; PAM sequence: TTC
cctagcaccatcaccgtcaa

SEQ ID NO: 63263 - DNA, 20 bp, Artificial Sequence
  Description of Artificial Sequence: Synthetic oligonucleotide
  Target: SCN10A; (+) strand; PAM type: YTN; PAM sequence: CTA
gcaccatcaccgtcaagaaa

SEQ ID NO: 63264 - DNA, 20 bp, Artificial Sequence
  Description of Artificial Sequence: Synthetic oligonucleotide
  Target: SCN10A; (+) strand; PAM type: YTN; PAM sequence: TTT
ttggccaacttccatgcagg

SEQ ID NO: 63265 - DNA, 20 bp, Artificial Sequence
  Description of Artificial Sequence: Synthetic oligonucleotide
  Target: SCN10A; (+) strand; PAM type: YTN; PAM sequence: TTT
tggccaacttccatgcaggc

SEQ ID NO: 63266 - DNA, 20 bp, Artificial Sequence
  Description of Artificial Sequence: Synthetic oligonucleotide
  Target: SCN10A; (+) strand; PAM type: YTN; PAM sequence: TTT
ggccaacttccatgcaggcc

SEQ ID NO: 63267 - DNA, 20 bp, Artificial Sequence
  Description of Artificial Sequence: Synthetic oligonucleotide
  Target: SCN10A; (+) strand; PAM type: YTN; PAM sequence: TTG
gccaacttccatgcaggccc

SEQ ID NO: 63268 - DNA, 20 bp, Artificial Sequence
  Description of Artificial Sequence: Synthetic oligonucleotide
  Target: SCN10A; (+) strand; PAM type: YTN; PAM sequence: CTT
ccatgcaggcccacatgttc

SEQ ID NO: 63269 - DNA, 20 bp, Artificial Sequence
  Description of Artificial Sequence: Synthetic oligonucleotide
  Target: SCN10A; (+) strand; PAM type: YTN; PAM sequence: TTC
catgcaggcccacatgttct

SEQ ID NO: 63270 - DNA, 20 bp, Artificial Sequence
  Description of Artificial Sequence: Synthetic oligonucleotide
  Target: SCN10A; (+) strand; PAM type: YTN; PAM sequence: TTC
tcaatccactctccacagag

SEQ ID NO: 63271 - DNA, 20 bp, Artificial Sequence
  Description of Artificial Sequence: Synthetic oligonucleotide
  Target: SCN10A; (+) strand; PAM type: YTN; PAM sequence: CTC
aatccactctccacagagga

SEQ ID NO: 63272 - DNA, 20 bp, Artificial Sequence
  Description of Artificial Sequence: Synthetic oligonucleotide
  Target: SCN10A; (+) strand; PAM type: YTN; PAM sequence: CTC
tccacagaggatacggaaga

SEQ ID NO: 63273 - DNA, 20 bp, Artificial Sequence
  Description of Artificial Sequence: Synthetic oligonucleotide
  Target: SCN10A; (+) strand; PAM type: YTN; PAM sequence: CTC
cacagaggatacggaagaca

SEQ ID NO: 63274 - DNA, 20 bp, Artificial Sequence
  Description of Artificial Sequence: Synthetic oligonucleotide
  Target: SCN10A; (+) strand; PAM type: YTN; PAM sequence: CTT
catggggcgcggagatattt

SEQ ID NO: 63275 - DNA, 20 bp, Artificial Sequence
  Description of Artificial Sequence: Synthetic oligonucleotide
  Target: SCN10A; (+) strand; PAM type: YTN; PAM sequence: TTC
atggggcgcggagatatttt

SEQ ID NO: 63276 - DNA, 20 bp, Artificial Sequence
  Description of Artificial Sequence: Synthetic oligonucleotide
  Target: SCN10A; (+) strand; PAM type: YTN; PAM sequence: TTT
tttcggttgttacggtagtt

SEQ ID NO: 63277 - DNA, 20 bp, Artificial Sequence
  Description of Artificial Sequence: Synthetic oligonucleotide
  Target: SCN10A; (+) strand; PAM type: YTN; PAM sequence: TTT
ttcggttgttacggtagttt

SEQ ID NO: 63278 - DNA, 20 bp, Artificial Sequence
  Description of Artificial Sequence: Synthetic oligonucleotide
  Target: SCN10A; (+) strand; PAM type: YTN; PAM sequence: TTT
tcggttgttacggtagtttt

SEQ ID NO: 63279 - DNA, 20 bp, Artificial Sequence
  Description of Artificial Sequence: Synthetic oligonucleotide
  Target: SCN10A; (+) strand; PAM type: YTN; PAM sequence: TTT
cggttgttacggtagttttc

SEQ ID NO: 63280 - DNA, 20 bp, Artificial Sequence
  Description of Artificial Sequence: Synthetic oligonucleotide
  Target: SCN10A; (+) strand; PAM type: YTN; PAM sequence: TTC
ggttgttacggtagttttcc

SEQ ID NO: 63281 - DNA, 20 bp, Artificial Sequence
  Description of Artificial Sequence: Synthetic oligonucleotide
  Target: SCN10A; (+) strand; PAM type: YTN; PAM sequence: TTG
ttacggtagttttcccctag

SEQ ID NO: 63282 - DNA, 20 bp, Artificial Sequence
  Description of Artificial Sequence: Synthetic oligonucleotide
  Target: SCN10A; (+) strand; PAM type: YTN; PAM sequence: TTA
cggtagttttcccctaggag

SEQ ID NO: 63283 - DNA, 20 bp, Artificial Sequence
  Description of Artificial Sequence: Synthetic oligonucleotide
  Target: SCN10A; (+) strand; PAM type: YTN; PAM sequence: TTT
tcccctaggagctgcttgcc

SEQ ID NO: 63284 - DNA, 20 bp, Artificial Sequence
  Description of Artificial Sequence: Synthetic oligonucleotide
  Target: SCN10A; (+) strand; PAM type: YTN; PAM sequence: TTT
cccctaggagctgcttgcca

SEQ ID NO: 63285 - DNA, 20 bp, Artificial Sequence
  Description of Artificial Sequence: Synthetic oligonucleotide
  Target: SCN10A; (+) strand; PAM type: YTN; PAM sequence: TTC
ccctaggagctgcttgccaa

SEQ ID NO: 63286 - DNA, 20 bp, Artificial Sequence
  Description of Artificial Sequence: Synthetic oligonucleotide
  Target: SCN10A; (+) strand; PAM type: YTN; PAM sequence: CTA
ggagctgcttgccaaccaga

SEQ ID NO: 63287 - DNA, 20 bp, Artificial Sequence
  Description of Artificial Sequence: Synthetic oligonucleotide
  Target: SCN10A; (+) strand; PAM type: YTN; PAM sequence: CTG
cttgccaaccagagcaaaga

SEQ ID NO: 63288 - DNA, 20 bp, Artificial Sequence
  Description of Artificial Sequence: Synthetic oligonucleotide
  Target: SCN10A; (+) strand; PAM type: YTN; PAM sequence: CTT
gccaaccagagcaaagacaa

SEQ ID NO: 63289 - DNA, 20 bp, Artificial Sequence
  Description of Artificial Sequence: Synthetic oligonucleotide
  Target: SCN10A; (+) strand; PAM type: YTN; PAM sequence: TTG
ccaaccagagcaaagacaaa

SEQ ID NO: 63290 - DNA, 20 bp, Artificial Sequence
  Description of Artificial Sequence: Synthetic oligonucleotide
  Target: SCN10A; (+) strand; PAM type: YTN; PAM sequence: TTC
cccagtgcccccactgagtt

SEQ ID NO: 63291 - DNA, 20 bp, Artificial Sequence
  Description of Artificial Sequence: Synthetic oligonucleotide
  Target: SCN10A; (+) strand; PAM type: YTN; PAM sequence: CTG
agtttccgatgatcttgatg

SEQ ID NO: 63292 - DNA, 20 bp, Artificial Sequence
  Description of Artificial Sequence: Synthetic oligonucleotide
  Target: SCN10A; (+) strand; PAM type: YTN; PAM sequence: TTT
ccgatgatcttgatgagtgt

SEQ ID NO: 63293 - DNA, 20 bp, Artificial Sequence
  Description of Artificial Sequence: Synthetic oligonucleotide
  Target: SCN10A; (+) strand; PAM type: YTN; PAM sequence: TTC
cgatgatcttgatgagtgtg

SEQ ID NO: 63294 - DNA, 20 bp, Artificial Sequence
  Description of Artificial Sequence: Synthetic oligonucleotide
  Target: SCN10A; (+) strand; PAM type: YTN; PAM sequence: CTT
gatgagtgtgtttaaggtgg

SEQ ID NO: 63295 - DNA, 20 bp, Artificial Sequence
  Description of Artificial Sequence: Synthetic oligonucleotide
  Target: SCN10A; (+) strand; PAM type: YTN; PAM sequence: TTG
atgagtgtgtttaaggtggg

SEQ ID NO: 63296 - DNA, 20 bp, Artificial Sequence
  Description of Artificial Sequence: Synthetic oligonucleotide
  Target: SCN10A; (+) strand; PAM type: YTN; PAM sequence: TTT
aaggtgggccaggatttggc

SEQ ID NO: 63297 - DNA, 20 bp, Artificial Sequence
  Description of Artificial Sequence: Synthetic oligonucleotide
  Target: SCN10A; (+) strand; PAM type: YTN; PAM sequence: TTA
aggtgggccaggatttggcc

SEQ ID NO: 63298 - DNA, 20 bp, Artificial Sequence
  Description of Artificial Sequence: Synthetic oligonucleotide
  Target: SCN10A; (+) strand; PAM type: YTN; PAM sequence: TTT
ggccagcttgaatacgcgca

SEQ ID NO: 63299 - DNA, 20 bp, Artificial Sequence
  Description of Artificial Sequence: Synthetic oligonucleotide
  Target: SCN10A; (+) strand; PAM type: YTN; PAM sequence: TTG
gccagcttgaatacgcgcag

SEQ ID NO: 63300 - DNA, 20 bp, Artificial Sequence
  Description of Artificial Sequence: Synthetic oligonucleotide
  Target: SCN10A; (+) strand; PAM type: YTN; PAM sequence: CTT
gaatacgcgcagctgcagag

SEQ ID NO: 63301 - DNA, 20 bp, Artificial Sequence
  Description of Artificial Sequence: Synthetic oligonucleotide
  Target: SCN10A; (+) strand; PAM type: YTN; PAM sequence: TTG
aatacgcgcagctgcagaga

SEQ ID NO: 63302 - DNA, 20 bp, Artificial Sequence
  Description of Artificial Sequence: Synthetic oligonucleotide
  Target: SCN10A; (+) strand; PAM type: YTN; PAM sequence: CTG
cagagaaacagagaccgtca

SEQ ID NO: 63303 - DNA, 20 bp, Artificial Sequence
  Description of Artificial Sequence: Synthetic oligonucleotide
  Target: SCN10A; (+) strand; PAM type: YTN; PAM sequence: TTT
tggtagctgtgctcattacc

SEQ ID NO: 63304 - DNA, 20 bp, Artificial Sequence
  Description of Artificial Sequence: Synthetic oligonucleotide
  Target: SCN10A; (+) strand; PAM type: YTN; PAM sequence: TTT
ggtagctgtgctcattacct

SEQ ID NO: 63305 - DNA, 20 bp, Artificial Sequence
  Description of Artificial Sequence: Synthetic oligonucleotide
  Target: SCN10A; (+) strand; PAM type: YTN; PAM sequence: TTG
gtagctgtgctcattacctt

SEQ ID NO: 63306 - DNA, 20 bp, Artificial Sequence
  Description of Artificial Sequence: Synthetic oligonucleotide
  Target: SCN10A; (+) strand; PAM type: YTN; PAM sequence: CTG
tgctcattacctttcatcta

SEQ ID NO: 63307 - DNA, 20 bp, Artificial Sequence
  Description of Artificial Sequence: Synthetic oligonucleotide
  Target: SCN10A; (+) strand; PAM type: YTN; PAM sequence: CTC
attacctttcatctaaagtt

SEQ ID NO: 63308 - DNA, 20 bp, Artificial Sequence
  Description of Artificial Sequence: Synthetic oligonucleotide
  Target: SCN10A; (+) strand; PAM type: YTN; PAM sequence: TTA
cctttcatctaaagttttgc

SEQ ID NO: 63309 - DNA, 20 bp, Artificial Sequence
  Description of Artificial Sequence: Synthetic oligonucleotide
  Target: SCN10A; (+) strand; PAM type: YTN; PAM sequence: CTT
tcatctaaagttttgcctgg

SEQ ID NO: 63310 - DNA, 20 bp, Artificial Sequence
  Description of Artificial Sequence: Synthetic oligonucleotide
  Target: SCN10A; (+) strand; PAM type: YTN; PAM sequence: TTT
catctaaagttttgcctgga

SEQ ID NO: 63311 - DNA, 20 bp, Artificial Sequence
  Description of Artificial Sequence: Synthetic oligonucleotide
  Target: SCN10A; (+) strand; PAM type: YTN; PAM sequence: TTC
atctaaagttttgcctggaa

SEQ ID NO: 63312 - DNA, 20 bp, Artificial Sequence
  Description of Artificial Sequence: Synthetic oligonucleotide
  Target: SCN10A; (+) strand; PAM type: YTN; PAM sequence: CTA
aagttttgcctggaaaccaa

SEQ ID NO: 63313 - DNA, 20 bp, Artificial Sequence
  Description of Artificial Sequence: Synthetic oligonucleotide
  Target: SCN10A; (+) strand; PAM type: YTN; PAM sequence: TTT
tgcctggaaaccaaagatct

SEQ ID NO: 63314 - DNA, 20 bp, Artificial Sequence
  Description of Artificial Sequence: Synthetic oligonucleotide
  Target: SCN10A; (+) strand; PAM type: YTN; PAM sequence: TTT
gcctggaaaccaaagatctg

SEQ ID NO: 63315 - DNA, 20 bp, Artificial Sequence
  Description of Artificial Sequence: Synthetic oligonucleotide
  Target: SCN10A; (+) strand; PAM type: YTN; PAM sequence: TTG
cctggaaaccaaagatctgg

SEQ ID NO: 63316 - DNA, 20 bp, Artificial Sequence
  Description of Artificial Sequence: Synthetic oligonucleotide
  Target: SCN10A; (+) strand; PAM type: YTN; PAM sequence: CTG
gaaaccaaagatctgggaaa

SEQ ID NO: 63317 - DNA, 20 bp, Artificial Sequence
  Description of Artificial Sequence: Synthetic oligonucleotide
  Target: SCN10A; (+) strand; PAM type: YTN; PAM sequence: CTG
ggaaaaacacaaggcctctc

SEQ ID NO: 63318 - DNA, 20 bp, Artificial Sequence
  Description of Artificial Sequence: Synthetic oligonucleotide
  Target: SCN10A; (+) strand; PAM type: YTN; PAM sequence: CTC
tcatcccattaaaccagggc

SEQ ID NO: 63319 - DNA, 20 bp, Artificial Sequence
  Description of Artificial Sequence: Synthetic oligonucleotide
  Target: SCN10A; (+) strand; PAM type: YTN; PAM sequence: CTC
atcccattaaaccagggcgt

SEQ ID NO: 63320 - DNA, 20 bp, Artificial Sequence
  Description of Artificial Sequence: Synthetic oligonucleotide
  Target: SCN10A; (+) strand; PAM type: YTN; PAM sequence: TTA
aaccagggcgttttctggac

SEQ ID NO: 63321 - DNA, 20 bp, Artificial Sequence
  Description of Artificial Sequence: Synthetic oligonucleotide
  Target: SCN10A; (+) strand; PAM type: YTN; PAM sequence: TTT
tctggacactgcttttggag

SEQ ID NO: 63322 - DNA, 20 bp, Artificial Sequence
  Description of Artificial Sequence: Synthetic oligonucleotide
  Target: SCN10A; (+) strand; PAM type: YTN; PAM sequence: TTT
ctggacactgcttttggaga

SEQ ID NO: 63323 - DNA, 20 bp, Artificial Sequence
  Description of Artificial Sequence: Synthetic oligonucleotide
  Target: SCN10A; (+) strand; PAM type: YTN; PAM sequence: TTC
tggacactgcttttggagac

SEQ ID NO: 63324 - DNA, 20 bp, Artificial Sequence
  Description of Artificial Sequence: Synthetic oligonucleotide
  Target: SCN10A; (+) strand; PAM type: YTN; PAM sequence: CTG
gacactgcttttggagacct

SEQ ID NO: 63325 - DNA, 20 bp, Artificial Sequence
  Description of Artificial Sequence: Synthetic oligonucleotide
  Target: SCN10A; (+) strand; PAM type: YTN; PAM sequence: CTG
cttttggagacctttcttcc

SEQ ID NO: 63326 - DNA, 20 bp, Artificial Sequence
  Description of Artificial Sequence: Synthetic oligonucleotide
  Target: SCN10A; (+) strand; PAM type: YTN; PAM sequence: CTT
ttggagacctttcttcctat

SEQ ID NO: 63327 - DNA, 20 bp, Artificial Sequence
  Description of Artificial Sequence: Synthetic oligonucleotide
  Target: SCN10A; (+) strand; PAM type: YTN; PAM sequence: TTT
tggagacctttcttcctatg

SEQ ID NO: 63328 - DNA, 20 bp, Artificial Sequence
  Description of Artificial Sequence: Synthetic oligonucleotide
  Target: SCN10A; (+) strand; PAM type: YTN; PAM sequence: TTT
ggagacctttcttcctatgc

SEQ ID NO: 63329 - DNA, 20 bp, Artificial Sequence
  Description of Artificial Sequence: Synthetic oligonucleotide
  Target: SCN10A; (+) strand; PAM type: YTN; PAM sequence: TTG
gagacctttcttcctatgct

SEQ ID NO: 63330 - DNA, 20 bp, Artificial Sequence
  Description of Artificial Sequence: Synthetic oligonucleotide
  Target: SCN10A; (+) strand; PAM type: YTN; PAM sequence: CTT
tcttcctatgctataaatta

SEQ ID NO: 63331 - DNA, 20 bp, Artificial Sequence
  Description of Artificial Sequence: Synthetic oligonucleotide
  Target: SCN10A; (+) strand; PAM type: YTN; PAM sequence: TTT
cttcctatgctataaattac

SEQ ID NO: 63332 - DNA, 20 bp, Artificial Sequence
  Description of Artificial Sequence: Synthetic oligonucleotide
  Target: SCN10A; (+) strand; PAM type: YTN; PAM sequence: TTC
ttcctatgctataaattact

SEQ ID NO: 63333 - DNA, 20 bp, Artificial Sequence
  Description of Artificial Sequence: Synthetic oligonucleotide
  Target: SCN10A; (+) strand; PAM type: YTN; PAM sequence: CTT
cctatgctataaattactca

SEQ ID NO: 63334 - DNA, 20 bp, Artificial Sequence
  Description of Artificial Sequence: Synthetic oligonucleotide
  Target: SCN10A; (+) strand; PAM type: YTN; PAM sequence: TTC
ctatgctataaattactcaa

SEQ ID NO: 63335 - DNA, 20 bp, Artificial Sequence
  Description of Artificial Sequence: Synthetic oligonucleotide
  Target: SCN10A; (+) strand; PAM type: YTN; PAM sequence: CTA
tgctataaattactcaaaaa

SEQ ID NO: 63336 - DNA, 20 bp, Artificial Sequence
  Description of Artificial Sequence: Synthetic oligonucleotide
  Target: SCN10A; (+) strand; PAM type: YTN; PAM sequence: CTA
taaattactcaaaaatatga

SEQ ID NO: 63337 - DNA, 20 bp, Artificial Sequence
  Description of Artificial Sequence: Synthetic oligonucleotide
  Target: SCN10A; (+) strand; PAM type: YTN; PAM sequence: TTA
ctcaaaaatatgatctgcct

SEQ ID NO: 63338 - DNA, 20 bp, Artificial Sequence
  Description of Artificial Sequence: Synthetic oligonucleotide
  Target: SCN10A; (+) strand; PAM type: YTN; PAM sequence: CTC
aaaaatatgatctgccttct

SEQ ID NO: 63339 - DNA, 20 bp, Artificial Sequence
  Description of Artificial Sequence: Synthetic oligonucleotide
  Target: SCN10A; (+) strand; PAM type: YTN; PAM sequence: CTG
ccttctatggttcataagta

SEQ ID NO: 63340 - DNA, 20 bp, Artificial Sequence
  Description of Artificial Sequence: Synthetic oligonucleotide
  Target: SCN10A; (+) strand; PAM type: YTN; PAM sequence: CTT
ctatggttcataagtatcaa

SEQ ID NO: 63341 - DNA, 20 bp, Artificial Sequence
  Description of Artificial Sequence: Synthetic oligonucleotide
  Target: SCN10A; (+) strand; PAM type: YTN; PAM sequence: TTC
tatggttcataagtatcaat

SEQ ID NO: 63342 - DNA, 20 bp, Artificial Sequence
  Description of Artificial Sequence: Synthetic oligonucleotide
  Target: SCN10A; (+) strand; PAM type: YTN; PAM sequence: CTA
tggttcataagtatcaatgt

SEQ ID NO: 63343 - DNA, 20 bp, Artificial Sequence
  Description of Artificial Sequence: Synthetic oligonucleotide
  Target: SCN10A; (+) strand; PAM type: YTN; PAM sequence: TTC
ataagtatcaatgtgcttca

SEQ ID NO: 63344 - DNA, 20 bp, Artificial Sequence
  Description of Artificial Sequence: Synthetic oligonucleotide
  Target: SCN10A; (+) strand; PAM type: YTN; PAM sequence: CTT
cattgactgtggctgagtca

SEQ ID NO: 63345 - DNA, 20 bp, Artificial Sequence
  Description of Artificial Sequence: Synthetic oligonucleotide
  Target: SCN10A; (+) strand; PAM type: YTN; PAM sequence: TTC
attgactgtggctgagtcag

SEQ ID NO: 63346 - DNA, 20 bp, Artificial Sequence
  Description of Artificial Sequence: Synthetic oligonucleotide
  Target: SCN10A; (+) strand; PAM type: YTN; PAM sequence: TTG
actgtggctgagtcagggtc

SEQ ID NO: 63347 - DNA, 20 bp, Artificial Sequence
  Description of Artificial Sequence: Synthetic oligonucleotide
  Target: SCN10A; (+) strand; PAM type: YTN; PAM sequence: CTG
tggctgagtcagggtcttct

SEQ ID NO: 63348 - DNA, 20 bp, Artificial Sequence
  Description of Artificial Sequence: Synthetic oligonucleotide
  Target: SCN10A; (+) strand; PAM type: YTN; PAM sequence: CTG
agtcagggtcttctactggg

SEQ ID NO: 63349 - DNA, 20 bp, Artificial Sequence
  Description of Artificial Sequence: Synthetic oligonucleotide
  Target: SCN10A; (+) strand; PAM type: YTN; PAM sequence: CTT
ctactggggtggtggccttg

SEQ ID NO: 63350 - DNA, 20 bp, Artificial Sequence
  Description of Artificial Sequence: Synthetic oligonucleotide
  Target: SCN10A; (+) strand; PAM type: YTN; PAM sequence: TTC
tactggggtggtggccttgc

SEQ ID NO: 63351 - DNA, 20 bp, Artificial Sequence
  Description of Artificial Sequence: Synthetic oligonucleotide
  Target: SCN10A; (+) strand; PAM type: YTN; PAM sequence: CTA
ctggggtggtggccttgcga

SEQ ID NO: 63352 - DNA, 20 bp, Artificial Sequence
  Description of Artificial Sequence: Synthetic oligonucleotide
  Target: SCN10A; (+) strand; PAM type: YTN; PAM sequence: CTG
gggtggtggccttgcgatct

SEQ ID NO: 63353 - DNA, 20 bp, Artificial Sequence
  Description of Artificial Sequence: Synthetic oligonucleotide
  Target: SCN10A; (+) strand; PAM type: YTN; PAM sequence: CTT
gcgatctgtactctgttcta

SEQ ID NO: 63354 - DNA, 20 bp, Artificial Sequence
  Description of Artificial Sequence: Synthetic oligonucleotide
  Target: SCN10A; (+) strand; PAM type: YTN; PAM sequence: TTG
cgatctgtactctgttctat

SEQ ID NO: 63355 - DNA, 20 bp, Artificial Sequence
  Description of Artificial Sequence: Synthetic oligonucleotide
  Target: SCN10A; (+) strand; PAM type: YTN; PAM sequence: CTG
tactctgttctatagccaca

SEQ ID NO: 63356 - DNA, 20 bp, Artificial Sequence
  Description of Artificial Sequence: Synthetic oligonucleotide
  Target: SCN10A; (+) strand; PAM type: YTN; PAM sequence: CTC
tgttctatagccacaggcct

SEQ ID NO: 63357 - DNA, 20 bp, Artificial Sequence
  Description of Artificial Sequence: Synthetic oligonucleotide
  Target: SCN10A; (+) strand; PAM type: YTN; PAM sequence: CTG
ttctatagccacaggcctga

SEQ ID NO: 63358 - DNA, 20 bp, Artificial Sequence
  Description of Artificial Sequence: Synthetic oligonucleotide
  Target: SCN10A; (+) strand; PAM type: YTN; PAM sequence: TTC
tatagccacaggcctgatcc

SEQ ID NO: 63359 - DNA, 20 bp, Artificial Sequence
  Description of Artificial Sequence: Synthetic oligonucleotide
  Target: SCN10A; (+) strand; PAM type: YTN; PAM sequence: CTA
tagccacaggcctgatccct

SEQ ID NO: 63360 - DNA, 20 bp, Artificial Sequence
  Description of Artificial Sequence: Synthetic oligonucleotide
  Target: SCN10A; (+) strand; PAM type: YTN; PAM sequence: CTG
atccctcctgaatatgggcc

SEQ ID NO: 63361 - DNA, 20 bp, Artificial Sequence
  Description of Artificial Sequence: Synthetic oligonucleotide
  Target: SCN10A; (+) strand; PAM type: YTN; PAM sequence: CTC
ctgaatatgggcctcttctg

SEQ ID NO: 63362 - DNA, 20 bp, Artificial Sequence
  Description of Artificial Sequence: Synthetic oligonucleotide
  Target: SCN10A; (+) strand; PAM type: YTN; PAM sequence: CTG
aatatgggcctcttctgtgg

SEQ ID NO: 63363 - DNA, 20 bp, Artificial Sequence
  Description of Artificial Sequence: Synthetic oligonucleotide
  Target: SCN10A; (+) strand; PAM type: YTN; PAM sequence: CTC
ttctgtggaggtggggtggg

SEQ ID NO: 63364 - DNA, 20 bp, Artificial Sequence
  Description of Artificial Sequence: Synthetic oligonucleotide
  Target: SCN10A; (+) strand; PAM type: YTN; PAM sequence: CTT
ctgtggaggtggggtgggtg

SEQ ID NO: 63365 - DNA, 20 bp, Artificial Sequence
  Description of Artificial Sequence: Synthetic oligonucleotide
  Target: SCN10A; (+) strand; PAM type: YTN; PAM sequence: TTC
tgtggaggtggggtgggtgt

SEQ ID NO: 63366 - DNA, 20 bp, Artificial Sequence
  Description of Artificial Sequence: Synthetic oligonucleotide
  Target: SCN10A; (+) strand; PAM type: YTN; PAM sequence: CTG
tggaggtggggtgggtgtga

SEQ ID NO: 63367 - DNA, 20 bp, Artificial Sequence
  Description of Artificial Sequence: Synthetic oligonucleotide
  Target: SCN10A; (+) strand; PAM type: YTN; PAM sequence: CTC
acaaataagtgagaacaagc

SEQ ID NO: 63368 - DNA, 20 bp, Artificial Sequence
  Description of Artificial Sequence: Synthetic oligonucleotide
  Target: SCN10A; (+) strand; PAM type: YTN; PAM sequence: CTT
atttatgactgaagagagac

SEQ ID NO: 63369 - DNA, 20 bp, Artificial Sequence
  Description of Artificial Sequence: Synthetic oligonucleotide
  Target: SCN10A; (+) strand; PAM type: YTN; PAM sequence: TTA
tttatgactgaagagagacc

SEQ ID NO: 63370 - DNA, 20 bp, Artificial Sequence
  Description of Artificial Sequence: Synthetic oligonucleotide
  Target: SCN10A; (+) strand; PAM type: YTN; PAM sequence: TTT
atgactgaagagagaccagc

SEQ ID NO: 63371 - DNA, 20 bp, Artificial Sequence
  Description of Artificial Sequence: Synthetic oligonucleotide
  Target: SCN10A; (+) strand; PAM type: YTN; PAM sequence: TTA
tgactgaagagagaccagcc

SEQ ID NO: 63372 - DNA, 20 bp, Artificial Sequence
  Description of Artificial Sequence: Synthetic oligonucleotide
  Target: SCN10A; (+) strand; PAM type: YTN; PAM sequence: CTG
aagagagaccagcctccttc

SEQ ID NO: 63373 - DNA, 20 bp, Artificial Sequence
  Description of Artificial Sequence: Synthetic oligonucleotide
  Target: SCN10A; (+) strand; PAM type: YTN; PAM sequence: CTC
cttcgggtaggggatgaccc

SEQ ID NO: 63374 - DNA, 20 bp, Artificial Sequence
  Description of Artificial Sequence: Synthetic oligonucleotide
  Target: SCN10A; (+) strand; PAM type: YTN; PAM sequence: CTT
cgggtaggggatgacccact

SEQ ID NO: 63375 - DNA, 20 bp, Artificial Sequence
  Description of Artificial Sequence: Synthetic oligonucleotide
  Target: SCN10A; (+) strand; PAM type: YTN; PAM sequence: TTC
gggtaggggatgacccactg

SEQ ID NO: 63376 - DNA, 20 bp, Artificial Sequence
  Description of Artificial Sequence: Synthetic oligonucleotide
  Target: SCN10A; (+) strand; PAM type: YTN; PAM sequence: CTG
cattcgataggtattggcaa

SEQ ID NO: 63377 - DNA, 20 bp, Artificial Sequence
  Description of Artificial Sequence: Synthetic oligonucleotide
  Target: SCN10A; (+) strand; PAM type: YTN; PAM sequence: TTC
gataggtattggcaaaacat

SEQ ID NO: 63378 - DNA, 20 bp, Artificial Sequence
  Description of Artificial Sequence: Synthetic oligonucleotide
  Target: SCN10A; (+) strand; PAM type: YTN; PAM sequence: TTG
gcaaaacatctcttagggca

SEQ ID NO: 63379 - DNA, 20 bp, Artificial Sequence
  Description of Artificial Sequence: Synthetic oligonucleotide
  Target: SCN10A; (+) strand; PAM type: YTN; PAM sequence: CTC
ttagggcatttctcatcttg

SEQ ID NO: 63380 - DNA, 20 bp, Artificial Sequence
  Description of Artificial Sequence: Synthetic oligonucleotide
  Target: SCN10A; (+) strand; PAM type: YTN; PAM sequence: CTT
agggcatttctcatcttggg

SEQ ID NO: 63381 - DNA, 20 bp, Artificial Sequence
  Description of Artificial Sequence: Synthetic oligonucleotide
  Target: SCN10A; (+) strand; PAM type: YTN; PAM sequence: TTA
gggcatttctcatcttgggg

SEQ ID NO: 63382 - DNA, 20 bp, Artificial Sequence
  Description of Artificial Sequence: Synthetic oligonucleotide
  Target: SCN10A; (+) strand; PAM type: YTN; PAM sequence: TTT
ctcatcttggggcagtggac

SEQ ID NO: 63383 - DNA, 20 bp, Artificial Sequence
  Description of Artificial Sequence: Synthetic oligonucleotide
  Target: SCN10A; (+) strand; PAM type: YTN; PAM sequence: TTC
tcatcttggggcagtggaca

SEQ ID NO: 63384 - DNA, 20 bp, Artificial Sequence
  Description of Artificial Sequence: Synthetic oligonucleotide
  Target: SCN10A; (+) strand; PAM type: YTN; PAM sequence: CTC
atcttggggcagtggacaac

SEQ ID NO: 63385 - DNA, 20 bp, Artificial Sequence
  Description of Artificial Sequence: Synthetic oligonucleotide
  Target: SCN10A; (+) strand; PAM type: YTN; PAM sequence: CTT
ggggcagtggacaacatctg

SEQ ID NO: 63386 - DNA, 20 bp, Artificial Sequence
  Description of Artificial Sequence: Synthetic oligonucleotide
  Target: SCN10A; (+) strand; PAM type: YTN; PAM sequence: TTG
gggcagtggacaacatctgt

SEQ ID NO: 63387 - DNA, 20 bp, Artificial Sequence
  Description of Artificial Sequence: Synthetic oligonucleotide
  Target: SCN10A; (+) strand; PAM type: YTN; PAM sequence: CTG
ttgctcccaccagctttgaa

SEQ ID NO: 63388 - DNA, 20 bp, Artificial Sequence
  Description of Artificial Sequence: Synthetic oligonucleotide
  Target: SCN10A; (+) strand; PAM type: YTN; PAM sequence: TTG
ctcccaccagctttgaaact

SEQ ID NO: 63389 - DNA, 20 bp, Artificial Sequence
  Description of Artificial Sequence: Synthetic oligonucleotide
  Target: SCN10A; (+) strand; PAM type: YTN; PAM sequence: CTC
ccaccagctttgaaactgca

SEQ ID NO: 63390 - DNA, 20 bp, Artificial Sequence
  Description of Artificial Sequence: Synthetic oligonucleotide
  Target: SCN10A; (+) strand; PAM type: YTN; PAM sequence: CTT
tgaaactgcaaatgtccatg

SEQ ID NO: 63391 - DNA, 20 bp, Artificial Sequence
  Description of Artificial Sequence: Synthetic oligonucleotide
  Target: SCN10A; (+) strand; PAM type: YTN; PAM sequence: TTT
gaaactgcaaatgtccatga

SEQ ID NO: 63392 - DNA, 20 bp, Artificial Sequence
  Description of Artificial Sequence: Synthetic oligonucleotide
  Target: SCN10A; (+) strand; PAM type: YTN; PAM sequence: TTG
aaactgcaaatgtccatgat

SEQ ID NO: 63393 - DNA, 20 bp, Artificial Sequence
  Description of Artificial Sequence: Synthetic oligonucleotide
  Target: SCN10A; (+) strand; PAM type: YTN; PAM sequence: CTG
caaatgtccatgatttcatg

SEQ ID NO: 63394 - DNA, 20 bp, Artificial Sequence
  Description of Artificial Sequence: Synthetic oligonucleotide
  Target: SCN10A; (+) strand; PAM type: YTN; PAM sequence: TTT
catggactcagcattcataa

SEQ ID NO: 63395 - DNA, 20 bp, Artificial Sequence
  Description of Artificial Sequence: Synthetic oligonucleotide
  Target: SCN10A; (+) strand; PAM type: YTN; PAM sequence: TTC
atggactcagcattcataag

SEQ ID NO: 63396 - DNA, 20 bp, Artificial Sequence
  Description of Artificial Sequence: Synthetic oligonucleotide
  Target: SCN10A; (+) strand; PAM type: YTN; PAM sequence: CTC
agcattcataagttgattta

SEQ ID NO: 63397 - DNA, 20 bp, Artificial Sequence
  Description of Artificial Sequence: Synthetic oligonucleotide
  Target: SCN10A; (+) strand; PAM type: YTN; PAM sequence: TTC
ataagttgatttaattgacc

SEQ ID NO: 63398 - DNA, 20 bp, Artificial Sequence
  Description of Artificial Sequence: Synthetic oligonucleotide
  Target: SCN10A; (+) strand; PAM type: YTN; PAM sequence: TTG
atttaattgaccaacgaacc

SEQ ID NO: 63399 - DNA, 20 bp, Artificial Sequence
  Description of Artificial Sequence: Synthetic oligonucleotide
  Target: SCN10A; (+) strand; PAM type: YTN; PAM sequence: TTT
aattgaccaacgaacctacc

SEQ ID NO: 63400 - DNA, 20 bp, Artificial Sequence
  Description of Artificial Sequence: Synthetic oligonucleotide
  Target: SCN10A; (+) strand; PAM type: YTN; PAM sequence: TTA
attgaccaacgaacctaccc

SEQ ID NO: 63401 - DNA, 20 bp, Artificial Sequence
  Description of Artificial Sequence: Synthetic oligonucleotide
  Target: SCN10A; (+) strand; PAM type: YTN; PAM sequence: TTG
accaacgaacctacccccca

SEQ ID NO: 63402 - DNA, 20 bp, Artificial Sequence
  Description of Artificial Sequence: Synthetic oligonucleotide
  Target: SCN10A; (+) strand; PAM type: YTN; PAM sequence: CTA
ccccccagaactccagccgt

SEQ ID NO: 63403 - DNA, 20 bp, Artificial Sequence
  Description of Artificial Sequence: Synthetic oligonucleotide
  Target: SCN10A; (+) strand; PAM type: YTN; PAM sequence: CTC
cagccgtgcaggtgcatggc

SEQ ID NO: 63404 - DNA, 20 bp, Artificial Sequence
  Description of Artificial Sequence: Synthetic oligonucleotide
  Target: SCN10A; (+) strand; PAM type: YTN; PAM sequence: CTA
gcctatgaggtgtatgaaga

SEQ ID NO: 63405 - DNA, 20 bp, Artificial Sequence
  Description of Artificial Sequence: Synthetic oligonucleotide
  Target: SCN10A; (+) strand; PAM type: YTN; PAM sequence: CTA
tgaggtgtatgaagagaggt

SEQ ID NO: 63406 - DNA, 20 bp, Artificial Sequence
  Description of Artificial Sequence: Synthetic oligonucleotide
  Target: SCN10A; (+) strand; PAM type: YTN; PAM sequence: CTC
ttgctctcatggaaccaatg

SEQ ID NO: 63407 - DNA, 20 bp, Artificial Sequence
  Description of Artificial Sequence: Synthetic oligonucleotide
  Target: SCN10A; (+) strand; PAM type: YTN; PAM sequence: CTT
gctctcatggaaccaatggt

SEQ ID NO: 63408 - DNA, 20 bp, Artificial Sequence
  Description of Artificial Sequence: Synthetic oligonucleotide
  Target: SCN10A; (+) strand; PAM type: YTN; PAM sequence: TTG
ctctcatggaaccaatggtt

SEQ ID NO: 63409 - DNA, 20 bp, Artificial Sequence
  Description of Artificial Sequence: Synthetic oligonucleotide
  Target: SCN10A; (+) strand; PAM type: YTN; PAM sequence: CTC
tcatggaaccaatggtttag

SEQ ID NO: 63410 - DNA, 20 bp, Artificial Sequence
  Description of Artificial Sequence: Synthetic oligonucleotide
  Target: SCN10A; (+) strand; PAM type: YTN; PAM sequence: CTC
atggaaccaatggtttagtt

SEQ ID NO: 63411 - DNA, 20 bp, Artificial Sequence
  Description of Artificial Sequence: Synthetic oligonucleotide
  Target: SCN10A; (+) strand; PAM type: YTN; PAM sequence: TTT
agttactgagaaaagatgaa

SEQ ID NO: 63412 - DNA, 20 bp, Artificial Sequence
  Description of Artificial Sequence: Synthetic oligonucleotide
  Target: SCN10A; (+) strand; PAM type: YTN; PAM sequence: TTA
gttactgagaaaagatgaag

SEQ ID NO: 63413 - DNA, 20 bp, Artificial Sequence
  Description of Artificial Sequence: Synthetic oligonucleotide
  Target: SCN10A; (+) strand; PAM type: YTN; PAM sequence: TTA
ctgagaaaagatgaagtctc

SEQ ID NO: 63414 - DNA, 20 bp, Artificial Sequence
  Description of Artificial Sequence: Synthetic oligonucleotide
  Target: SCN10A; (+) strand; PAM type: YTN; PAM sequence: CTG
agaaaagatgaagtctcaaa

SEQ ID NO: 63415 - DNA, 20 bp, Artificial Sequence
  Description of Artificial Sequence: Synthetic oligonucleotide
  Target: SCN10A; (+) strand; PAM type: YTN; PAM sequence: CTC
aaaagtcttcactgtaaact

SEQ ID NO: 63416 - DNA, 20 bp, Artificial Sequence
  Description of Artificial Sequence: Synthetic oligonucleotide
  Target: SCN10A; (+) strand; PAM type: YTN; PAM sequence: CTT
cactgtaaactcaaatatgc

SEQ ID NO: 63417 - DNA, 20 bp, Artificial Sequence
  Description of Artificial Sequence: Synthetic oligonucleotide
  Target: SCN10A; (+) strand; PAM type: YTN; PAM sequence: TTC
actgtaaactcaaatatgct

SEQ ID NO: 63418 - DNA, 20 bp, Artificial Sequence
  Description of Artificial Sequence: Synthetic oligonucleotide
  Target: SCN10A; (+) strand; PAM type: YTN; PAM sequence: CTG
taaactcaaatatgctaagt

SEQ ID NO: 63419 - DNA, 20 bp, Artificial Sequence
  Description of Artificial Sequence: Synthetic oligonucleotide
  Target: SCN10A; (+) strand; PAM type: YTN; PAM sequence: CTC
aaatatgctaagtcccacaa

SEQ ID NO: 63420 - DNA, 20 bp, Artificial Sequence
  Description of Artificial Sequence: Synthetic oligonucleotide
  Target: SCN10A; (+) strand; PAM type: YTN; PAM sequence: CTA
agtcccacaagacagcaaaa

SEQ ID NO: 63421 - DNA, 20 bp, Artificial Sequence
  Description of Artificial Sequence: Synthetic oligonucleotide
  Target: SCN10A; (+) strand; PAM type: YTN; PAM sequence: TTT
taaaatatatttgtatggtt

SEQ ID NO: 63422 - DNA, 20 bp, Artificial Sequence
  Description of Artificial Sequence: Synthetic oligonucleotide
  Target: SCN10A; (+) strand; PAM type: YTN; PAM sequence: TTT
aaaatatatttgtatggttc

SEQ ID NO: 63423 - DNA, 20 bp, Artificial Sequence
  Description of Artificial Sequence: Synthetic oligonucleotide
  Target: SCN10A; (+) strand; PAM type: YTN; PAM sequence: TTA
aaatatatttgtatggttct

SEQ ID NO: 63424 - DNA, 20 bp, Artificial Sequence
  Description of Artificial Sequence: Synthetic oligonucleotide
  Target: SCN10A; (+) strand; PAM type: YTN; PAM sequence: TTT
gtatggttctctaatttgtc

SEQ ID NO: 63425 - DNA, 20 bp, Artificial Sequence
  Description of Artificial Sequence: Synthetic oligonucleotide
  Target: SCN10A; (+) strand; PAM type: YTN; PAM sequence: TTG
tatggttctctaatttgtca

SEQ ID NO: 63426 - DNA, 20 bp, Artificial Sequence
  Description of Artificial Sequence: Synthetic oligonucleotide
  Target: SCN10A; (+) strand; PAM type: YTN; PAM sequence: TTC
tctaatttgtcaggaaaaaa

SEQ ID NO: 63427 - DNA, 20 bp, Artificial Sequence
  Description of Artificial Sequence: Synthetic oligonucleotide
  Target: SCN10A; (+) strand; PAM type: YTN; PAM sequence: CTC
taatttgtcaggaaaaaaaa

SEQ ID NO: 63428 - DNA, 20 bp, Artificial Sequence
  Description of Artificial Sequence: Synthetic oligonucleotide
  Target: SCN10A; (+) strand; PAM type: YTN; PAM sequence: CTA
atttgtcaggaaaaaaaatc

SEQ ID NO: 63429 - DNA, 20 bp, Artificial Sequence
  Description of Artificial Sequence: Synthetic oligonucleotide
  Target: SCN10A; (+) strand; PAM type: YTN; PAM sequence: TTT
gtcaggaaaaaaaatctgag

SEQ ID NO: 63430 - DNA, 20 bp, Artificial Sequence
  Description of Artificial Sequence: Synthetic oligonucleotide
  Target: SCN10A; (+) strand; PAM type: YTN; PAM sequence: TTG
tcaggaaaaaaaatctgagc

SEQ ID NO: 63431 - DNA, 20 bp, Artificial Sequence
  Description of Artificial Sequence: Synthetic oligonucleotide
  Target: SCN10A; (+) strand; PAM type: YTN; PAM sequence: CTG
agctcaactgtcagtctgtc

SEQ ID NO: 63432 - DNA, 20 bp, Artificial Sequence
  Description of Artificial Sequence: Synthetic oligonucleotide
  Target: SCN10A; (+) strand; PAM type: YTN; PAM sequence: CTC
aactgtcagtctgtcagtca

SEQ ID NO: 63433 - DNA, 20 bp, Artificial Sequence
  Description of Artificial Sequence: Synthetic oligonucleotide
  Target: SCN10A; (+) strand; PAM type: YTN; PAM sequence: CTG
tcagtctgtcagtcaaggtg

SEQ ID NO: 63434 - DNA, 20 bp, Artificial Sequence
  Description of Artificial Sequence: Synthetic oligonucleotide
  Target: SCN10A; (+) strand; PAM type: YTN; PAM sequence: CTG
tcagtcaaggtgtgtttatg

SEQ ID NO: 63435 - DNA, 20 bp, Artificial Sequence
  Description of Artificial Sequence: Synthetic oligonucleotide
  Target: SCN10A; (+) strand; PAM type: YTN; PAM sequence: TTT
atggagcacctactaagagc

SEQ ID NO: 63436 - DNA, 20 bp, Artificial Sequence
  Description of Artificial Sequence: Synthetic oligonucleotide
  Target: SCN10A; (+) strand; PAM type: YTN; PAM sequence: TTA
tggagcacctactaagagcc

SEQ ID NO: 63437 - DNA, 20 bp, Artificial Sequence
  Description of Artificial Sequence: Synthetic oligonucleotide
  Target: SCN10A; (+) strand; PAM type: YTN; PAM sequence: CTA
ctaagagccaggctgtggct

SEQ ID NO: 63438 - DNA, 20 bp, Artificial Sequence
  Description of Artificial Sequence: Synthetic oligonucleotide
  Target: SCN10A; (+) strand; PAM type: YTN; PAM sequence: CTA
agagccaggctgtggcttag

SEQ ID NO: 63439 - DNA, 20 bp, Artificial Sequence
  Description of Artificial Sequence: Synthetic oligonucleotide
  Target: SCN10A; (+) strand; PAM type: YTN; PAM sequence: CTG
tggcttaggtgctaggatgc

SEQ ID NO: 63440 - DNA, 20 bp, Artificial Sequence
  Description of Artificial Sequence: Synthetic oligonucleotide
  Target: SCN10A; (+) strand; PAM type: YTN; PAM sequence: CTT
aggtgctaggatgcaatgct

SEQ ID NO: 63441 - DNA, 20 bp, Artificial Sequence
  Description of Artificial Sequence: Synthetic oligonucleotide
  Target: SCN10A; (+) strand; PAM type: YTN; PAM sequence: TTA
ggtgctaggatgcaatgctg

SEQ ID NO: 63442 - DNA, 20 bp, Artificial Sequence
  Description of Artificial Sequence: Synthetic oligonucleotide
  Target: SCN10A; (+) strand; PAM type: YTN; PAM sequence: CTA
ggatgcaatgctgaacacaa

SEQ ID NO: 63443 - DNA, 20 bp, Artificial Sequence
  Description of Artificial Sequence: Synthetic oligonucleotide
  Target: SCN10A; (+) strand; PAM type: YTN; PAM sequence: CTG
aacacaacagtgtagctaca

SEQ ID NO: 63444 - DNA, 20 bp, Artificial Sequence
  Description of Artificial Sequence: Synthetic oligonucleotide
  Target: SCN10A; (+) strand; PAM type: YTN; PAM sequence: CTA
caattttatcacccatatcc

SEQ ID NO: 63445 - DNA, 20 bp, Artificial Sequence
  Description of Artificial Sequence: Synthetic oligonucleotide
  Target: SCN10A; (+) strand; PAM type: YTN; PAM sequence: TTT
tatcacccatatccgtgagt

SEQ ID NO: 63446 - DNA, 20 bp, Artificial Sequence
  Description of Artificial Sequence: Synthetic oligonucleotide
  Target: SCN10A; (+) strand; PAM type: YTN; PAM sequence: TTT
atcacccatatccgtgagta

SEQ ID NO: 63447 - DNA, 20 bp, Artificial Sequence
  Description of Artificial Sequence: Synthetic oligonucleotide
  Target: SCN10A; (+) strand; PAM type: YTN; PAM sequence: TTA
tcacccatatccgtgagtaa

SEQ ID NO: 63448 - DNA, 20 bp, Artificial Sequence
  Description of Artificial Sequence: Synthetic oligonucleotide
  Target: SCN10A; (+) strand; PAM type: YTN; PAM sequence: TTT
aatcctgttatacagtaagt

SEQ ID NO: 63449 - DNA, 20 bp, Artificial Sequence
  Description of Artificial Sequence: Synthetic oligonucleotide
  Target: SCN10A; (+) strand; PAM type: YTN; PAM sequence: TTA
atcctgttatacagtaagtg

SEQ ID NO: 63450 - DNA, 20 bp, Artificial Sequence
  Description of Artificial Sequence: Synthetic oligonucleotide
  Target: SCN10A; (+) strand; PAM type: YTN; PAM sequence: CTG
ttatacagtaagtgctgtat

SEQ ID NO: 63451 - DNA, 20 bp, Artificial Sequence
  Description of Artificial Sequence: Synthetic oligonucleotide
  Target: SCN10A; (+) strand; PAM type: YTN; PAM sequence: TTA
tacagtaagtgctgtatgca

SEQ ID NO: 63452 - DNA, 20 bp, Artificial Sequence
  Description of Artificial Sequence: Synthetic oligonucleotide
  Target: SCN10A; (+) strand; PAM type: YTN; PAM sequence: CTG
tatgcacctctttatgtgat

SEQ ID NO: 63453 - DNA, 20 bp, Artificial Sequence
  Description of Artificial Sequence: Synthetic oligonucleotide
  Target: SCN10A; (+) strand; PAM type: YTN; PAM sequence: CTC
tttatgtgatgggggagagc

SEQ ID NO: 63454 - DNA, 20 bp, Artificial Sequence
  Description of Artificial Sequence: Synthetic oligonucleotide
  Target: SCN10A; (+) strand; PAM type: YTN; PAM sequence: CTT
tatgtgatgggggagagcgg

SEQ ID NO: 63455 - DNA, 20 bp, Artificial Sequence
  Description of Artificial Sequence: Synthetic oligonucleotide
  Target: SCN10A; (+) strand; PAM type: YTN; PAM sequence: TTT
atgtgatgggggagagcggg

SEQ ID NO: 63456 - DNA, 20 bp, Artificial Sequence
  Description of Artificial Sequence: Synthetic oligonucleotide
  Target: SCN10A; (+) strand; PAM type: YTN; PAM sequence: TTA
tgtgatgggggagagcgggt

SEQ ID NO: 63457 - DNA, 20 bp, Artificial Sequence
  Description of Artificial Sequence: Synthetic oligonucleotide
  Target: SCN10A; (+) strand; PAM type: YTN; PAM sequence: TTC
accttacacccaatctggaa

SEQ ID NO: 63458 - DNA, 20 bp, Artificial Sequence
  Description of Artificial Sequence: Synthetic oligonucleotide
  Target: SCN10A; (+) strand; PAM type: YTN; PAM sequence: CTT
acacccaatctggaagttac

SEQ ID NO: 63459 - DNA, 20 bp, Artificial Sequence
  Description of Artificial Sequence: Synthetic oligonucleotide
  Target: SCN10A; (+) strand; PAM type: YTN; PAM sequence: TTA
cacccaatctggaagttact

SEQ ID NO: 63460 - DNA, 20 bp, Artificial Sequence
  Description of Artificial Sequence: Synthetic oligonucleotide
  Target: SCN10A; (+) strand; PAM type: YTN; PAM sequence: CTG
gaagttactctcctcatatg

SEQ ID NO: 63461 - DNA, 20 bp, Artificial Sequence
  Description of Artificial Sequence: Synthetic oligonucleotide
  Target: SCN10A; (+) strand; PAM type: YTN; PAM sequence: TTA
ctctcctcatatgggaagca

SEQ ID NO: 63462 - DNA, 20 bp, Artificial Sequence
  Description of Artificial Sequence: Synthetic oligonucleotide
  Target: SCN10A; (+) strand; PAM type: YTN; PAM sequence: CTC
tcctcatatgggaagcagag

SEQ ID NO: 63463 - DNA, 20 bp, Artificial Sequence
  Description of Artificial Sequence: Synthetic oligonucleotide
  Target: SCN10A; (+) strand; PAM type: YTN; PAM sequence: CTC
ctcatatgggaagcagagct

SEQ ID NO: 63464 - DNA, 20 bp, Artificial Sequence
  Description of Artificial Sequence: Synthetic oligonucleotide
  Target: SCN10A; (+) strand; PAM type: YTN; PAM sequence: CTC
atatgggaagcagagcttaa

SEQ ID NO: 63465 - DNA, 20 bp, Artificial Sequence
  Description of Artificial Sequence: Synthetic oligonucleotide
  Target: SCN10A; (+) strand; PAM type: YTN; PAM sequence: CTT
aaaacaacaactctgtggac

SEQ ID NO: 63466 - DNA, 20 bp, Artificial Sequence
  Description of Artificial Sequence: Synthetic oligonucleotide
  Target: SCN10A; (+) strand; PAM type: YTN; PAM sequence: TTA
aaacaacaactctgtggact

SEQ ID NO: 63467 - DNA, 20 bp, Artificial Sequence
  Description of Artificial Sequence: Synthetic oligonucleotide
  Target: SCN10A; (+) strand; PAM type: YTN; PAM sequence: CTC
tgtggactggtcacagaggc

SEQ ID NO: 63468 - DNA, 20 bp, Artificial Sequence
  Description of Artificial Sequence: Synthetic oligonucleotide
  Target: SCN10A; (+) strand; PAM type: YTN; PAM sequence: CTG
tggactggtcacagaggcag

SEQ ID NO: 63469 - DNA, 20 bp, Artificial Sequence
  Description of Artificial Sequence: Synthetic oligonucleotide
  Target: SCN10A; (+) strand; PAM type: YTN; PAM sequence: CTG
gtcacagaggcagctgataa

SEQ ID NO: 63470 - DNA, 20 bp, Artificial Sequence
  Description of Artificial Sequence: Synthetic oligonucleotide
  Target: SCN10A; (+) strand; PAM type: YTN; PAM sequence: CTG
ataaacacaaataaaaactg

SEQ ID NO: 63471 - DNA, 20 bp, Artificial Sequence
  Description of Artificial Sequence: Synthetic oligonucleotide
  Target: SCN10A; (+) strand; PAM type: YTN; PAM sequence: CTG
agcattagtaactagtatgg

SEQ ID NO: 63472 - DNA, 20 bp, Artificial Sequence
  Description of Artificial Sequence: Synthetic oligonucleotide
  Target: SCN10A; (+) strand; PAM type: YTN; PAM sequence: TTA
gtaactagtatggggagcag

SEQ ID NO: 63473 - DNA, 20 bp, Artificial Sequence
  Description of Artificial Sequence: Synthetic oligonucleotide
  Target: SCN10A; (+) strand; PAM type: YTN; PAM sequence: CTA
gtatggggagcaggaaacgt

SEQ ID NO: 63474 - DNA, 20 bp, Artificial Sequence
  Description of Artificial Sequence: Synthetic oligonucleotide
  Target: SCN10A; (+) strand; PAM type: YTN; PAM sequence: CTG
ccgaaggttgtaagcctagc

SEQ ID NO: 63475 - DNA, 20 bp, Artificial Sequence
  Description of Artificial Sequence: Synthetic oligonucleotide
  Target: SCN10A; (+) strand; PAM type: YTN; PAM sequence: TTG
taagcctagcaggaatttct

SEQ ID NO: 63476 - DNA, 20 bp, Artificial Sequence
  Description of Artificial Sequence: Synthetic oligonucleotide
  Target: SCN10A; (+) strand; PAM type: YTN; PAM sequence: CTA
gcaggaatttctccctgctt

SEQ ID NO: 63477 - DNA, 20 bp, Artificial Sequence
  Description of Artificial Sequence: Synthetic oligonucleotide
  Target: SCN10A; (+) strand; PAM type: YTN; PAM sequence: TTT
ctccctgctttaagactaga

SEQ ID NO: 63478 - DNA, 20 bp, Artificial Sequence
  Description of Artificial Sequence: Synthetic oligonucleotide
  Target: SCN10A; (+) strand; PAM type: YTN; PAM sequence: TTC
tccctgctttaagactagat

SEQ ID NO: 63479 - DNA, 20 bp, Artificial Sequence
  Description of Artificial Sequence: Synthetic oligonucleotide
  Target: SCN10A; (+) strand; PAM type: YTN; PAM sequence: CTC
cctgctttaagactagatcc

SEQ ID NO: 63480 - DNA, 20 bp, Artificial Sequence
  Description of Artificial Sequence: Synthetic oligonucleotide
  Target: SCN10A; (+) strand; PAM type: YTN; PAM sequence: CTG
ctttaagactagatcccaaa

SEQ ID NO: 63481 - DNA, 20 bp, Artificial Sequence
  Description of Artificial Sequence: Synthetic oligonucleotide
  Target: SCN10A; (+) strand; PAM type: YTN; PAM sequence: CTT
taagactagatcccaaagag

SEQ ID NO: 63482 - DNA, 20 bp, Artificial Sequence
  Description of Artificial Sequence: Synthetic oligonucleotide
  Target: SCN10A; (+) strand; PAM type: YTN; PAM sequence: TTT
aagactagatcccaaagagc

SEQ ID NO: 63483 - DNA, 20 bp, Artificial Sequence
  Description of Artificial Sequence: Synthetic oligonucleotide
  Target: SCN10A; (+) strand; PAM type: YTN; PAM sequence: TTA
agactagatcccaaagagct

SEQ ID NO: 63484 - DNA, 20 bp, Artificial Sequence
  Description of Artificial Sequence: Synthetic oligonucleotide
  Target: SCN10A; (+) strand; PAM type: YTN; PAM sequence: CTA
gatcccaaagagctataccc

SEQ ID NO: 63485 - DNA, 20 bp, Artificial Sequence
  Description of Artificial Sequence: Synthetic oligonucleotide
  Target: SCN10A; (+) strand; PAM type: YTN; PAM sequence: CTA
tacccttcatgtaaggatga

SEQ ID NO: 63486 - DNA, 20 bp, Artificial Sequence
  Description of Artificial Sequence: Synthetic oligonucleotide
  Target: SCN10A; (+) strand; PAM type: YTN; PAM sequence: CTT
catgtaaggatgaaccacaa

SEQ ID NO: 63487 - DNA, 20 bp, Artificial Sequence
  Description of Artificial Sequence: Synthetic oligonucleotide
  Target: SCN10A; (+) strand; PAM type: YTN; PAM sequence: TTC
atgtaaggatgaaccacaaa

SEQ ID NO: 63488 - DNA, 20 bp, Artificial Sequence
  Description of Artificial Sequence: Synthetic oligonucleotide
  Target: SCN10A; (+) strand; PAM type: YTN; PAM sequence: TTG
aatggctggtgttaggtacc

SEQ ID NO: 63489 - DNA, 20 bp, Artificial Sequence
  Description of Artificial Sequence: Synthetic oligonucleotide
  Target: SCN10A; (+) strand; PAM type: YTN; PAM sequence: CTG
gtgttaggtaccagctacag

SEQ ID NO: 63490 - DNA, 20 bp, Artificial Sequence
  Description of Artificial Sequence: Synthetic oligonucleotide
  Target: SCN10A; (+) strand; PAM type: YTN; PAM sequence: TTA
ggtaccagctacaggaggaa

SEQ ID NO: 63491 - DNA, 20 bp, Artificial Sequence
  Description of Artificial Sequence: Synthetic oligonucleotide
  Target: SCN10A; (+) strand; PAM type: YTN; PAM sequence: CTA
caggaggaaaattgacgctg

SEQ ID NO: 63492 - DNA, 20 bp, Artificial Sequence
  Description of Artificial Sequence: Synthetic oligonucleotide
  Target: SCN10A; (+) strand; PAM type: YTN; PAM sequence: TTG
acgctgagcatttgaaacaa

SEQ ID NO: 63493 - DNA, 20 bp, Artificial Sequence
  Description of Artificial Sequence: Synthetic oligonucleotide
  Target: SCN10A; (+) strand; PAM type: YTN; PAM sequence: CTG
agcatttgaaacaacaaagt

SEQ ID NO: 63494 - DNA, 20 bp, Artificial Sequence
  Description of Artificial Sequence: Synthetic oligonucleotide
  Target: SCN10A; (+) strand; PAM type: YTN; PAM sequence: TTT
gaaacaacaaagtggtgctc

SEQ ID NO: 63495 - DNA, 20 bp, Artificial Sequence
  Description of Artificial Sequence: Synthetic oligonucleotide
  Target: SCN10A; (+) strand; PAM type: YTN; PAM sequence: TTG
aaacaacaaagtggtgctca

SEQ ID NO: 63496 - DNA, 20 bp, Artificial Sequence
  Description of Artificial Sequence: Synthetic oligonucleotide
  Target: SCN10A; (+) strand; PAM type: YTN; PAM sequence: CTC
atataggattttatctggaa

SEQ ID NO: 63497 - DNA, 20 bp, Artificial Sequence
  Description of Artificial Sequence: Synthetic oligonucleotide
  Target: SCN10A; (+) strand; PAM type: YTN; PAM sequence: TTT
tatctggaattcacactacc

SEQ ID NO: 63498 - DNA, 20 bp, Artificial Sequence
  Description of Artificial Sequence: Synthetic oligonucleotide
  Target: SCN10A; (+) strand; PAM type: YTN; PAM sequence: TTT
atctggaattcacactacct

SEQ ID NO: 63499 - DNA, 20 bp, Artificial Sequence
  Description of Artificial Sequence: Synthetic oligonucleotide
  Target: SCN10A; (+) strand; PAM type: YTN; PAM sequence: TTA
tctggaattcacactaccta

SEQ ID NO: 63500 - DNA, 20 bp, Artificial Sequence
  Description of Artificial Sequence: Synthetic oligonucleotide
  Target: SCN10A; (+) strand; PAM type: YTN; PAM sequence: CTG
gaattcacactacctaggta

SEQ ID NO: 63501 - DNA, 20 bp, Artificial Sequence
  Description of Artificial Sequence: Synthetic oligonucleotide
  Target: SCN10A; (+) strand; PAM type: YTN; PAM sequence: TTC
acactacctaggtattttaa

SEQ ID NO: 63502 - DNA, 20 bp, Artificial Sequence
  Description of Artificial Sequence: Synthetic oligonucleotide
  Target: SCN10A; (+) strand; PAM type: YTN; PAM sequence: CTA
cctaggtattttaagttgag

SEQ ID NO: 63503 - DNA, 20 bp, Artificial Sequence
  Description of Artificial Sequence: Synthetic oligonucleotide
  Target: SCN10A; (+) strand; PAM type: YTN; PAM sequence: CTA
ggtattttaagttgagaatt

SEQ ID NO: 63504 - DNA, 20 bp, Artificial Sequence
  Description of Artificial Sequence: Synthetic oligonucleotide
  Target: SCN10A; (+) strand; PAM type: YTN; PAM sequence: TTT
taagttgagaatttaattta

SEQ ID NO: 63505 - DNA, 20 bp, Artificial Sequence
  Description of Artificial Sequence: Synthetic oligonucleotide
  Target: SCN10A; (+) strand; PAM type: YTN; PAM sequence: TTT
aagttgagaatttaatttag

SEQ ID NO: 63506 - DNA, 20 bp, Artificial Sequence
  Description of Artificial Sequence: Synthetic oligonucleotide
  Target: SCN10A; (+) strand; PAM type: YTN; PAM sequence: TTA
agttgagaatttaatttaga

SEQ ID NO: 63507 - DNA, 20 bp, Artificial Sequence
  Description of Artificial Sequence: Synthetic oligonucleotide
  Target: SCN10A; (+) strand; PAM type: YTN; PAM sequence: TTG
agaatttaatttagagcaat

SEQ ID NO: 63508 - DNA, 20 bp, Artificial Sequence
  Description of Artificial Sequence: Synthetic oligonucleotide
  Target: SCN10A; (+) strand; PAM type: YTN; PAM sequence: TTT
aatttagagcaattctacaa

SEQ ID NO: 63509 - DNA, 20 bp, Artificial Sequence
  Description of Artificial Sequence: Synthetic oligonucleotide
  Target: SCN10A; (+) strand; PAM type: YTN; PAM sequence: TTA
atttagagcaattctacaaa

SEQ ID NO: 63510 - DNA, 20 bp, Artificial Sequence
  Description of Artificial Sequence: Synthetic oligonucleotide
  Target: SCN10A; (+) strand; PAM type: YTN; PAM sequence: TTT
agagcaattctacaaagtgc

SEQ ID NO: 63511 - DNA, 20 bp, Artificial Sequence
  Description of Artificial Sequence: Synthetic oligonucleotide
  Target: SCN10A; (+) strand; PAM type: YTN; PAM sequence: TTA
gagcaattctacaaagtgct

SEQ ID NO: 63512 - DNA, 20 bp, Artificial Sequence
  Description of Artificial Sequence: Synthetic oligonucleotide
  Target: SCN10A; (+) strand; PAM type: YTN; PAM sequence: TTC
tacaaagtgctctgcagaat

SEQ ID NO: 63513 - DNA, 20 bp, Artificial Sequence
  Description of Artificial Sequence: Synthetic oligonucleotide
  Target: SCN10A; (+) strand; PAM type: YTN; PAM sequence: CTA
caaagtgctctgcagaatta

SEQ ID NO: 63514 - DNA, 20 bp, Artificial Sequence
  Description of Artificial Sequence: Synthetic oligonucleotide
  Target: SCN10A; (+) strand; PAM type: YTN; PAM sequence: CTC
tgcagaattaaatgcaaata

SEQ ID NO: 63515 - DNA, 20 bp, Artificial Sequence
  Description of Artificial Sequence: Synthetic oligonucleotide
  Target: SCN10A; (+) strand; PAM type: YTN; PAM sequence: CTG
cagaattaaatgcaaatacc

SEQ ID NO: 63516 - DNA, 20 bp, Artificial Sequence
  Description of Artificial Sequence: Synthetic oligonucleotide
  Target: SCN10A; (+) strand; PAM type: YTN; PAM sequence: TTA
aatgcaaatacctctggagg

SEQ ID NO: 63517 - DNA, 20 bp, Artificial Sequence
  Description of Artificial Sequence: Synthetic oligonucleotide
  Target: SCN10A; (+) strand; PAM type: YTN; PAM sequence: CTC
tggaggaacctgcctttatc

SEQ ID NO: 63518 - DNA, 20 bp, Artificial Sequence
  Description of Artificial Sequence: Synthetic oligonucleotide
  Target: SCN10A; (+) strand; PAM type: YTN; PAM sequence: CTG
gaggaacctgcctttatctc

SEQ ID NO: 63519 - DNA, 20 bp, Artificial Sequence
  Description of Artificial Sequence: Synthetic oligonucleotide
  Target: SCN10A; (+) strand; PAM type: YTN; PAM sequence: CTG
cctttatctcaggtttcaaa

SEQ ID NO: 63520 - DNA, 20 bp, Artificial Sequence
  Description of Artificial Sequence: Synthetic oligonucleotide
  Target: SCN10A; (+) strand; PAM type: YTN; PAM sequence: CTT
tatctcaggtttcaaactat

SEQ ID NO: 63521 - DNA, 20 bp, Artificial Sequence
  Description of Artificial Sequence: Synthetic oligonucleotide
  Target: SCN10A; (+) strand; PAM type: YTN; PAM sequence: TTT
atctcaggtttcaaactatt

SEQ ID NO: 63522 - DNA, 20 bp, Artificial Sequence
  Description of Artificial Sequence: Synthetic oligonucleotide
  Target: SCN10A; (+) strand; PAM type: YTN; PAM sequence: TTA
tctcaggtttcaaactattc

SEQ ID NO: 63523 - DNA, 20 bp, Artificial Sequence
  Description of Artificial Sequence: Synthetic oligonucleotide
  Target: SCN10A; (+) strand; PAM type: YTN; PAM sequence: CTC
aggtttcaaactattccctc

SEQ ID NO: 63524 - DNA, 20 bp, Artificial Sequence
  Description of Artificial Sequence: Synthetic oligonucleotide
  Target: SCN10A; (+) strand; PAM type: YTN; PAM sequence: TTT
caaactattccctcaaaaat

SEQ ID NO: 63525 - DNA, 20 bp, Artificial Sequence
  Description of Artificial Sequence: Synthetic oligonucleotide
  Target: SCN10A; (+) strand; PAM type: YTN; PAM sequence: TTC
aaactattccctcaaaaatt

SEQ ID NO: 63526 - DNA, 20 bp, Artificial Sequence
  Description of Artificial Sequence: Synthetic oligonucleotide
  Target: SCN10A; (+) strand; PAM type: YTN; PAM sequence: CTA
ttccctcaaaaattgtttaa

SEQ ID NO: 63527 - DNA, 20 bp, Artificial Sequence
  Description of Artificial Sequence: Synthetic oligonucleotide
  Target: SCN10A; (+) strand; PAM type: YTN; PAM sequence: TTC
cctcaaaaattgtttaagag

SEQ ID NO: 63528 - DNA, 20 bp, Artificial Sequence
  Description of Artificial Sequence: Synthetic oligonucleotide
  Target: SCN10A; (+) strand; PAM type: YTN; PAM sequence: CTC
aaaaattgtttaagagttgc

SEQ ID NO: 63529 - DNA, 20 bp, Artificial Sequence
  Description of Artificial Sequence: Synthetic oligonucleotide
  Target: SCN10A; (+) strand; PAM type: YTN; PAM sequence: TTG
tttaagagttgcagtaaaaa

SEQ ID NO: 63530 - DNA, 20 bp, Artificial Sequence
  Description of Artificial Sequence: Synthetic oligonucleotide
  Target: SCN10A; (+) strand; PAM type: YTN; PAM sequence: TTT
aagagttgcagtaaaaaaac

SEQ ID NO: 63531 - DNA, 20 bp, Artificial Sequence
  Description of Artificial Sequence: Synthetic oligonucleotide
  Target: SCN10A; (+) strand; PAM type: YTN; PAM sequence: TTA
agagttgcagtaaaaaaaca

SEQ ID NO: 63532 - DNA, 20 bp, Artificial Sequence
  Description of Artificial Sequence: Synthetic oligonucleotide
  Target: SCN10A; (+) strand; PAM type: YTN; PAM sequence: TTG
cagtaaaaaaacaaacaaaa

SEQ ID NO: 63533 - DNA, 20 bp, Artificial Sequence
  Description of Artificial Sequence: Synthetic oligonucleotide
  Target: SCN10A; (+) strand; PAM type: YTN; PAM sequence: CTT
gaagaaaccacagatgtgga

SEQ ID NO: 63534 - DNA, 20 bp, Artificial Sequence
  Description of Artificial Sequence: Synthetic oligonucleotide
  Target: SCN10A; (+) strand; PAM type: YTN; PAM sequence: TTG
aagaaaccacagatgtggaa

SEQ ID NO: 63535 - DNA, 20 bp, Artificial Sequence
  Description of Artificial Sequence: Synthetic oligonucleotide
  Target: SCN10A; (+) strand; PAM type: YTN; PAM sequence: TTC
catttcttcagatgatagaa

SEQ ID NO: 63536 - DNA, 20 bp, Artificial Sequence
  Description of Artificial Sequence: Synthetic oligonucleotide
  Target: SCN10A; (+) strand; PAM type: YTN; PAM sequence: TTT
cttcagatgatagaattatt

SEQ ID NO: 63537 - DNA, 20 bp, Artificial Sequence
  Description of Artificial Sequence: Synthetic oligonucleotide
  Target: SCN10A; (+) strand; PAM type: YTN; PAM sequence: TTC
ttcagatgatagaattatta

SEQ ID NO: 63538 - DNA, 20 bp, Artificial Sequence
  Description of Artificial Sequence: Synthetic oligonucleotide
  Target: SCN10A; (+) strand; PAM type: YTN; PAM sequence: CTT
cagatgatagaattattagt

SEQ ID NO: 63539 - DNA, 20 bp, Artificial Sequence
  Description of Artificial Sequence: Synthetic oligonucleotide
  Target: SCN10A; (+) strand; PAM type: YTN; PAM sequence: TTC
agatgatagaattattagtc

SEQ ID NO: 63540 - DNA, 20 bp, Artificial Sequence
  Description of Artificial Sequence: Synthetic oligonucleotide
  Target: SCN10A; (+) strand; PAM type: YTN; PAM sequence: TTA
ttagtcagagataacagtat

SEQ ID NO: 63541 - DNA, 20 bp, Artificial Sequence
  Description of Artificial Sequence: Synthetic oligonucleotide
  Target: SCN10A; (+) strand; PAM type: YTN; PAM sequence: TTA
gtcagagataacagtataat

SEQ ID NO: 63542 - DNA, 20 bp, Artificial Sequence
  Description of Artificial Sequence: Synthetic oligonucleotide
  Target: SCN10A; (+) strand; PAM type: YTN; PAM sequence: TTA
gatataatatgttaaagaaa

SEQ ID NO: 63543 - DNA, 20 bp, Artificial Sequence
  Description of Artificial Sequence: Synthetic oligonucleotide
  Target: SCN10A; (+) strand; PAM type: YTN; PAM sequence: TTA
aagaaataaaataataactt

SEQ ID NO: 63544 - DNA, 20 bp, Artificial Sequence
  Description of Artificial Sequence: Synthetic oligonucleotide
  Target: SCN10A; (+) strand; PAM type: YTN; PAM sequence: CTT
gaaactatgtgcagagaata

SEQ ID NO: 63545 - DNA, 20 bp, Artificial Sequence
  Description of Artificial Sequence: Synthetic oligonucleotide
  Target: SCN10A; (+) strand; PAM type: YTN; PAM sequence: TTG
aaactatgtgcagagaataa

SEQ ID NO: 63546 - DNA, 20 bp, Artificial Sequence
  Description of Artificial Sequence: Synthetic oligonucleotide
  Target: SCN10A; (+) strand; PAM type: YTN; PAM sequence: CTA
tgtgcagagaataaaaaaac

SEQ ID NO: 63547 - DNA, 20 bp, Artificial Sequence
  Description of Artificial Sequence: Synthetic oligonucleotide
  Target: SCN10A; (+) strand; PAM type: YTN; PAM sequence: CTA
tagataacaataacaagttg

SEQ ID NO: 63548 - DNA, 20 bp, Artificial Sequence
  Description of Artificial Sequence: Synthetic oligonucleotide
  Target: SCN10A; (+) strand; PAM type: YTN; PAM sequence: TTG
tgaaaaatacactcttagaa

SEQ ID NO: 63549 - DNA, 20 bp, Artificial Sequence
  Description of Artificial Sequence: Synthetic oligonucleotide
  Target: SCN10A; (+) strand; PAM type: YTN; PAM sequence: CTC
ttagaaatgaaaaatataat

SEQ ID NO: 63550 - DNA, 20 bp, Artificial Sequence
  Description of Artificial Sequence: Synthetic oligonucleotide
  Target: SCN10A; (+) strand; PAM type: YTN; PAM sequence: CTT
agaaatgaaaaatataatac

SEQ ID NO: 63551 - DNA, 20 bp, Artificial Sequence
  Description of Artificial Sequence: Synthetic oligonucleotide
  Target: SCN10A; (+) strand; PAM type: YTN; PAM sequence: TTA
gaaatgaaaaatataatact

SEQ ID NO: 63552 - DNA, 20 bp, Artificial Sequence
  Description of Artificial Sequence: Synthetic oligonucleotide
  Target: SCN10A; (+) strand; PAM type: YTN; PAM sequence: CTT
aaaattaaaaatattatgaa

SEQ ID NO: 63553 - DNA, 20 bp, Artificial Sequence
  Description of Artificial Sequence: Synthetic oligonucleotide
  Target: SCN10A; (+) strand; PAM type: YTN; PAM sequence: TTA
aaattaaaaatattatgaag

SEQ ID NO: 63554 - DNA, 20 bp, Artificial Sequence
  Description of Artificial Sequence: Synthetic oligonucleotide
  Target: SCN10A; (+) strand; PAM type: YTN; PAM sequence: TTA
aaaatattatgaagaaggtt

SEQ ID NO: 63555 - DNA, 20 bp, Artificial Sequence
  Description of Artificial Sequence: Synthetic oligonucleotide
  Target: SCN10A; (+) strand; PAM type: YTN; PAM sequence: TTA
tgaagaaggtttgcatcaga

SEQ ID NO: 63556 - DNA, 20 bp, Artificial Sequence
  Description of Artificial Sequence: Synthetic oligonucleotide
  Target: SCN10A; (+) strand; PAM type: YTN; PAM sequence: TTT
gcatcagatttgacacagtt

SEQ ID NO: 63557 - DNA, 20 bp, Artificial Sequence
  Description of Artificial Sequence: Synthetic oligonucleotide
  Target: SCN10A; (+) strand; PAM type: YTN; PAM sequence: TTG
catcagatttgacacagttt

SEQ ID NO: 63558 - DNA, 20 bp, Artificial Sequence
  Description of Artificial Sequence: Synthetic oligonucleotide
  Target: SCN10A; (+) strand; PAM type: YTN; PAM sequence: TTT
gacacagtttgggagagaat

SEQ ID NO: 63559 - DNA, 20 bp, Artificial Sequence
  Description of Artificial Sequence: Synthetic oligonucleotide
  Target: SCN10A; (+) strand; PAM type: YTN; PAM sequence: TTG
acacagtttgggagagaatt

SEQ ID NO: 63560 - DNA, 20 bp, Artificial Sequence
  Description of Artificial Sequence: Synthetic oligonucleotide
  Target: SCN10A; (+) strand; PAM type: YTN; PAM sequence: TTT
gggagagaattagtgaactg

SEQ ID NO: 63561 - DNA, 20 bp, Artificial Sequence
  Description of Artificial Sequence: Synthetic oligonucleotide
  Target: SCN10A; (+) strand; PAM type: YTN; PAM sequence: TTG
ggagagaattagtgaactga

SEQ ID NO: 63562 - DNA, 20 bp, Artificial Sequence
  Description of Artificial Sequence: Synthetic oligonucleotide
  Target: SCN10A; (+) strand; PAM type: YTN; PAM sequence: TTA
gtgaactgaggatatatcag

SEQ ID NO: 63563 - DNA, 20 bp, Artificial Sequence
  Description of Artificial Sequence: Synthetic oligonucleotide
  Target: SCN10A; (+) strand; PAM type: YTN; PAM sequence: CTG
aggatatatcagaataaatt

SEQ ID NO: 63564 - DNA, 20 bp, Artificial Sequence
  Description of Artificial Sequence: Synthetic oligonucleotide
  Target: SCN10A; (+) strand; PAM type: YTN; PAM sequence: TTA
ttcagaatgtaacctagaga

SEQ ID NO: 63565 - DNA, 20 bp, Artificial Sequence
  Description of Artificial Sequence: Synthetic oligonucleotide
  Target: SCN10A; (+) strand; PAM type: YTN; PAM sequence: TTC
agaatgtaacctagagagac

SEQ ID NO: 63566 - DNA, 20 bp, Artificial Sequence
  Description of Artificial Sequence: Synthetic oligonucleotide
  Target: SCN10A; (+) strand; PAM type: YTN; PAM sequence: CTA
gagagacataagatgaaaaa

SEQ ID NO: 63567 - DNA, 20 bp, Artificial Sequence
  Description of Artificial Sequence: Synthetic oligonucleotide
  Target: SCN10A; (+) strand; PAM type: YTN; PAM sequence: TTT
aacatctatctaaccaaagt

SEQ ID NO: 63568 - DNA, 20 bp, Artificial Sequence
  Description of Artificial Sequence: Synthetic oligonucleotide
  Target: SCN10A; (+) strand; PAM type: YTN; PAM sequence: TTA
acatctatctaaccaaagtc

SEQ ID NO: 63569 - DNA, 20 bp, Artificial Sequence
  Description of Artificial Sequence: Synthetic oligonucleotide
  Target: SCN10A; (+) strand; PAM type: YTN; PAM sequence: CTA
tctaaccaaagtccagaagg

SEQ ID NO: 63570 - DNA, 20 bp, Artificial Sequence
  Description of Artificial Sequence: Synthetic oligonucleotide
  Target: SCN10A; (+) strand; PAM type: YTN; PAM sequence: CTA
accaaagtccagaaggagaa

SEQ ID NO: 63571 - DNA, 20 bp, Artificial Sequence
  Description of Artificial Sequence: Synthetic oligonucleotide
  Target: SCN10A; (+) strand; PAM type: YTN; PAM sequence: CTA
tgactgcccacatcatgtct

SEQ ID NO: 63572 - DNA, 20 bp, Artificial Sequence
  Description of Artificial Sequence: Synthetic oligonucleotide
  Target: SCN10A; (+) strand; PAM type: YTN; PAM sequence: CTG
cccacatcatgtctgggaac

SEQ ID NO: 63573 - DNA, 20 bp, Artificial Sequence
  Description of Artificial Sequence: Synthetic oligonucleotide
  Target: SCN10A; (+) strand; PAM type: YTN; PAM sequence: CTG
ggaactttccagaattgaag

SEQ ID NO: 63574 - DNA, 20 bp, Artificial Sequence
  Description of Artificial Sequence: Synthetic oligonucleotide
  Target: SCN10A; (+) strand; PAM type: YTN; PAM sequence: CTT
tccagaattgaagaaaatta

SEQ ID NO: 63575 - DNA, 20 bp, Artificial Sequence
  Description of Artificial Sequence: Synthetic oligonucleotide
  Target: SCN10A; (+) strand; PAM type: YTN; PAM sequence: TTT
ccagaattgaagaaaattac

SEQ ID NO: 63576 - DNA, 20 bp, Artificial Sequence
  Description of Artificial Sequence: Synthetic oligonucleotide
  Target: SCN10A; (+) strand; PAM type: YTN; PAM sequence: TTC
cagaattgaagaaaattaca

SEQ ID NO: 63577 - DNA, 20 bp, Artificial Sequence
  Description of Artificial Sequence: Synthetic oligonucleotide
  Target: SCN10A; (+) strand; PAM type: YTN; PAM sequence: TTG
aagaaaattacaaaactaaa

SEQ ID NO: 63578 - DNA, 20 bp, Artificial Sequence
  Description of Artificial Sequence: Synthetic oligonucleotide
  Target: SCN10A; (+) strand; PAM type: YTN; PAM sequence: TTA
caaaactaaagattcaagaa

SEQ ID NO: 63579 - DNA, 20 bp, Artificial Sequence
  Description of Artificial Sequence: Synthetic oligonucleotide
  Target: SCN10A; (+) strand; PAM type: YTN; PAM sequence: CTA
aagattcaagaagtcagtat

SEQ ID NO: 63580 - DNA, 20 bp, Artificial Sequence
  Description of Artificial Sequence: Synthetic oligonucleotide
  Target: SCN10A; (+) strand; PAM type: YTN; PAM sequence: TTC
aagaagtcagtatatcttaa

SEQ ID NO: 63581 - DNA, 20 bp, Artificial Sequence
  Description of Artificial Sequence: Synthetic oligonucleotide
  Target: SCN10A; (+) strand; PAM type: YTN; PAM sequence: CTT
aagcattataaatggaaaga

SEQ ID NO: 63582 - DNA, 20 bp, Artificial Sequence
  Description of Artificial Sequence: Synthetic oligonucleotide
  Target: SCN10A; (+) strand; PAM type: YTN; PAM sequence: TTA
agcattataaatggaaagaa

SEQ ID NO: 63583 - DNA, 20 bp, Artificial Sequence
  Description of Artificial Sequence: Synthetic oligonucleotide
  Target: SCN10A; (+) strand; PAM type: YTN; PAM sequence: TTA
taaatggaaagaagtccaca

SEQ ID NO: 63584 - DNA, 20 bp, Artificial Sequence
  Description of Artificial Sequence: Synthetic oligonucleotide
  Target: SCN10A; (+) strand; PAM type: YTN; PAM sequence: CTA
gacatattacagtgaaactg

SEQ ID NO: 63585 - DNA, 20 bp, Artificial Sequence
  Description of Artificial Sequence: Synthetic oligonucleotide
  Target: SCN10A; (+) strand; PAM type: YTN; PAM sequence: TTA
cagtgaaactgcagaacacc

SEQ ID NO: 63586 - DNA, 20 bp, Artificial Sequence
  Description of Artificial Sequence: Synthetic oligonucleotide
  Target: SCN10A; (+) strand; PAM type: YTN; PAM sequence: CTG
cagaacaccaaagatggata

SEQ ID NO: 63587 - DNA, 20 bp, Artificial Sequence
  Description of Artificial Sequence: Synthetic oligonucleotide
  Target: SCN10A; (+) strand; PAM type: YTN; PAM sequence: TTT
aaaaagcatccagaaaggaa

SEQ ID NO: 63588 - DNA, 20 bp, Artificial Sequence
  Description of Artificial Sequence: Synthetic oligonucleotide
  Target: SCN10A; (+) strand; PAM type: YTN; PAM sequence: TTA
aaaagcatccagaaaggaag

SEQ ID NO: 63589 - DNA, 20 bp, Artificial Sequence
  Description of Artificial Sequence: Synthetic oligonucleotide
  Target: SCN10A; (+) strand; PAM type: YTN; PAM sequence: TTA
aattgaaagctgactgctca

SEQ ID NO: 63590 - DNA, 20 bp, Artificial Sequence
  Description of Artificial Sequence: Synthetic oligonucleotide
  Target: SCN10A; (+) strand; PAM type: YTN; PAM sequence: TTG
aaagctgactgctcattagc

SEQ ID NO: 63591 - DNA, 20 bp, Artificial Sequence
  Description of Artificial Sequence: Synthetic oligonucleotide
  Target: SCN10A; (+) strand; PAM type: YTN; PAM sequence: CTG
actgctcattagcaacaatg

SEQ ID NO: 63592 - DNA, 20 bp, Artificial Sequence
  Description of Artificial Sequence: Synthetic oligonucleotide
  Target: SCN10A; (+) strand; PAM type: YTN; PAM sequence: CTG
ctcattagcaacaatggagg

SEQ ID NO: 63593 - DNA, 20 bp, Artificial Sequence
  Description of Artificial Sequence: Synthetic oligonucleotide
  Target: SCN10A; (+) strand; PAM type: YTN; PAM sequence: CTC
attagcaacaatggaggcta

SEQ ID NO: 63594 - DNA, 20 bp, Artificial Sequence
  Description of Artificial Sequence: Synthetic oligonucleotide
  Target: SCN10A; (+) strand; PAM type: YTN; PAM sequence: TTA
gcaacaatggaggctaattg

SEQ ID NO: 63595 - DNA, 20 bp, Artificial Sequence
  Description of Artificial Sequence: Synthetic oligonucleotide
  Target: SCN10A; (+) strand; PAM type: YTN; PAM sequence: CTA
attgttggaatactatcttc

SEQ ID NO: 63596 - DNA, 20 bp, Artificial Sequence
  Description of Artificial Sequence: Synthetic oligonucleotide
  Target: SCN10A; (+) strand; PAM type: YTN; PAM sequence: TTG
ttggaatactatcttcactg

SEQ ID NO: 63597 - DNA, 20 bp, Artificial Sequence
  Description of Artificial Sequence: Synthetic oligonucleotide
  Target: SCN10A; (+) strand; PAM type: YTN; PAM sequence: TTG
gaatactatcttcactgaag

SEQ ID NO: 63598 - DNA, 20 bp, Artificial Sequence
  Description of Artificial Sequence: Synthetic oligonucleotide
  Target: SCN10A; (+) strand; PAM type: YTN; PAM sequence: CTA
tcttcactgaaggaagataa

SEQ ID NO: 63599 - DNA, 20 bp, Artificial Sequence
  Description of Artificial Sequence: Synthetic oligonucleotide
  Target: SCN10A; (+) strand; PAM type: YTN; PAM sequence: CTT
cactgaaggaagataaagta

SEQ ID NO: 63600 - DNA, 20 bp, Artificial Sequence
  Description of Artificial Sequence: Synthetic oligonucleotide
  Target: SCN10A; (+) strand; PAM type: YTN; PAM sequence: TTC
actgaaggaagataaagtat

SEQ ID NO: 63601 - DNA, 20 bp, Artificial Sequence
  Description of Artificial Sequence: Synthetic oligonucleotide
  Target: SCN10A; (+) strand; PAM type: YTN; PAM sequence: CTG
aaggaagataaagtatcaac

SEQ ID NO: 63602 - DNA, 20 bp, Artificial Sequence
  Description of Artificial Sequence: Synthetic oligonucleotide
  Target: SCN10A; (+) strand; PAM type: YTN; PAM sequence: CTA
gaattttacattcataagaa

SEQ ID NO: 63603 - DNA, 20 bp, Artificial Sequence
  Description of Artificial Sequence: Synthetic oligonucleotide
  Target: SCN10A; (+) strand; PAM type: YTN; PAM sequence: TTT
tacattcataagaaatgtct

SEQ ID NO: 63604 - DNA, 20 bp, Artificial Sequence
  Description of Artificial Sequence: Synthetic oligonucleotide
  Target: SCN10A; (+) strand; PAM type: YTN; PAM sequence: TTT
acattcataagaaatgtctc

SEQ ID NO: 63605 - DNA, 20 bp, Artificial Sequence
  Description of Artificial Sequence: Synthetic oligonucleotide
  Target: SCN10A; (+) strand; PAM type: YTN; PAM sequence: TTA
cattcataagaaatgtctct

SEQ ID NO: 63606 - DNA, 20 bp, Artificial Sequence
  Description of Artificial Sequence: Synthetic oligonucleotide
  Target: SCN10A; (+) strand; PAM type: YTN; PAM sequence: TTC
ataagaaatgtctctcaaag

SEQ ID NO: 63607 - DNA, 20 bp, Artificial Sequence
  Description of Artificial Sequence: Synthetic oligonucleotide
  Target: SCN10A; (+) strand; PAM type: YTN; PAM sequence: CTC
tcaaagacacgggcaaactg

SEQ ID NO: 63608 - DNA, 20 bp, Artificial Sequence
  Description of Artificial Sequence: Synthetic oligonucleotide
  Target: SCN10A; (+) strand; PAM type: YTN; PAM sequence: CTC
aaagacacgggcaaactgaa

SEQ ID NO: 63609 - DNA, 20 bp, Artificial Sequence
  Description of Artificial Sequence: Synthetic oligonucleotide
  Target: SCN10A; (+) strand; PAM type: YTN; PAM sequence: CTG
aagagcaaatttcagataaa

SEQ ID NO: 63610 - DNA, 20 bp, Artificial Sequence
  Description of Artificial Sequence: Synthetic oligonucleotide
  Target: SCN10A; (+) strand; PAM type: YTN; PAM sequence: TTT
cagataaacaaagaggttat

SEQ ID NO: 63611 - DNA, 20 bp, Artificial Sequence
  Description of Artificial Sequence: Synthetic oligonucleotide
  Target: SCN10A; (+) strand; PAM type: YTN; PAM sequence: TTC
agataaacaaagaggttatg

SEQ ID NO: 63612 - DNA, 20 bp, Artificial Sequence
  Description of Artificial Sequence: Synthetic oligonucleotide
  Target: SCN10A; (+) strand; PAM type: YTN; PAM sequence: TTA
tggccagaaggcacttacta

SEQ ID NO: 63613 - DNA, 20 bp, Artificial Sequence
  Description of Artificial Sequence: Synthetic oligonucleotide
  Target: SCN10A; (+) strand; PAM type: YTN; PAM sequence: CTT
actaaaagaaattctaaagg

SEQ ID NO: 63614 - DNA, 20 bp, Artificial Sequence
  Description of Artificial Sequence: Synthetic oligonucleotide
  Target: SCN10A; (+) strand; PAM type: YTN; PAM sequence: TTA
ctaaaagaaattctaaagga

SEQ ID NO: 63615 - DNA, 20 bp, Artificial Sequence
  Description of Artificial Sequence: Synthetic oligonucleotide
  Target: SCN10A; (+) strand; PAM type: YTN; PAM sequence: CTA
aaagaaattctaaaggaggt

SEQ ID NO: 63616 - DNA, 20 bp, Artificial Sequence
  Description of Artificial Sequence: Synthetic oligonucleotide
  Target: SCN10A; (+) strand; PAM type: YTN; PAM sequence: TTC
taaaggaggtacttcaggta

SEQ ID NO: 63617 - DNA, 20 bp, Artificial Sequence
  Description of Artificial Sequence: Synthetic oligonucleotide
  Target: SCN10A; (+) strand; PAM type: YTN; PAM sequence: CTA
aaggaggtacttcaggtaga

SEQ ID NO: 63618 - DNA, 20 bp, Artificial Sequence
  Description of Artificial Sequence: Synthetic oligonucleotide
  Target: SCN10A; (+) strand; PAM type: YTN; PAM sequence: CTT
caggtagatagaaagtgatc

SEQ ID NO: 63619 - DNA, 20 bp, Artificial Sequence
  Description of Artificial Sequence: Synthetic oligonucleotide
  Target: SCN10A; (+) strand; PAM type: YTN; PAM sequence: TTC
aggtagatagaaagtgatcc

SEQ ID NO: 63620 - DNA, 20 bp, Artificial Sequence
  Description of Artificial Sequence: Synthetic oligonucleotide
  Target: SCN10A; (+) strand; PAM type: YTN; PAM sequence: CTG
tgctccaaagggttgaagaa

SEQ ID NO: 63621 - DNA, 20 bp, Artificial Sequence
  Description of Artificial Sequence: Synthetic oligonucleotide
  Target: SCN10A; (+) strand; PAM type: YTN; PAM sequence: CTC
caaagggttgaagaaatcaa

SEQ ID NO: 63622 - DNA, 20 bp, Artificial Sequence
  Description of Artificial Sequence: Synthetic oligonucleotide
  Target: SCN10A; (+) strand; PAM type: YTN; PAM sequence: TTG
aagaaatcaataactaaatt

SEQ ID NO: 63623 - DNA, 20 bp, Artificial Sequence
  Description of Artificial Sequence: Synthetic oligonucleotide
  Target: SCN10A; (+) strand; PAM type: YTN; PAM sequence: CTA
aatttttaggcttacaggat

SEQ ID NO: 63624 - DNA, 20 bp, Artificial Sequence
  Description of Artificial Sequence: Synthetic oligonucleotide
  Target: SCN10A; (+) strand; PAM type: YTN; PAM sequence: TTT
ttaggcttacaggataccag

SEQ ID NO: 63625 - DNA, 20 bp, Artificial Sequence
  Description of Artificial Sequence: Synthetic oligonucleotide
  Target: SCN10A; (+) strand; PAM type: YTN; PAM sequence: TTT
taggcttacaggataccaga

SEQ ID NO: 63626 - DNA, 20 bp, Artificial Sequence
  Description of Artificial Sequence: Synthetic oligonucleotide
  Target: SCN10A; (+) strand; PAM type: YTN; PAM sequence: TTT
aggcttacaggataccagat

SEQ ID NO: 63627 - DNA, 20 bp, Artificial Sequence
  Description of Artificial Sequence: Synthetic oligonucleotide
  Target: SCN10A; (+) strand; PAM type: YTN; PAM sequence: TTA
ggcttacaggataccagata

SEQ ID NO: 63628 - DNA, 20 bp, Artificial Sequence
  Description of Artificial Sequence: Synthetic oligonucleotide
  Target: SCN10A; (+) strand; PAM type: YTN; PAM sequence: CTT
acaggataccagataagaaa

SEQ ID NO: 63629 - DNA, 20 bp, Artificial Sequence
  Description of Artificial Sequence: Synthetic oligonucleotide
  Target: SCN10A; (+) strand; PAM type: YTN; PAM sequence: TTA
caggataccagataagaaat

SEQ ID NO: 63630 - DNA, 20 bp, Artificial Sequence
  Description of Artificial Sequence: Synthetic oligonucleotide
  Target: SCN10A; (+) strand; PAM type: YTN; PAM sequence: CTC
actgaaaatctgaaactcaa

SEQ ID NO: 63631 - DNA, 20 bp, Artificial Sequence
  Description of Artificial Sequence: Synthetic oligonucleotide
  Target: SCN10A; (+) strand; PAM type: YTN; PAM sequence: CTG
aaaatctgaaactcaaactg

SEQ ID NO: 63632 - DNA, 20 bp, Artificial Sequence
  Description of Artificial Sequence: Synthetic oligonucleotide
  Target: SCN10A; (+) strand; PAM type: YTN; PAM sequence: CTG
aaactcaaactgtgttccaa

SEQ ID NO: 63633 - DNA, 20 bp, Artificial Sequence
  Description of Artificial Sequence: Synthetic oligonucleotide
  Target: SCN10A; (+) strand; PAM type: YTN; PAM sequence: CTC
aaactgtgttccaaagagta

SEQ ID NO: 63634 - DNA, 20 bp, Artificial Sequence
  Description of Artificial Sequence: Synthetic oligonucleotide
  Target: SCN10A; (+) strand; PAM type: YTN; PAM sequence: CTG
tgttccaaagagtaagaaat

SEQ ID NO: 63635 - DNA, 20 bp, Artificial Sequence
  Description of Artificial Sequence: Synthetic oligonucleotide
  Target: SCN10A; (+) strand; PAM type: YTN; PAM sequence: TTC
caaagagtaagaaatcagta

SEQ ID NO: 63636 - DNA, 20 bp, Artificial Sequence
  Description of Artificial Sequence: Synthetic oligonucleotide
  Target: SCN10A; (+) strand; PAM type: YTN; PAM sequence: CTT
acaaaaattcttgagttttt

SEQ ID NO: 63637 - DNA, 20 bp, Artificial Sequence
  Description of Artificial Sequence: Synthetic oligonucleotide
  Target: SCN10A; (+) strand; PAM type: YTN; PAM sequence: TTA
caaaaattcttgagttttta

SEQ ID NO: 63638 - DNA, 20 bp, Artificial Sequence
  Description of Artificial Sequence: Synthetic oligonucleotide
  Target: SCN10A; (+) strand; PAM type: YTN; PAM sequence: TTC
ttgagtttttaggatagcag

SEQ ID NO: 63639 - DNA, 20 bp, Artificial Sequence
  Description of Artificial Sequence: Synthetic oligonucleotide
  Target: SCN10A; (+) strand; PAM type: YTN; PAM sequence: CTT
gagtttttaggatagcagat

SEQ ID NO: 63640 - DNA, 20 bp, Artificial Sequence
  Description of Artificial Sequence: Synthetic oligonucleotide
  Target: SCN10A; (+) strand; PAM type: YTN; PAM sequence: TTG
agtttttaggatagcagata

SEQ ID NO: 63641 - DNA, 20 bp, Artificial Sequence
  Description of Artificial Sequence: Synthetic oligonucleotide
  Target: SCN10A; (+) strand; PAM type: YTN; PAM sequence: TTT
ttaggatagcagataggtaa

SEQ ID NO: 63642 - DNA, 20 bp, Artificial Sequence
  Description of Artificial Sequence: Synthetic oligonucleotide
  Target: SCN10A; (+) strand; PAM type: YTN; PAM sequence: TTT
taggatagcagataggtaaa

SEQ ID NO: 63643 - DNA, 20 bp, Artificial Sequence
  Description of Artificial Sequence: Synthetic oligonucleotide
  Target: SCN10A; (+) strand; PAM type: YTN; PAM sequence: TTT
aggatagcagataggtaaag

SEQ ID NO: 63644 - DNA, 20 bp, Artificial Sequence
  Description of Artificial Sequence: Synthetic oligonucleotide
  Target: SCN10A; (+) strand; PAM type: YTN; PAM sequence: TTA
ggatagcagataggtaaaga

SEQ ID NO: 63645 - DNA, 20 bp, Artificial Sequence
  Description of Artificial Sequence: Synthetic oligonucleotide
  Target: SCN10A; (+) strand; PAM type: YTN; PAM sequence: CTT
gctgagacactgaaactccc

SEQ ID NO: 63646 - DNA, 20 bp, Artificial Sequence
  Description of Artificial Sequence: Synthetic oligonucleotide
  Target: SCN10A; (+) strand; PAM type: YTN; PAM sequence: TTG
ctgagacactgaaactccct

SEQ ID NO: 63647 - DNA, 20 bp, Artificial Sequence
  Description of Artificial Sequence: Synthetic oligonucleotide
  Target: SCN10A; (+) strand; PAM type: YTN; PAM sequence: CTG
agacactgaaactccctccc

SEQ ID NO: 63648 - DNA, 20 bp, Artificial Sequence
  Description of Artificial Sequence: Synthetic oligonucleotide
  Target: SCN10A; (+) strand; PAM type: YTN; PAM sequence: CTG
aaactccctccccttgtgtg

SEQ ID NO: 63649 - DNA, 20 bp, Artificial Sequence
  Description of Artificial Sequence: Synthetic oligonucleotide
  Target: SCN10A; (+) strand; PAM type: YTN; PAM sequence: CTC
cctccccttgtgtgatgatg

SEQ ID NO: 63650 - DNA, 20 bp, Artificial Sequence
  Description of Artificial Sequence: Synthetic oligonucleotide
  Target: SCN10A; (+) strand; PAM type: YTN; PAM sequence: CTC
cccttgtgtgatgatgaaaa

SEQ ID NO: 63651 - DNA, 20 bp, Artificial Sequence
  Description of Artificial Sequence: Synthetic oligonucleotide
  Target: SCN10A; (+) strand; PAM type: YTN; PAM sequence: CTT
gtgtgatgatgaaaaaacag

SEQ ID NO: 63652 - DNA, 20 bp, Artificial Sequence
  Description of Artificial Sequence: Synthetic oligonucleotide
  Target: SCN10A; (+) strand; PAM type: YTN; PAM sequence: TTG
tgtgatgatgaaaaaacagg

SEQ ID NO: 63653 - DNA, 20 bp, Artificial Sequence
  Description of Artificial Sequence: Synthetic oligonucleotide
  Target: SCN10A; (+) strand; PAM type: YTN; PAM sequence: CTG
aaatcaattggaaccaggat

SEQ ID NO: 63654 - DNA, 20 bp, Artificial Sequence
  Description of Artificial Sequence: Synthetic oligonucleotide
  Target: SCN10A; (+) strand; PAM type: YTN; PAM sequence: TTG
gaaccaggatggccgactgg

SEQ ID NO: 63655 - DNA, 20 bp, Artificial Sequence
  Description of Artificial Sequence: Synthetic oligonucleotide
  Target: SCN10A; (+) strand; PAM type: YTN; PAM sequence: CTG
gagtttgtgcagaatgagct

SEQ ID NO: 63656 - DNA, 20 bp, Artificial Sequence
  Description of Artificial Sequence: Synthetic oligonucleotide
  Target: SCN10A; (+) strand; PAM type: YTN; PAM sequence: TTT
gtgcagaatgagcttgctga

SEQ ID NO: 63657 - DNA, 20 bp, Artificial Sequence
  Description of Artificial Sequence: Synthetic oligonucleotide
  Target: SCN10A; (+) strand; PAM type: YTN; PAM sequence: TTG
tgcagaatgagcttgctgac

SEQ ID NO: 63658 - DNA, 20 bp, Artificial Sequence
  Description of Artificial Sequence: Synthetic oligonucleotide
  Target: SCN10A; (+) strand; PAM type: YTN; PAM sequence: CTT
gctgacgtcatggactgaat

SEQ ID NO: 63659 - DNA, 20 bp, Artificial Sequence
  Description of Artificial Sequence: Synthetic oligonucleotide
  Target: SCN10A; (+) strand; PAM type: YTN; PAM sequence: TTG
ctgacgtcatggactgaatt

SEQ ID NO: 63660 - DNA, 20 bp, Artificial Sequence
  Description of Artificial Sequence: Synthetic oligonucleotide
  Target: SCN10A; (+) strand; PAM type: YTN; PAM sequence: CTG
acgtcatggactgaatttcc

SEQ ID NO: 63661 - DNA, 20 bp, Artificial Sequence
  Description of Artificial Sequence: Synthetic oligonucleotide
  Target: SCN10A; (+) strand; PAM type: YTN; PAM sequence: CTG
aatttccacttcatattgca

SEQ ID NO: 63662 - DNA, 20 bp, Artificial Sequence
  Description of Artificial Sequence: Synthetic oligonucleotide
  Target: SCN10A; (+) strand; PAM type: YTN; PAM sequence: TTT
ccacttcatattgcatacta

SEQ ID NO: 63663 - DNA, 20 bp, Artificial Sequence
  Description of Artificial Sequence: Synthetic oligonucleotide
  Target: SCN10A; (+) strand; PAM type: YTN; PAM sequence: TTC
cacttcatattgcatactaa

SEQ ID NO: 63664 - DNA, 20 bp, Artificial Sequence
  Description of Artificial Sequence: Synthetic oligonucleotide
  Target: SCN10A; (+) strand; PAM type: YTN; PAM sequence: CTT
catattgcatactaactccc

SEQ ID NO: 63665 - DNA, 20 bp, Artificial Sequence
  Description of Artificial Sequence: Synthetic oligonucleotide
  Target: SCN10A; (+) strand; PAM type: YTN; PAM sequence: TTC
atattgcatactaactcccc

SEQ ID NO: 63666 - DNA, 20 bp, Artificial Sequence
  Description of Artificial Sequence: Synthetic oligonucleotide
  Target: SCN10A; (+) strand; PAM type: YTN; PAM sequence: TTG
catactaactccccccagat

SEQ ID NO: 63667 - DNA, 20 bp, Artificial Sequence
  Description of Artificial Sequence: Synthetic oligonucleotide
  Target: SCN10A; (+) strand; PAM type: YTN; PAM sequence: CTA
actccccccagatttgcata

SEQ ID NO: 63668 - DNA, 20 bp, Artificial Sequence
  Description of Artificial Sequence: Synthetic oligonucleotide
  Target: SCN10A; (+) strand; PAM type: YTN; PAM sequence: CTC
cccccagatttgcatatgca

SEQ ID NO: 63669 - DNA, 20 bp, Artificial Sequence
  Description of Artificial Sequence: Synthetic oligonucleotide
  Target: SCN10A; (+) strand; PAM type: YTN; PAM sequence: TTT
gcatatgcaacccatgagta

SEQ ID NO: 63670 - DNA, 20 bp, Artificial Sequence
  Description of Artificial Sequence: Synthetic oligonucleotide
  Target: SCN10A; (+) strand; PAM type: YTN; PAM sequence: TTG
catatgcaacccatgagtaa

SEQ ID NO: 63671 - DNA, 20 bp, Artificial Sequence
  Description of Artificial Sequence: Synthetic oligonucleotide
  Target: SCN10A; (+) strand; PAM type: YTN; PAM sequence: CTG
tgcaggcccatggactctcc

SEQ ID NO: 63672 - DNA, 20 bp, Artificial Sequence
  Description of Artificial Sequence: Synthetic oligonucleotide
  Target: SCN10A; (+) strand; PAM type: YTN; PAM sequence: CTC
tccaaacctcccctttcctt

SEQ ID NO: 63673 - DNA, 20 bp, Artificial Sequence
  Description of Artificial Sequence: Synthetic oligonucleotide
  Target: SCN10A; (+) strand; PAM type: YTN; PAM sequence: CTC
caaacctcccctttccttcc

SEQ ID NO: 63674 - DNA, 20 bp, Artificial Sequence
  Description of Artificial Sequence: Synthetic oligonucleotide
  Target: SCN10A; (+) strand; PAM type: YTN; PAM sequence: CTC
ccctttccttccaccaatca

SEQ ID NO: 63675 - DNA, 20 bp, Artificial Sequence
  Description of Artificial Sequence: Synthetic oligonucleotide
  Target: SCN10A; (+) strand; PAM type: YTN; PAM sequence: CTT
tccttccaccaatcacctgc

SEQ ID NO: 63676 - DNA, 20 bp, Artificial Sequence
  Description of Artificial Sequence: Synthetic oligonucleotide
  Target: SCN10A; (+) strand; PAM type: YTN; PAM sequence: TTT
ccttccaccaatcacctgca

SEQ ID NO: 63677 - DNA, 20 bp, Artificial Sequence
  Description of Artificial Sequence: Synthetic oligonucleotide
  Target: SCN10A; (+) strand; PAM type: YTN; PAM sequence: TTC
cttccaccaatcacctgcaa

SEQ ID NO: 63678 - DNA, 20 bp, Artificial Sequence
  Description of Artificial Sequence: Synthetic oligonucleotide
  Target: SCN10A; (+) strand; PAM type: YTN; PAM sequence: CTT
ccaccaatcacctgcaaatc

SEQ ID NO: 63679 - DNA, 20 bp, Artificial Sequence
  Description of Artificial Sequence: Synthetic oligonucleotide
  Target: SCN10A; (+) strand; PAM type: YTN; PAM sequence: TTC
caccaatcacctgcaaatcc

SEQ ID NO: 63680 - DNA, 20 bp, Artificial Sequence
  Description of Artificial Sequence: Synthetic oligonucleotide
  Target: SCN10A; (+) strand; PAM type: YTN; PAM sequence: CTG
caaatcccggtatccaccca

SEQ ID NO: 63681 - DNA, 20 bp, Artificial Sequence
  Description of Artificial Sequence: Synthetic oligonucleotide
  Target: SCN10A; (+) strand; PAM type: YTN; PAM sequence: CTA
aacattttctaataaaaata

SEQ ID NO: 63682 - DNA, 20 bp, Artificial Sequence
  Description of Artificial Sequence: Synthetic oligonucleotide
  Target: SCN10A; (+) strand; PAM type: YTN; PAM sequence: TTT
tctaataaaaatactgcctt

SEQ ID NO: 63683 - DNA, 20 bp, Artificial Sequence
  Description of Artificial Sequence: Synthetic oligonucleotide
  Target: SCN10A; (+) strand; PAM type: YTN; PAM sequence: TTT
ctaataaaaatactgccttg

SEQ ID NO: 63684 - DNA, 20 bp, Artificial Sequence
  Description of Artificial Sequence: Synthetic oligonucleotide
  Target: SCN10A; (+) strand; PAM type: YTN; PAM sequence: TTC
taataaaaatactgccttga

SEQ ID NO: 63685 - DNA, 20 bp, Artificial Sequence
  Description of Artificial Sequence: Synthetic oligonucleotide
  Target: SCN10A; (+) strand; PAM type: YTN; PAM sequence: CTA
ataaaaatactgccttgaag

SEQ ID NO: 63686 - DNA, 20 bp, Artificial Sequence
  Description of Artificial Sequence: Synthetic oligonucleotide
  Target: SCN10A; (+) strand; PAM type: YTN; PAM sequence: CTG
ccttgaagacagcacaggga

SEQ ID NO: 63687 - DNA, 20 bp, Artificial Sequence
  Description of Artificial Sequence: Synthetic oligonucleotide
  Target: SCN10A; (+) strand; PAM type: YTN; PAM sequence: CTT
gaagacagcacagggagaca

SEQ ID NO: 63688 - DNA, 20 bp, Artificial Sequence
  Description of Artificial Sequence: Synthetic oligonucleotide
  Target: SCN10A; (+) strand; PAM type: YTN; PAM sequence: TTG
aagacagcacagggagacag

SEQ ID NO: 63689 - DNA, 20 bp, Artificial Sequence
  Description of Artificial Sequence: Synthetic oligonucleotide
  Target: SCN10A; (+) strand; PAM type: YTN; PAM sequence: CTG
agcttgacctcctgtcttct

SEQ ID NO: 63690 - DNA, 20 bp, Artificial Sequence
  Description of Artificial Sequence: Synthetic oligonucleotide
  Target: SCN10A; (+) strand; PAM type: YTN; PAM sequence: CTT
gacctcctgtcttcttgcca

SEQ ID NO: 63691 - DNA, 20 bp, Artificial Sequence
  Description of Artificial Sequence: Synthetic oligonucleotide
  Target: SCN10A; (+) strand; PAM type: YTN; PAM sequence: TTG
acctcctgtcttcttgccag

SEQ ID NO: 63692 - DNA, 20 bp, Artificial Sequence
  Description of Artificial Sequence: Synthetic oligonucleotide
  Target: SCN10A; (+) strand; PAM type: YTN; PAM sequence: CTC
ctgtcttcttgccagccagc

SEQ ID NO: 63693 - DNA, 20 bp, Artificial Sequence
  Description of Artificial Sequence: Synthetic oligonucleotide
  Target: SCN10A; (+) strand; PAM type: YTN; PAM sequence: CTG
tcttcttgccagccagcttg

SEQ ID NO: 63694 - DNA, 20 bp, Artificial Sequence
  Description of Artificial Sequence: Synthetic oligonucleotide
  Target: SCN10A; (+) strand; PAM type: YTN; PAM sequence: CTT
cttgccagccagcttgcagt

SEQ ID NO: 63695 - DNA, 20 bp, Artificial Sequence
  Description of Artificial Sequence: Synthetic oligonucleotide
  Target: SCN10A; (+) strand; PAM type: YTN; PAM sequence: TTC
ttgccagccagcttgcagta

SEQ ID NO: 63696 - DNA, 20 bp, Artificial Sequence
  Description of Artificial Sequence: Synthetic oligonucleotide
  Target: SCN10A; (+) strand; PAM type: YTN; PAM sequence: CTT
gccagccagcttgcagtatt

SEQ ID NO: 63697 - DNA, 20 bp, Artificial Sequence
  Description of Artificial Sequence: Synthetic oligonucleotide
  Target: SCN10A; (+) strand; PAM type: YTN; PAM sequence: TTG
ccagccagcttgcagtatta

SEQ ID NO: 63698 - DNA, 20 bp, Artificial Sequence
  Description of Artificial Sequence: Synthetic oligonucleotide
  Target: SCN10A; (+) strand; PAM type: YTN; PAM sequence: CTT
gcagtattaagcttttcttt

SEQ ID NO: 63699 - DNA, 20 bp, Artificial Sequence
  Description of Artificial Sequence: Synthetic oligonucleotide
  Target: SCN10A; (+) strand; PAM type: YTN; PAM sequence: TTG
cagtattaagcttttctttt

SEQ ID NO: 63700 - DNA, 20 bp, Artificial Sequence
  Description of Artificial Sequence: Synthetic oligonucleotide
  Target: SCN10A; (+) strand; PAM type: YTN; PAM sequence: TTA
agcttttcttttctcaaaag

SEQ ID NO: 63701 - DNA, 20 bp, Artificial Sequence
  Description of Artificial Sequence: Synthetic oligonucleotide
  Target: SCN10A; (+) strand; PAM type: YTN; PAM sequence: CTT
ttcttttctcaaaagcctgg

SEQ ID NO: 63702 - DNA, 20 bp, Artificial Sequence
  Description of Artificial Sequence: Synthetic oligonucleotide
  Target: SCN10A; (+) strand; PAM type: YTN; PAM sequence: TTT
tcttttctcaaaagcctggt

SEQ ID NO: 63703 - DNA, 20 bp, Artificial Sequence
  Description of Artificial Sequence: Synthetic oligonucleotide
  Target: SCN10A; (+) strand; PAM type: YTN; PAM sequence: TTT
cttttctcaaaagcctggtg

SEQ ID NO: 63704 - DNA, 20 bp, Artificial Sequence
  Description of Artificial Sequence: Synthetic oligonucleotide
  Target: SCN10A; (+) strand; PAM type: YTN; PAM sequence: TTC
ttttctcaaaagcctggtgt

SEQ ID NO: 63705 - DNA, 20 bp, Artificial Sequence
  Description of Artificial Sequence: Synthetic oligonucleotide
  Target: SCN10A; (+) strand; PAM type: YTN; PAM sequence: CTT
ttctcaaaagcctggtgtcc

SEQ ID NO: 63706 - DNA, 20 bp, Artificial Sequence
  Description of Artificial Sequence: Synthetic oligonucleotide
  Target: SCN10A; (+) strand; PAM type: YTN; PAM sequence: TTT
tctcaaaagcctggtgtcct

SEQ ID NO: 63707 - DNA, 20 bp, Artificial Sequence
  Description of Artificial Sequence: Synthetic oligonucleotide
  Target: SCN10A; (+) strand; PAM type: YTN; PAM sequence: TTT
ctcaaaagcctggtgtcctc

SEQ ID NO: 63708 - DNA, 20 bp, Artificial Sequence
  Description of Artificial Sequence: Synthetic oligonucleotide
  Target: SCN10A; (+) strand; PAM type: YTN; PAM sequence: TTC
tcaaaagcctggtgtcctcg

SEQ ID NO: 63709 - DNA, 20 bp, Artificial Sequence
  Description of Artificial Sequence: Synthetic oligonucleotide
  Target: SCN10A; (+) strand; PAM type: YTN; PAM sequence: CTC
aaaagcctggtgtcctcgtc

SEQ ID NO: 63710 - DNA, 20 bp, Artificial Sequence
  Description of Artificial Sequence: Synthetic oligonucleotide
  Target: SCN10A; (+) strand; PAM type: YTN; PAM sequence: CTG
gtgtcctcgtcttggcttcc

SEQ ID NO: 63711 - DNA, 20 bp, Artificial Sequence
  Description of Artificial Sequence: Synthetic oligonucleotide
  Target: SCN10A; (+) strand; PAM type: YTN; PAM sequence: CTC
gtcttggcttccaaagtcat

SEQ ID NO: 63712 - DNA, 20 bp, Artificial Sequence
  Description of Artificial Sequence: Synthetic oligonucleotide
  Target: SCN10A; (+) strand; PAM type: YTN; PAM sequence: CTT
ggcttccaaagtcatagtat

SEQ ID NO: 63713 - DNA, 20 bp, Artificial Sequence
  Description of Artificial Sequence: Synthetic oligonucleotide
  Target: SCN10A; (+) strand; PAM type: YTN; PAM sequence: TTG
gcttccaaagtcatagtatt

SEQ ID NO: 63714 - DNA, 20 bp, Artificial Sequence
  Description of Artificial Sequence: Synthetic oligonucleotide
  Target: SCN10A; (+) strand; PAM type: YTN; PAM sequence: CTT
ccaaagtcatagtattggct

SEQ ID NO: 63715 - DNA, 20 bp, Artificial Sequence
  Description of Artificial Sequence: Synthetic oligonucleotide
  Target: SCN10A; (+) strand; PAM type: YTN; PAM sequence: TTC
caaagtcatagtattggctt

SEQ ID NO: 63716 - DNA, 20 bp, Artificial Sequence
  Description of Artificial Sequence: Synthetic oligonucleotide
  Target: SCN10A; (+) strand; PAM type: YTN; PAM sequence: TTG
gcttctagagcattgggcag

SEQ ID NO: 63717 - DNA, 20 bp, Artificial Sequence
  Description of Artificial Sequence: Synthetic oligonucleotide
  Target: SCN10A; (+) strand; PAM type: YTN; PAM sequence: CTT
ctagagcattgggcagtgag

SEQ ID NO: 63718 - DNA, 20 bp, Artificial Sequence
  Description of Artificial Sequence: Synthetic oligonucleotide
  Target: SCN10A; (+) strand; PAM type: YTN; PAM sequence: TTC
tagagcattgggcagtgagc

SEQ ID NO: 63719 - DNA, 20 bp, Artificial Sequence
  Description of Artificial Sequence: Synthetic oligonucleotide
  Target: SCN10A; (+) strand; PAM type: YTN; PAM sequence: CTA
gagcattgggcagtgagccc

SEQ ID NO: 63720 - DNA, 20 bp, Artificial Sequence
  Description of Artificial Sequence: Synthetic oligonucleotide
  Target: SCN10A; (+) strand; PAM type: YTN; PAM sequence: TTG
ggcagtgagcccccactggc

SEQ ID NO: 63721 - DNA, 20 bp, Artificial Sequence
  Description of Artificial Sequence: Synthetic oligonucleotide
  Target: SCN10A; (+) strand; PAM type: YTN; PAM sequence: CTG
gctctataacaaaggtataa

SEQ ID NO: 63722 - DNA, 20 bp, Artificial Sequence
  Description of Artificial Sequence: Synthetic oligonucleotide
  Target: SCN10A; (+) strand; PAM type: YTN; PAM sequence: CTC
tataacaaaggtataaagag

SEQ ID NO: 63723 - DNA, 20 bp, Artificial Sequence
  Description of Artificial Sequence: Synthetic oligonucleotide
  Target: SCN10A; (+) strand; PAM type: YTN; PAM sequence: CTA
taacaaaggtataaagagca

SEQ ID NO: 63724 - DNA, 20 bp, Artificial Sequence
  Description of Artificial Sequence: Synthetic oligonucleotide
  Target: SCN10A; (+) strand; PAM type: YTN; PAM sequence: CTA
agcatgagagtgaatctaaa

SEQ ID NO: 63725 - DNA, 20 bp, Artificial Sequence
  Description of Artificial Sequence: Synthetic oligonucleotide
  Target: SCN10A; (+) strand; PAM type: YTN; PAM sequence: CTA
aataaacattgagtggacac

SEQ ID NO: 63726 - DNA, 20 bp, Artificial Sequence
  Description of Artificial Sequence: Synthetic oligonucleotide
  Target: SCN10A; (+) strand; PAM type: YTN; PAM sequence: TTG
agtggacacaacaacaatgt

SEQ ID NO: 63727 - DNA, 20 bp, Artificial Sequence
  Description of Artificial Sequence: Synthetic oligonucleotide
  Target: SCN10A; (+) strand; PAM type: YTN; PAM sequence: CTT
gtgagatgtggaagagactg

SEQ ID NO: 63728 - DNA, 20 bp, Artificial Sequence
  Description of Artificial Sequence: Synthetic oligonucleotide
  Target: SCN10A; (+) strand; PAM type: YTN; PAM sequence: TTG
tgagatgtggaagagactgg

SEQ ID NO: 63729 - DNA, 20 bp, Artificial Sequence
  Description of Artificial Sequence: Synthetic oligonucleotide
  Target: SCN10A; (+) strand; PAM type: YTN; PAM sequence: CTG
gtcatatagtctccattcac

SEQ ID NO: 63730 - DNA, 20 bp, Artificial Sequence
  Description of Artificial Sequence: Synthetic oligonucleotide
  Target: SCN10A; (+) strand; PAM type: YTN; PAM sequence: CTC
cattcacttttctcctccca

SEQ ID NO: 63731 - DNA, 20 bp, Artificial Sequence
  Description of Artificial Sequence: Synthetic oligonucleotide
  Target: SCN10A; (+) strand; PAM type: YTN; PAM sequence: TTC
acttttctcctcccagacac

SEQ ID NO: 63732 - DNA, 20 bp, Artificial Sequence
  Description of Artificial Sequence: Synthetic oligonucleotide
  Target: SCN10A; (+) strand; PAM type: YTN; PAM sequence: CTT
ttctcctcccagacacaacg

SEQ ID NO: 63733 - DNA, 20 bp, Artificial Sequence
  Description of Artificial Sequence: Synthetic oligonucleotide
  Target: SCN10A; (+) strand; PAM type: YTN; PAM sequence: TTT
tctcctcccagacacaacgg

SEQ ID NO: 63734 - DNA, 20 bp, Artificial Sequence
  Description of Artificial Sequence: Synthetic oligonucleotide
  Target: SCN10A; (+) strand; PAM type: YTN; PAM sequence: TTT
ctcctcccagacacaacgga

SEQ ID NO: 63735 - DNA, 20 bp, Artificial Sequence
  Description of Artificial Sequence: Synthetic oligonucleotide
  Target: SCN10A; (+) strand; PAM type: YTN; PAM sequence: TTC
tcctcccagacacaacggaa

SEQ ID NO: 63736 - DNA, 20 bp, Artificial Sequence
  Description of Artificial Sequence: Synthetic oligonucleotide
  Target: SCN10A; (+) strand; PAM type: YTN; PAM sequence: CTC
ctcccagacacaacggaaga

SEQ ID NO: 63737 - DNA, 20 bp, Artificial Sequence
  Description of Artificial Sequence: Synthetic oligonucleotide
  Target: SCN10A; (+) strand; PAM type: YTN; PAM sequence: CTC
ccagacacaacggaagactg

SEQ ID NO: 63738 - DNA, 20 bp, Artificial Sequence
  Description of Artificial Sequence: Synthetic oligonucleotide
  Target: SCN10A; (+) strand; PAM type: YTN; PAM sequence: CTG
ttttccagttttgcttgcaa

SEQ ID NO: 63739 - DNA, 20 bp, Artificial Sequence
  Description of Artificial Sequence: Synthetic oligonucleotide
  Target: SCN10A; (+) strand; PAM type: YTN; PAM sequence: TTT
tccagttttgcttgcaaata

SEQ ID NO: 63740 - DNA, 20 bp, Artificial Sequence
  Description of Artificial Sequence: Synthetic oligonucleotide
  Target: SCN10A; (+) strand; PAM type: YTN; PAM sequence: TTT
ccagttttgcttgcaaatag

SEQ ID NO: 63741 - DNA, 20 bp, Artificial Sequence
  Description of Artificial Sequence: Synthetic oligonucleotide
  Target: SCN10A; (+) strand; PAM type: YTN; PAM sequence: TTC
cagttttgcttgcaaatagt

SEQ ID NO: 63742 - DNA, 20 bp, Artificial Sequence
  Description of Artificial Sequence: Synthetic oligonucleotide
  Target: SCN10A; (+) strand; PAM type: YTN; PAM sequence: TTT
tgcttgcaaatagttggggt

SEQ ID NO: 63743 - DNA, 20 bp, Artificial Sequence
  Description of Artificial Sequence: Synthetic oligonucleotide
  Target: SCN10A; (+) strand; PAM type: YTN; PAM sequence: TTT
gcttgcaaatagttggggtc

SEQ ID NO: 63744 - DNA, 20 bp, Artificial Sequence
  Description of Artificial Sequence: Synthetic oligonucleotide
  Target: SCN10A; (+) strand; PAM type: YTN; PAM sequence: TTG
cttgcaaatagttggggtca

SEQ ID NO: 63745 - DNA, 20 bp, Artificial Sequence
  Description of Artificial Sequence: Synthetic oligonucleotide
  Target: SCN10A; (+) strand; PAM type: YTN; PAM sequence: CTT
gcaaatagttggggtcatgt

SEQ ID NO: 63746 - DNA, 20 bp, Artificial Sequence
  Description of Artificial Sequence: Synthetic oligonucleotide
  Target: SCN10A; (+) strand; PAM type: YTN; PAM sequence: TTG
caaatagttggggtcatgtt

SEQ ID NO: 63747 - DNA, 20 bp, Artificial Sequence
  Description of Artificial Sequence: Synthetic oligonucleotide
  Target: SCN10A; (+) strand; PAM type: YTN; PAM sequence: TTG
gggtcatgttagtgggttct

SEQ ID NO: 63748 - DNA, 20 bp, Artificial Sequence
  Description of Artificial Sequence: Synthetic oligonucleotide
  Target: SCN10A; (+) strand; PAM type: YTN; PAM sequence: TTA
gtgggttctgtctggtggaa

SEQ ID NO: 63749 - DNA, 20 bp, Artificial Sequence
  Description of Artificial Sequence: Synthetic oligonucleotide
  Target: SCN10A; (+) strand; PAM type: YTN; PAM sequence: TTC
tgtctggtggaatggagatg

SEQ ID NO: 63750 - DNA, 20 bp, Artificial Sequence
  Description of Artificial Sequence: Synthetic oligonucleotide
  Target: SCN10A; (+) strand; PAM type: YTN; PAM sequence: CTG
tctggtggaatggagatgga

SEQ ID NO: 63751 - DNA, 20 bp, Artificial Sequence
  Description of Artificial Sequence: Synthetic oligonucleotide
  Target: SCN10A; (+) strand; PAM type: YTN; PAM sequence: CTG
gtggaatggagatggagaca

SEQ ID NO: 63752 - DNA, 20 bp, Artificial Sequence
  Description of Artificial Sequence: Synthetic oligonucleotide
  Target: SCN10A; (+) strand; PAM type: YTN; PAM sequence: CTT
ttaggcatagccttaaaccc

SEQ ID NO: 63753 - DNA, 20 bp, Artificial Sequence
  Description of Artificial Sequence: Synthetic oligonucleotide
  Target: SCN10A; (+) strand; PAM type: YTN; PAM sequence: TTT
taggcatagccttaaacccc

SEQ ID NO: 63754 - DNA, 20 bp, Artificial Sequence
  Description of Artificial Sequence: Synthetic oligonucleotide
  Target: SCN10A; (+) strand; PAM type: YTN; PAM sequence: TTT
aggcatagccttaaaccccc

SEQ ID NO: 63755 - DNA, 20 bp, Artificial Sequence
  Description of Artificial Sequence: Synthetic oligonucleotide
  Target: SCN10A; (+) strand; PAM type: YTN; PAM sequence: TTA
ggcatagccttaaaccccct

SEQ ID NO: 63756 - DNA, 20 bp, Artificial Sequence
  Description of Artificial Sequence: Synthetic oligonucleotide
  Target: SCN10A; (+) strand; PAM type: YTN; PAM sequence: CTT
aaaccccctgaactttttct

SEQ ID NO: 63757 - DNA, 20 bp, Artificial Sequence
  Description of Artificial Sequence: Synthetic oligonucleotide
  Target: SCN10A; (+) strand; PAM type: YTN; PAM sequence: TTA
aaccccctgaactttttctt

SEQ ID NO: 63758 - DNA, 20 bp, Artificial Sequence
  Description of Artificial Sequence: Synthetic oligonucleotide
  Target: SCN10A; (+) strand; PAM type: YTN; PAM sequence: CTG
aactttttctttccctttca

SEQ ID NO: 63759 - DNA, 20 bp, Artificial Sequence
  Description of Artificial Sequence: Synthetic oligonucleotide
  Target: SCN10A; (+) strand; PAM type: YTN; PAM sequence: CTT
tttctttccctttcatgttc

SEQ ID NO: 63760 - DNA, 20 bp, Artificial Sequence
  Description of Artificial Sequence: Synthetic oligonucleotide
  Target: SCN10A; (+) strand; PAM type: YTN; PAM sequence: TTT
ttctttccctttcatgttca

SEQ ID NO: 63761 - DNA, 20 bp, Artificial Sequence
  Description of Artificial Sequence: Synthetic oligonucleotide
  Target: SCN10A; (+) strand; PAM type: YTN; PAM sequence: TTT
tctttccctttcatgttcac

SEQ ID NO: 63762 - DNA, 20 bp, Artificial Sequence
  Description of Artificial Sequence: Synthetic oligonucleotide
  Target: SCN10A; (+) strand; PAM type: YTN; PAM sequence: TTT
ctttccctttcatgttcacc

SEQ ID NO: 63763 - DNA, 20 bp, Artificial Sequence
  Description of Artificial Sequence: Synthetic oligonucleotide
  Target: SCN10A; (+) strand; PAM type: YTN; PAM sequence: TTC
tttccctttcatgttcacca

SEQ ID NO: 63764 - DNA, 20 bp, Artificial Sequence
  Description of Artificial Sequence: Synthetic oligonucleotide
  Target: SCN10A; (+) strand; PAM type: YTN; PAM sequence: CTT
tccctttcatgttcaccata

SEQ ID NO: 63765 - DNA, 20 bp, Artificial Sequence
  Description of Artificial Sequence: Synthetic oligonucleotide
  Target: SCN10A; (+) strand; PAM type: YTN; PAM sequence: TTT
ccctttcatgttcaccataa

SEQ ID NO: 63766 - DNA, 20 bp, Artificial Sequence
  Description of Artificial Sequence: Synthetic oligonucleotide
  Target: SCN10A; (+) strand; PAM type: YTN; PAM sequence: TTC
cctttcatgttcaccataaa

SEQ ID NO: 63767 - DNA, 20 bp, Artificial Sequence
  Description of Artificial Sequence: Synthetic oligonucleotide
  Target: SCN10A; (+) strand; PAM type: YTN; PAM sequence: CTT
tcatgttcaccataaaggtc

SEQ ID NO: 63768 - DNA, 20 bp, Artificial Sequence
  Description of Artificial Sequence: Synthetic oligonucleotide
  Target: SCN10A; (+) strand; PAM type: YTN; PAM sequence: TTT
catgttcaccataaaggtca

SEQ ID NO: 63769 - DNA, 20 bp, Artificial Sequence
  Description of Artificial Sequence: Synthetic oligonucleotide
  Target: SCN10A; (+) strand; PAM type: YTN; PAM sequence: TTC
atgttcaccataaaggtcac

SEQ ID NO: 63770 - DNA, 20 bp, Artificial Sequence
  Description of Artificial Sequence: Synthetic oligonucleotide
  Target: SCN10A; (+) strand; PAM type: YTN; PAM sequence: TTC
accataaaggtcactaactg

SEQ ID NO: 63771 - DNA, 20 bp, Artificial Sequence
  Description of Artificial Sequence: Synthetic oligonucleotide
  Target: SCN10A; (+) strand; PAM type: YTN; PAM sequence: CTA
actgaagatggtgacatcac

SEQ ID NO: 63772 - DNA, 20 bp, Artificial Sequence
  Description of Artificial Sequence: Synthetic oligonucleotide
  Target: SCN10A; (+) strand; PAM type: YTN; PAM sequence: CTG
aagatggtgacatcacgata

SEQ ID NO: 63773 - DNA, 20 bp, Artificial Sequence
  Description of Artificial Sequence: Synthetic oligonucleotide
  Target: SCN10A; (+) strand; PAM type: YTN; PAM sequence: CTA
gatccttgaggcgctacttg

SEQ ID NO: 63774 - DNA, 20 bp, Artificial Sequence
  Description of Artificial Sequence: Synthetic oligonucleotide
  Target: SCN10A; (+) strand; PAM type: YTN; PAM sequence: CTT
gaggcgctacttgaagtaga

SEQ ID NO: 63775 - DNA, 20 bp, Artificial Sequence
  Description of Artificial Sequence: Synthetic oligonucleotide
  Target: SCN10A; (+) strand; PAM type: YTN; PAM sequence: TTG
aggcgctacttgaagtagac

SEQ ID NO: 63776 - DNA, 20 bp, Artificial Sequence
  Description of Artificial Sequence: Synthetic oligonucleotide
  Target: SCN10A; (+) strand; PAM type: YTN; PAM sequence: CTA
cttgaagtagacactcccag

SEQ ID NO: 63777 - DNA, 20 bp, Artificial Sequence
  Description of Artificial Sequence: Synthetic oligonucleotide
  Target: SCN10A; (+) strand; PAM type: YTN; PAM sequence: CTT
gaagtagacactcccaggag

SEQ ID NO: 63778 - DNA, 20 bp, Artificial Sequence
  Description of Artificial Sequence: Synthetic oligonucleotide
  Target: SCN10A; (+) strand; PAM type: YTN; PAM sequence: TTG
aagtagacactcccaggaga

SEQ ID NO: 63779 - DNA, 20 bp, Artificial Sequence
  Description of Artificial Sequence: Synthetic oligonucleotide
  Target: SCN10A; (+) strand; PAM type: YTN; PAM sequence: CTC
ccaggagagcttcccaacaa

SEQ ID NO: 63780 - DNA, 20 bp, Artificial Sequence
  Description of Artificial Sequence: Synthetic oligonucleotide
  Target: SCN10A; (+) strand; PAM type: YTN; PAM sequence: CTT
cccaacaagcactgaatgtg

SEQ ID NO: 63781 - DNA, 20 bp, Artificial Sequence
  Description of Artificial Sequence: Synthetic oligonucleotide
  Target: SCN10A; (+) strand; PAM type: YTN; PAM sequence: TTC
ccaacaagcactgaatgtgc

SEQ ID NO: 63782 - DNA, 20 bp, Artificial Sequence
  Description of Artificial Sequence: Synthetic oligonucleotide
  Target: SCN10A; (+) strand; PAM type: YTN; PAM sequence: CTG
aatgtgctgtgagacataca

SEQ ID NO: 63783 - DNA, 20 bp, Artificial Sequence
  Description of Artificial Sequence: Synthetic oligonucleotide
  Target: SCN10A; (+) strand; PAM type: YTN; PAM sequence: CTG
tgagacatacatctctatta

SEQ ID NO: 63784 - DNA, 20 bp, Artificial Sequence
  Description of Artificial Sequence: Synthetic oligonucleotide
  Target: SCN10A; (+) strand; PAM type: YTN; PAM sequence: CTC
tattatgttaactcacagat

SEQ ID NO: 63785 - DNA, 20 bp, Artificial Sequence
  Description of Artificial Sequence: Synthetic oligonucleotide
  Target: SCN10A; (+) strand; PAM type: YTN; PAM sequence: CTA
ttatgttaactcacagattt

SEQ ID NO: 63786 - DNA, 20 bp, Artificial Sequence
  Description of Artificial Sequence: Synthetic oligonucleotide
  Target: SCN10A; (+) strand; PAM type: YTN; PAM sequence: TTA
tgttaactcacagatttaga

SEQ ID NO: 63787 - DNA, 20 bp, Artificial Sequence
  Description of Artificial Sequence: Synthetic oligonucleotide
  Target: SCN10A; (+) strand; PAM type: YTN; PAM sequence: TTA
actcacagatttagagggta

SEQ ID NO: 63788 - DNA, 20 bp, Artificial Sequence
  Description of Artificial Sequence: Synthetic oligonucleotide
  Target: SCN10A; (+) strand; PAM type: YTN; PAM sequence: CTC
acagatttagagggtatcac

SEQ ID NO: 63789 - DNA, 20 bp, Artificial Sequence
  Description of Artificial Sequence: Synthetic oligonucleotide
  Target: SCN10A; (+) strand; PAM type: YTN; PAM sequence: TTT
agagggtatcactgcagcta

SEQ ID NO: 63790 - DNA, 20 bp, Artificial Sequence
  Description of Artificial Sequence: Synthetic oligonucleotide
  Target: SCN10A; (+) strand; PAM type: YTN; PAM sequence: TTA
gagggtatcactgcagctag

SEQ ID NO: 63791 - DNA, 20 bp, Artificial Sequence
  Description of Artificial Sequence: Synthetic oligonucleotide
  Target: SCN10A; (+) strand; PAM type: YTN; PAM sequence: CTG
cagctagttgtacttatctt

SEQ ID NO: 63792 - DNA, 20 bp, Artificial Sequence
  Description of Artificial Sequence: Synthetic oligonucleotide
  Target: SCN10A; (+) strand; PAM type: YTN; PAM sequence: CTA
gttgtacttatcttgagtaa

SEQ ID NO: 63793 - DNA, 20 bp, Artificial Sequence
  Description of Artificial Sequence: Synthetic oligonucleotide
  Target: SCN10A; (+) strand; PAM type: YTN; PAM sequence: TTG
tacttatcttgagtaatgga

SEQ ID NO: 63794 - DNA, 20 bp, Artificial Sequence
  Description of Artificial Sequence: Synthetic oligonucleotide
  Target: SCN10A; (+) strand; PAM type: YTN; PAM sequence: CTT
atcttgagtaatggagaaat

SEQ ID NO: 63795 - DNA, 20 bp, Artificial Sequence
  Description of Artificial Sequence: Synthetic oligonucleotide
  Target: SCN10A; (+) strand; PAM type: YTN; PAM sequence: TTA
tcttgagtaatggagaaatt

SEQ ID NO: 63796 - DNA, 20 bp, Artificial Sequence
  Description of Artificial Sequence: Synthetic oligonucleotide
  Target: SCN10A; (+) strand; PAM type: YTN; PAM sequence: CTT
gagtaatggagaaattgctt

SEQ ID NO: 63797 - DNA, 20 bp, Artificial Sequence
  Description of Artificial Sequence: Synthetic oligonucleotide
  Target: SCN10A; (+) strand; PAM type: YTN; PAM sequence: TTG
agtaatggagaaattgcttc

SEQ ID NO: 63798 - DNA, 20 bp, Artificial Sequence
  Description of Artificial Sequence: Synthetic oligonucleotide
  Target: SCN10A; (+) strand; PAM type: YTN; PAM sequence: TTG
cttcattgaaaaaaggtatt

SEQ ID NO: 63799 - DNA, 20 bp, Artificial Sequence
  Description of Artificial Sequence: Synthetic oligonucleotide
  Target: SCN10A; (+) strand; PAM type: YTN; PAM sequence: CTT
cattgaaaaaaggtattgcc

SEQ ID NO: 63800 - DNA, 20 bp, Artificial Sequence
  Description of Artificial Sequence: Synthetic oligonucleotide
  Target: SCN10A; (+) strand; PAM type: YTN; PAM sequence: TTC
attgaaaaaaggtattgcct

SEQ ID NO: 63801 - DNA, 20 bp, Artificial Sequence
  Description of Artificial Sequence: Synthetic oligonucleotide
  Target: SCN10A; (+) strand; PAM type: YTN; PAM sequence: TTG
aaaaaaggtattgccttttc

SEQ ID NO: 63802 - DNA, 20 bp, Artificial Sequence
  Description of Artificial Sequence: Synthetic oligonucleotide
  Target: SCN10A; (+) strand; PAM type: YTN; PAM sequence: TTG
ccttttcaaaagcatcaact

SEQ ID NO: 63803 - DNA, 20 bp, Artificial Sequence
  Description of Artificial Sequence: Synthetic oligonucleotide
  Target: SCN10A; (+) strand; PAM type: YTN; PAM sequence: CTT
ttcaaaagcatcaactatgt

SEQ ID NO: 63804 - DNA, 20 bp, Artificial Sequence
  Description of Artificial Sequence: Synthetic oligonucleotide
  Target: SCN10A; (+) strand; PAM type: YTN; PAM sequence: TTT
tcaaaagcatcaactatgtg

SEQ ID NO: 63805 - DNA, 20 bp, Artificial Sequence
  Description of Artificial Sequence: Synthetic oligonucleotide
  Target: SCN10A; (+) strand; PAM type: YTN; PAM sequence: TTT
caaaagcatcaactatgtgg

SEQ ID NO: 63806 - DNA, 20 bp, Artificial Sequence
  Description of Artificial Sequence: Synthetic oligonucleotide
  Target: SCN10A; (+) strand; PAM type: YTN; PAM sequence: TTC
aaaagcatcaactatgtggc

SEQ ID NO: 63807 - DNA, 20 bp, Artificial Sequence
  Description of Artificial Sequence: Synthetic oligonucleotide
  Target: SCN10A; (+) strand; PAM type: YTN; PAM sequence: CTA
tgtggcactggcttaatgat

SEQ ID NO: 63808 - DNA, 20 bp, Artificial Sequence
  Description of Artificial Sequence: Synthetic oligonucleotide
  Target: SCN10A; (+) strand; PAM type: YTN; PAM sequence: CTG
gcttaatgatcatgtggtgg

SEQ ID NO: 63809 - DNA, 20 bp, Artificial Sequence
  Description of Artificial Sequence: Synthetic oligonucleotide
  Target: SCN10A; (+) strand; PAM type: YTN; PAM sequence: CTT
aatgatcatgtggtgggcaa

SEQ ID NO: 63810 - DNA, 20 bp, Artificial Sequence
  Description of Artificial Sequence: Synthetic oligonucleotide
  Target: SCN10A; (+) strand; PAM type: YTN; PAM sequence: TTA
atgatcatgtggtgggcaac

SEQ ID NO: 63811 - DNA, 20 bp, Artificial Sequence
  Description of Artificial Sequence: Synthetic oligonucleotide
  Target: SCN10A; (+) strand; PAM type: YTN; PAM sequence: CTG
ataggagaaggcttggaatg

SEQ ID NO: 63812 - DNA, 20 bp, Artificial Sequence
  Description of Artificial Sequence: Synthetic oligonucleotide
  Target: SCN10A; (+) strand; PAM type: YTN; PAM sequence: CTT
ggaatgtcaatctatgttat

SEQ ID NO: 63813 - DNA, 20 bp, Artificial Sequence
  Description of Artificial Sequence: Synthetic oligonucleotide
  Target: SCN10A; (+) strand; PAM type: YTN; PAM sequence: TTG
gaatgtcaatctatgttatt

SEQ ID NO: 63814 - DNA, 20 bp, Artificial Sequence
  Description of Artificial Sequence: Synthetic oligonucleotide
  Target: SCN10A; (+) strand; PAM type: YTN; PAM sequence: CTA
tgttattcagtgacaaaaat

SEQ ID NO: 63815 - DNA, 20 bp, Artificial Sequence
  Description of Artificial Sequence: Synthetic oligonucleotide
  Target: SCN10A; (+) strand; PAM type: YTN; PAM sequence: TTA
ttcagtgacaaaaatattgc

SEQ ID NO: 63816 - DNA, 20 bp, Artificial Sequence
  Description of Artificial Sequence: Synthetic oligonucleotide
  Target: SCN10A; (+) strand; PAM type: YTN; PAM sequence: TTC
agtgacaaaaatattgctgg

SEQ ID NO: 63817 - DNA, 20 bp, Artificial Sequence
  Description of Artificial Sequence: Synthetic oligonucleotide
  Target: SCN10A; (+) strand; PAM type: YTN; PAM sequence: TTG
ctggcaaaaattttgaggca

SEQ ID NO: 63818 - DNA, 20 bp, Artificial Sequence
  Description of Artificial Sequence: Synthetic oligonucleotide
  Target: SCN10A; (+) strand; PAM type: YTN; PAM sequence: CTG
gcaaaaattttgaggcagag

SEQ ID NO: 63819 - DNA, 20 bp, Artificial Sequence
  Description of Artificial Sequence: Synthetic oligonucleotide
  Target: SCN10A; (+) strand; PAM type: YTN; PAM sequence: TTT
tgaggcagagcacgagcctc

SEQ ID NO: 63820 - DNA, 20 bp, Artificial Sequence
  Description of Artificial Sequence: Synthetic oligonucleotide
  Target: SCN10A; (+) strand; PAM type: YTN; PAM sequence: TTT
gaggcagagcacgagcctca

SEQ ID NO: 63821 - DNA, 20 bp, Artificial Sequence
  Description of Artificial Sequence: Synthetic oligonucleotide
  Target: SCN10A; (+) strand; PAM type: YTN; PAM sequence: TTG
aggcagagcacgagcctcat

SEQ ID NO: 63822 - DNA, 20 bp, Artificial Sequence
  Description of Artificial Sequence: Synthetic oligonucleotide
  Target: SCN10A; (+) strand; PAM type: YTN; PAM sequence: CTC
atgaaccagcaaccctaggg

SEQ ID NO: 63823 - DNA, 20 bp, Artificial Sequence
  Description of Artificial Sequence: Synthetic oligonucleotide
  Target: SCN10A; (+) strand; PAM type: YTN; PAM sequence: CTA
ggggaagggtttattaaacc

SEQ ID NO: 63824 - DNA, 20 bp, Artificial Sequence
  Description of Artificial Sequence: Synthetic oligonucleotide
  Target: SCN10A; (+) strand; PAM type: YTN; PAM sequence: TTT
attaaaccttagtattgtgg

SEQ ID NO: 63825 - DNA, 20 bp, Artificial Sequence
  Description of Artificial Sequence: Synthetic oligonucleotide
  Target: SCN10A; (+) strand; PAM type: YTN; PAM sequence: TTA
ttaaaccttagtattgtggg

SEQ ID NO: 63826 - DNA, 20 bp, Artificial Sequence
  Description of Artificial Sequence: Synthetic oligonucleotide
  Target: SCN10A; (+) strand; PAM type: YTN; PAM sequence: TTA
aaccttagtattgtgggtca

SEQ ID NO: 63827 - DNA, 20 bp, Artificial Sequence
  Description of Artificial Sequence: Synthetic oligonucleotide
  Target: SCN10A; (+) strand; PAM type: YTN; PAM sequence: CTT
agtattgtgggtcagttgta

SEQ ID NO: 63828 - DNA, 20 bp, Artificial Sequence
  Description of Artificial Sequence: Synthetic oligonucleotide
  Target: SCN10A; (+) strand; PAM type: YTN; PAM sequence: TTA
gtattgtgggtcagttgtaa

SEQ ID NO: 63829 - DNA, 20 bp, Artificial Sequence
  Description of Artificial Sequence: Synthetic oligonucleotide
  Target: SCN10A; (+) strand; PAM type: YTN; PAM sequence: TTG
tgggtcagttgtaattggct

SEQ ID NO: 63830 - DNA, 20 bp, Artificial Sequence
  Description of Artificial Sequence: Synthetic oligonucleotide
  Target: SCN10A; (+) strand; PAM type: YTN; PAM sequence: TTG
taattggctatgttggtcaa

SEQ ID NO: 63831 - DNA, 20 bp, Artificial Sequence
  Description of Artificial Sequence: Synthetic oligonucleotide
  Target: SCN10A; (+) strand; PAM type: YTN; PAM sequence: TTG
gctatgttggtcaagacagt

SEQ ID NO: 63832 - DNA, 20 bp, Artificial Sequence
  Description of Artificial Sequence: Synthetic oligonucleotide
  Target: SCN10A; (+) strand; PAM type: YTN; PAM sequence: CTA
tgttggtcaagacagtacaa

SEQ ID NO: 63833 - DNA, 20 bp, Artificial Sequence
  Description of Artificial Sequence: Synthetic oligonucleotide
  Target: SCN10A; (+) strand; PAM type: YTN; PAM sequence: TTG
gtcaagacagtacaagaaag

SEQ ID NO: 63834 - DNA, 20 bp, Artificial Sequence
  Description of Artificial Sequence: Synthetic oligonucleotide
  Target: SCN10A; (+) strand; PAM type: YTN; PAM sequence: TTA
gctcaggaaagatttagctg

SEQ ID NO: 63835 - DNA, 20 bp, Artificial Sequence
  Description of Artificial Sequence: Synthetic oligonucleotide
  Target: SCN10A; (+) strand; PAM type: YTN; PAM sequence: CTC
aggaaagatttagctggttt

SEQ ID NO: 63836 - DNA, 20 bp, Artificial Sequence
  Description of Artificial Sequence: Synthetic oligonucleotide
  Target: SCN10A; (+) strand; PAM type: YTN; PAM sequence: TTT
agctggtttataagaataaa

SEQ ID NO: 63837 - DNA, 20 bp, Artificial Sequence
  Description of Artificial Sequence: Synthetic oligonucleotide
  Target: SCN10A; (+) strand; PAM type: YTN; PAM sequence: TTA
gctggtttataagaataaaa

SEQ ID NO: 63838 - DNA, 20 bp, Artificial Sequence
  Description of Artificial Sequence: Synthetic oligonucleotide
  Target: SCN10A; (+) strand; PAM type: YTN; PAM sequence: CTG
gtttataagaataaaagaaa

SEQ ID NO: 63839 - DNA, 20 bp, Artificial Sequence
  Description of Artificial Sequence: Synthetic oligonucleotide
  Target: SCN10A; (+) strand; PAM type: YTN; PAM sequence: TTT
ataagaataaaagaaaatat

SEQ ID NO: 63840 - DNA, 20 bp, Artificial Sequence
  Description of Artificial Sequence: Synthetic oligonucleotide
  Target: SCN10A; (+) strand; PAM type: YTN; PAM sequence: TTA
taagaataaaagaaaatata

SEQ ID NO: 63841 - DNA, 20 bp, Artificial Sequence
  Description of Artificial Sequence: Synthetic oligonucleotide
  Target: SCN10A; (+) strand; PAM type: YTN; PAM sequence: TTT
agagccttgacgatttaggg

SEQ ID NO: 63842 - DNA, 20 bp, Artificial Sequence
  Description of Artificial Sequence: Synthetic oligonucleotide
  Target: SCN10A; (+) strand; PAM type: YTN; PAM sequence: TTA
gagccttgacgatttaggga

SEQ ID NO: 63843 - DNA, 20 bp, Artificial Sequence
  Description of Artificial Sequence: Synthetic oligonucleotide
  Target: SCN10A; (+) strand; PAM type: YTN; PAM sequence: CTT
gacgatttagggaactgtac

SEQ ID NO: 63844 - DNA, 20 bp, Artificial Sequence
  Description of Artificial Sequence: Synthetic oligonucleotide
  Target: SCN10A; (+) strand; PAM type: YTN; PAM sequence: TTG
acgatttagggaactgtact

SEQ ID NO: 63845 - DNA, 20 bp, Artificial Sequence
  Description of Artificial Sequence: Synthetic oligonucleotide
  Target: SCN10A; (+) strand; PAM type: YTN; PAM sequence: TTT
agggaactgtactgcttcta

SEQ ID NO: 63846 - DNA, 20 bp, Artificial Sequence
  Description of Artificial Sequence: Synthetic oligonucleotide
  Target: SCN10A; (+) strand; PAM type: YTN; PAM sequence: TTA
gggaactgtactgcttctag

SEQ ID NO: 63847 - DNA, 20 bp, Artificial Sequence
  Description of Artificial Sequence: Synthetic oligonucleotide
  Target: SCN10A; (+) strand; PAM type: YTN; PAM sequence: CTG
tactgcttctagattccagg

SEQ ID NO: 63848 - DNA, 20 bp, Artificial Sequence
  Description of Artificial Sequence: Synthetic oligonucleotide
  Target: SCN10A; (+) strand; PAM type: YTN; PAM sequence: CTG
cttctagattccaggcagtg

SEQ ID NO: 63849 - DNA, 20 bp, Artificial Sequence
  Description of Artificial Sequence: Synthetic oligonucleotide
  Target: SCN10A; (+) strand; PAM type: YTN; PAM sequence: CTT
ctagattccaggcagtgagc

SEQ ID NO: 63850 - DNA, 20 bp, Artificial Sequence
  Description of Artificial Sequence: Synthetic oligonucleotide
  Target: SCN10A; (+) strand; PAM type: YTN; PAM sequence: TTC
tagattccaggcagtgagca

SEQ ID NO: 63851 - DNA, 20 bp, Artificial Sequence
  Description of Artificial Sequence: Synthetic oligonucleotide
  Target: SCN10A; (+) strand; PAM type: YTN; PAM sequence: CTA
gattccaggcagtgagcaat

SEQ ID NO: 63852 - DNA, 20 bp, Artificial Sequence
  Description of Artificial Sequence: Synthetic oligonucleotide
  Target: SCN10A; (+) strand; PAM type: YTN; PAM sequence: TTC
caggcagtgagcaatgggat

SEQ ID NO: 63853 - DNA, 20 bp, Artificial Sequence
  Description of Artificial Sequence: Synthetic oligonucleotide
  Target: SCN10A; (+) strand; PAM type: YTN; PAM sequence: TTA
agtcttcaaatgttgaagac

SEQ ID NO: 63854 - DNA, 20 bp, Artificial Sequence
  Description of Artificial Sequence: Synthetic oligonucleotide
  Target: SCN10A; (+) strand; PAM type: YTN; PAM sequence: CTT
caaatgttgaagactagtta

SEQ ID NO: 63855 - DNA, 20 bp, Artificial Sequence
  Description of Artificial Sequence: Synthetic oligonucleotide
  Target: SCN10A; (+) strand; PAM type: YTN; PAM sequence: TTC
aaatgttgaagactagttaa

SEQ ID NO: 63856 - DNA, 20 bp, Artificial Sequence
  Description of Artificial Sequence: Synthetic oligonucleotide
  Target: SCN10A; (+) strand; PAM type: YTN; PAM sequence: TTG
aagactagttaaattttcca

SEQ ID NO: 63857 - DNA, 20 bp, Artificial Sequence
  Description of Artificial Sequence: Synthetic oligonucleotide
  Target: SCN10A; (+) strand; PAM type: YTN; PAM sequence: CTA
gttaaattttccaattaaat

SEQ ID NO: 63858 - DNA, 20 bp, Artificial Sequence
  Description of Artificial Sequence: Synthetic oligonucleotide
  Target: SCN10A; (+) strand; PAM type: YTN; PAM sequence: TTA
aattttccaattaaatgaaa

SEQ ID NO: 63859 - DNA, 20 bp, Artificial Sequence
  Description of Artificial Sequence: Synthetic oligonucleotide
  Target: SCN10A; (+) strand; PAM type: YTN; PAM sequence: TTT
tccaattaaatgaaacaact

SEQ ID NO: 63860 - DNA, 20 bp, Artificial Sequence
  Description of Artificial Sequence: Synthetic oligonucleotide
  Target: SCN10A; (+) strand; PAM type: YTN; PAM sequence: TTT
ccaattaaatgaaacaactc

SEQ ID NO: 63861 - DNA, 20 bp, Artificial Sequence
  Description of Artificial Sequence: Synthetic oligonucleotide
  Target: SCN10A; (+) strand; PAM type: YTN; PAM sequence: TTC
caattaaatgaaacaactct

SEQ ID NO: 63862 - DNA, 20 bp, Artificial Sequence
  Description of Artificial Sequence: Synthetic oligonucleotide
  Target: SCN10A; (+) strand; PAM type: YTN; PAM sequence: TTA
aatgaaacaactcttagcaa

SEQ ID NO: 63863 - DNA, 20 bp, Artificial Sequence
  Description of Artificial Sequence: Synthetic oligonucleotide
  Target: SCN10A; (+) strand; PAM type: YTN; PAM sequence: CTC
ttagcaaagcttgtagtaat

SEQ ID NO: 63864 - DNA, 20 bp, Artificial Sequence
  Description of Artificial Sequence: Synthetic oligonucleotide
  Target: SCN10A; (+) strand; PAM type: YTN; PAM sequence: CTT
agcaaagcttgtagtaatgg

SEQ ID NO: 63865 - DNA, 20 bp, Artificial Sequence
  Description of Artificial Sequence: Synthetic oligonucleotide
  Target: SCN10A; (+) strand; PAM type: YTN; PAM sequence: TTA
gcaaagcttgtagtaatggt

SEQ ID NO: 63866 - DNA, 20 bp, Artificial Sequence
  Description of Artificial Sequence: Synthetic oligonucleotide
  Target: SCN10A; (+) strand; PAM type: YTN; PAM sequence: CTT
gtagtaatggtgtagccact

SEQ ID NO: 63867 - DNA, 20 bp, Artificial Sequence
  Description of Artificial Sequence: Synthetic oligonucleotide
  Target: SCN10A; (+) strand; PAM type: YTN; PAM sequence: TTG
tagtaatggtgtagccactg

SEQ ID NO: 63868 - DNA, 20 bp, Artificial Sequence
  Description of Artificial Sequence: Synthetic oligonucleotide
  Target: SCN10A; (+) strand; PAM type: YTN; PAM sequence: CTG
tttcttgtgcaagagaaagg

SEQ ID NO: 63869 - DNA, 20 bp, Artificial Sequence
  Description of Artificial Sequence: Synthetic oligonucleotide
  Target: SCN10A; (+) strand; PAM type: YTN; PAM sequence: TTT
cttgtgcaagagaaaggcat

SEQ ID NO: 63870 - DNA, 20 bp, Artificial Sequence
  Description of Artificial Sequence: Synthetic oligonucleotide
  Target: SCN10A; (+) strand; PAM type: YTN; PAM sequence: TTC
ttgtgcaagagaaaggcatg

SEQ ID NO: 63871 - DNA, 20 bp, Artificial Sequence
  Description of Artificial Sequence: Synthetic oligonucleotide
  Target: SCN10A; (+) strand; PAM type: YTN; PAM sequence: CTT
gtgcaagagaaaggcatggg

SEQ ID NO: 63872 - DNA, 20 bp, Artificial Sequence
  Description of Artificial Sequence: Synthetic oligonucleotide
  Target: SCN10A; (+) strand; PAM type: YTN; PAM sequence: TTG
tgcaagagaaaggcatgggg

SEQ ID NO: 63873 - DNA, 20 bp, Artificial Sequence
  Description of Artificial Sequence: Synthetic oligonucleotide
  Target: SCN10A; (+) strand; PAM type: YTN; PAM sequence: TTG
agaactttgtcaaagaaagc

SEQ ID NO: 63874 - DNA, 20 bp, Artificial Sequence
  Description of Artificial Sequence: Synthetic oligonucleotide
  Target: SCN10A; (+) strand; PAM type: YTN; PAM sequence: CTT
tgtcaaagaaagcactttgt

SEQ ID NO: 63875 - DNA, 20 bp, Artificial Sequence
  Description of Artificial Sequence: Synthetic oligonucleotide
  Target: SCN10A; (+) strand; PAM type: YTN; PAM sequence: TTT
gtcaaagaaagcactttgtg

SEQ ID NO: 63876 - DNA, 20 bp, Artificial Sequence
  Description of Artificial Sequence: Synthetic oligonucleotide
  Target: SCN10A; (+) strand; PAM type: YTN; PAM sequence: TTG
tcaaagaaagcactttgtgt

SEQ ID NO: 63877 - DNA, 20 bp, Artificial Sequence
  Description of Artificial Sequence: Synthetic oligonucleotide
  Target: SCN10A; (+) strand; PAM type: YTN; PAM sequence: CTT
tgtgtggcaatgagaggtct

SEQ ID NO: 63878 - DNA, 20 bp, Artificial Sequence
  Description of Artificial Sequence: Synthetic oligonucleotide
  Target: SCN10A; (+) strand; PAM type: YTN; PAM sequence: TTT
gtgtggcaatgagaggtctg

SEQ ID NO: 63879 - DNA, 20 bp, Artificial Sequence
  Description of Artificial Sequence: Synthetic oligonucleotide
  Target: SCN10A; (+) strand; PAM type: YTN; PAM sequence: TTG
tgtggcaatgagaggtctga

SEQ ID NO: 63880 - DNA, 20 bp, Artificial Sequence
  Description of Artificial Sequence: Synthetic oligonucleotide
  Target: SCN10A; (+) strand; PAM type: YTN; PAM sequence: CTG
aagccatctaagtttttgaa

SEQ ID NO: 63881 - DNA, 20 bp, Artificial Sequence
  Description of Artificial Sequence: Synthetic oligonucleotide
  Target: SCN10A; (+) strand; PAM type: YTN; PAM sequence: CTA
agtttttgaagtaattgtat

SEQ ID NO: 63882 - DNA, 20 bp, Artificial Sequence
  Description of Artificial Sequence: Synthetic oligonucleotide
  Target: SCN10A; (+) strand; PAM type: YTN; PAM sequence: TTT
ttgaagtaattgtattgtga

SEQ ID NO: 63883 - DNA, 20 bp, Artificial Sequence
  Description of Artificial Sequence: Synthetic oligonucleotide
  Target: SCN10A; (+) strand; PAM type: YTN; PAM sequence: TTT
tgaagtaattgtattgtgaa

SEQ ID NO: 63884 - DNA, 20 bp, Artificial Sequence
  Description of Artificial Sequence: Synthetic oligonucleotide
  Target: SCN10A; (+) strand; PAM type: YTN; PAM sequence: TTT
gaagtaattgtattgtgaaa

SEQ ID NO: 63885 - DNA, 20 bp, Artificial Sequence
  Description of Artificial Sequence: Synthetic oligonucleotide
  Target: SCN10A; (+) strand; PAM type: YTN; PAM sequence: TTG
aagtaattgtattgtgaaat

SEQ ID NO: 63886 - DNA, 20 bp, Artificial Sequence
  Description of Artificial Sequence: Synthetic oligonucleotide
  Target: SCN10A; (+) strand; PAM type: YTN; PAM sequence: TTG
tattgtgaaataaatcaaaa

SEQ ID NO: 63887 - DNA, 20 bp, Artificial Sequence
  Description of Artificial Sequence: Synthetic oligonucleotide
  Target: SCN10A; (+) strand; PAM type: YTN; PAM sequence: TTG
tgaaataaatcaaaatccct

SEQ ID NO: 63888 - DNA, 20 bp, Artificial Sequence
  Description of Artificial Sequence: Synthetic oligonucleotide
  Target: SCN10A; (+) strand; PAM type: YTN; PAM sequence: CTG
actgaaaaagcctttcactg

SEQ ID NO: 63889 - DNA, 20 bp, Artificial Sequence
  Description of Artificial Sequence: Synthetic oligonucleotide
  Target: SCN10A; (+) strand; PAM type: YTN; PAM sequence: CTG
aaaaagcctttcactgttta

SEQ ID NO: 63890 - DNA, 20 bp, Artificial Sequence
  Description of Artificial Sequence: Synthetic oligonucleotide
  Target: SCN10A; (+) strand; PAM type: YTN; PAM sequence: CTT
tcactgtttaaaccttaaaa

SEQ ID NO: 63891 - DNA, 20 bp, Artificial Sequence
  Description of Artificial Sequence: Synthetic oligonucleotide
  Target: SCN10A; (+) strand; PAM type: YTN; PAM sequence: TTT
cactgtttaaaccttaaaac

SEQ ID NO: 63892 - DNA, 20 bp, Artificial Sequence
  Description of Artificial Sequence: Synthetic oligonucleotide
  Target: SCN10A; (+) strand; PAM type: YTN; PAM sequence: TTC
actgtttaaaccttaaaaca

SEQ ID NO: 63893 - DNA, 20 bp, Artificial Sequence
  Description of Artificial Sequence: Synthetic oligonucleotide
  Target: SCN10A; (+) strand; PAM type: YTN; PAM sequence: CTG
tttaaaccttaaaacaaacc

SEQ ID NO: 63894 - DNA, 20 bp, Artificial Sequence
  Description of Artificial Sequence: Synthetic oligonucleotide
  Target: SCN10A; (+) strand; PAM type: YTN; PAM sequence: TTT
aaaccttaaaacaaaccttg

SEQ ID NO: 63895 - DNA, 20 bp, Artificial Sequence
  Description of Artificial Sequence: Synthetic oligonucleotide
  Target: SCN10A; (+) strand; PAM type: YTN; PAM sequence: TTA
aaccttaaaacaaaccttgg

SEQ ID NO: 63896 - DNA, 20 bp, Artificial Sequence
  Description of Artificial Sequence: Synthetic oligonucleotide
  Target: SCN10A; (+) strand; PAM type: YTN; PAM sequence: CTT
aaaacaaaccttggctttcc

SEQ ID NO: 63897 - DNA, 20 bp, Artificial Sequence
  Description of Artificial Sequence: Synthetic oligonucleotide
  Target: SCN10A; (+) strand; PAM type: YTN; PAM sequence: TTA
aaacaaaccttggctttcca

SEQ ID NO: 63898 - DNA, 20 bp, Artificial Sequence
  Description of Artificial Sequence: Synthetic oligonucleotide
  Target: SCN10A; (+) strand; PAM type: YTN; PAM sequence: CTT
ggctttccattttcccacaa

SEQ ID NO: 63899 - DNA, 20 bp, Artificial Sequence
  Description of Artificial Sequence: Synthetic oligonucleotide
  Target: SCN10A; (+) strand; PAM type: YTN; PAM sequence: TTG
gctttccattttcccacaag

SEQ ID NO: 63900 - DNA, 20 bp, Artificial Sequence
  Description of Artificial Sequence: Synthetic oligonucleotide
  Target: SCN10A; (+) strand; PAM type: YTN; PAM sequence: CTT
tccattttcccacaagcagg

SEQ ID NO: 63901 - DNA, 20 bp, Artificial Sequence
  Description of Artificial Sequence: Synthetic oligonucleotide
  Target: SCN10A; (+) strand; PAM type: YTN; PAM sequence: TTT
ccattttcccacaagcagga

SEQ ID NO: 63902 - DNA, 20 bp, Artificial Sequence
  Description of Artificial Sequence: Synthetic oligonucleotide
  Target: SCN10A; (+) strand; PAM type: YTN; PAM sequence: TTC
cattttcccacaagcaggag

SEQ ID NO: 63903 - DNA, 20 bp, Artificial Sequence
  Description of Artificial Sequence: Synthetic oligonucleotide
  Target: SCN10A; (+) strand; PAM type: YTN; PAM sequence: TTT
tcccacaagcaggaggcaaa

SEQ ID NO: 63904 - DNA, 20 bp, Artificial Sequence
  Description of Artificial Sequence: Synthetic oligonucleotide
  Target: SCN10A; (+) strand; PAM type: YTN; PAM sequence: TTT
cccacaagcaggaggcaaac

SEQ ID NO: 63905 - DNA, 20 bp, Artificial Sequence
  Description of Artificial Sequence: Synthetic oligonucleotide
  Target: SCN10A; (+) strand; PAM type: YTN; PAM sequence: TTC
ccacaagcaggaggcaaact

SEQ ID NO: 63906 - DNA, 20 bp, Artificial Sequence
  Description of Artificial Sequence: Synthetic oligonucleotide
  Target: SCN10A; (+) strand; PAM type: YTN; PAM sequence: CTT
tgaagttatattggcctcct

SEQ ID NO: 63907 - DNA, 20 bp, Artificial Sequence
  Description of Artificial Sequence: Synthetic oligonucleotide
  Target: SCN10A; (+) strand; PAM type: YTN; PAM sequence: TTT
gaagttatattggcctcctt

SEQ ID NO: 63908 - DNA, 20 bp, Artificial Sequence
  Description of Artificial Sequence: Synthetic oligonucleotide
  Target: SCN10A; (+) strand; PAM type: YTN; PAM sequence: TTG
aagttatattggcctccttc

SEQ ID NO: 63909 - DNA, 20 bp, Artificial Sequence
  Description of Artificial Sequence: Synthetic oligonucleotide
  Target: SCN10A; (+) strand; PAM type: YTN; PAM sequence: TTA
tattggcctccttcaggcat

SEQ ID NO: 63910 - DNA, 20 bp, Artificial Sequence
  Description of Artificial Sequence: Synthetic oligonucleotide
  Target: SCN10A; (+) strand; PAM type: YTN; PAM sequence: TTG
gcctccttcaggcatggcaa

SEQ ID NO: 63911 - DNA, 20 bp, Artificial Sequence
  Description of Artificial Sequence: Synthetic oligonucleotide
  Target: SCN10A; (+) strand; PAM type: YTN; PAM sequence: CTC
cttcaggcatggcaaagtca

SEQ ID NO: 63912 - DNA, 20 bp, Artificial Sequence
  Description of Artificial Sequence: Synthetic oligonucleotide
  Target: SCN10A; (+) strand; PAM type: YTN; PAM sequence: CTT
caggcatggcaaagtcactt

SEQ ID NO: 63913 - DNA, 20 bp, Artificial Sequence
  Description of Artificial Sequence: Synthetic oligonucleotide
  Target: SCN10A; (+) strand; PAM type: YTN; PAM sequence: TTC
aggcatggcaaagtcacttc

SEQ ID NO: 63914 - DNA, 20 bp, Artificial Sequence
  Description of Artificial Sequence: Synthetic oligonucleotide
  Target: SCN10A; (+) strand; PAM type: YTN; PAM sequence: CTT
cttggagtcccacctagagc

SEQ ID NO: 63915 - DNA, 20 bp, Artificial Sequence
  Description of Artificial Sequence: Synthetic oligonucleotide
  Target: SCN10A; (+) strand; PAM type: YTN; PAM sequence: TTC
ttggagtcccacctagagct

SEQ ID NO: 63916 - DNA, 20 bp, Artificial Sequence
  Description of Artificial Sequence: Synthetic oligonucleotide
  Target: SCN10A; (+) strand; PAM type: YTN; PAM sequence: CTT
ggagtcccacctagagctgt

SEQ ID NO: 63917 - DNA, 20 bp, Artificial Sequence
  Description of Artificial Sequence: Synthetic oligonucleotide
  Target: SCN10A; (+) strand; PAM type: YTN; PAM sequence: TTG
gagtcccacctagagctgtc

SEQ ID NO: 63918 - DNA, 20 bp, Artificial Sequence
  Description of Artificial Sequence: Synthetic oligonucleotide
  Target: SCN10A; (+) strand; PAM type: YTN; PAM sequence: CTA
gagctgtctggcttgcatta

SEQ ID NO: 63919 - DNA, 20 bp, Artificial Sequence
  Description of Artificial Sequence: Synthetic oligonucleotide
  Target: SCN10A; (+) strand; PAM type: YTN; PAM sequence: CTG
tctggcttgcattaggctat

SEQ ID NO: 63920 - DNA, 20 bp, Artificial Sequence
  Description of Artificial Sequence: Synthetic oligonucleotide
  Target: SCN10A; (+) strand; PAM type: YTN; PAM sequence: CTG
gcttgcattaggctatgata

SEQ ID NO: 63921 - DNA, 20 bp, Artificial Sequence
  Description of Artificial Sequence: Synthetic oligonucleotide
  Target: SCN10A; (+) strand; PAM type: YTN; PAM sequence: CTT
gcattaggctatgatacgag

SEQ ID NO: 63922 - DNA, 20 bp, Artificial Sequence
  Description of Artificial Sequence: Synthetic oligonucleotide
  Target: SCN10A; (+) strand; PAM type: YTN; PAM sequence: TTG
cattaggctatgatacgagt

SEQ ID NO: 63923 - DNA, 20 bp, Artificial Sequence
  Description of Artificial Sequence: Synthetic oligonucleotide
  Target: SCN10A; (+) strand; PAM type: YTN; PAM sequence: TTA
ggctatgatacgagtgagaa

SEQ ID NO: 63924 - DNA, 20 bp, Artificial Sequence
  Description of Artificial Sequence: Synthetic oligonucleotide
  Target: SCN10A; (+) strand; PAM type: YTN; PAM sequence: CTA
tgatacgagtgagaaataaa

SEQ ID NO: 63925 - DNA, 20 bp, Artificial Sequence
  Description of Artificial Sequence: Synthetic oligonucleotide
  Target: SCN10A; (+) strand; PAM type: YTN; PAM sequence: CTT
tattggggtcagttactcag

SEQ ID NO: 63926 - DNA, 20 bp, Artificial Sequence
  Description of Artificial Sequence: Synthetic oligonucleotide
  Target: SCN10A; (+) strand; PAM type: YTN; PAM sequence: TTT
attggggtcagttactcagt

SEQ ID NO: 63927 - DNA, 20 bp, Artificial Sequence
  Description of Artificial Sequence: Synthetic oligonucleotide
  Target: SCN10A; (+) strand; PAM type: YTN; PAM sequence: TTA
ttggggtcagttactcagtt

SEQ ID NO: 63928 - DNA, 20 bp, Artificial Sequence
  Description of Artificial Sequence: Synthetic oligonucleotide
  Target: SCN10A; (+) strand; PAM type: YTN; PAM sequence: TTG
gggtcagttactcagtttta

SEQ ID NO: 63929 - DNA, 20 bp, Artificial Sequence
  Description of Artificial Sequence: Synthetic oligonucleotide
  Target: SCN10A; (+) strand; PAM type: YTN; PAM sequence: TTA
ctcagttttagagattgtct

SEQ ID NO: 63930 - DNA, 20 bp, Artificial Sequence
  Description of Artificial Sequence: Synthetic oligonucleotide
  Target: SCN10A; (+) strand; PAM type: YTN; PAM sequence: CTC
agttttagagattgtctgta

SEQ ID NO: 63931 - DNA, 20 bp, Artificial Sequence
  Description of Artificial Sequence: Synthetic oligonucleotide
  Target: SCN10A; (+) strand; PAM type: YTN; PAM sequence: TTT
tagagattgtctgtataata

SEQ ID NO: 63932 - DNA, 20 bp, Artificial Sequence
  Description of Artificial Sequence: Synthetic oligonucleotide
  Target: SCN10A; (+) strand; PAM type: YTN; PAM sequence: TTT
agagattgtctgtataatag

SEQ ID NO: 63933 - DNA, 20 bp, Artificial Sequence
  Description of Artificial Sequence: Synthetic oligonucleotide
  Target: SCN10A; (+) strand; PAM type: YTN; PAM sequence: TTA
gagattgtctgtataatagg

SEQ ID NO: 63934 - DNA, 20 bp, Artificial Sequence
  Description of Artificial Sequence: Synthetic oligonucleotide
  Target: SCN10A; (+) strand; PAM type: YTN; PAM sequence: TTG
tctgtataataggtagcttt

SEQ ID NO: 63935 - DNA, 20 bp, Artificial Sequence
  Description of Artificial Sequence: Synthetic oligonucleotide
  Target: SCN10A; (+) strand; PAM type: YTN; PAM sequence: CTG
tataataggtagctttattt

SEQ ID NO: 63936 - DNA, 20 bp, Artificial Sequence
  Description of Artificial Sequence: Synthetic oligonucleotide
  Target: SCN10A; (+) strand; PAM type: YTN; PAM sequence: CTT
tatttttcattgattaataa

SEQ ID NO: 63937 - DNA, 20 bp, Artificial Sequence
  Description of Artificial Sequence: Synthetic oligonucleotide
  Target: SCN10A; (+) strand; PAM type: YTN; PAM sequence: TTT
atttttcattgattaataaa

SEQ ID NO: 63938 - DNA, 20 bp, Artificial Sequence
  Description of Artificial Sequence: Synthetic oligonucleotide
  Target: SCN10A; (+) strand; PAM type: YTN; PAM sequence: TTA
tttttcattgattaataaaa

SEQ ID NO: 63939 - DNA, 20 bp, Artificial Sequence
  Description of Artificial Sequence: Synthetic oligonucleotide
  Target: SCN10A; (+) strand; PAM type: YTN; PAM sequence: TTT
ttcattgattaataaaaatt

SEQ ID NO: 63940 - DNA, 20 bp, Artificial Sequence
  Description of Artificial Sequence: Synthetic oligonucleotide
  Target: SCN10A; (+) strand; PAM type: YTN; PAM sequence: TTT
tcattgattaataaaaattt

SEQ ID NO: 63941 - DNA, 20 bp, Artificial Sequence
  Description of Artificial Sequence: Synthetic oligonucleotide
  Target: SCN10A; (+) strand; PAM type: YTN; PAM sequence: TTT
cattgattaataaaaatttt

SEQ ID NO: 63942 - DNA, 20 bp, Artificial Sequence
  Description of Artificial Sequence: Synthetic oligonucleotide
  Target: SCN10A; (+) strand; PAM type: YTN; PAM sequence: TTC
attgattaataaaaattttt

SEQ ID NO: 63943 - DNA, 20 bp, Artificial Sequence
  Description of Artificial Sequence: Synthetic oligonucleotide
  Target: SCN10A; (+) strand; PAM type: YTN; PAM sequence: TTG
attaataaaaatttttataa

SEQ ID NO: 63944 - DNA, 20 bp, Artificial Sequence
  Description of Artificial Sequence: Synthetic oligonucleotide
  Target: SCN10A; (+) strand; PAM type: YTN; PAM sequence: TTA
ataaaaatttttataaacaa

SEQ ID NO: 63945 - DNA, 20 bp, Artificial Sequence
  Description of Artificial Sequence: Synthetic oligonucleotide
  Target: SCN10A; (+) strand; PAM type: YTN; PAM sequence: TTT
ttataaacaagataaaatta

SEQ ID NO: 63946 - DNA, 20 bp, Artificial Sequence
  Description of Artificial Sequence: Synthetic oligonucleotide
  Target: SCN10A; (+) strand; PAM type: YTN; PAM sequence: TTT
tataaacaagataaaattaa

SEQ ID NO: 63947 - DNA, 20 bp, Artificial Sequence
  Description of Artificial Sequence: Synthetic oligonucleotide
  Target: SCN10A; (+) strand; PAM type: YTN; PAM sequence: TTT
ataaacaagataaaattaaa

SEQ ID NO: 63948 - DNA, 20 bp, Artificial Sequence
  Description of Artificial Sequence: Synthetic oligonucleotide
  Target: SCN10A; (+) strand; PAM type: YTN; PAM sequence: TTA
taaacaagataaaattaaaa

SEQ ID NO: 63949 - DNA, 20 bp, Artificial Sequence
  Description of Artificial Sequence: Synthetic oligonucleotide
  Target: SCN10A; (+) strand; PAM type: YTN; PAM sequence: TTA
aaatacttatcattacaata

SEQ ID NO: 63950 - DNA, 20 bp, Artificial Sequence
  Description of Artificial Sequence: Synthetic oligonucleotide
  Target: SCN10A; (+) strand; PAM type: YTN; PAM sequence: CTT
atcattacaataaattggga

SEQ ID NO: 63951 - DNA, 20 bp, Artificial Sequence
  Description of Artificial Sequence: Synthetic oligonucleotide
  Target: SCN10A; (+) strand; PAM type: YTN; PAM sequence: TTA
tcattacaataaattgggaa

SEQ ID NO: 63952 - DNA, 20 bp, Artificial Sequence
  Description of Artificial Sequence: Synthetic oligonucleotide
  Target: SCN10A; (+) strand; PAM type: YTN; PAM sequence: TTA
caataaattgggaaaggata

SEQ ID NO: 63953 - DNA, 20 bp, Artificial Sequence
  Description of Artificial Sequence: Synthetic oligonucleotide
  Target: SCN10A; (+) strand; PAM type: YTN; PAM sequence: TTG
ggaaaggatatctggaatga

SEQ ID NO: 63954 - DNA, 20 bp, Artificial Sequence
  Description of Artificial Sequence: Synthetic oligonucleotide
  Target: SCN10A; (+) strand; PAM type: YTN; PAM sequence: CTG
gaatgaaaagttgtcttgga

SEQ ID NO: 63955 - DNA, 20 bp, Artificial Sequence
  Description of Artificial Sequence: Synthetic oligonucleotide
  Target: SCN10A; (+) strand; PAM type: YTN; PAM sequence: TTG
tcttggaggaaggttaaaga

SEQ ID NO: 63956 - DNA, 20 bp, Artificial Sequence
  Description of Artificial Sequence: Synthetic oligonucleotide
  Target: SCN10A; (+) strand; PAM type: YTN; PAM sequence: CTT
ggaggaaggttaaagatttt

SEQ ID NO: 63957 - DNA, 20 bp, Artificial Sequence
  Description of Artificial Sequence: Synthetic oligonucleotide
  Target: SCN10A; (+) strand; PAM type: YTN; PAM sequence: TTG
gaggaaggttaaagatttta

SEQ ID NO: 63958 - DNA, 20 bp, Artificial Sequence
  Description of Artificial Sequence: Synthetic oligonucleotide
  Target: SCN10A; (+) strand; PAM type: YTN; PAM sequence: TTA
aagattttagctaacttttg

SEQ ID NO: 63959 - DNA, 20 bp, Artificial Sequence
  Description of Artificial Sequence: Synthetic oligonucleotide
  Target: SCN10A; (+) strand; PAM type: YTN; PAM sequence: TTT
tagctaacttttggctttga

SEQ ID NO: 63960 - DNA, 20 bp, Artificial Sequence
  Description of Artificial Sequence: Synthetic oligonucleotide
  Target: SCN10A; (+) strand; PAM type: YTN; PAM sequence: TTT
agctaacttttggctttgat

SEQ ID NO: 63961 - DNA, 20 bp, Artificial Sequence
  Description of Artificial Sequence: Synthetic oligonucleotide
  Target: SCN10A; (+) strand; PAM type: YTN; PAM sequence: TTA
gctaacttttggctttgatt

SEQ ID NO: 63962 - DNA, 20 bp, Artificial Sequence
  Description of Artificial Sequence: Synthetic oligonucleotide
  Target: SCN10A; (+) strand; PAM type: YTN; PAM sequence: CTA
acttttggctttgattaagt

SEQ ID NO: 63963 - DNA, 20 bp, Artificial Sequence
  Description of Artificial Sequence: Synthetic oligonucleotide
  Target: SCN10A; (+) strand; PAM type: YTN; PAM sequence: CTT
ttggctttgattaagttaac

SEQ ID NO: 63964 - DNA, 20 bp, Artificial Sequence
  Description of Artificial Sequence: Synthetic oligonucleotide
  Target: SCN10A; (+) strand; PAM type: YTN; PAM sequence: TTT
tggctttgattaagttaact

SEQ ID NO: 63965 - DNA, 20 bp, Artificial Sequence
  Description of Artificial Sequence: Synthetic oligonucleotide
  Target: SCN10A; (+) strand; PAM type: YTN; PAM sequence: TTT
ggctttgattaagttaacta

SEQ ID NO: 63966 - DNA, 20 bp, Artificial Sequence
  Description of Artificial Sequence: Synthetic oligonucleotide
  Target: SCN10A; (+) strand; PAM type: YTN; PAM sequence: TTG
gctttgattaagttaactaa

SEQ ID NO: 63967 - DNA, 20 bp, Artificial Sequence
  Description of Artificial Sequence: Synthetic oligonucleotide
  Target: SCN10A; (+) strand; PAM type: YTN; PAM sequence: CTT
tgattaagttaactaatgga

SEQ ID NO: 63968 - DNA, 20 bp, Artificial Sequence
  Description of Artificial Sequence: Synthetic oligonucleotide
  Target: SCN10A; (+) strand; PAM type: YTN; PAM sequence: TTT
gattaagttaactaatggag

SEQ ID NO: 63969 - DNA, 20 bp, Artificial Sequence
  Description of Artificial Sequence: Synthetic oligonucleotide
  Target: SCN10A; (+) strand; PAM type: YTN; PAM sequence: TTG
attaagttaactaatggaga

SEQ ID NO: 63970 - DNA, 20 bp, Artificial Sequence
  Description of Artificial Sequence: Synthetic oligonucleotide
  Target: SCN10A; (+) strand; PAM type: YTN; PAM sequence: TTA
agttaactaatggagagtta

SEQ ID NO: 63971 - DNA, 20 bp, Artificial Sequence
  Description of Artificial Sequence: Synthetic oligonucleotide
  Target: SCN10A; (+) strand; PAM type: YTN; PAM sequence: TTA
actaatggagagttaattta

SEQ ID NO: 63972 - DNA, 20 bp, Artificial Sequence
  Description of Artificial Sequence: Synthetic oligonucleotide
  Target: SCN10A; (+) strand; PAM type: YTN; PAM sequence: CTA
atggagagttaatttatgct

SEQ ID NO: 63973 - DNA, 20 bp, Artificial Sequence
  Description of Artificial Sequence: Synthetic oligonucleotide
  Target: SCN10A; (+) strand; PAM type: YTN; PAM sequence: TTA
atttatgctgtaatttctgc

SEQ ID NO: 63974 - DNA, 20 bp, Artificial Sequence
  Description of Artificial Sequence: Synthetic oligonucleotide
  Target: SCN10A; (+) strand; PAM type: YTN; PAM sequence: TTT
atgctgtaatttctgcagcc

SEQ ID NO: 63975 - DNA, 20 bp, Artificial Sequence
  Description of Artificial Sequence: Synthetic oligonucleotide
  Target: SCN10A; (+) strand; PAM type: YTN; PAM sequence: TTA
tgctgtaatttctgcagcca

SEQ ID NO: 63976 - DNA, 20 bp, Artificial Sequence
  Description of Artificial Sequence: Synthetic oligonucleotide
  Target: SCN10A; (+) strand; PAM type: YTN; PAM sequence: CTG
taatttctgcagccacgacc

SEQ ID NO: 63977 - DNA, 20 bp, Artificial Sequence
  Description of Artificial Sequence: Synthetic oligonucleotide
  Target: SCN10A; (+) strand; PAM type: YTN; PAM sequence: TTT
ctgcagccacgacctcctgg

SEQ ID NO: 63978 - DNA, 20 bp, Artificial Sequence
  Description of Artificial Sequence: Synthetic oligonucleotide
  Target: SCN10A; (+) strand; PAM type: YTN; PAM sequence: TTC
tgcagccacgacctcctggg

SEQ ID NO: 63979 - DNA, 20 bp, Artificial Sequence
  Description of Artificial Sequence: Synthetic oligonucleotide
  Target: SCN10A; (+) strand; PAM type: YTN; PAM sequence: CTG
cagccacgacctcctgggct

SEQ ID NO: 63980 - DNA, 20 bp, Artificial Sequence
  Description of Artificial Sequence: Synthetic oligonucleotide
  Target: SCN10A; (+) strand; PAM type: YTN; PAM sequence: CTC
ctgggctcaagtcatcctcc

SEQ ID NO: 63981 - DNA, 20 bp, Artificial Sequence
  Description of Artificial Sequence: Synthetic oligonucleotide
  Target: SCN10A; (+) strand; PAM type: YTN; PAM sequence: CTG
ggctcaagtcatcctcccac

SEQ ID NO: 63982 - DNA, 20 bp, Artificial Sequence
  Description of Artificial Sequence: Synthetic oligonucleotide
  Target: SCN10A; (+) strand; PAM type: YTN; PAM sequence: CTC
aagtcatcctcccacctcag

SEQ ID NO: 63983 - DNA, 20 bp, Artificial Sequence
  Description of Artificial Sequence: Synthetic oligonucleotide
  Target: SCN10A; (+) strand; PAM type: YTN; PAM sequence: CTC
ccacctcagcctcccaaata

SEQ ID NO: 63984 - DNA, 20 bp, Artificial Sequence
  Description of Artificial Sequence: Synthetic oligonucleotide
  Target: SCN10A; (+) strand; PAM type: YTN; PAM sequence: CTC
agcctcccaaatagctgaga

SEQ ID NO: 63985 - DNA, 20 bp, Artificial Sequence
  Description of Artificial Sequence: Synthetic oligonucleotide
  Target: SCN10A; (+) strand; PAM type: YTN; PAM sequence: CTC
ccaaatagctgagactacag

SEQ ID NO: 63986 - DNA, 20 bp, Artificial Sequence
  Description of Artificial Sequence: Synthetic oligonucleotide
  Target: SCN10A; (+) strand; PAM type: YTN; PAM sequence: CTG
agactacagacacgtgccat

SEQ ID NO: 63987 - DNA, 20 bp, Artificial Sequence
  Description of Artificial Sequence: Synthetic oligonucleotide
  Target: SCN10A; (+) strand; PAM type: YTN; PAM sequence: CTA
cagacacgtgccatcatgcc

SEQ ID NO: 63988 - DNA, 20 bp, Artificial Sequence
  Description of Artificial Sequence: Synthetic oligonucleotide
  Target: SCN10A; (+) strand; PAM type: YTN; PAM sequence: CTA
atttctttccttttcttttt

SEQ ID NO: 63989 - DNA, 20 bp, Artificial Sequence
  Description of Artificial Sequence: Synthetic oligonucleotide
  Target: SCN10A; (+) strand; PAM type: YTN; PAM sequence: TTT
ctttccttttcttttttaaa

SEQ ID NO: 63990 - DNA, 20 bp, Artificial Sequence
  Description of Artificial Sequence: Synthetic oligonucleotide
  Target: SCN10A; (+) strand; PAM type: YTN; PAM sequence: TTC
tttccttttcttttttaaat

SEQ ID NO: 63991 - DNA, 20 bp, Artificial Sequence
  Description of Artificial Sequence: Synthetic oligonucleotide
  Target: SCN10A; (+) strand; PAM type: YTN; PAM sequence: CTT
tccttttcttttttaaattt

SEQ ID NO: 63992 - DNA, 20 bp, Artificial Sequence
  Description of Artificial Sequence: Synthetic oligonucleotide
  Target: SCN10A; (+) strand; PAM type: YTN; PAM sequence: TTT
ccttttcttttttaaattta

SEQ ID NO: 63993 - DNA, 20 bp, Artificial Sequence
  Description of Artificial Sequence: Synthetic oligonucleotide
  Target: SCN10A; (+) strand; PAM type: YTN; PAM sequence: TTC
cttttcttttttaaatttaa

SEQ ID NO: 63994 - DNA, 20 bp, Artificial Sequence
  Description of Artificial Sequence: Synthetic oligonucleotide
  Target: SCN10A; (+) strand; PAM type: YTN; PAM sequence: CTT
ttcttttttaaatttaaaat

SEQ ID NO: 63995 - DNA, 20 bp, Artificial Sequence
  Description of Artificial Sequence: Synthetic oligonucleotide
  Target: SCN10A; (+) strand; PAM type: YTN; PAM sequence: TTT
tcttttttaaatttaaaatt

SEQ ID NO: 63996 - DNA, 20 bp, Artificial Sequence
  Description of Artificial Sequence: Synthetic oligonucleotide
  Target: SCN10A; (+) strand; PAM type: YTN; PAM sequence: TTT
cttttttaaatttaaaattt

SEQ ID NO: 63997 - DNA, 20 bp, Artificial Sequence
  Description of Artificial Sequence: Synthetic oligonucleotide
  Target: SCN10A; (+) strand; PAM type: YTN; PAM sequence: TTC
ttttttaaatttaaaattta

SEQ ID NO: 63998 - DNA, 20 bp, Artificial Sequence
  Description of Artificial Sequence: Synthetic oligonucleotide
  Target: SCN10A; (+) strand; PAM type: YTN; PAM sequence: CTT
ttttaaatttaaaatttatt

SEQ ID NO: 63999 - DNA, 20 bp, Artificial Sequence
  Description of Artificial Sequence: Synthetic oligonucleotide
  Target: SCN10A; (+) strand; PAM type: YTN; PAM sequence: TTT
tttaaatttaaaatttattt

SEQ ID NO: 64000 - DNA, 20 bp, Artificial Sequence
  Description of Artificial Sequence: Synthetic oligonucleotide
  Target: SCN10A; (+) strand; PAM type: YTN; PAM sequence: TTT
ttaaatttaaaatttattta

SEQ ID NO: 64001 - DNA, 20 bp, Artificial Sequence
  Description of Artificial Sequence: Synthetic oligonucleotide
  Target: SCN10A; (+) strand; PAM type: YTN; PAM sequence: TTT
taaatttaaaatttatttat

SEQ ID NO: 64002 - DNA, 20 bp, Artificial Sequence
  Description of Artificial Sequence: Synthetic oligonucleotide
  Target: SCN10A; (+) strand; PAM type: YTN; PAM sequence: TTT
aaatttaaaatttatttatt

SEQ ID NO: 64003 - DNA, 20 bp, Artificial Sequence
  Description of Artificial Sequence: Synthetic oligonucleotide
  Target: SCN10A; (+) strand; PAM type: YTN; PAM sequence: TTA
aatttaaaatttatttattt

SEQ ID NO: 64004 - DNA, 20 bp, Artificial Sequence
  Description of Artificial Sequence: Synthetic oligonucleotide
  Target: SCN10A; (+) strand; PAM type: YTN; PAM sequence: TTT
aaaatttatttatttattta

SEQ ID NO: 64005 - DNA, 20 bp, Artificial Sequence
  Description of Artificial Sequence: Synthetic oligonucleotide
  Target: SCN10A; (+) strand; PAM type: YTN; PAM sequence: TTA
aaatttatttatttatttat

SEQ ID NO: 64006 - DNA, 20 bp, Artificial Sequence
  Description of Artificial Sequence: Synthetic oligonucleotide
  Target: SCN10A; (+) strand; PAM type: YTN; PAM sequence: TTT
atttatttatttatttattt

SEQ ID NO: 64007 - DNA, 20 bp, Artificial Sequence
  Description of Artificial Sequence: Synthetic oligonucleotide
  Target: SCN10A; (+) strand; PAM type: YTN; PAM sequence: TTA
tttatttatttatttatttt

SEQ ID NO: 64008 - DNA, 20 bp, Artificial Sequence
  Description of Artificial Sequence: Synthetic oligonucleotide
  Target: SCN10A; (+) strand; PAM type: YTN; PAM sequence: TTT
atttatttatttatttttga

SEQ ID NO: 64009 - DNA, 20 bp, Artificial Sequence
  Description of Artificial Sequence: Synthetic oligonucleotide
  Target: SCN10A; (+) strand; PAM type: YTN; PAM sequence: TTA
tttatttatttatttttgag

SEQ ID NO: 64010 - DNA, 20 bp, Artificial Sequence
  Description of Artificial Sequence: Synthetic oligonucleotide
  Target: SCN10A; (+) strand; PAM type: YTN; PAM sequence: TTT
atttatttatttttgagatg

SEQ ID NO: 64011 - DNA, 20 bp, Artificial Sequence
  Description of Artificial Sequence: Synthetic oligonucleotide
  Target: SCN10A; (+) strand; PAM type: YTN; PAM sequence: TTA
tttatttatttttgagatgg

SEQ ID NO: 64012 - DNA, 20 bp, Artificial Sequence
  Description of Artificial Sequence: Synthetic oligonucleotide
  Target: SCN10A; (+) strand; PAM type: YTN; PAM sequence: TTT
atttatttttgagatggagt

SEQ ID NO: 64013 - DNA, 20 bp, Artificial Sequence
  Description of Artificial Sequence: Synthetic oligonucleotide
  Target: SCN10A; (+) strand; PAM type: YTN; PAM sequence: TTA
tttatttttgagatggagtt

SEQ ID NO: 64014 - DNA, 20 bp, Artificial Sequence
  Description of Artificial Sequence: Synthetic oligonucleotide
  Target: SCN10A; (+) strand; PAM type: YTN; PAM sequence: TTT
atttttgagatggagttttg

SEQ ID NO: 64015 - DNA, 20 bp, Artificial Sequence
  Description of Artificial Sequence: Synthetic oligonucleotide
  Target: SCN10A; (+) strand; PAM type: YTN; PAM sequence: TTA
tttttgagatggagttttgc

SEQ ID NO: 64016 - DNA, 20 bp, Artificial Sequence
  Description of Artificial Sequence: Synthetic oligonucleotide
  Target: SCN10A; (+) strand; PAM type: YTN; PAM sequence: TTT
ttgagatggagttttgccct

SEQ ID NO: 64017 - DNA, 20 bp, Artificial Sequence
  Description of Artificial Sequence: Synthetic oligonucleotide
  Target: SCN10A; (+) strand; PAM type: YTN; PAM sequence: TTT
tgagatggagttttgccctt

SEQ ID NO: 64018 - DNA, 20 bp, Artificial Sequence
  Description of Artificial Sequence: Synthetic oligonucleotide
  Target: SCN10A; (+) strand; PAM type: YTN; PAM sequence: TTT
gagatggagttttgcccttg

SEQ ID NO: 64019 - DNA, 20 bp, Artificial Sequence
  Description of Artificial Sequence: Synthetic oligonucleotide
  Target: SCN10A; (+) strand; PAM type: YTN; PAM sequence: TTG
agatggagttttgcccttgt

SEQ ID NO: 64020 - DNA, 20 bp, Artificial Sequence
  Description of Artificial Sequence: Synthetic oligonucleotide
  Target: SCN10A; (+) strand; PAM type: YTN; PAM sequence: TTT
tgcccttgttgcccaggctg

SEQ ID NO: 64021 - DNA, 20 bp, Artificial Sequence
  Description of Artificial Sequence: Synthetic oligonucleotide
  Target: SCN10A; (+) strand; PAM type: YTN; PAM sequence: TTT
gcccttgttgcccaggctgg

SEQ ID NO: 64022 - DNA, 20 bp, Artificial Sequence
  Description of Artificial Sequence: Synthetic oligonucleotide
  Target: SCN10A; (+) strand; PAM type: YTN; PAM sequence: TTG
cccttgttgcccaggctgga

SEQ ID NO: 64023 - DNA, 20 bp, Artificial Sequence
  Description of Artificial Sequence: Synthetic oligonucleotide
  Target: SCN10A; (+) strand; PAM type: YTN; PAM sequence: CTT
gttgcccaggctggagtgca

SEQ ID NO: 64024 - DNA, 20 bp, Artificial Sequence
  Description of Artificial Sequence: Synthetic oligonucleotide
  Target: SCN10A; (+) strand; PAM type: YTN; PAM sequence: TTG
ttgcccaggctggagtgcaa

SEQ ID NO: 64025 - DNA, 20 bp, Artificial Sequence
  Description of Artificial Sequence: Synthetic oligonucleotide
  Target: SCN10A; (+) strand; PAM type: YTN; PAM sequence: TTG
cccaggctggagtgcaatgg

SEQ ID NO: 64026 - DNA, 20 bp, Artificial Sequence
  Description of Artificial Sequence: Synthetic oligonucleotide
  Target: SCN10A; (+) strand; PAM type: YTN; PAM sequence: CTG
gagtgcaatggtgcaatctc

SEQ ID NO: 64027 - DNA, 20 bp, Artificial Sequence
  Description of Artificial Sequence: Synthetic oligonucleotide
  Target: SCN10A; (+) strand; PAM type: YTN; PAM sequence: CTC
agctcaccgcaacctccgcc

SEQ ID NO: 64028 - DNA, 20 bp, Artificial Sequence
  Description of Artificial Sequence: Synthetic oligonucleotide
  Target: SCN10A; (+) strand; PAM type: YTN; PAM sequence: CTC
accgcaacctccgcctcccg

SEQ ID NO: 64029 - DNA, 20 bp, Artificial Sequence
  Description of Artificial Sequence: Synthetic oligonucleotide
  Target: SCN10A; (+) strand; PAM type: YTN; PAM sequence: CTC
cgcctcccgggttcaagcaa

SEQ ID NO: 64030 - DNA, 20 bp, Artificial Sequence
  Description of Artificial Sequence: Synthetic oligonucleotide
  Target: SCN10A; (+) strand; PAM type: YTN; PAM sequence: CTC
ccgggttcaagcaattctcc

SEQ ID NO: 64031 - DNA, 20 bp, Artificial Sequence
  Description of Artificial Sequence: Synthetic oligonucleotide
  Target: SCN10A; (+) strand; PAM type: YTN; PAM sequence: TTC
aagcaattctcctccctcag

SEQ ID NO: 64032 - DNA, 20 bp, Artificial Sequence
  Description of Artificial Sequence: Synthetic oligonucleotide
  Target: SCN10A; (+) strand; PAM type: YTN; PAM sequence: TTC
tcctccctcagcctcccaag

SEQ ID NO: 64033 - DNA, 20 bp, Artificial Sequence
  Description of Artificial Sequence: Synthetic oligonucleotide
  Target: SCN10A; (+) strand; PAM type: YTN; PAM sequence: CTC
ctccctcagcctcccaagta

SEQ ID NO: 64034 - DNA, 20 bp, Artificial Sequence
  Description of Artificial Sequence: Synthetic oligonucleotide
  Target: SCN10A; (+) strand; PAM type: YTN; PAM sequence: CTC
cctcagcctcccaagtagct

SEQ ID NO: 64035 - DNA, 20 bp, Artificial Sequence
  Description of Artificial Sequence: Synthetic oligonucleotide
  Target: SCN10A; (+) strand; PAM type: YTN; PAM sequence: CTC
agcctcccaagtagctggga

SEQ ID NO: 64036 - DNA, 20 bp, Artificial Sequence
  Description of Artificial Sequence: Synthetic oligonucleotide
  Target: SCN10A; (+) strand; PAM type: YTN; PAM sequence: CTC
ccaagtagctgggattaaaa

SEQ ID NO: 64037 - DNA, 20 bp, Artificial Sequence
  Description of Artificial Sequence: Synthetic oligonucleotide
  Target: SCN10A; (+) strand; PAM type: YTN; PAM sequence: CTG
ggattaaaagtatgcaccat

SEQ ID NO: 64038 - DNA, 20 bp, Artificial Sequence
  Description of Artificial Sequence: Synthetic oligonucleotide
  Target: SCN10A; (+) strand; PAM type: YTN; PAM sequence: TTA
aaagtatgcaccatcacacc

SEQ ID NO: 64039 - DNA, 20 bp, Artificial Sequence
  Description of Artificial Sequence: Synthetic oligonucleotide
  Target: SCN10A; (+) strand; PAM type: YTN; PAM sequence: CTG
gctaattttgtatttttggt

SEQ ID NO: 64040 - DNA, 20 bp, Artificial Sequence
  Description of Artificial Sequence: Synthetic oligonucleotide
  Target: SCN10A; (+) strand; PAM type: YTN; PAM sequence: CTA
attttgtatttttggtagag

SEQ ID NO: 64041 - DNA, 20 bp, Artificial Sequence
  Description of Artificial Sequence: Synthetic oligonucleotide
  Target: SCN10A; (+) strand; PAM type: YTN; PAM sequence: TTT
tgtatttttggtagagatgg

SEQ ID NO: 64042 - DNA, 20 bp, Artificial Sequence
  Description of Artificial Sequence: Synthetic oligonucleotide
  Target: SCN10A; (+) strand; PAM type: YTN; PAM sequence: TTT
gtatttttggtagagatggg

SEQ ID NO: 64043 - DNA, 20 bp, Artificial Sequence
  Description of Artificial Sequence: Synthetic oligonucleotide
  Target: SCN10A; (+) strand; PAM type: YTN; PAM sequence: TTG
tatttttggtagagatgggt

SEQ ID NO: 64044 - DNA, 20 bp, Artificial Sequence
  Description of Artificial Sequence: Synthetic oligonucleotide
  Target: SCN10A; (+) strand; PAM type: YTN; PAM sequence: TTT
ttggtagagatgggtcttct

SEQ ID NO: 64045 - DNA, 20 bp, Artificial Sequence
  Description of Artificial Sequence: Synthetic oligonucleotide
  Target: SCN10A; (+) strand; PAM type: YTN; PAM sequence: TTT
tggtagagatgggtcttctc

SEQ ID NO: 64046 - DNA, 20 bp, Artificial Sequence
  Description of Artificial Sequence: Synthetic oligonucleotide
  Target: SCN10A; (+) strand; PAM type: YTN; PAM sequence: TTT
ggtagagatgggtcttctcc

SEQ ID NO: 64047 - DNA, 20 bp, Artificial Sequence
  Description of Artificial Sequence: Synthetic oligonucleotide
  Target: SCN10A; (+) strand; PAM type: YTN; PAM sequence: TTG
gtagagatgggtcttctcca

SEQ ID NO: 64048 - DNA, 20 bp, Artificial Sequence
  Description of Artificial Sequence: Synthetic oligonucleotide
  Target: SCN10A; (+) strand; PAM type: YTN; PAM sequence: CTT
ctccatgttggtcaggctgg

SEQ ID NO: 64049 - DNA, 20 bp, Artificial Sequence
  Description of Artificial Sequence: Synthetic oligonucleotide
  Target: SCN10A; (+) strand; PAM type: YTN; PAM sequence: TTC
tccatgttggtcaggctggt

SEQ ID NO: 64050 - DNA, 20 bp, Artificial Sequence
  Description of Artificial Sequence: Synthetic oligonucleotide
  Target: SCN10A; (+) strand; PAM type: YTN; PAM sequence: CTC
catgttggtcaggctggtct

SEQ ID NO: 64051 - DNA, 20 bp, Artificial Sequence
  Description of Artificial Sequence: Synthetic oligonucleotide
  Target: SCN10A; (+) strand; PAM type: YTN; PAM sequence: TTG
gtcaggctggtctcgaactc

SEQ ID NO: 64052 - DNA, 20 bp, Artificial Sequence
  Description of Artificial Sequence: Synthetic oligonucleotide
  Target: SCN10A; (+) strand; PAM type: YTN; PAM sequence: CTG
gtctcgaactcccgacctca

SEQ ID NO: 64053 - DNA, 20 bp, Artificial Sequence
  Description of Artificial Sequence: Synthetic oligonucleotide
  Target: SCN10A; (+) strand; PAM type: YTN; PAM sequence: CTC
gaactcccgacctcaggtga

SEQ ID NO: 64054 - DNA, 20 bp, Artificial Sequence
  Description of Artificial Sequence: Synthetic oligonucleotide
  Target: SCN10A; (+) strand; PAM type: YTN; PAM sequence: CTC
ccgacctcaggtgatccgcc

SEQ ID NO: 64055 - DNA, 20 bp, Artificial Sequence
  Description of Artificial Sequence: Synthetic oligonucleotide
  Target: SCN10A; (+) strand; PAM type: YTN; PAM sequence: CTC
aggtgatccgcctgcctgcg

SEQ ID NO: 64056 - DNA, 20 bp, Artificial Sequence
  Description of Artificial Sequence: Synthetic oligonucleotide
  Target: SCN10A; (+) strand; PAM type: YTN; PAM sequence: CTG
cctgcgcctccaacagtgct

SEQ ID NO: 64057 - DNA, 20 bp, Artificial Sequence
  Description of Artificial Sequence: Synthetic oligonucleotide
  Target: SCN10A; (+) strand; PAM type: YTN; PAM sequence: CTG
cgcctccaacagtgctggga

SEQ ID NO: 64058 - DNA, 20 bp, Artificial Sequence
  Description of Artificial Sequence: Synthetic oligonucleotide
  Target: SCN10A; (+) strand; PAM type: YTN; PAM sequence: CTC
caacagtgctgggattacag

SEQ ID NO: 64059 - DNA, 20 bp, Artificial Sequence
  Description of Artificial Sequence: Synthetic oligonucleotide
  Target: SCN10A; (+) strand; PAM type: YTN; PAM sequence: CTG
ggattacaggcattaaccac

SEQ ID NO: 64060 - DNA, 20 bp, Artificial Sequence
  Description of Artificial Sequence: Synthetic oligonucleotide
  Target: SCN10A; (+) strand; PAM type: YTN; PAM sequence: TTA
caggcattaaccactgcccc

SEQ ID NO: 64061 - DNA, 20 bp, Artificial Sequence
  Description of Artificial Sequence: Synthetic oligonucleotide
  Target: SCN10A; (+) strand; PAM type: YTN; PAM sequence: TTA
accactgcccctggccttct

SEQ ID NO: 64062 - DNA, 20 bp, Artificial Sequence
  Description of Artificial Sequence: Synthetic oligonucleotide
  Target: SCN10A; (+) strand; PAM type: YTN; PAM sequence: CTG
cccctggccttctttttatt

SEQ ID NO: 64063 - DNA, 20 bp, Artificial Sequence
  Description of Artificial Sequence: Synthetic oligonucleotide
  Target: SCN10A; (+) strand; PAM type: YTN; PAM sequence: CTG
gccttctttttattgttttc

SEQ ID NO: 64064 - DNA, 20 bp, Artificial Sequence
  Description of Artificial Sequence: Synthetic oligonucleotide
  Target: SCN10A; (+) strand; PAM type: YTN; PAM sequence: CTT
ctttttattgttttcaatga

SEQ ID NO: 64065 - DNA, 20 bp, Artificial Sequence
  Description of Artificial Sequence: Synthetic oligonucleotide
  Target: SCN10A; (+) strand; PAM type: YTN; PAM sequence: TTC
tttttattgttttcaatgag

SEQ ID NO: 64066 - DNA, 20 bp, Artificial Sequence
  Description of Artificial Sequence: Synthetic oligonucleotide
  Target: SCN10A; (+) strand; PAM type: YTN; PAM sequence: CTT
tttattgttttcaatgagac

SEQ ID NO: 64067 - DNA, 20 bp, Artificial Sequence
  Description of Artificial Sequence: Synthetic oligonucleotide
  Target: SCN10A; (+) strand; PAM type: YTN; PAM sequence: TTT
ttattgttttcaatgagacg

SEQ ID NO: 64068 - DNA, 20 bp, Artificial Sequence
  Description of Artificial Sequence: Synthetic oligonucleotide
  Target: SCN10A; (+) strand; PAM type: YTN; PAM sequence: TTT
tattgttttcaatgagacgg

SEQ ID NO: 64069 - DNA, 20 bp, Artificial Sequence
  Description of Artificial Sequence: Synthetic oligonucleotide
  Target: SCN10A; (+) strand; PAM type: YTN; PAM sequence: TTT
attgttttcaatgagacgga

SEQ ID NO: 64070 - DNA, 20 bp, Artificial Sequence
  Description of Artificial Sequence: Synthetic oligonucleotide
  Target: SCN10A; (+) strand; PAM type: YTN; PAM sequence: TTA
ttgttttcaatgagacggag

SEQ ID NO: 64071 - DNA, 20 bp, Artificial Sequence
  Description of Artificial Sequence: Synthetic oligonucleotide
  Target: SCN10A; (+) strand; PAM type: YTN; PAM sequence: TTG
ttttcaatgagacggagtct

SEQ ID NO: 64072 - DNA, 20 bp, Artificial Sequence
  Description of Artificial Sequence: Synthetic oligonucleotide
  Target: SCN10A; (+) strand; PAM type: YTN; PAM sequence: TTT
tcaatgagacggagtctcgc

SEQ ID NO: 64073 - DNA, 20 bp, Artificial Sequence
  Description of Artificial Sequence: Synthetic oligonucleotide
  Target: SCN10A; (+) strand; PAM type: YTN; PAM sequence: TTT
caatgagacggagtctcgct

SEQ ID NO: 64074 - DNA, 20 bp, Artificial Sequence
  Description of Artificial Sequence: Synthetic oligonucleotide
  Target: SCN10A; (+) strand; PAM type: YTN; PAM sequence: TTC
aatgagacggagtctcgctc

SEQ ID NO: 64075 - DNA, 20 bp, Artificial Sequence
  Description of Artificial Sequence: Synthetic oligonucleotide
  Target: SCN10A; (+) strand; PAM type: YTN; PAM sequence: CTC
gctctgttgcccaggctgga

SEQ ID NO: 64076 - DNA, 20 bp, Artificial Sequence
  Description of Artificial Sequence: Synthetic oligonucleotide
  Target: SCN10A; (+) strand; PAM type: YTN; PAM sequence: CTC
tgttgcccaggctggagtgc

SEQ ID NO: 64077 - DNA, 20 bp, Artificial Sequence
  Description of Artificial Sequence: Synthetic oligonucleotide
  Target: SCN10A; (+) strand; PAM type: YTN; PAM sequence: CTG
ttgcccaggctggagtgcag

SEQ ID NO: 64078 - DNA, 20 bp, Artificial Sequence
  Description of Artificial Sequence: Synthetic oligonucleotide
  Target: SCN10A; (+) strand; PAM type: YTN; PAM sequence: TTG
cccaggctggagtgcagtgg

SEQ ID NO: 64079 - DNA, 20 bp, Artificial Sequence
  Description of Artificial Sequence: Synthetic oligonucleotide
  Target: SCN10A; (+) strand; PAM type: YTN; PAM sequence: CTG
gagtgcagtggcatgatctc

SEQ ID NO: 64080 - DNA, 20 bp, Artificial Sequence
  Description of Artificial Sequence: Synthetic oligonucleotide
  Target: SCN10A; (+) strand; PAM type: YTN; PAM sequence: CTC
agctcactgcaacctctgtc

SEQ ID NO: 64081 - DNA, 20 bp, Artificial Sequence
  Description of Artificial Sequence: Synthetic oligonucleotide
  Target: SCN10A; (+) strand; PAM type: YTN; PAM sequence: CTC
actgcaacctctgtctctgg

SEQ ID NO: 64082 - DNA, 20 bp, Artificial Sequence
  Description of Artificial Sequence: Synthetic oligonucleotide
  Target: SCN10A; (+) strand; PAM type: YTN; PAM sequence: CTG
caacctctgtctctgggatt

SEQ ID NO: 64083 - DNA, 20 bp, Artificial Sequence
  Description of Artificial Sequence: Synthetic oligonucleotide
  Target: SCN10A; (+) strand; PAM type: YTN; PAM sequence: CTC
tgtctctgggattcaagcaa

SEQ ID NO: 64084 - DNA, 20 bp, Artificial Sequence
  Description of Artificial Sequence: Synthetic oligonucleotide
  Target: SCN10A; (+) strand; PAM type: YTN; PAM sequence: CTG
tctctgggattcaagcaatt

SEQ ID NO: 64085 - DNA, 20 bp, Artificial Sequence
  Description of Artificial Sequence: Synthetic oligonucleotide
  Target: SCN10A; (+) strand; PAM type: YTN; PAM sequence: CTC
tgggattcaagcaattctca

SEQ ID NO: 64086 - DNA, 20 bp, Artificial Sequence
  Description of Artificial Sequence: Synthetic oligonucleotide
  Target: SCN10A; (+) strand; PAM type: YTN; PAM sequence: CTG
ggattcaagcaattctcatg

SEQ ID NO: 64087 - DNA, 20 bp, Artificial Sequence
  Description of Artificial Sequence: Synthetic oligonucleotide
  Target: SCN10A; (+) strand; PAM type: YTN; PAM sequence: TTC
aagcaattctcatgcctcac

SEQ ID NO: 64088 - DNA, 20 bp, Artificial Sequence
  Description of Artificial Sequence: Synthetic oligonucleotide
  Target: SCN10A; (+) strand; PAM type: YTN; PAM sequence: TTC
tcatgcctcaccctcctgag

SEQ ID NO: 64089 - DNA, 20 bp, Artificial Sequence
  Description of Artificial Sequence: Synthetic oligonucleotide
  Target: SCN10A; (+) strand; PAM type: YTN; PAM sequence: CTC
atgcctcaccctcctgagta

SEQ ID NO: 64090 - DNA, 20 bp, Artificial Sequence
  Description of Artificial Sequence: Synthetic oligonucleotide
  Target: SCN10A; (+) strand; PAM type: YTN; PAM sequence: CTC
accctcctgagtagctggga

SEQ ID NO: 64091 - DNA, 20 bp, Artificial Sequence
  Description of Artificial Sequence: Synthetic oligonucleotide
  Target: SCN10A; (+) strand; PAM type: YTN; PAM sequence: CTC
ctgagtagctgggattacag

SEQ ID NO: 64092 - DNA, 20 bp, Artificial Sequence
  Description of Artificial Sequence: Synthetic oligonucleotide
  Target: SCN10A; (+) strand; PAM type: YTN; PAM sequence: CTG
agtagctgggattacaggtg

SEQ ID NO: 64093 - DNA, 20 bp, Artificial Sequence
  Description of Artificial Sequence: Synthetic oligonucleotide
  Target: SCN10A; (+) strand; PAM type: YTN; PAM sequence: CTG
ggattacaggtgtgtgccac

SEQ ID NO: 64094 - DNA, 20 bp, Artificial Sequence
  Description of Artificial Sequence: Synthetic oligonucleotide
  Target: SCN10A; (+) strand; PAM type: YTN; PAM sequence: TTA
caggtgtgtgccaccacacc

SEQ ID NO: 64095 - DNA, 20 bp, Artificial Sequence
  Description of Artificial Sequence: Synthetic oligonucleotide
  Target: SCN10A; (+) strand; PAM type: YTN; PAM sequence: CTA
atttatatatttttagtaga

SEQ ID NO: 64096 - DNA, 20 bp, Artificial Sequence
  Description of Artificial Sequence: Synthetic oligonucleotide
  Target: SCN10A; (+) strand; PAM type: YTN; PAM sequence: TTT
atatatttttagtagagatg

SEQ ID NO: 64097 - DNA, 20 bp, Artificial Sequence
  Description of Artificial Sequence: Synthetic oligonucleotide
  Target: SCN10A; (+) strand; PAM type: YTN; PAM sequence: TTA
tatatttttagtagagatgg

SEQ ID NO: 64098 - DNA, 20 bp, Artificial Sequence
  Description of Artificial Sequence: Synthetic oligonucleotide
  Target: SCN10A; (+) strand; PAM type: YTN; PAM sequence: TTT
ttagtagagatggggttttc

SEQ ID NO: 64099 - DNA, 20 bp, Artificial Sequence
  Description of Artificial Sequence: Synthetic oligonucleotide
  Target: SCN10A; (+) strand; PAM type: YTN; PAM sequence: TTT
tagtagagatggggttttct

SEQ ID NO: 64100 - DNA, 20 bp, Artificial Sequence
  Description of Artificial Sequence: Synthetic oligonucleotide
  Target: SCN10A; (+) strand; PAM type: YTN; PAM sequence: TTT
agtagagatggggttttctc

SEQ ID NO: 64101 - DNA, 20 bp, Artificial Sequence
  Description of Artificial Sequence: Synthetic oligonucleotide
  Target: SCN10A; (+) strand; PAM type: YTN; PAM sequence: TTA
gtagagatggggttttctcc

SEQ ID NO: 64102 - DNA, 20 bp, Artificial Sequence
  Description of Artificial Sequence: Synthetic oligonucleotide
  Target: SCN10A; (+) strand; PAM type: YTN; PAM sequence: TTT
tctcctgttggccaggctgg

SEQ ID NO: 64103 - DNA, 20 bp, Artificial Sequence
  Description of Artificial Sequence: Synthetic oligonucleotide
  Target: SCN10A; (+) strand; PAM type: YTN; PAM sequence: TTT
ctcctgttggccaggctggt

SEQ ID NO: 64104 - DNA, 20 bp, Artificial Sequence
  Description of Artificial Sequence: Synthetic oligonucleotide
  Target: SCN10A; (+) strand; PAM type: YTN; PAM sequence: TTC
tcctgttggccaggctggtc

SEQ ID NO: 64105 - DNA, 20 bp, Artificial Sequence
  Description of Artificial Sequence: Synthetic oligonucleotide
  Target: SCN10A; (+) strand; PAM type: YTN; PAM sequence: CTC
ctgttggccaggctggtctc

SEQ ID NO: 64106 - DNA, 20 bp, Artificial Sequence
  Description of Artificial Sequence: Synthetic oligonucleotide
  Target: SCN10A; (+) strand; PAM type: YTN; PAM sequence: CTG
ttggccaggctggtctccaa

SEQ ID NO: 64107 - DNA, 20 bp, Artificial Sequence
  Description of Artificial Sequence: Synthetic oligonucleotide
  Target: SCN10A; (+) strand; PAM type: YTN; PAM sequence: TTG
gccaggctggtctccaactc

SEQ ID NO: 64108 - DNA, 20 bp, Artificial Sequence
  Description of Artificial Sequence: Synthetic oligonucleotide
  Target: SCN10A; (+) strand; PAM type: YTN; PAM sequence: CTG
gtctccaactcctgtcctca

SEQ ID NO: 64109 - DNA, 20 bp, Artificial Sequence
  Description of Artificial Sequence: Synthetic oligonucleotide
  Target: SCN10A; (+) strand; PAM type: YTN; PAM sequence: CTC
caactcctgtcctcaagcaa

SEQ ID NO: 64110 - DNA, 20 bp, Artificial Sequence
  Description of Artificial Sequence: Synthetic oligonucleotide
  Target: SCN10A; (+) strand; PAM type: YTN; PAM sequence: CTC
ctgtcctcaagcaatcctcc

SEQ ID NO: 64111 - DNA, 20 bp, Artificial Sequence
  Description of Artificial Sequence: Synthetic oligonucleotide
  Target: SCN10A; (+) strand; PAM type: YTN; PAM sequence: CTG
tcctcaagcaatcctcccac

SEQ ID NO: 64112 - DNA, 20 bp, Artificial Sequence
  Description of Artificial Sequence: Synthetic oligonucleotide
  Target: SCN10A; (+) strand; PAM type: YTN; PAM sequence: CTC
aagcaatcctcccaccttgg

SEQ ID NO: 64113 - DNA, 20 bp, Artificial Sequence
  Description of Artificial Sequence: Synthetic oligonucleotide
  Target: SCN10A; (+) strand; PAM type: YTN; PAM sequence: CTC
ccaccttggcctcccaaaat

SEQ ID NO: 64114 - DNA, 20 bp, Artificial Sequence
  Description of Artificial Sequence: Synthetic oligonucleotide
  Target: SCN10A; (+) strand; PAM type: YTN; PAM sequence: CTT
ggcctcccaaaattctggga

SEQ ID NO: 64115 - DNA, 20 bp, Artificial Sequence
  Description of Artificial Sequence: Synthetic oligonucleotide
  Target: SCN10A; (+) strand; PAM type: YTN; PAM sequence: TTG
gcctcccaaaattctgggat

SEQ ID NO: 64116 - DNA, 20 bp, Artificial Sequence
  Description of Artificial Sequence: Synthetic oligonucleotide
  Target: SCN10A; (+) strand; PAM type: YTN; PAM sequence: CTC
ccaaaattctgggattacag

SEQ ID NO: 64117 - DNA, 20 bp, Artificial Sequence
  Description of Artificial Sequence: Synthetic oligonucleotide
  Target: SCN10A; (+) strand; PAM type: YTN; PAM sequence: TTC
tgggattacaggcgtgagcc

SEQ ID NO: 64118 - DNA, 20 bp, Artificial Sequence
  Description of Artificial Sequence: Synthetic oligonucleotide
  Target: SCN10A; (+) strand; PAM type: YTN; PAM sequence: CTG
ggattacaggcgtgagccac

SEQ ID NO: 64119 - DNA, 20 bp, Artificial Sequence
  Description of Artificial Sequence: Synthetic oligonucleotide
  Target: SCN10A; (+) strand; PAM type: YTN; PAM sequence: TTA
caggcgtgagccaccccacc

SEQ ID NO: 64120 - DNA, 20 bp, Artificial Sequence
  Description of Artificial Sequence: Synthetic oligonucleotide
  Target: SCN10A; (+) strand; PAM type: YTN; PAM sequence: CTG
gcccccttggctttaaaaaa

SEQ ID NO: 64121 - DNA, 20 bp, Artificial Sequence
  Description of Artificial Sequence: Synthetic oligonucleotide
  Target: SCN10A; (+) strand; PAM type: YTN; PAM sequence: CTT
ggctttaaaaaaaaaatggc

SEQ ID NO: 64122 - DNA, 20 bp, Artificial Sequence
  Description of Artificial Sequence: Synthetic oligonucleotide
  Target: SCN10A; (+) strand; PAM type: YTN; PAM sequence: TTG
gctttaaaaaaaaaatggca

SEQ ID NO: 64123 - DNA, 20 bp, Artificial Sequence
  Description of Artificial Sequence: Synthetic oligonucleotide
  Target: SCN10A; (+) strand; PAM type: YTN; PAM sequence: CTT
taaaaaaaaaatggcataat

SEQ ID NO: 64124 - DNA, 20 bp, Artificial Sequence
  Description of Artificial Sequence: Synthetic oligonucleotide
  Target: SCN10A; (+) strand; PAM type: YTN; PAM sequence: TTT
aaaaaaaaaatggcataatc

SEQ ID NO: 64125 - DNA, 20 bp, Artificial Sequence
  Description of Artificial Sequence: Synthetic oligonucleotide
  Target: SCN10A; (+) strand; PAM type: YTN; PAM sequence: TTA
aaaaaaaaatggcataatct

SEQ ID NO: 64126 - DNA, 20 bp, Artificial Sequence
  Description of Artificial Sequence: Synthetic oligonucleotide
  Target: SCN10A; (+) strand; PAM type: YTN; PAM sequence: CTT
ggaaccttgataccaaaacc

SEQ ID NO: 64127 - DNA, 20 bp, Artificial Sequence
  Description of Artificial Sequence: Synthetic oligonucleotide
  Target: SCN10A; (+) strand; PAM type: YTN; PAM sequence: TTG
gaaccttgataccaaaacct

SEQ ID NO: 64128 - DNA, 20 bp, Artificial Sequence
  Description of Artificial Sequence: Synthetic oligonucleotide
  Target: SCN10A; (+) strand; PAM type: YTN; PAM sequence: CTT
gataccaaaacctggcaagg

SEQ ID NO: 64129 - DNA, 20 bp, Artificial Sequence
  Description of Artificial Sequence: Synthetic oligonucleotide
  Target: SCN10A; (+) strand; PAM type: YTN; PAM sequence: TTG
ataccaaaacctggcaagga

SEQ ID NO: 64130 - DNA, 20 bp, Artificial Sequence
  Description of Artificial Sequence: Synthetic oligonucleotide
  Target: SCN10A; (+) strand; PAM type: YTN; PAM sequence: CTG
gcaaggacaatgaaagtcag

SEQ ID NO: 64131 - DNA, 20 bp, Artificial Sequence
  Description of Artificial Sequence: Synthetic oligonucleotide
  Target: SCN10A; (+) strand; PAM type: YTN; PAM sequence: TTA
tagatcaaatattactcatt

SEQ ID NO: 64132 - DNA, 20 bp, Artificial Sequence
  Description of Artificial Sequence: Synthetic oligonucleotide
  Target: SCN10A; (+) strand; PAM type: YTN; PAM sequence: TTA
ctcattgatatggataaaaa

SEQ ID NO: 64133 - DNA, 20 bp, Artificial Sequence
  Description of Artificial Sequence: Synthetic oligonucleotide
  Target: SCN10A; (+) strand; PAM type: YTN; PAM sequence: CTC
attgatatggataaaaaaat

SEQ ID NO: 64134 - DNA, 20 bp, Artificial Sequence
  Description of Artificial Sequence: Synthetic oligonucleotide
  Target: SCN10A; (+) strand; PAM type: YTN; PAM sequence: TTG
atatggataaaaaaatctta

SEQ ID NO: 64135 - DNA, 20 bp, Artificial Sequence
  Description of Artificial Sequence: Synthetic oligonucleotide
  Target: SCN10A; (+) strand; PAM type: YTN; PAM sequence: CTT
aagcaaatttttagcaaact

SEQ ID NO: 64136 - DNA, 20 bp, Artificial Sequence
  Description of Artificial Sequence: Synthetic oligonucleotide
  Target: SCN10A; (+) strand; PAM type: YTN; PAM sequence: TTA
agcaaatttttagcaaacta

SEQ ID NO: 64137 - DNA, 20 bp, Artificial Sequence
  Description of Artificial Sequence: Synthetic oligonucleotide
  Target: SCN10A; (+) strand; PAM type: YTN; PAM sequence: TTT
ttagcaaactaaatcttcca

SEQ ID NO: 64138 - DNA, 20 bp, Artificial Sequence
  Description of Artificial Sequence: Synthetic oligonucleotide
  Target: SCN10A; (+) strand; PAM type: YTN; PAM sequence: TTT
tagcaaactaaatcttccaa

SEQ ID NO: 64139 - DNA, 20 bp, Artificial Sequence
  Description of Artificial Sequence: Synthetic oligonucleotide
  Target: SCN10A; (+) strand; PAM type: YTN; PAM sequence: TTT
agcaaactaaatcttccaat

SEQ ID NO: 64140 - DNA, 20 bp, Artificial Sequence
  Description of Artificial Sequence: Synthetic oligonucleotide
  Target: SCN10A; (+) strand; PAM type: YTN; PAM sequence: TTA
gcaaactaaatcttccaatg

SEQ ID NO: 64141 - DNA, 20 bp, Artificial Sequence
  Description of Artificial Sequence: Synthetic oligonucleotide
  Target: SCN10A; (+) strand; PAM type: YTN; PAM sequence: CTA
aatcttccaatgtattaaaa

SEQ ID NO: 64142 - DNA, 20 bp, Artificial Sequence
  Description of Artificial Sequence: Synthetic oligonucleotide
  Target: SCN10A; (+) strand; PAM type: YTN; PAM sequence: CTT
ccaatgtattaaaaaatgca

SEQ ID NO: 64143 - DNA, 20 bp, Artificial Sequence
  Description of Artificial Sequence: Synthetic oligonucleotide
  Target: SCN10A; (+) strand; PAM type: YTN; PAM sequence: TTC
caatgtattaaaaaatgcat

SEQ ID NO: 64144 - DNA, 20 bp, Artificial Sequence
  Description of Artificial Sequence: Synthetic oligonucleotide
  Target: SCN10A; (+) strand; PAM type: YTN; PAM sequence: TTA
aaaaatgcatcacgatcaag

SEQ ID NO: 64145 - DNA, 20 bp, Artificial Sequence
  Description of Artificial Sequence: Synthetic oligonucleotide
  Target: SCN10A; (+) strand; PAM type: YTN; PAM sequence: CTA
ggtttgagctgggaatgtaa

SEQ ID NO: 64146 - DNA, 20 bp, Artificial Sequence
  Description of Artificial Sequence: Synthetic oligonucleotide
  Target: SCN10A; (+) strand; PAM type: YTN; PAM sequence: TTT
gagctgggaatgtaaagttg

SEQ ID NO: 64147 - DNA, 20 bp, Artificial Sequence
  Description of Artificial Sequence: Synthetic oligonucleotide
  Target: SCN10A; (+) strand; PAM type: YTN; PAM sequence: TTG
agctgggaatgtaaagttga

SEQ ID NO: 64148 - DNA, 20 bp, Artificial Sequence
  Description of Artificial Sequence: Synthetic oligonucleotide
  Target: SCN10A; (+) strand; PAM type: YTN; PAM sequence: CTG
ggaatgtaaagttgatttaa

SEQ ID NO: 64149 - DNA, 20 bp, Artificial Sequence
  Description of Artificial Sequence: Synthetic oligonucleotide
  Target: SCN10A; (+) strand; PAM type: YTN; PAM sequence: TTG
atttaacattagaaaatcaa

SEQ ID NO: 64150 - DNA, 20 bp, Artificial Sequence
  Description of Artificial Sequence: Synthetic oligonucleotide
  Target: SCN10A; (+) strand; PAM type: YTN; PAM sequence: TTT
aacattagaaaatcaattaa

SEQ ID NO: 64151 - DNA, 20 bp, Artificial Sequence
  Description of Artificial Sequence: Synthetic oligonucleotide
  Target: SCN10A; (+) strand; PAM type: YTN; PAM sequence: TTA
acattagaaaatcaattaat

SEQ ID NO: 64152 - DNA, 20 bp, Artificial Sequence
  Description of Artificial Sequence: Synthetic oligonucleotide
  Target: SCN10A; (+) strand; PAM type: YTN; PAM sequence: TTA
gaaaatcaattaatataatt

SEQ ID NO: 64153 - DNA, 20 bp, Artificial Sequence
  Description of Artificial Sequence: Synthetic oligonucleotide
  Target: SCN10A; (+) strand; PAM type: YTN; PAM sequence: TTA
atataattcaccactttaac

SEQ ID NO: 64154 - DNA, 20 bp, Artificial Sequence
  Description of Artificial Sequence: Synthetic oligonucleotide
  Target: SCN10A; (+) strand; PAM type: YTN; PAM sequence: TTC
accactttaacagattgaag

SEQ ID NO: 64155 - DNA, 20 bp, Artificial Sequence
  Description of Artificial Sequence: Synthetic oligonucleotide
  Target: SCN10A; (+) strand; PAM type: YTN; PAM sequence: CTT
taacagattgaaggagaaaa

SEQ ID NO: 64156 - DNA, 20 bp, Artificial Sequence
  Description of Artificial Sequence: Synthetic oligonucleotide
  Target: SCN10A; (+) strand; PAM type: YTN; PAM sequence: TTT
aacagattgaaggagaaaat

SEQ ID NO: 64157 - DNA, 20 bp, Artificial Sequence
  Description of Artificial Sequence: Synthetic oligonucleotide
  Target: SCN10A; (+) strand; PAM type: YTN; PAM sequence: TTA
acagattgaaggagaaaata

SEQ ID NO: 64158 - DNA, 20 bp, Artificial Sequence
  Description of Artificial Sequence: Synthetic oligonucleotide
  Target: SCN10A; (+) strand; PAM type: YTN; PAM sequence: TTG
aaggagaaaatacatgatta

SEQ ID NO: 64159 - DNA, 20 bp, Artificial Sequence
  Description of Artificial Sequence: Synthetic oligonucleotide
  Target: SCN10A; (+) strand; PAM type: YTN; PAM sequence: TTA
tctcaatacatgtagaataa

SEQ ID NO: 64160 - DNA, 20 bp, Artificial Sequence
  Description of Artificial Sequence: Synthetic oligonucleotide
  Target: SCN10A; (+) strand; PAM type: YTN; PAM sequence: CTC
aatacatgtagaataattgt

SEQ ID NO: 64161 - DNA, 20 bp, Artificial Sequence
  Description of Artificial Sequence: Synthetic oligonucleotide
  Target: SCN10A; (+) strand; PAM type: YTN; PAM sequence: TTG
tctgataaaattaaacatcc

SEQ ID NO: 64162 - DNA, 20 bp, Artificial Sequence
  Description of Artificial Sequence: Synthetic oligonucleotide
  Target: SCN10A; (+) strand; PAM type: YTN; PAM sequence: CTG
ataaaattaaacatccattc

SEQ ID NO: 64163 - DNA, 20 bp, Artificial Sequence
  Description of Artificial Sequence: Synthetic oligonucleotide
  Target: SCN10A; (+) strand; PAM type: YTN; PAM sequence: TTA
aacatccattcatgataaat

SEQ ID NO: 64164 - DNA, 20 bp, Artificial Sequence
  Description of Artificial Sequence: Synthetic oligonucleotide
  Target: SCN10A; (+) strand; PAM type: YTN; PAM sequence: TTC
atgataaatattcttgataa

SEQ ID NO: 64165 - DNA, 20 bp, Artificial Sequence
  Description of Artificial Sequence: Synthetic oligonucleotide
  Target: SCN10A; (+) strand; PAM type: YTN; PAM sequence: TTC
ttgataaaagagaacttcct

SEQ ID NO: 64166 - DNA, 20 bp, Artificial Sequence
  Description of Artificial Sequence: Synthetic oligonucleotide
  Target: SCN10A; (+) strand; PAM type: YTN; PAM sequence: CTT
gataaaagagaacttcctga

SEQ ID NO: 64167 - DNA, 20 bp, Artificial Sequence
  Description of Artificial Sequence: Synthetic oligonucleotide
  Target: SCN10A; (+) strand; PAM type: YTN; PAM sequence: TTG
ataaaagagaacttcctgaa

SEQ ID NO: 64168 - DNA, 20 bp, Artificial Sequence
  Description of Artificial Sequence: Synthetic oligonucleotide
  Target: SCN10A; (+) strand; PAM type: YTN; PAM sequence: CTT
cctgaactgataaagatttc

SEQ ID NO: 64169 - DNA, 20 bp, Artificial Sequence
  Description of Artificial Sequence: Synthetic oligonucleotide
  Target: SCN10A; (+) strand; PAM type: YTN; PAM sequence: TTC
ctgaactgataaagatttct

SEQ ID NO: 64170 - DNA, 20 bp, Artificial Sequence
  Description of Artificial Sequence: Synthetic oligonucleotide
  Target: SCN10A; (+) strand; PAM type: YTN; PAM sequence: CTG
aactgataaagatttcttat

SEQ ID NO: 64171 - DNA, 20 bp, Artificial Sequence
  Description of Artificial Sequence: Synthetic oligonucleotide
  Target: SCN10A; (+) strand; PAM type: YTN; PAM sequence: CTG
ataaagatttcttatcttta

SEQ ID NO: 64172 - DNA, 20 bp, Artificial Sequence
  Description of Artificial Sequence: Synthetic oligonucleotide
  Target: SCN10A; (+) strand; PAM type: YTN; PAM sequence: TTT
cttatctttaaaaaaagcct

SEQ ID NO: 64173 - DNA, 20 bp, Artificial Sequence
  Description of Artificial Sequence: Synthetic oligonucleotide
  Target: SCN10A; (+) strand; PAM type: YTN; PAM sequence: TTC
ttatctttaaaaaaagcctg

SEQ ID NO: 64174 - DNA, 20 bp, Artificial Sequence
  Description of Artificial Sequence: Synthetic oligonucleotide
  Target: SCN10A; (+) strand; PAM type: YTN; PAM sequence: CTT
atctttaaaaaaagcctgcc

SEQ ID NO: 64175 - DNA, 20 bp, Artificial Sequence
  Description of Artificial Sequence: Synthetic oligonucleotide
  Target: SCN10A; (+) strand; PAM type: YTN; PAM sequence: TTA
tctttaaaaaaagcctgcca

SEQ ID NO: 64176 - DNA, 20 bp, Artificial Sequence
  Description of Artificial Sequence: Synthetic oligonucleotide
  Target: SCN10A; (+) strand; PAM type: YTN; PAM sequence: CTT
taaaaaaagcctgccacaat

SEQ ID NO: 64177 - DNA, 20 bp, Artificial Sequence
  Description of Artificial Sequence: Synthetic oligonucleotide
  Target: SCN10A; (+) strand; PAM type: YTN; PAM sequence: TTT
aaaaaaagcctgccacaatt

SEQ ID NO: 64178 - DNA, 20 bp, Artificial Sequence
  Description of Artificial Sequence: Synthetic oligonucleotide
  Target: SCN10A; (+) strand; PAM type: YTN; PAM sequence: TTA
aaaaaagcctgccacaattg

SEQ ID NO: 64179 - DNA, 20 bp, Artificial Sequence
  Description of Artificial Sequence: Synthetic oligonucleotide
  Target: SCN10A; (+) strand; PAM type: YTN; PAM sequence: CTG
ccacaattgttagaggtggt

SEQ ID NO: 64180 - DNA, 20 bp, Artificial Sequence
  Description of Artificial Sequence: Synthetic oligonucleotide
  Target: SCN10A; (+) strand; PAM type: YTN; PAM sequence: TTG
ttagaggtggtgaaatattg

SEQ ID NO: 64181 - DNA, 20 bp, Artificial Sequence
  Description of Artificial Sequence: Synthetic oligonucleotide
  Target: SCN10A; (+) strand; PAM type: YTN; PAM sequence: TTA
gaggtggtgaaatattgaaa

SEQ ID NO: 64182 - DNA, 20 bp, Artificial Sequence
  Description of Artificial Sequence: Synthetic oligonucleotide
  Target: SCN10A; (+) strand; PAM type: YTN; PAM sequence: TTG
aaaggattctttttgggatc

SEQ ID NO: 64183 - DNA, 20 bp, Artificial Sequence
  Description of Artificial Sequence: Synthetic oligonucleotide
  Target: SCN10A; (+) strand; PAM type: YTN; PAM sequence: TTC
tttttgggatcagaaaattg

SEQ ID NO: 64184 - DNA, 20 bp, Artificial Sequence
  Description of Artificial Sequence: Synthetic oligonucleotide
  Target: SCN10A; (+) strand; PAM type: YTN; PAM sequence: CTT
tttgggatcagaaaattgat

SEQ ID NO: 64185 - DNA, 20 bp, Artificial Sequence
  Description of Artificial Sequence: Synthetic oligonucleotide
  Target: SCN10A; (+) strand; PAM type: YTN; PAM sequence: TTT
ttgggatcagaaaattgata

SEQ ID NO: 64186 - DNA, 20 bp, Artificial Sequence
  Description of Artificial Sequence: Synthetic oligonucleotide
  Target: SCN10A; (+) strand; PAM type: YTN; PAM sequence: TTT
tgggatcagaaaattgataa

SEQ ID NO: 64187 - DNA, 20 bp, Artificial Sequence
  Description of Artificial Sequence: Synthetic oligonucleotide
  Target: SCN10A; (+) strand; PAM type: YTN; PAM sequence: TTT
gggatcagaaaattgataaa

SEQ ID NO: 64188 - DNA, 20 bp, Artificial Sequence
  Description of Artificial Sequence: Synthetic oligonucleotide
  Target: SCN10A; (+) strand; PAM type: YTN; PAM sequence: TTG
ggatcagaaaattgataaag

SEQ ID NO: 64189 - DNA, 20 bp, Artificial Sequence
  Description of Artificial Sequence: Synthetic oligonucleotide
  Target: SCN10A; (+) strand; PAM type: YTN; PAM sequence: TTG
ataaagatacctgttattaa

SEQ ID NO: 64190 - DNA, 20 bp, Artificial Sequence
  Description of Artificial Sequence: Synthetic oligonucleotide
  Target: SCN10A; (+) strand; PAM type: YTN; PAM sequence: CTG
ttattaacacttcttttcaa

SEQ ID NO: 64191 - DNA, 20 bp, Artificial Sequence
  Description of Artificial Sequence: Synthetic oligonucleotide
  Target: SCN10A; (+) strand; PAM type: YTN; PAM sequence: TTA
ttaacacttcttttcaacag

SEQ ID NO: 64192 - DNA, 20 bp, Artificial Sequence
  Description of Artificial Sequence: Synthetic oligonucleotide
  Target: SCN10A; (+) strand; PAM type: YTN; PAM sequence: TTA
acacttcttttcaacagtgt

SEQ ID NO: 64193 - DNA, 20 bp, Artificial Sequence
  Description of Artificial Sequence: Synthetic oligonucleotide
  Target: SCN10A; (+) strand; PAM type: YTN; PAM sequence: CTT
cttttcaacagtgtactgga

SEQ ID NO: 64194 - DNA, 20 bp, Artificial Sequence
  Description of Artificial Sequence: Synthetic oligonucleotide
  Target: SCN10A; (+) strand; PAM type: YTN; PAM sequence: TTC
ttttcaacagtgtactggat

SEQ ID NO: 64195 - DNA, 20 bp, Artificial Sequence
  Description of Artificial Sequence: Synthetic oligonucleotide
  Target: SCN10A; (+) strand; PAM type: YTN; PAM sequence: CTT
ttcaacagtgtactggatgt

SEQ ID NO: 64196 - DNA, 20 bp, Artificial Sequence
  Description of Artificial Sequence: Synthetic oligonucleotide
  Target: SCN10A; (+) strand; PAM type: YTN; PAM sequence: TTT
tcaacagtgtactggatgtc

SEQ ID NO: 64197 - DNA, 20 bp, Artificial Sequence
  Description of Artificial Sequence: Synthetic oligonucleotide
  Target: SCN10A; (+) strand; PAM type: YTN; PAM sequence: TTT
caacagtgtactggatgtcc

SEQ ID NO: 64198 - DNA, 20 bp, Artificial Sequence
  Description of Artificial Sequence: Synthetic oligonucleotide
  Target: SCN10A; (+) strand; PAM type: YTN; PAM sequence: TTC
aacagtgtactggatgtcct

SEQ ID NO: 64199 - DNA, 20 bp, Artificial Sequence
  Description of Artificial Sequence: Synthetic oligonucleotide
  Target: SCN10A; (+) strand; PAM type: YTN; PAM sequence: CTG
gatgtcctaactagcacagt

SEQ ID NO: 64200 - DNA, 20 bp, Artificial Sequence
  Description of Artificial Sequence: Synthetic oligonucleotide
  Target: SCN10A; (+) strand; PAM type: YTN; PAM sequence: CTA
actagcacagtgatctagta

SEQ ID NO: 64201 - DNA, 20 bp, Artificial Sequence
  Description of Artificial Sequence: Synthetic oligonucleotide
  Target: SCN10A; (+) strand; PAM type: YTN; PAM sequence: CTA
gcacagtgatctagtaaaaa

SEQ ID NO: 64202 - DNA, 20 bp, Artificial Sequence
  Description of Artificial Sequence: Synthetic oligonucleotide
  Target: SCN10A; (+) strand; PAM type: YTN; PAM sequence: CTA
gtaaaaagaacctaatggca

SEQ ID NO: 64203 - DNA, 20 bp, Artificial Sequence
  Description of Artificial Sequence: Synthetic oligonucleotide
  Target: SCN10A; (+) strand; PAM type: YTN; PAM sequence: CTA
atggcataaggattagaaaa

SEQ ID NO: 64204 - DNA, 20 bp, Artificial Sequence
  Description of Artificial Sequence: Synthetic oligonucleotide
  Target: SCN10A; (+) strand; PAM type: YTN; PAM sequence: TTA
gaaaagaagaaattaggctg

SEQ ID NO: 64205 - DNA, 20 bp, Artificial Sequence
  Description of Artificial Sequence: Synthetic oligonucleotide
  Target: SCN10A; (+) strand; PAM type: YTN; PAM sequence: TTA
ggctgggcgtgggtggctca

SEQ ID NO: 64206 - DNA, 20 bp, Artificial Sequence
  Description of Artificial Sequence: Synthetic oligonucleotide
  Target: SCN10A; (+) strand; PAM type: YTN; PAM sequence: CTG
ggcgtgggtggctcatgcct

SEQ ID NO: 64207 - DNA, 20 bp, Artificial Sequence
  Description of Artificial Sequence: Synthetic oligonucleotide
  Target: SCN10A; (+) strand; PAM type: YTN; PAM sequence: CTC
atgcctgtaatcccagcact

SEQ ID NO: 64208 - DNA, 20 bp, Artificial Sequence
  Description of Artificial Sequence: Synthetic oligonucleotide
  Target: SCN10A; (+) strand; PAM type: YTN; PAM sequence: CTG
taatcccagcactttaggag

SEQ ID NO: 64209 - DNA, 20 bp, Artificial Sequence
  Description of Artificial Sequence: Synthetic oligonucleotide
  Target: SCN10A; (+) strand; PAM type: YTN; PAM sequence: CTT
taggaggccaaggcaggcag

SEQ ID NO: 64210 - DNA, 20 bp, Artificial Sequence
  Description of Artificial Sequence: Synthetic oligonucleotide
  Target: SCN10A; (+) strand; PAM type: YTN; PAM sequence: TTT
aggaggccaaggcaggcaga

SEQ ID NO: 64211 - DNA, 20 bp, Artificial Sequence
  Description of Artificial Sequence: Synthetic oligonucleotide
  Target: SCN10A; (+) strand; PAM type: YTN; PAM sequence: TTA
ggaggccaaggcaggcagat

SEQ ID NO: 64212 - DNA, 20 bp, Artificial Sequence
  Description of Artificial Sequence: Synthetic oligonucleotide
  Target: SCN10A; (+) strand; PAM type: YTN; PAM sequence: CTG
gctaacacggtgaaaccccg

SEQ ID NO: 64213 - DNA, 20 bp, Artificial Sequence
  Description of Artificial Sequence: Synthetic oligonucleotide
  Target: SCN10A; (+) strand; PAM type: YTN; PAM sequence: CTA
acacggtgaaaccccgtctc

SEQ ID NO: 64214 - DNA, 20 bp, Artificial Sequence
  Description of Artificial Sequence: Synthetic oligonucleotide
  Target: SCN10A; (+) strand; PAM type: YTN; PAM sequence: CTC
tactaaaaatacaaagaatt

SEQ ID NO: 64215 - DNA, 20 bp, Artificial Sequence
  Description of Artificial Sequence: Synthetic oligonucleotide
  Target: SCN10A; (+) strand; PAM type: YTN; PAM sequence: CTA
ctaaaaatacaaagaattag

SEQ ID NO: 64216 - DNA, 20 bp, Artificial Sequence
  Description of Artificial Sequence: Synthetic oligonucleotide
  Target: SCN10A; (+) strand; PAM type: YTN; PAM sequence: CTA
aaaatacaaagaattagcca

SEQ ID NO: 64217 - DNA, 20 bp, Artificial Sequence
  Description of Artificial Sequence: Synthetic oligonucleotide
  Target: SCN10A; (+) strand; PAM type: YTN; PAM sequence: TTA
gccaggcatggtggtgggtg

SEQ ID NO: 64218 - DNA, 20 bp, Artificial Sequence
  Description of Artificial Sequence: Synthetic oligonucleotide
  Target: SCN10A; (+) strand; PAM type: YTN; PAM sequence: CTG
tagtcccagctactcaggag

SEQ ID NO: 64219 - DNA, 20 bp, Artificial Sequence
  Description of Artificial Sequence: Synthetic oligonucleotide
  Target: SCN10A; (+) strand; PAM type: YTN; PAM sequence: CTA
ctcaggaggctgaggcagga

SEQ ID NO: 64220 - DNA, 20 bp, Artificial Sequence
  Description of Artificial Sequence: Synthetic oligonucleotide
  Target: SCN10A; (+) strand; PAM type: YTN; PAM sequence: CTC
aggaggctgaggcaggagaa

SEQ ID NO: 64221 - DNA, 20 bp, Artificial Sequence
  Description of Artificial Sequence: Synthetic oligonucleotide
  Target: SCN10A; (+) strand; PAM type: YTN; PAM sequence: CTG
aggcaggagaatggcgtgaa

SEQ ID NO: 64222 - DNA, 20 bp, Artificial Sequence
  Description of Artificial Sequence: Synthetic oligonucleotide
  Target: SCN10A; (+) strand; PAM type: YTN; PAM sequence: CTG
gcaatgagccgagatcacgc

SEQ ID NO: 64223 - DNA, 20 bp, Artificial Sequence
  Description of Artificial Sequence: Synthetic oligonucleotide
  Target: SCN10A; (+) strand; PAM type: YTN; PAM sequence: CTG
cactctagcctgggtgacag

SEQ ID NO: 64224 - DNA, 20 bp, Artificial Sequence
  Description of Artificial Sequence: Synthetic oligonucleotide
  Target: SCN10A; (+) strand; PAM type: YTN; PAM sequence: CTC
tagcctgggtgacagagcga

SEQ ID NO: 64225 - DNA, 20 bp, Artificial Sequence
  Description of Artificial Sequence: Synthetic oligonucleotide
  Target: SCN10A; (+) strand; PAM type: YTN; PAM sequence: CTA
gcctgggtgacagagcgaga

SEQ ID NO: 64226 - DNA, 20 bp, Artificial Sequence
  Description of Artificial Sequence: Synthetic oligonucleotide
  Target: SCN10A; (+) strand; PAM type: YTN; PAM sequence: CTG
ggtgacagagcgagactctg

SEQ ID NO: 64227 - DNA, 20 bp, Artificial Sequence
  Description of Artificial Sequence: Synthetic oligonucleotide
  Target: SCN10A; (+) strand; PAM type: YTN; PAM sequence: CTC
tgtctcaaaaaaaaaaaaaa

SEQ ID NO: 64228 - DNA, 20 bp, Artificial Sequence
  Description of Artificial Sequence: Synthetic oligonucleotide
  Target: SCN10A; (+) strand; PAM type: YTN; PAM sequence: CTG
tctcaaaaaaaaaaaaaaaa

SEQ ID NO: 64229 - DNA, 20 bp, Artificial Sequence
  Description of Artificial Sequence: Synthetic oligonucleotide
  Target: SCN10A; (+) strand; PAM type: YTN; PAM sequence: CTC
aaaaaaaaaaaaaaaaaaaa

SEQ ID NO: 64230 - DNA, 20 bp, Artificial Sequence
  Description of Artificial Sequence: Synthetic oligonucleotide
  Target: SCN10A; (+) strand; PAM type: YTN; PAM sequence: TTA
aactcattgttattttcaca

SEQ ID NO: 64231 - DNA, 20 bp, Artificial Sequence
  Description of Artificial Sequence: Synthetic oligonucleotide
  Target: SCN10A; (+) strand; PAM type: YTN; PAM sequence: CTC
attgttattttcacatgatg

SEQ ID NO: 64232 - DNA, 20 bp, Artificial Sequence
  Description of Artificial Sequence: Synthetic oligonucleotide
  Target: SCN10A; (+) strand; PAM type: YTN; PAM sequence: TTG
ttattttcacatgatgtgat

SEQ ID NO: 64233 - DNA, 20 bp, Artificial Sequence
  Description of Artificial Sequence: Synthetic oligonucleotide
  Target: SCN10A; (+) strand; PAM type: YTN; PAM sequence: TTA
ttttcacatgatgtgattat

SEQ ID NO: 64234 - DNA, 20 bp, Artificial Sequence
  Description of Artificial Sequence: Synthetic oligonucleotide
  Target: SCN10A; (+) strand; PAM type: YTN; PAM sequence: TTT
tcacatgatgtgattatgtt

SEQ ID NO: 64235 - DNA, 20 bp, Artificial Sequence
  Description of Artificial Sequence: Synthetic oligonucleotide
  Target: SCN10A; (+) strand; PAM type: YTN; PAM sequence: TTT
cacatgatgtgattatgtta

SEQ ID NO: 64236 - DNA, 20 bp, Artificial Sequence
  Description of Artificial Sequence: Synthetic oligonucleotide
  Target: SCN10A; (+) strand; PAM type: YTN; PAM sequence: TTC
acatgatgtgattatgttag

SEQ ID NO: 64237 - DNA, 20 bp, Artificial Sequence
  Description of Artificial Sequence: Synthetic oligonucleotide
  Target: SCN10A; (+) strand; PAM type: YTN; PAM sequence: TTA
tgttagaaaatttaaaacat

SEQ ID NO: 64238 - DNA, 20 bp, Artificial Sequence
  Description of Artificial Sequence: Synthetic oligonucleotide
  Target: SCN10A; (+) strand; PAM type: YTN; PAM sequence: TTA
gaaaatttaaaacattgtat

SEQ ID NO: 64239 - DNA, 20 bp, Artificial Sequence
  Description of Artificial Sequence: Synthetic oligonucleotide
  Target: SCN10A; (+) strand; PAM type: YTN; PAM sequence: TTT
aaaacattgtatagataaat

SEQ ID NO: 64240 - DNA, 20 bp, Artificial Sequence
  Description of Artificial Sequence: Synthetic oligonucleotide
  Target: SCN10A; (+) strand; PAM type: YTN; PAM sequence: TTA
aaacattgtatagataaatt

SEQ ID NO: 64241 - DNA, 20 bp, Artificial Sequence
  Description of Artificial Sequence: Synthetic oligonucleotide
  Target: SCN10A; (+) strand; PAM type: YTN; PAM sequence: TTG
tatagataaattattagaat

SEQ ID NO: 64242 - DNA, 20 bp, Artificial Sequence
  Description of Artificial Sequence: Synthetic oligonucleotide
  Target: SCN10A; (+) strand; PAM type: YTN; PAM sequence: TTA
ttagaattaataagagacat

SEQ ID NO: 64243 - DNA, 20 bp, Artificial Sequence
  Description of Artificial Sequence: Synthetic oligonucleotide
  Target: SCN10A; (+) strand; PAM type: YTN; PAM sequence: TTA
gaattaataagagacatttc

SEQ ID NO: 64244 - DNA, 20 bp, Artificial Sequence
  Description of Artificial Sequence: Synthetic oligonucleotide
  Target: SCN10A; (+) strand; PAM type: YTN; PAM sequence: TTA
ataagagacatttctagata

SEQ ID NO: 64245 - DNA, 20 bp, Artificial Sequence
  Description of Artificial Sequence: Synthetic oligonucleotide
  Target: SCN10A; (+) strand; PAM type: YTN; PAM sequence: TTT
ctagatacaaaaatgttaaa

SEQ ID NO: 64246 - DNA, 20 bp, Artificial Sequence
  Description of Artificial Sequence: Synthetic oligonucleotide
  Target: SCN10A; (+) strand; PAM type: YTN; PAM sequence: TTC
tagatacaaaaatgttaaat

SEQ ID NO: 64247 - DNA, 20 bp, Artificial Sequence
  Description of Artificial Sequence: Synthetic oligonucleotide
  Target: SCN10A; (+) strand; PAM type: YTN; PAM sequence: CTA
gatacaaaaatgttaaatat

SEQ ID NO: 64248 - DNA, 20 bp, Artificial Sequence
  Description of Artificial Sequence: Synthetic oligonucleotide
  Target: SCN10A; (+) strand; PAM type: YTN; PAM sequence: TTA
aatatcaaaatgctagccaa

SEQ ID NO: 64249 - DNA, 20 bp, Artificial Sequence
  Description of Artificial Sequence: Synthetic oligonucleotide
  Target: SCN10A; (+) strand; PAM type: YTN; PAM sequence: CTA
gccaaaaatgccagaaaaga

SEQ ID NO: 64250 - DNA, 20 bp, Artificial Sequence
  Description of Artificial Sequence: Synthetic oligonucleotide
  Target: SCN10A; (+) strand; PAM type: YTN; PAM sequence: TTT
aagaagatatgcaagatcct

SEQ ID NO: 64251 - DNA, 20 bp, Artificial Sequence
  Description of Artificial Sequence: Synthetic oligonucleotide
  Target: SCN10A; (+) strand; PAM type: YTN; PAM sequence: TTA
agaagatatgcaagatccta

SEQ ID NO: 64252 - DNA, 20 bp, Artificial Sequence
  Description of Artificial Sequence: Synthetic oligonucleotide
  Target: SCN10A; (+) strand; PAM type: YTN; PAM sequence: CTA
tggagaaaattataaaaacc

SEQ ID NO: 64253 - DNA, 20 bp, Artificial Sequence
  Description of Artificial Sequence: Synthetic oligonucleotide
  Target: SCN10A; (+) strand; PAM type: YTN; PAM sequence: TTA
taaaaacctcatggaaacat

SEQ ID NO: 64254 - DNA, 20 bp, Artificial Sequence
  Description of Artificial Sequence: Synthetic oligonucleotide
  Target: SCN10A; (+) strand; PAM type: YTN; PAM sequence: CTC
atggaaacatttttaaactt

SEQ ID NO: 64255 - DNA, 20 bp, Artificial Sequence
  Description of Artificial Sequence: Synthetic oligonucleotide
  Target: SCN10A; (+) strand; PAM type: YTN; PAM sequence: TTT
ttaaactttattgaaagact

SEQ ID NO: 64256 - DNA, 20 bp, Artificial Sequence
  Description of Artificial Sequence: Synthetic oligonucleotide
  Target: SCN10A; (+) strand; PAM type: YTN; PAM sequence: TTT
taaactttattgaaagactg

SEQ ID NO: 64257 - DNA, 20 bp, Artificial Sequence
  Description of Artificial Sequence: Synthetic oligonucleotide
  Target: SCN10A; (+) strand; PAM type: YTN; PAM sequence: TTT
aaactttattgaaagactgg

SEQ ID NO: 64258 - DNA, 20 bp, Artificial Sequence
  Description of Artificial Sequence: Synthetic oligonucleotide
  Target: SCN10A; (+) strand; PAM type: YTN; PAM sequence: TTA
aactttattgaaagactggt

SEQ ID NO: 64259 - DNA, 20 bp, Artificial Sequence
  Description of Artificial Sequence: Synthetic oligonucleotide
  Target: SCN10A; (+) strand; PAM type: YTN; PAM sequence: CTT
tattgaaagactggtataca

SEQ ID NO: 64260 - DNA, 20 bp, Artificial Sequence
  Description of Artificial Sequence: Synthetic oligonucleotide
  Target: SCN10A; (+) strand; PAM type: YTN; PAM sequence: TTT
attgaaagactggtatacag

SEQ ID NO: 64261 - DNA, 20 bp, Artificial Sequence
  Description of Artificial Sequence: Synthetic oligonucleotide
  Target: SCN10A; (+) strand; PAM type: YTN; PAM sequence: TTA
ttgaaagactggtatacagc

SEQ ID NO: 64262 - DNA, 20 bp, Artificial Sequence
  Description of Artificial Sequence: Synthetic oligonucleotide
  Target: SCN10A; (+) strand; PAM type: YTN; PAM sequence: TTG
aaagactggtatacagcgta

SEQ ID NO: 64263 - DNA, 20 bp, Artificial Sequence
  Description of Artificial Sequence: Synthetic oligonucleotide
  Target: SCN10A; (+) strand; PAM type: YTN; PAM sequence: CTG
gtatacagcgtatactatct

SEQ ID NO: 64264 - DNA, 20 bp, Artificial Sequence
  Description of Artificial Sequence: Synthetic oligonucleotide
  Target: SCN10A; (+) strand; PAM type: YTN; PAM sequence: CTA
tcttcatagatcagaagact

SEQ ID NO: 64265 - DNA, 20 bp, Artificial Sequence
  Description of Artificial Sequence: Synthetic oligonucleotide
  Target: SCN10A; (+) strand; PAM type: YTN; PAM sequence: CTT
catagatcagaagactgaat

SEQ ID NO: 64266 - DNA, 20 bp, Artificial Sequence
  Description of Artificial Sequence: Synthetic oligonucleotide
  Target: SCN10A; (+) strand; PAM type: YTN; PAM sequence: TTC
atagatcagaagactgaatt

SEQ ID NO: 64267 - DNA, 20 bp, Artificial Sequence
  Description of Artificial Sequence: Synthetic oligonucleotide
  Target: SCN10A; (+) strand; PAM type: YTN; PAM sequence: CTG
aattatgtaaagattataag

SEQ ID NO: 64268 - DNA, 20 bp, Artificial Sequence
  Description of Artificial Sequence: Synthetic oligonucleotide
  Target: SCN10A; (+) strand; PAM type: YTN; PAM sequence: TTA
tgtaaagattataagtcttc

SEQ ID NO: 64269 - DNA, 20 bp, Artificial Sequence
  Description of Artificial Sequence: Synthetic oligonucleotide
  Target: SCN10A; (+) strand; PAM type: YTN; PAM sequence: TTA
taagtcttcccaaattgacc

SEQ ID NO: 64270 - DNA, 20 bp, Artificial Sequence
  Description of Artificial Sequence: Synthetic oligonucleotide
  Target: SCN10A; (+) strand; PAM type: YTN; PAM sequence: CTT
cccaaattgacctatcaatt

SEQ ID NO: 64271 - DNA, 20 bp, Artificial Sequence
  Description of Artificial Sequence: Synthetic oligonucleotide
  Target: SCN10A; (+) strand; PAM type: YTN; PAM sequence: TTC
ccaaattgacctatcaatta

SEQ ID NO: 64272 - DNA, 20 bp, Artificial Sequence
  Description of Artificial Sequence: Synthetic oligonucleotide
  Target: SCN10A; (+) strand; PAM type: YTN; PAM sequence: TTG
acctatcaattacagcagtc

SEQ ID NO: 64273 - DNA, 20 bp, Artificial Sequence
  Description of Artificial Sequence: Synthetic oligonucleotide
  Target: SCN10A; (+) strand; PAM type: YTN; PAM sequence: CTA
tcaattacagcagtccctaa

SEQ ID NO: 64274 - DNA, 20 bp, Artificial Sequence
  Description of Artificial Sequence: Synthetic oligonucleotide
  Target: SCN10A; (+) strand; PAM type: YTN; PAM sequence: TTA
cagcagtccctaatgggaaa

SEQ ID NO: 64275 - DNA, 20 bp, Artificial Sequence
  Description of Artificial Sequence: Synthetic oligonucleotide
  Target: SCN10A; (+) strand; PAM type: YTN; PAM sequence: CTA
atgggaaaaacaatagcagt

SEQ ID NO: 64276 - DNA, 20 bp, Artificial Sequence
  Description of Artificial Sequence: Synthetic oligonucleotide
  Target: SCN10A; (+) strand; PAM type: YTN; PAM sequence: TTT
tgtgtgtatgtgggtatgta

SEQ ID NO: 64277 - DNA, 20 bp, Artificial Sequence
  Description of Artificial Sequence: Synthetic oligonucleotide
  Target: SCN10A; (+) strand; PAM type: YTN; PAM sequence: TTT
gtgtgtatgtgggtatgtaa

SEQ ID NO: 64278 - DNA, 20 bp, Artificial Sequence
  Description of Artificial Sequence: Synthetic oligonucleotide
  Target: SCN10A; (+) strand; PAM type: YTN; PAM sequence: TTG
tgtgtatgtgggtatgtaac

SEQ ID NO: 64279 - DNA, 20 bp, Artificial Sequence
  Description of Artificial Sequence: Synthetic oligonucleotide
  Target: SCN10A; (+) strand; PAM type: YTN; PAM sequence: CTT
ggcaagataattctaaagtg

SEQ ID NO: 64280 - DNA, 20 bp, Artificial Sequence
  Description of Artificial Sequence: Synthetic oligonucleotide
  Target: SCN10A; (+) strand; PAM type: YTN; PAM sequence: TTG
gcaagataattctaaagtga

SEQ ID NO: 64281 - DNA, 20 bp, Artificial Sequence
  Description of Artificial Sequence: Synthetic oligonucleotide
  Target: SCN10A; (+) strand; PAM type: YTN; PAM sequence: TTC
taaagtgaatatgaaagtgt

SEQ ID NO: 64282 - DNA, 20 bp, Artificial Sequence
  Description of Artificial Sequence: Synthetic oligonucleotide
  Target: SCN10A; (+) strand; PAM type: YTN; PAM sequence: CTA
aagtgaatatgaaagtgtgc

SEQ ID NO: 64283 - DNA, 20 bp, Artificial Sequence
  Description of Artificial Sequence: Synthetic oligonucleotide
  Target: SCN10A; (+) strand; PAM type: YTN; PAM sequence: TTC
ttgaagtaaattaggtggat

SEQ ID NO: 64284 - DNA, 20 bp, Artificial Sequence
  Description of Artificial Sequence: Synthetic oligonucleotide
  Target: SCN10A; (+) strand; PAM type: YTN; PAM sequence: CTT
gaagtaaattaggtggatta

SEQ ID NO: 64285 - DNA, 20 bp, Artificial Sequence
  Description of Artificial Sequence: Synthetic oligonucleotide
  Target: SCN10A; (+) strand; PAM type: YTN; PAM sequence: TTG
aagtaaattaggtggattac

SEQ ID NO: 64286 - DNA, 20 bp, Artificial Sequence
  Description of Artificial Sequence: Synthetic oligonucleotide
  Target: SCN10A; (+) strand; PAM type: YTN; PAM sequence: TTA
ggtggattacttgatttaca

SEQ ID NO: 64287 - DNA, 20 bp, Artificial Sequence
  Description of Artificial Sequence: Synthetic oligonucleotide
  Target: SCN10A; (+) strand; PAM type: YTN; PAM sequence: TTA
cttgatttacagacacagat

SEQ ID NO: 64288 - DNA, 20 bp, Artificial Sequence
  Description of Artificial Sequence: Synthetic oligonucleotide
  Target: SCN10A; (+) strand; PAM type: YTN; PAM sequence: CTT
gatttacagacacagatata

SEQ ID NO: 64289 - DNA, 20 bp, Artificial Sequence
  Description of Artificial Sequence: Synthetic oligonucleotide
  Target: SCN10A; (+) strand; PAM type: YTN; PAM sequence: TTG
atttacagacacagatatat

SEQ ID NO: 64290 - DNA, 20 bp, Artificial Sequence
  Description of Artificial Sequence: Synthetic oligonucleotide
  Target: SCN10A; (+) strand; PAM type: YTN; PAM sequence: TTT
acagacacagatatatttaa

SEQ ID NO: 64291 - DNA, 20 bp, Artificial Sequence
  Description of Artificial Sequence: Synthetic oligonucleotide
  Target: SCN10A; (+) strand; PAM type: YTN; PAM sequence: TTA
cagacacagatatatttaaa

SEQ ID NO: 64292 - DNA, 20 bp, Artificial Sequence
  Description of Artificial Sequence: Synthetic oligonucleotide
  Target: SCN10A; (+) strand; PAM type: YTN; PAM sequence: TTT
aaagctgccataattaagac

SEQ ID NO: 64293 - DNA, 20 bp, Artificial Sequence
  Description of Artificial Sequence: Synthetic oligonucleotide
  Target: SCN10A; (+) strand; PAM type: YTN; PAM sequence: TTA
aagctgccataattaagact

SEQ ID NO: 64294 - DNA, 20 bp, Artificial Sequence
  Description of Artificial Sequence: Synthetic oligonucleotide
  Target: SCN10A; (+) strand; PAM type: YTN; PAM sequence: CTG
ccataattaagactgatatt

SEQ ID NO: 64295 - DNA, 20 bp, Artificial Sequence
  Description of Artificial Sequence: Synthetic oligonucleotide
  Target: SCN10A; (+) strand; PAM type: YTN; PAM sequence: TTA
agactgatattggtgccagg

SEQ ID NO: 64296 - DNA, 20 bp, Artificial Sequence
  Description of Artificial Sequence: Synthetic oligonucleotide
  Target: SCN10A; (+) strand; PAM type: YTN; PAM sequence: CTG
atattggtgccaggatagac

SEQ ID NO: 64297 - DNA, 20 bp, Artificial Sequence
  Description of Artificial Sequence: Synthetic oligonucleotide
  Target: SCN10A; (+) strand; PAM type: YTN; PAM sequence: TTG
gtgccaggatagaccaatgg

SEQ ID NO: 64298 - DNA, 20 bp, Artificial Sequence
  Description of Artificial Sequence: Synthetic oligonucleotide
  Target: SCN10A; (+) strand; PAM type: YTN; PAM sequence: CTA
acagagcaaatggagcaagg

SEQ ID NO: 64299 - DNA, 20 bp, Artificial Sequence
  Description of Artificial Sequence: Synthetic oligonucleotide
  Target: SCN10A; (+) strand; PAM type: YTN; PAM sequence: CTT
taagtgacgggaggagaagc

SEQ ID NO: 64300 - DNA, 20 bp, Artificial Sequence
  Description of Artificial Sequence: Synthetic oligonucleotide
  Target: SCN10A; (+) strand; PAM type: YTN; PAM sequence: TTT
aagtgacgggaggagaagca

SEQ ID NO: 64301 - DNA, 20 bp, Artificial Sequence
  Description of Artificial Sequence: Synthetic oligonucleotide
  Target: SCN10A; (+) strand; PAM type: YTN; PAM sequence: TTA
agtgacgggaggagaagcaa

SEQ ID NO: 64302 - DNA, 20 bp, Artificial Sequence
  Description of Artificial Sequence: Synthetic oligonucleotide
  Target: SCN10A; (+) strand; PAM type: YTN; PAM sequence: CTA
ttttgggagagaaggaagac

SEQ ID NO: 64303 - DNA, 20 bp, Artificial Sequence
  Description of Artificial Sequence: Synthetic oligonucleotide
  Target: SCN10A; (+) strand; PAM type: YTN; PAM sequence: TTT
tgggagagaaggaagacaga

SEQ ID NO: 64304 - DNA, 20 bp, Artificial Sequence
  Description of Artificial Sequence: Synthetic oligonucleotide
  Target: SCN10A; (+) strand; PAM type: YTN; PAM sequence: TTT
gggagagaaggaagacagac

SEQ ID NO: 64305 - DNA, 20 bp, Artificial Sequence
  Description of Artificial Sequence: Synthetic oligonucleotide
  Target: SCN10A; (+) strand; PAM type: YTN; PAM sequence: TTG
ggagagaaggaagacagact

SEQ ID NO: 64306 - DNA, 20 bp, Artificial Sequence
  Description of Artificial Sequence: Synthetic oligonucleotide
  Target: SCN10A; (+) strand; PAM type: YTN; PAM sequence: CTT
tttatttcttcctttttccc

SEQ ID NO: 64307 - DNA, 20 bp, Artificial Sequence
  Description of Artificial Sequence: Synthetic oligonucleotide
  Target: SCN10A; (+) strand; PAM type: YTN; PAM sequence: TTT
ttatttcttcctttttccct

SEQ ID NO: 64308 - DNA, 20 bp, Artificial Sequence
  Description of Artificial Sequence: Synthetic oligonucleotide
  Target: SCN10A; (+) strand; PAM type: YTN; PAM sequence: TTT
tatttcttcctttttccctc

SEQ ID NO: 64309 - DNA, 20 bp, Artificial Sequence
  Description of Artificial Sequence: Synthetic oligonucleotide
  Target: SCN10A; (+) strand; PAM type: YTN; PAM sequence: TTT
atttcttcctttttccctcc

SEQ ID NO: 64310 - DNA, 20 bp, Artificial Sequence
  Description of Artificial Sequence: Synthetic oligonucleotide
  Target: SCN10A; (+) strand; PAM type: YTN; PAM sequence: TTA
tttcttcctttttccctcca

SEQ ID NO: 64311 - DNA, 20 bp, Artificial Sequence
  Description of Artificial Sequence: Synthetic oligonucleotide
  Target: SCN10A; (+) strand; PAM type: YTN; PAM sequence: TTT
cttcctttttccctccacct

SEQ ID NO: 64312 - DNA, 20 bp, Artificial Sequence
  Description of Artificial Sequence: Synthetic oligonucleotide
  Target: SCN10A; (+) strand; PAM type: YTN; PAM sequence: TTC
ttcctttttccctccacctt

SEQ ID NO: 64313 - DNA, 20 bp, Artificial Sequence
  Description of Artificial Sequence: Synthetic oligonucleotide
  Target: SCN10A; (+) strand; PAM type: YTN; PAM sequence: CTT
cctttttccctccaccttcc

SEQ ID NO: 64314 - DNA, 20 bp, Artificial Sequence
  Description of Artificial Sequence: Synthetic oligonucleotide
  Target: SCN10A; (+) strand; PAM type: YTN; PAM sequence: TTC
ctttttccctccaccttcct

SEQ ID NO: 64315 - DNA, 20 bp, Artificial Sequence
  Description of Artificial Sequence: Synthetic oligonucleotide
  Target: SCN10A; (+) strand; PAM type: YTN; PAM sequence: CTT
tttccctccaccttcctctc

SEQ ID NO: 64316 - DNA, 20 bp, Artificial Sequence
  Description of Artificial Sequence: Synthetic oligonucleotide
  Target: SCN10A; (+) strand; PAM type: YTN; PAM sequence: TTT
ttccctccaccttcctctct

SEQ ID NO: 64317 - DNA, 20 bp, Artificial Sequence
  Description of Artificial Sequence: Synthetic oligonucleotide
  Target: SCN10A; (+) strand; PAM type: YTN; PAM sequence: TTT
tccctccaccttcctctctt

SEQ ID NO: 64318 - DNA, 20 bp, Artificial Sequence
  Description of Artificial Sequence: Synthetic oligonucleotide
  Target: SCN10A; (+) strand; PAM type: YTN; PAM sequence: TTT
ccctccaccttcctctcttt

SEQ ID NO: 64319 - DNA, 20 bp, Artificial Sequence
  Description of Artificial Sequence: Synthetic oligonucleotide
  Target: SCN10A; (+) strand; PAM type: YTN; PAM sequence: TTC
cctccaccttcctctctttc

SEQ ID NO: 64320 - DNA, 20 bp, Artificial Sequence
  Description of Artificial Sequence: Synthetic oligonucleotide
  Target: SCN10A; (+) strand; PAM type: YTN; PAM sequence: CTC
caccttcctctctttctttc

SEQ ID NO: 64321 - DNA, 20 bp, Artificial Sequence
  Description of Artificial Sequence: Synthetic oligonucleotide
  Target: SCN10A; (+) strand; PAM type: YTN; PAM sequence: CTT
cctctctttctttccttcct

SEQ ID NO: 64322 - DNA, 20 bp, Artificial Sequence
  Description of Artificial Sequence: Synthetic oligonucleotide
  Target: SCN10A; (+) strand; PAM type: YTN; PAM sequence: TTC
ctctctttctttccttcctt

SEQ ID NO: 64323 - DNA, 20 bp, Artificial Sequence
  Description of Artificial Sequence: Synthetic oligonucleotide
  Target: SCN10A; (+) strand; PAM type: YTN; PAM sequence: CTC
tctttctttccttccttcaa

SEQ ID NO: 64324 - DNA, 20 bp, Artificial Sequence
  Description of Artificial Sequence: Synthetic oligonucleotide
  Target: SCN10A; (+) strand; PAM type: YTN; PAM sequence: CTC
tttctttccttccttcaatc

SEQ ID NO: 64325 - DNA, 20 bp, Artificial Sequence
  Description of Artificial Sequence: Synthetic oligonucleotide
  Target: SCN10A; (+) strand; PAM type: YTN; PAM sequence: CTT
tctttccttccttcaatcaa

SEQ ID NO: 64326 - DNA, 20 bp, Artificial Sequence
  Description of Artificial Sequence: Synthetic oligonucleotide
  Target: SCN10A; (+) strand; PAM type: YTN; PAM sequence: TTT
ctttccttccttcaatcaat

SEQ ID NO: 64327 - DNA, 20 bp, Artificial Sequence
  Description of Artificial Sequence: Synthetic oligonucleotide
  Target: SCN10A; (+) strand; PAM type: YTN; PAM sequence: TTC
tttccttccttcaatcaatc

SEQ ID NO: 64328 - DNA, 20 bp, Artificial Sequence
  Description of Artificial Sequence: Synthetic oligonucleotide
  Target: SCN10A; (+) strand; PAM type: YTN; PAM sequence: CTT
tccttccttcaatcaatcaa

SEQ ID NO: 64329 - DNA, 20 bp, Artificial Sequence
  Description of Artificial Sequence: Synthetic oligonucleotide
  Target: SCN10A; (+) strand; PAM type: YTN; PAM sequence: TTT
ccttccttcaatcaatcaac

SEQ ID NO: 64330 - DNA, 20 bp, Artificial Sequence
  Description of Artificial Sequence: Synthetic oligonucleotide
  Target: SCN10A; (+) strand; PAM type: YTN; PAM sequence: TTC
cttccttcaatcaatcaaca

SEQ ID NO: 64331 - DNA, 20 bp, Artificial Sequence
  Description of Artificial Sequence: Synthetic oligonucleotide
  Target: SCN10A; (+) strand; PAM type: YTN; PAM sequence: CTT
ccttcaatcaatcaacaggt

SEQ ID NO: 64332 - DNA, 20 bp, Artificial Sequence
  Description of Artificial Sequence: Synthetic oligonucleotide
  Target: SCN10A; (+) strand; PAM type: YTN; PAM sequence: TTC
cttcaatcaatcaacaggtg

SEQ ID NO: 64333 - DNA, 20 bp, Artificial Sequence
  Description of Artificial Sequence: Synthetic oligonucleotide
  Target: SCN10A; (+) strand; PAM type: YTN; PAM sequence: CTT
caatcaatcaacaggtgttt

SEQ ID NO: 64334 - DNA, 20 bp, Artificial Sequence
  Description of Artificial Sequence: Synthetic oligonucleotide
  Target: SCN10A; (+) strand; PAM type: YTN; PAM sequence: TTC
aatcaatcaacaggtgttta

SEQ ID NO: 64335 - DNA, 20 bp, Artificial Sequence
  Description of Artificial Sequence: Synthetic oligonucleotide
  Target: SCN10A; (+) strand; PAM type: YTN; PAM sequence: TTT
attgagttcctatgtatgtg

SEQ ID NO: 64336 - DNA, 20 bp, Artificial Sequence
  Description of Artificial Sequence: Synthetic oligonucleotide
  Target: SCN10A; (+) strand; PAM type: YTN; PAM sequence: TTA
ttgagttcctatgtatgtgc

SEQ ID NO: 64337 - DNA, 20 bp, Artificial Sequence
  Description of Artificial Sequence: Synthetic oligonucleotide
  Target: SCN10A; (+) strand; PAM type: YTN; PAM sequence: TTG
agttcctatgtatgtgctgg

SEQ ID NO: 64338 - DNA, 20 bp, Artificial Sequence
  Description of Artificial Sequence: Synthetic oligonucleotide
  Target: SCN10A; (+) strand; PAM type: YTN; PAM sequence: TTC
ctatgtatgtgctgggcctt

SEQ ID NO: 64339 - DNA, 20 bp, Artificial Sequence
  Description of Artificial Sequence: Synthetic oligonucleotide
  Target: SCN10A; (+) strand; PAM type: YTN; PAM sequence: CTA
tgtatgtgctgggccttgtg

SEQ ID NO: 64340 - DNA, 20 bp, Artificial Sequence
  Description of Artificial Sequence: Synthetic oligonucleotide
  Target: SCN10A; (+) strand; PAM type: YTN; PAM sequence: CTG
ggccttgtgctaggcccttg

SEQ ID NO: 64341 - DNA, 20 bp, Artificial Sequence
  Description of Artificial Sequence: Synthetic oligonucleotide
  Target: SCN10A; (+) strand; PAM type: YTN; PAM sequence: CTT
gtgctaggcccttgggataa

SEQ ID NO: 64342 - DNA, 20 bp, Artificial Sequence
  Description of Artificial Sequence: Synthetic oligonucleotide
  Target: SCN10A; (+) strand; PAM type: YTN; PAM sequence: TTG
tgctaggcccttgggataaa

SEQ ID NO: 64343 - DNA, 20 bp, Artificial Sequence
  Description of Artificial Sequence: Synthetic oligonucleotide
  Target: SCN10A; (+) strand; PAM type: YTN; PAM sequence: CTA
ggcccttgggataaaacggt

SEQ ID NO: 64344 - DNA, 20 bp, Artificial Sequence
  Description of Artificial Sequence: Synthetic oligonucleotide
  Target: SCN10A; (+) strand; PAM type: YTN; PAM sequence: CTT
gggataaaacggtagacaag

SEQ ID NO: 64345 - DNA, 20 bp, Artificial Sequence
  Description of Artificial Sequence: Synthetic oligonucleotide
  Target: SCN10A; (+) strand; PAM type: YTN; PAM sequence: TTG
ggataaaacggtagacaaga

SEQ ID NO: 64346 - DNA, 20 bp, Artificial Sequence
  Description of Artificial Sequence: Synthetic oligonucleotide
  Target: SCN10A; (+) strand; PAM type: YTN; PAM sequence: CTC
tggtttttgcctcatgggat

SEQ ID NO: 64347 - DNA, 20 bp, Artificial Sequence
  Description of Artificial Sequence: Synthetic oligonucleotide
  Target: SCN10A; (+) strand; PAM type: YTN; PAM sequence: CTG
gtttttgcctcatgggatag

SEQ ID NO: 64348 - DNA, 20 bp, Artificial Sequence
  Description of Artificial Sequence: Synthetic oligonucleotide
  Target: SCN10A; (+) strand; PAM type: YTN; PAM sequence: TTT
ttgcctcatgggatagcagg

SEQ ID NO: 64349 - DNA, 20 bp, Artificial Sequence
  Description of Artificial Sequence: Synthetic oligonucleotide
  Target: SCN10A; (+) strand; PAM type: YTN; PAM sequence: TTT
tgcctcatgggatagcagga

SEQ ID NO: 64350 - DNA, 20 bp, Artificial Sequence
  Description of Artificial Sequence: Synthetic oligonucleotide
  Target: SCN10A; (+) strand; PAM type: YTN; PAM sequence: TTT
gcctcatgggatagcaggac

SEQ ID NO: 64351 - DNA, 20 bp, Artificial Sequence
  Description of Artificial Sequence: Synthetic oligonucleotide
  Target: SCN10A; (+) strand; PAM type: YTN; PAM sequence: TTG
cctcatgggatagcaggaca

SEQ ID NO: 64352 - DNA, 20 bp, Artificial Sequence
  Description of Artificial Sequence: Synthetic oligonucleotide
  Target: SCN10A; (+) strand; PAM type: YTN; PAM sequence: CTC
atgggatagcaggacaattg

SEQ ID NO: 64353 - DNA, 20 bp, Artificial Sequence
  Description of Artificial Sequence: Synthetic oligonucleotide
  Target: SCN10A; (+) strand; PAM type: YTN; PAM sequence: TTG
taaatgccaggttaatttga

SEQ ID NO: 64354 - DNA, 20 bp, Artificial Sequence
  Description of Artificial Sequence: Synthetic oligonucleotide
  Target: SCN10A; (+) strand; PAM type: YTN; PAM sequence: TTA
atttgatgaaggaatccaac

SEQ ID NO: 64355 - DNA, 20 bp, Artificial Sequence
  Description of Artificial Sequence: Synthetic oligonucleotide
  Target: SCN10A; (+) strand; PAM type: YTN; PAM sequence: TTT
gatgaaggaatccaacttta

SEQ ID NO: 64356 - DNA, 20 bp, Artificial Sequence
  Description of Artificial Sequence: Synthetic oligonucleotide
  Target: SCN10A; (+) strand; PAM type: YTN; PAM sequence: TTG
atgaaggaatccaactttag

SEQ ID NO: 64357 - DNA, 20 bp, Artificial Sequence
  Description of Artificial Sequence: Synthetic oligonucleotide
  Target: SCN10A; (+) strand; PAM type: YTN; PAM sequence: CTT
tagatagtgtggttggggag

SEQ ID NO: 64358 - DNA, 20 bp, Artificial Sequence
  Description of Artificial Sequence: Synthetic oligonucleotide
  Target: SCN10A; (+) strand; PAM type: YTN; PAM sequence: TTT
agatagtgtggttggggagg

SEQ ID NO: 64359 - DNA, 20 bp, Artificial Sequence
  Description of Artificial Sequence: Synthetic oligonucleotide
  Target: SCN10A; (+) strand; PAM type: YTN; PAM sequence: TTA
gatagtgtggttggggaggt

SEQ ID NO: 64360 - DNA, 20 bp, Artificial Sequence
  Description of Artificial Sequence: Synthetic oligonucleotide
  Target: SCN10A; (+) strand; PAM type: YTN; PAM sequence: TTG
gggaggtcccctctaaggag

SEQ ID NO: 64361 - DNA, 20 bp, Artificial Sequence
  Description of Artificial Sequence: Synthetic oligonucleotide
  Target: SCN10A; (+) strand; PAM type: YTN; PAM sequence: CTC
taaggaggtgacaagtgcat

SEQ ID NO: 64362 - DNA, 20 bp, Artificial Sequence
  Description of Artificial Sequence: Synthetic oligonucleotide
  Target: SCN10A; (+) strand; PAM type: YTN; PAM sequence: CTA
aggaggtgacaagtgcattg

SEQ ID NO: 64363 - DNA, 20 bp, Artificial Sequence
  Description of Artificial Sequence: Synthetic oligonucleotide
  Target: SCN10A; (+) strand; PAM type: YTN; PAM sequence: TTG
aacacagagtttgagaataa

SEQ ID NO: 64364 - DNA, 20 bp, Artificial Sequence
  Description of Artificial Sequence: Synthetic oligonucleotide
  Target: SCN10A; (+) strand; PAM type: YTN; PAM sequence: TTT
gagaataagtgagctaagtg

SEQ ID NO: 64365 - DNA, 20 bp, Artificial Sequence
  Description of Artificial Sequence: Synthetic oligonucleotide
  Target: SCN10A; (+) strand; PAM type: YTN; PAM sequence: TTG
agaataagtgagctaagtga

SEQ ID NO: 64366 - DNA, 20 bp, Artificial Sequence
  Description of Artificial Sequence: Synthetic oligonucleotide
  Target: SCN10A; (+) strand; PAM type: YTN; PAM sequence: CTA
agtgaagactaaaggaaaag

SEQ ID NO: 64367 - DNA, 20 bp, Artificial Sequence
  Description of Artificial Sequence: Synthetic oligonucleotide
  Target: SCN10A; (+) strand; PAM type: YTN; PAM sequence: CTA
aaggaaaagtattccaggca

SEQ ID NO: 64368 - DNA, 20 bp, Artificial Sequence
  Description of Artificial Sequence: Synthetic oligonucleotide
  Target: SCN10A; (+) strand; PAM type: YTN; PAM sequence: TTC
caggcacagcgaaaaaaact

SEQ ID NO: 64369 - DNA, 20 bp, Artificial Sequence
  Description of Artificial Sequence: Synthetic oligonucleotide
  Target: SCN10A; (+) strand; PAM type: YTN; PAM sequence: CTT
caaaggcccaaagccaagaa

SEQ ID NO: 64370 - DNA, 20 bp, Artificial Sequence
  Description of Artificial Sequence: Synthetic oligonucleotide
  Target: SCN10A; (+) strand; PAM type: YTN; PAM sequence: TTC
aaaggcccaaagccaagaag

SEQ ID NO: 64371 - DNA, 20 bp, Artificial Sequence
  Description of Artificial Sequence: Synthetic oligonucleotide
  Target: SCN10A; (+) strand; PAM type: YTN; PAM sequence: TTC
tctgttatgtgtgaagaaga

SEQ ID NO: 64372 - DNA, 20 bp, Artificial Sequence
  Description of Artificial Sequence: Synthetic oligonucleotide
  Target: SCN10A; (+) strand; PAM type: YTN; PAM sequence: CTC
tgttatgtgtgaagaagaga

SEQ ID NO: 64373 - DNA, 20 bp, Artificial Sequence
  Description of Artificial Sequence: Synthetic oligonucleotide
  Target: SCN10A; (+) strand; PAM type: YTN; PAM sequence: CTG
ttatgtgtgaagaagagaga

SEQ ID NO: 64374 - DNA, 20 bp, Artificial Sequence
  Description of Artificial Sequence: Synthetic oligonucleotide
  Target: SCN10A; (+) strand; PAM type: YTN; PAM sequence: TTA
tgtgtgaagaagagagagta

SEQ ID NO: 64375 - DNA, 20 bp, Artificial Sequence
  Description of Artificial Sequence: Synthetic oligonucleotide
  Target: SCN10A; (+) strand; PAM type: YTN; PAM sequence: CTT
tttggctggagcaaagtggg

SEQ ID NO: 64376 - DNA, 20 bp, Artificial Sequence
  Description of Artificial Sequence: Synthetic oligonucleotide
  Target: SCN10A; (+) strand; PAM type: YTN; PAM sequence: TTT
ttggctggagcaaagtgggc

SEQ ID NO: 64377 - DNA, 20 bp, Artificial Sequence
  Description of Artificial Sequence: Synthetic oligonucleotide
  Target: SCN10A; (+) strand; PAM type: YTN; PAM sequence: TTT
tggctggagcaaagtgggca

SEQ ID NO: 64378 - DNA, 20 bp, Artificial Sequence
  Description of Artificial Sequence: Synthetic oligonucleotide
  Target: SCN10A; (+) strand; PAM type: YTN; PAM sequence: TTT
ggctggagcaaagtgggcaa

SEQ ID NO: 64379 - DNA, 20 bp, Artificial Sequence
  Description of Artificial Sequence: Synthetic oligonucleotide
  Target: SCN10A; (+) strand; PAM type: YTN; PAM sequence: TTG
gctggagcaaagtgggcaag

SEQ ID NO: 64380 - DNA, 20 bp, Artificial Sequence
  Description of Artificial Sequence: Synthetic oligonucleotide
  Target: SCN10A; (+) strand; PAM type: YTN; PAM sequence: CTG
gagcaaagtgggcaagacgg

SEQ ID NO: 64381 - DNA, 20 bp, Artificial Sequence
  Description of Artificial Sequence: Synthetic oligonucleotide
  Target: SCN10A; (+) strand; PAM type: YTN; PAM sequence: CTG
gtgaactggcaggtcctgat

SEQ ID NO: 64382 - DNA, 20 bp, Artificial Sequence
  Description of Artificial Sequence: Synthetic oligonucleotide
  Target: SCN10A; (+) strand; PAM type: YTN; PAM sequence: CTG
gcaggtcctgattatgcaga

SEQ ID NO: 64383 - DNA, 20 bp, Artificial Sequence
  Description of Artificial Sequence: Synthetic oligonucleotide
  Target: SCN10A; (+) strand; PAM type: YTN; PAM sequence: CTG
attatgcagaactttgtaca

SEQ ID NO: 64384 - DNA, 20 bp, Artificial Sequence
  Description of Artificial Sequence: Synthetic oligonucleotide
  Target: SCN10A; (+) strand; PAM type: YTN; PAM sequence: TTA
tgcagaactttgtacaccat

SEQ ID NO: 64385 - DNA, 20 bp, Artificial Sequence
  Description of Artificial Sequence: Synthetic oligonucleotide
  Target: SCN10A; (+) strand; PAM type: YTN; PAM sequence: CTT
tgtacaccatcatgaggagt

SEQ ID NO: 64386 - DNA, 20 bp, Artificial Sequence
  Description of Artificial Sequence: Synthetic oligonucleotide
  Target: SCN10A; (+) strand; PAM type: YTN; PAM sequence: TTT
gtacaccatcatgaggagtc

SEQ ID NO: 64387 - DNA, 20 bp, Artificial Sequence
  Description of Artificial Sequence: Synthetic oligonucleotide
  Target: SCN10A; (+) strand; PAM type: YTN; PAM sequence: TTG
tacaccatcatgaggagtct

SEQ ID NO: 64388 - DNA, 20 bp, Artificial Sequence
  Description of Artificial Sequence: Synthetic oligonucleotide
  Target: SCN10A; (+) strand; PAM type: YTN; PAM sequence: CTG
gattttattctcagagcaat

SEQ ID NO: 64389 - DNA, 20 bp, Artificial Sequence
  Description of Artificial Sequence: Synthetic oligonucleotide
  Target: SCN10A; (+) strand; PAM type: YTN; PAM sequence: TTT
tattctcagagcaatgggaa

SEQ ID NO: 64390 - DNA, 20 bp, Artificial Sequence
  Description of Artificial Sequence: Synthetic oligonucleotide
  Target: SCN10A; (+) strand; PAM type: YTN; PAM sequence: TTT
attctcagagcaatgggaaa

SEQ ID NO: 64391 - DNA, 20 bp, Artificial Sequence
  Description of Artificial Sequence: Synthetic oligonucleotide
  Target: SCN10A; (+) strand; PAM type: YTN; PAM sequence: TTA
ttctcagagcaatgggaaac

SEQ ID NO: 64392 - DNA, 20 bp, Artificial Sequence
  Description of Artificial Sequence: Synthetic oligonucleotide
  Target: SCN10A; (+) strand; PAM type: YTN; PAM sequence: TTC
tcagagcaatgggaaaccag

SEQ ID NO: 64393 - DNA, 20 bp, Artificial Sequence
  Description of Artificial Sequence: Synthetic oligonucleotide
  Target: SCN10A; (+) strand; PAM type: YTN; PAM sequence: CTC
agagcaatgggaaaccagtg

SEQ ID NO: 64394 - DNA, 20 bp, Artificial Sequence
  Description of Artificial Sequence: Synthetic oligonucleotide
  Target: SCN10A; (+) strand; PAM type: YTN; PAM sequence: TTA
tttgtaacaaatgtaggtac

SEQ ID NO: 64395 - DNA, 20 bp, Artificial Sequence
  Description of Artificial Sequence: Synthetic oligonucleotide
  Target: SCN10A; (+) strand; PAM type: YTN; PAM sequence: TTT
gtaacaaatgtaggtactaa

SEQ ID NO: 64396 - DNA, 20 bp, Artificial Sequence
  Description of Artificial Sequence: Synthetic oligonucleotide
  Target: SCN10A; (+) strand; PAM type: YTN; PAM sequence: TTG
taacaaatgtaggtactaac

SEQ ID NO: 64397 - DNA, 20 bp, Artificial Sequence
  Description of Artificial Sequence: Synthetic oligonucleotide
  Target: SCN10A; (+) strand; PAM type: YTN; PAM sequence: CTA
acataagatgttggtaatag

SEQ ID NO: 64398 - DNA, 20 bp, Artificial Sequence
  Description of Artificial Sequence: Synthetic oligonucleotide
  Target: SCN10A; (+) strand; PAM type: YTN; PAM sequence: TTG
gtaatagggaaactctgtgt

SEQ ID NO: 64399 - DNA, 20 bp, Artificial Sequence
  Description of Artificial Sequence: Synthetic oligonucleotide
  Target: SCN10A; (+) strand; PAM type: YTN; PAM sequence: CTC
tgtgtgtgtgtgtgtgtgtg

SEQ ID NO: 64400 - DNA, 20 bp, Artificial Sequence
  Description of Artificial Sequence: Synthetic oligonucleotide
  Target: SCN10A; (+) strand; PAM type: YTN; PAM sequence: CTG
tgtgtgtgtgtgtgtgtgtg

SEQ ID NO: 64401 - DNA, 20 bp, Artificial Sequence
  Description of Artificial Sequence: Synthetic oligonucleotide
  Target: SCN10A; (+) strand; PAM type: YTN; PAM sequence: TTG
tgggattgatggtatatgaa

SEQ ID NO: 64402 - DNA, 20 bp, Artificial Sequence
  Description of Artificial Sequence: Synthetic oligonucleotide
  Target: SCN10A; (+) strand; PAM type: YTN; PAM sequence: TTG
atggtatatgaaagctttct

SEQ ID NO: 64403 - DNA, 20 bp, Artificial Sequence
  Description of Artificial Sequence: Synthetic oligonucleotide
  Target: SCN10A; (+) strand; PAM type: YTN; PAM sequence: CTT
tctgttcaatctgctccagt

SEQ ID NO: 64404 - DNA, 20 bp, Artificial Sequence
  Description of Artificial Sequence: Synthetic oligonucleotide
  Target: SCN10A; (+) strand; PAM type: YTN; PAM sequence: TTT
ctgttcaatctgctccagtt

SEQ ID NO: 64405 - DNA, 20 bp, Artificial Sequence
  Description of Artificial Sequence: Synthetic oligonucleotide
  Target: SCN10A; (+) strand; PAM type: YTN; PAM sequence: TTC
tgttcaatctgctccagttt

SEQ ID NO: 64406 - DNA, 20 bp, Artificial Sequence
  Description of Artificial Sequence: Synthetic oligonucleotide
  Target: SCN10A; (+) strand; PAM type: YTN; PAM sequence: CTG
ttcaatctgctccagttttc

SEQ ID NO: 64407 - DNA, 20 bp, Artificial Sequence
  Description of Artificial Sequence: Synthetic oligonucleotide
  Target: SCN10A; (+) strand; PAM type: YTN; PAM sequence: TTC
aatctgctccagttttctga

SEQ ID NO: 64408 - DNA, 20 bp, Artificial Sequence
  Description of Artificial Sequence: Synthetic oligonucleotide
  Target: SCN10A; (+) strand; PAM type: YTN; PAM sequence: CTG
ctccagttttctgaaaactg

SEQ ID NO: 64409 - DNA, 20 bp, Artificial Sequence
  Description of Artificial Sequence: Synthetic oligonucleotide
  Target: SCN10A; (+) strand; PAM type: YTN; PAM sequence: CTC
cagttttctgaaaactgaaa

SEQ ID NO: 64410 - DNA, 20 bp, Artificial Sequence
  Description of Artificial Sequence: Synthetic oligonucleotide
  Target: SCN10A; (+) strand; PAM type: YTN; PAM sequence: TTT
tctgaaaactgaaaactgtc

SEQ ID NO: 64411 - DNA, 20 bp, Artificial Sequence
  Description of Artificial Sequence: Synthetic oligonucleotide
  Target: SCN10A; (+) strand; PAM type: YTN; PAM sequence: TTT
ctgaaaactgaaaactgtcc

SEQ ID NO: 64412 - DNA, 20 bp, Artificial Sequence
  Description of Artificial Sequence: Synthetic oligonucleotide
  Target: SCN10A; (+) strand; PAM type: YTN; PAM sequence: TTC
tgaaaactgaaaactgtcct

SEQ ID NO: 64413 - DNA, 20 bp, Artificial Sequence
  Description of Artificial Sequence: Synthetic oligonucleotide
  Target: SCN10A; (+) strand; PAM type: YTN; PAM sequence: CTG
aaaactgaaaactgtcctga

SEQ ID NO: 64414 - DNA, 20 bp, Artificial Sequence
  Description of Artificial Sequence: Synthetic oligonucleotide
  Target: SCN10A; (+) strand; PAM type: YTN; PAM sequence: CTG
aaaactgtcctgaaaataaa

SEQ ID NO: 64415 - DNA, 20 bp, Artificial Sequence
  Description of Artificial Sequence: Synthetic oligonucleotide
  Target: SCN10A; (+) strand; PAM type: YTN; PAM sequence: CTG
tcctgaaaataaagtctatt

SEQ ID NO: 64416 - DNA, 20 bp, Artificial Sequence
  Description of Artificial Sequence: Synthetic oligonucleotide
  Target: SCN10A; (+) strand; PAM type: YTN; PAM sequence: CTG
aaaataaagtctattaatta

SEQ ID NO: 64417 - DNA, 20 bp, Artificial Sequence
  Description of Artificial Sequence: Synthetic oligonucleotide
  Target: SCN10A; (+) strand; PAM type: YTN; PAM sequence: CTA
ttaattaaaaccaggaaact

SEQ ID NO: 64418 - DNA, 20 bp, Artificial Sequence
  Description of Artificial Sequence: Synthetic oligonucleotide
  Target: SCN10A; (+) strand; PAM type: YTN; PAM sequence: TTA
attaaaaccaggaaactgac

SEQ ID NO: 64419 - DNA, 20 bp, Artificial Sequence
  Description of Artificial Sequence: Synthetic oligonucleotide
  Target: SCN10A; (+) strand; PAM type: YTN; PAM sequence: TTA
aaaccaggaaactgaccagc

SEQ ID NO: 64420 - DNA, 20 bp, Artificial Sequence
  Description of Artificial Sequence: Synthetic oligonucleotide
  Target: SCN10A; (+) strand; PAM type: YTN; PAM sequence: CTG
accagctggcggtgattttt

SEQ ID NO: 64421 - DNA, 20 bp, Artificial Sequence
  Description of Artificial Sequence: Synthetic oligonucleotide
  Target: SCN10A; (+) strand; PAM type: YTN; PAM sequence: CTG
gcggtgatttttctccagca

SEQ ID NO: 64422 - DNA, 20 bp, Artificial Sequence
  Description of Artificial Sequence: Synthetic oligonucleotide
  Target: SCN10A; (+) strand; PAM type: YTN; PAM sequence: TTT
ttctccagcatttctcacag

SEQ ID NO: 64423 - DNA, 20 bp, Artificial Sequence
  Description of Artificial Sequence: Synthetic oligonucleotide
  Target: SCN10A; (+) strand; PAM type: YTN; PAM sequence: TTT
tctccagcatttctcacagc

SEQ ID NO: 64424 - DNA, 20 bp, Artificial Sequence
  Description of Artificial Sequence: Synthetic oligonucleotide
  Target: SCN10A; (+) strand; PAM type: YTN; PAM sequence: TTT
ctccagcatttctcacagct

SEQ ID NO: 64425 - DNA, 20 bp, Artificial Sequence
  Description of Artificial Sequence: Synthetic oligonucleotide
  Target: SCN10A; (+) strand; PAM type: YTN; PAM sequence: TTC
tccagcatttctcacagctc

SEQ ID NO: 64426 - DNA, 20 bp, Artificial Sequence
  Description of Artificial Sequence: Synthetic oligonucleotide
  Target: SCN10A; (+) strand; PAM type: YTN; PAM sequence: CTC
cagcatttctcacagctcag

SEQ ID NO: 64427 - DNA, 20 bp, Artificial Sequence
  Description of Artificial Sequence: Synthetic oligonucleotide
  Target: SCN10A; (+) strand; PAM type: YTN; PAM sequence: TTT
ctcacagctcaggtgcagac

SEQ ID NO: 64428 - DNA, 20 bp, Artificial Sequence
  Description of Artificial Sequence: Synthetic oligonucleotide
  Target: SCN10A; (+) strand; PAM type: YTN; PAM sequence: TTC
tcacagctcaggtgcagaca

SEQ ID NO: 64429 - DNA, 20 bp, Artificial Sequence
  Description of Artificial Sequence: Synthetic oligonucleotide
  Target: SCN10A; (+) strand; PAM type: YTN; PAM sequence: CTC
acagctcaggtgcagacaag

SEQ ID NO: 64430 - DNA, 20 bp, Artificial Sequence
  Description of Artificial Sequence: Synthetic oligonucleotide
  Target: SCN10A; (+) strand; PAM type: YTN; PAM sequence: CTC
aggtgcagacaaggtggaga

SEQ ID NO: 64431 - DNA, 20 bp, Artificial Sequence
  Description of Artificial Sequence: Synthetic oligonucleotide
  Target: SCN10A; (+) strand; PAM type: YTN; PAM sequence: TTT
gacttagactctccggtgag

SEQ ID NO: 64432 - DNA, 20 bp, Artificial Sequence
  Description of Artificial Sequence: Synthetic oligonucleotide
  Target: SCN10A; (+) strand; PAM type: YTN; PAM sequence: TTG
acttagactctccggtgagg

SEQ ID NO: 64433 - DNA, 20 bp, Artificial Sequence
  Description of Artificial Sequence: Synthetic oligonucleotide
  Target: SCN10A; (+) strand; PAM type: YTN; PAM sequence: CTT
agactctccggtgaggtttt

SEQ ID NO: 64434 - DNA, 20 bp, Artificial Sequence
  Description of Artificial Sequence: Synthetic oligonucleotide
  Target: SCN10A; (+) strand; PAM type: YTN; PAM sequence: TTA
gactctccggtgaggttttg

SEQ ID NO: 64435 - DNA, 20 bp, Artificial Sequence
  Description of Artificial Sequence: Synthetic oligonucleotide
  Target: SCN10A; (+) strand; PAM type: YTN; PAM sequence: CTC
tccggtgaggttttggcaaa

SEQ ID NO: 64436 - DNA, 20 bp, Artificial Sequence
  Description of Artificial Sequence: Synthetic oligonucleotide
  Target: SCN10A; (+) strand; PAM type: YTN; PAM sequence: CTC
cggtgaggttttggcaaaca

SEQ ID NO: 64437 - DNA, 20 bp, Artificial Sequence
  Description of Artificial Sequence: Synthetic oligonucleotide
  Target: SCN10A; (+) strand; PAM type: YTN; PAM sequence: TTT
tggcaaacacaaaaacgcaa

SEQ ID NO: 64438 - DNA, 20 bp, Artificial Sequence
  Description of Artificial Sequence: Synthetic oligonucleotide
  Target: SCN10A; (+) strand; PAM type: YTN; PAM sequence: TTT
ggcaaacacaaaaacgcaaa

SEQ ID NO: 64439 - DNA, 20 bp, Artificial Sequence
  Description of Artificial Sequence: Synthetic oligonucleotide
  Target: SCN10A; (+) strand; PAM type: YTN; PAM sequence: TTG
gcaaacacaaaaacgcaaag

SEQ ID NO: 64440 - DNA, 20 bp, Artificial Sequence
  Description of Artificial Sequence: Synthetic oligonucleotide
  Target: SCN10A; (+) strand; PAM type: YTN; PAM sequence: TTG
agtttgttttcaagggcata

SEQ ID NO: 64441 - DNA, 20 bp, Artificial Sequence
  Description of Artificial Sequence: Synthetic oligonucleotide
  Target: SCN10A; (+) strand; PAM type: YTN; PAM sequence: TTT
gttttcaagggcataataat

SEQ ID NO: 64442 - DNA, 20 bp, Artificial Sequence
  Description of Artificial Sequence: Synthetic oligonucleotide
  Target: SCN10A; (+) strand; PAM type: YTN; PAM sequence: TTG
ttttcaagggcataataata

SEQ ID NO: 64443 - DNA, 20 bp, Artificial Sequence
  Description of Artificial Sequence: Synthetic oligonucleotide
  Target: SCN10A; (+) strand; PAM type: YTN; PAM sequence: TTT
tcaagggcataataatattg

SEQ ID NO: 64444 - DNA, 20 bp, Artificial Sequence
  Description of Artificial Sequence: Synthetic oligonucleotide
  Target: SCN10A; (+) strand; PAM type: YTN; PAM sequence: TTT
caagggcataataatattgg

SEQ ID NO: 64445 - DNA, 20 bp, Artificial Sequence
  Description of Artificial Sequence: Synthetic oligonucleotide
  Target: SCN10A; (+) strand; PAM type: YTN; PAM sequence: TTC
aagggcataataatattggt

SEQ ID NO: 64446 - DNA, 20 bp, Artificial Sequence
  Description of Artificial Sequence: Synthetic oligonucleotide
  Target: SCN10A; (+) strand; PAM type: YTN; PAM sequence: TTG
gtgggctgtgaaatctaagc

SEQ ID NO: 64447 - DNA, 20 bp, Artificial Sequence
  Description of Artificial Sequence: Synthetic oligonucleotide
  Target: SCN10A; (+) strand; PAM type: YTN; PAM sequence: CTG
tgaaatctaagctaggtcat

SEQ ID NO: 64448 - DNA, 20 bp, Artificial Sequence
  Description of Artificial Sequence: Synthetic oligonucleotide
  Target: SCN10A; (+) strand; PAM type: YTN; PAM sequence: CTA
agctaggtcatgagggaagt

SEQ ID NO: 64449 - DNA, 20 bp, Artificial Sequence
  Description of Artificial Sequence: Synthetic oligonucleotide
  Target: SCN10A; (+) strand; PAM type: YTN; PAM sequence: CTA
ggtcatgagggaagtggaat

SEQ ID NO: 64450 - DNA, 20 bp, Artificial Sequence
  Description of Artificial Sequence: Synthetic oligonucleotide
  Target: SCN10A; (+) strand; PAM type: YTN; PAM sequence: TTG
gtgggtgtggttagggaatt

SEQ ID NO: 64451 - DNA, 20 bp, Artificial Sequence
  Description of Artificial Sequence: Synthetic oligonucleotide
  Target: SCN10A; (+) strand; PAM type: YTN; PAM sequence: TTA
gggaattgagcactgatcag

SEQ ID NO: 64452 - DNA, 20 bp, Artificial Sequence
  Description of Artificial Sequence: Synthetic oligonucleotide
  Target: SCN10A; (+) strand; PAM type: YTN; PAM sequence: TTG
agcactgatcagcatgttaa

SEQ ID NO: 64453 - DNA, 20 bp, Artificial Sequence
  Description of Artificial Sequence: Synthetic oligonucleotide
  Target: SCN10A; (+) strand; PAM type: YTN; PAM sequence: CTG
atcagcatgttaaatcagcg

SEQ ID NO: 64454 - DNA, 20 bp, Artificial Sequence
  Description of Artificial Sequence: Synthetic oligonucleotide
  Target: SCN10A; (+) strand; PAM type: YTN; PAM sequence: TTA
aatcagcgaggtggggacag

SEQ ID NO: 64455 - DNA, 20 bp, Artificial Sequence
  Description of Artificial Sequence: Synthetic oligonucleotide
  Target: SCN10A; (+) strand; PAM type: YTN; PAM sequence: TTC
ccctgcagaatcctgtaggg

SEQ ID NO: 64456 - DNA, 20 bp, Artificial Sequence
  Description of Artificial Sequence: Synthetic oligonucleotide
  Target: SCN10A; (+) strand; PAM type: YTN; PAM sequence: CTG
cagaatcctgtaggggcaga

SEQ ID NO: 64457 - DNA, 20 bp, Artificial Sequence
  Description of Artificial Sequence: Synthetic oligonucleotide
  Target: SCN10A; (+) strand; PAM type: YTN; PAM sequence: CTG
taggggcagactgtgaagta

SEQ ID NO: 64458 - DNA, 20 bp, Artificial Sequence
  Description of Artificial Sequence: Synthetic oligonucleotide
  Target: SCN10A; (+) strand; PAM type: YTN; PAM sequence: CTG
tgaagtaaacttgcctattt

SEQ ID NO: 64459 - DNA, 20 bp, Artificial Sequence
  Description of Artificial Sequence: Synthetic oligonucleotide
  Target: SCN10A; (+) strand; PAM type: YTN; PAM sequence: CTT
gcctatttttggttgtttgg

SEQ ID NO: 64460 - DNA, 20 bp, Artificial Sequence
  Description of Artificial Sequence: Synthetic oligonucleotide
  Target: SCN10A; (+) strand; PAM type: YTN; PAM sequence: TTG
cctatttttggttgtttggg

SEQ ID NO: 64461 - DNA, 20 bp, Artificial Sequence
  Description of Artificial Sequence: Synthetic oligonucleotide
  Target: SCN10A; (+) strand; PAM type: YTN; PAM sequence: CTA
tttttggttgtttgggactt

SEQ ID NO: 64462 - DNA, 20 bp, Artificial Sequence
  Description of Artificial Sequence: Synthetic oligonucleotide
  Target: SCN10A; (+) strand; PAM type: YTN; PAM sequence: TTT
ttggttgtttgggactttag

SEQ ID NO: 64463 - DNA, 20 bp, Artificial Sequence
  Description of Artificial Sequence: Synthetic oligonucleotide
  Target: SCN10A; (+) strand; PAM type: YTN; PAM sequence: TTT
tggttgtttgggactttaga

SEQ ID NO: 64464 - DNA, 20 bp, Artificial Sequence
  Description of Artificial Sequence: Synthetic oligonucleotide
  Target: SCN10A; (+) strand; PAM type: YTN; PAM sequence: TTT
ggttgtttgggactttagac

SEQ ID NO: 64465 - DNA, 20 bp, Artificial Sequence
  Description of Artificial Sequence: Synthetic oligonucleotide
  Target: SCN10A; (+) strand; PAM type: YTN; PAM sequence: TTG
gttgtttgggactttagact

SEQ ID NO: 64466 - DNA, 20 bp, Artificial Sequence
  Description of Artificial Sequence: Synthetic oligonucleotide
  Target: SCN10A; (+) strand; PAM type: YTN; PAM sequence: TTG
tttgggactttagactgtgg

SEQ ID NO: 64467 - DNA, 20 bp, Artificial Sequence
  Description of Artificial Sequence: Synthetic oligonucleotide
  Target: SCN10A; (+) strand; PAM type: YTN; PAM sequence: TTT
gggactttagactgtgggat

SEQ ID NO: 64468 - DNA, 20 bp, Artificial Sequence
  Description of Artificial Sequence: Synthetic oligonucleotide
  Target: SCN10A; (+) strand; PAM type: YTN; PAM sequence: TTG
ggactttagactgtgggatc

SEQ ID NO: 64469 - DNA, 20 bp, Artificial Sequence
  Description of Artificial Sequence: Synthetic oligonucleotide
  Target: SCN10A; (+) strand; PAM type: YTN; PAM sequence: CTT
tagactgtgggatcagaaca

SEQ ID NO: 64470 - DNA, 20 bp, Artificial Sequence
  Description of Artificial Sequence: Synthetic oligonucleotide
  Target: SCN10A; (+) strand; PAM type: YTN; PAM sequence: TTT
agactgtgggatcagaacaa

SEQ ID NO: 64471 - DNA, 20 bp, Artificial Sequence
  Description of Artificial Sequence: Synthetic oligonucleotide
  Target: SCN10A; (+) strand; PAM type: YTN; PAM sequence: TTA
gactgtgggatcagaacaaa

SEQ ID NO: 64472 - DNA, 20 bp, Artificial Sequence
  Description of Artificial Sequence: Synthetic oligonucleotide
  Target: SCN10A; (+) strand; PAM type: YTN; PAM sequence: CTG
tgggatcagaacaaaagtag

SEQ ID NO: 64473 - DNA, 20 bp, Artificial Sequence
  Description of Artificial Sequence: Synthetic oligonucleotide
  Target: SCN10A; (+) strand; PAM type: YTN; PAM sequence: CTT
aaaacactaagcttctgctt

SEQ ID NO: 64474 - DNA, 20 bp, Artificial Sequence
  Description of Artificial Sequence: Synthetic oligonucleotide
  Target: SCN10A; (+) strand; PAM type: YTN; PAM sequence: TTA
aaacactaagcttctgcttc

SEQ ID NO: 64475 - DNA, 20 bp, Artificial Sequence
  Description of Artificial Sequence: Synthetic oligonucleotide
  Target: SCN10A; (+) strand; PAM type: YTN; PAM sequence: CTA
agcttctgcttccccaagtg

SEQ ID NO: 64476 - DNA, 20 bp, Artificial Sequence
  Description of Artificial Sequence: Synthetic oligonucleotide
  Target: SCN10A; (+) strand; PAM type: YTN; PAM sequence: CTT
ctgcttccccaagtgtagca

SEQ ID NO: 64477 - DNA, 20 bp, Artificial Sequence
  Description of Artificial Sequence: Synthetic oligonucleotide
  Target: SCN10A; (+) strand; PAM type: YTN; PAM sequence: TTC
tgcttccccaagtgtagcag

SEQ ID NO: 64478 - DNA, 20 bp, Artificial Sequence
  Description of Artificial Sequence: Synthetic oligonucleotide
  Target: SCN10A; (+) strand; PAM type: YTN; PAM sequence: CTG
cttccccaagtgtagcagaa

SEQ ID NO: 64479 - DNA, 20 bp, Artificial Sequence
  Description of Artificial Sequence: Synthetic oligonucleotide
  Target: SCN10A; (+) strand; PAM type: YTN; PAM sequence: CTT
ccccaagtgtagcagaaatg

SEQ ID NO: 64480 - DNA, 20 bp, Artificial Sequence
  Description of Artificial Sequence: Synthetic oligonucleotide
  Target: SCN10A; (+) strand; PAM type: YTN; PAM sequence: TTC
cccaagtgtagcagaaatgt

SEQ ID NO: 64481 - DNA, 20 bp, Artificial Sequence
  Description of Artificial Sequence: Synthetic oligonucleotide
  Target: SCN10A; (+) strand; PAM type: YTN; PAM sequence: TTC
gttttttttttttttttttt

SEQ ID NO: 64482 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 64483 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 64484 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttt

SEQ ID NO: 64485 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttttg

SEQ ID NO: 64486 - DNA, 20 bp, Artificial Sequence
  Description of Artificial Sequence: Synthetic oligonucleotide
  Target: SCN10A; (+) strand; PAM type: YTN; PAM sequence: TTT
ttttttttttttttttttga

SEQ ID NO: 64487 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttgag

SEQ ID NO: 64488 - DNA, 20 bp, Artificial Sequence
  Description of Artificial Sequence: Synthetic oligonucleotide
  Target: SCN10A; (+) strand; PAM type: YTN; PAM sequence: TTT
ttttttttttttttttgaga

SEQ ID NO: 64489 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttgagac

SEQ ID NO: 64490 - DNA, 20 bp, Artificial Sequence
  Description of Artificial Sequence: Synthetic oligonucleotide
  Target: SCN10A; (+) strand; PAM type: YTN; PAM sequence: TTT
ttttttttttttttgagacg

SEQ ID NO: 64491 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttgagacgg

SEQ ID NO: 64492 - DNA, 20 bp, Artificial Sequence
  Description of Artificial Sequence: Synthetic oligonucleotide
  Target: SCN10A; (+) strand; PAM type: YTN; PAM sequence: TTT
ttttttttttttgagacgga

SEQ ID NO: 64493 - DNA, 20 bp, Artificial Sequence
  Description of Artificial Sequence: Synthetic oligonucleotide
  Target: SCN10A; (+) strand; PAM type: YTN; PAM sequence: TTT
tttttttttttgagacggag

SEQ ID NO: 64494 - DNA, 20 bp, Artificial Sequence
  Description of Artificial Sequence: Synthetic oligonucleotide
  Target: SCN10A; (+) strand; PAM type: YTN; PAM sequence: TTT
ttttttttttgagacggagt

SEQ ID NO: 64495 - DNA, 20 bp, Artificial Sequence
  Description of Artificial Sequence: Synthetic oligonucleotide
  Target: SCN10A; (+) strand; PAM type: YTN; PAM sequence: TTT
tttttttttgagacggagtc

SEQ ID NO: 64496 - DNA, 20 bp, Artificial Sequence
  Description of Artificial Sequence: Synthetic oligonucleotide
  Target: SCN10A; (+) strand; PAM type: YTN; PAM sequence: TTT
ttttttttgagacggagtcc

SEQ ID NO: 64497 - DNA, 20 bp, Artificial Sequence
  Description of Artificial Sequence: Synthetic oligonucleotide
  Target: SCN10A; (+) strand; PAM type: YTN; PAM sequence: TTT
tttttttgagacggagtccc

SEQ ID NO: 64498 - DNA, 20 bp, Artificial Sequence
  Description of Artificial Sequence: Synthetic oligonucleotide
  Target: SCN10A; (+) strand; PAM type: YTN; PAM sequence: TTT
ttttttgagacggagtcccg

SEQ ID NO: 64499 - DNA, 20 bp, Artificial Sequence
  Description of Artificial Sequence: Synthetic oligonucleotide
  Target: SCN10A; (+) strand; PAM type: YTN; PAM sequence: TTT
tttttgagacggagtcccgc

SEQ ID NO: 64500 - DNA, 20 bp, Artificial Sequence
  Description of Artificial Sequence: Synthetic oligonucleotide
  Target: SCN10A; (+) strand; PAM type: YTN; PAM sequence: TTT
ttttgagacggagtcccgct

SEQ ID NO: 64501 - DNA, 20 bp, Artificial Sequence
  Description of Artificial Sequence: Synthetic oligonucleotide
  Target: SCN10A; (+) strand; PAM type: YTN; PAM sequence: TTT
tttgagacggagtcccgctg

SEQ ID NO: 64502 - DNA, 20 bp, Artificial Sequence
  Description of Artificial Sequence: Synthetic oligonucleotide
  Target: SCN10A; (+) strand; PAM type: YTN; PAM sequence: TTT
ttgagacggagtcccgctgt

SEQ ID NO: 64503 - DNA, 20 bp, Artificial Sequence
  Description of Artificial Sequence: Synthetic oligonucleotide
  Target: SCN10A; (+) strand; PAM type: YTN; PAM sequence: TTT
tgagacggagtcccgctgtt

SEQ ID NO: 64504 - DNA, 20 bp, Artificial Sequence
  Description of Artificial Sequence: Synthetic oligonucleotide
  Target: SCN10A; (+) strand; PAM type: YTN; PAM sequence: TTT
gagacggagtcccgctgttt

SEQ ID NO: 64505 - DNA, 20 bp, Artificial Sequence
  Description of Artificial Sequence: Synthetic oligonucleotide
  Target: SCN10A; (+) strand; PAM type: YTN; PAM sequence: TTG
agacggagtcccgctgttta

SEQ ID NO: 64506 - DNA, 20 bp, Artificial Sequence
  Description of Artificial Sequence: Synthetic oligonucleotide
  Target: SCN10A; (+) strand; PAM type: YTN; PAM sequence: CTG
tttagcccaggccggattgc

SEQ ID NO: 64507 - DNA, 20 bp, Artificial Sequence
  Description of Artificial Sequence: Synthetic oligonucleotide
  Target: SCN10A; (+) strand; PAM type: YTN; PAM sequence: TTT
agcccaggccggattgcagt

SEQ ID NO: 64508 - DNA, 20 bp, Artificial Sequence
  Description of Artificial Sequence: Synthetic oligonucleotide
  Target: SCN10A; (+) strand; PAM type: YTN; PAM sequence: TTA
gcccaggccggattgcagtg

SEQ ID NO: 64509 - DNA, 20 bp, Artificial Sequence
  Description of Artificial Sequence: Synthetic oligonucleotide
  Target: SCN10A; (+) strand; PAM type: YTN; PAM sequence: TTG
cagtggcgcaatctcggctc

SEQ ID NO: 64510 - DNA, 20 bp, Artificial Sequence
  Description of Artificial Sequence: Synthetic oligonucleotide
  Target: SCN10A; (+) strand; PAM type: YTN; PAM sequence: CTC
ggctcactgtaagctccgcc

SEQ ID NO: 64511 - DNA, 20 bp, Artificial Sequence
  Description of Artificial Sequence: Synthetic oligonucleotide
  Target: SCN10A; (+) strand; PAM type: YTN; PAM sequence: CTC
actgtaagctccgcctccca

SEQ ID NO: 64512 - DNA, 20 bp, Artificial Sequence
  Description of Artificial Sequence: Synthetic oligonucleotide
  Target: SCN10A; (+) strand; PAM type: YTN; PAM sequence: CTG
taagctccgcctcccaggtt

SEQ ID NO: 64513 - DNA, 20 bp, Artificial Sequence
  Description of Artificial Sequence: Synthetic oligonucleotide
  Target: SCN10A; (+) strand; PAM type: YTN; PAM sequence: CTC
cgcctcccaggttcacgcca

SEQ ID NO: 64514 - DNA, 20 bp, Artificial Sequence
  Description of Artificial Sequence: Synthetic oligonucleotide
  Target: SCN10A; (+) strand; PAM type: YTN; PAM sequence: CTC
ccaggttcacgccattctcc

SEQ ID NO: 64515 - DNA, 20 bp, Artificial Sequence
  Description of Artificial Sequence: Synthetic oligonucleotide
  Target: SCN10A; (+) strand; PAM type: YTN; PAM sequence: TTC
acgccattctcctgcctcag

SEQ ID NO: 64516 - DNA, 20 bp, Artificial Sequence
  Description of Artificial Sequence: Synthetic oligonucleotide
  Target: SCN10A; (+) strand; PAM type: YTN; PAM sequence: TTC
tcctgcctcagcctcccgag

SEQ ID NO: 64517 - DNA, 20 bp, Artificial Sequence
  Description of Artificial Sequence: Synthetic oligonucleotide
  Target: SCN10A; (+) strand; PAM type: YTN; PAM sequence: CTC
ctgcctcagcctcccgagta

SEQ ID NO: 64518 - DNA, 20 bp, Artificial Sequence
  Description of Artificial Sequence: Synthetic oligonucleotide
  Target: SCN10A; (+) strand; PAM type: YTN; PAM sequence: CTG
cctcagcctcccgagtagct

SEQ ID NO: 64519 - DNA, 20 bp, Artificial Sequence
  Description of Artificial Sequence: Synthetic oligonucleotide
  Target: SCN10A; (+) strand; PAM type: YTN; PAM sequence: CTC
agcctcccgagtagctggga

SEQ ID NO: 64520 - DNA, 20 bp, Artificial Sequence
  Description of Artificial Sequence: Synthetic oligonucleotide
  Target: SCN10A; (+) strand; PAM type: YTN; PAM sequence: CTC
ccgagtagctgggactacag

SEQ ID NO: 64521 - DNA, 20 bp, Artificial Sequence
  Description of Artificial Sequence: Synthetic oligonucleotide
  Target: SCN10A; (+) strand; PAM type: YTN; PAM sequence: CTG
ggactacaggcgcccgccac

SEQ ID NO: 64522 - DNA, 20 bp, Artificial Sequence
  Description of Artificial Sequence: Synthetic oligonucleotide
  Target: SCN10A; (+) strand; PAM type: YTN; PAM sequence: CTA
caggcgcccgccaccgtgcc

SEQ ID NO: 64523 - DNA, 20 bp, Artificial Sequence
  Description of Artificial Sequence: Synthetic oligonucleotide
  Target: SCN10A; (+) strand; PAM type: YTN; PAM sequence: CTA
attttttgtatttttagtag

SEQ ID NO: 64524 - DNA, 20 bp, Artificial Sequence
  Description of Artificial Sequence: Synthetic oligonucleotide
  Target: SCN10A; (+) strand; PAM type: YTN; PAM sequence: TTT
tttgtatttttagtagagac

SEQ ID NO: 64525 - DNA, 20 bp, Artificial Sequence
  Description of Artificial Sequence: Synthetic oligonucleotide
  Target: SCN10A; (+) strand; PAM type: YTN; PAM sequence: TTT
ttgtatttttagtagagacg

SEQ ID NO: 64526 - DNA, 20 bp, Artificial Sequence
  Description of Artificial Sequence: Synthetic oligonucleotide
  Target: SCN10A; (+) strand; PAM type: YTN; PAM sequence: TTT
tgtatttttagtagagacgg

SEQ ID NO: 64527 - DNA, 20 bp, Artificial Sequence
  Description of Artificial Sequence: Synthetic oligonucleotide
  Target: SCN10A; (+) strand; PAM type: YTN; PAM sequence: TTT
gtatttttagtagagacggg

SEQ ID NO: 64528 - DNA, 20 bp, Artificial Sequence
  Description of Artificial Sequence: Synthetic oligonucleotide
  Target: SCN10A; (+) strand; PAM type: YTN; PAM sequence: TTG
tatttttagtagagacgggg

SEQ ID NO: 64529 - DNA, 20 bp, Artificial Sequence
  Description of Artificial Sequence: Synthetic oligonucleotide
  Target: SCN10A; (+) strand; PAM type: YTN; PAM sequence: TTT
ttagtagagacggggtttca

SEQ ID NO: 64530 - DNA, 20 bp, Artificial Sequence
  Description of Artificial Sequence: Synthetic oligonucleotide
  Target: SCN10A; (+) strand; PAM type: YTN; PAM sequence: TTT
tagtagagacggggtttcac

SEQ ID NO: 64531 - DNA, 20 bp, Artificial Sequence
  Description of Artificial Sequence: Synthetic oligonucleotide
  Target: SCN10A; (+) strand; PAM type: YTN; PAM sequence: TTT
agtagagacggggtttcacc

SEQ ID NO: 64532 - DNA, 20 bp, Artificial Sequence
  Description of Artificial Sequence: Synthetic oligonucleotide
  Target: SCN10A; (+) strand; PAM type: YTN; PAM sequence: TTA
gtagagacggggtttcaccg

SEQ ID NO: 64533 - DNA, 20 bp, Artificial Sequence
  Description of Artificial Sequence: Synthetic oligonucleotide
  Target: SCN10A; (+) strand; PAM type: YTN; PAM sequence: TTT
caccgtgttagccaagatgg

SEQ ID NO: 64534 - DNA, 20 bp, Artificial Sequence
  Description of Artificial Sequence: Synthetic oligonucleotide
  Target: SCN10A; (+) strand; PAM type: YTN; PAM sequence: TTC
accgtgttagccaagatggt

SEQ ID NO: 64535 - DNA, 20 bp, Artificial Sequence
  Description of Artificial Sequence: Synthetic oligonucleotide
  Target: SCN10A; (+) strand; PAM type: YTN; PAM sequence: TTA
gccaagatggtctcgatctc

SEQ ID NO: 64536 - DNA, 20 bp, Artificial Sequence
  Description of Artificial Sequence: Synthetic oligonucleotide
  Target: SCN10A; (+) strand; PAM type: YTN; PAM sequence: CTC
gatctcctgaccttgtgatc

SEQ ID NO: 64537 - DNA, 20 bp, Artificial Sequence
  Description of Artificial Sequence: Synthetic oligonucleotide
  Target: SCN10A; (+) strand; PAM type: YTN; PAM sequence: CTC
ctgaccttgtgatccgcctg

SEQ ID NO: 64538 - DNA, 20 bp, Artificial Sequence
  Description of Artificial Sequence: Synthetic oligonucleotide
  Target: SCN10A; (+) strand; PAM type: YTN; PAM sequence: CTG
accttgtgatccgcctgcct

SEQ ID NO: 64539 - DNA, 20 bp, Artificial Sequence
  Description of Artificial Sequence: Synthetic oligonucleotide
  Target: SCN10A; (+) strand; PAM type: YTN; PAM sequence: CTT
gtgatccgcctgcctcggcc

SEQ ID NO: 64540 - DNA, 20 bp, Artificial Sequence
  Description of Artificial Sequence: Synthetic oligonucleotide
  Target: SCN10A; (+) strand; PAM type: YTN; PAM sequence: TTG
tgatccgcctgcctcggcct

SEQ ID NO: 64541 - DNA, 20 bp, Artificial Sequence
  Description of Artificial Sequence: Synthetic oligonucleotide
  Target: SCN10A; (+) strand; PAM type: YTN; PAM sequence: CTG
cctcggcctcccaaagtgct

SEQ ID NO: 64542 - DNA, 20 bp, Artificial Sequence
  Description of Artificial Sequence: Synthetic oligonucleotide
  Target: SCN10A; (+) strand; PAM type: YTN; PAM sequence: CTC
ggcctcccaaagtgctggga

SEQ ID NO: 64543 - DNA, 20 bp, Artificial Sequence
  Description of Artificial Sequence: Synthetic oligonucleotide
  Target: SCN10A; (+) strand; PAM type: YTN; PAM sequence: CTC
ccaaagtgctgggattacag

SEQ ID NO: 64544 - DNA, 20 bp, Artificial Sequence
  Description of Artificial Sequence: Synthetic oligonucleotide
  Target: SCN10A; (+) strand; PAM type: YTN; PAM sequence: CTG
ggattacaggcgtgagccac

SEQ ID NO: 64545 - DNA, 20 bp, Artificial Sequence
  Description of Artificial Sequence: Synthetic oligonucleotide
  Target: SCN10A; (+) strand; PAM type: YTN; PAM sequence: TTA
caggcgtgagccaccgcgcc

SEQ ID NO: 64546 - DNA, 20 bp, Artificial Sequence
  Description of Artificial Sequence: Synthetic oligonucleotide
  Target: SCN10A; (+) strand; PAM type: YTN; PAM sequence: CTC
gtattttattagaaaactaa

SEQ ID NO: 64547 - DNA, 20 bp, Artificial Sequence
  Description of Artificial Sequence: Synthetic oligonucleotide
  Target: SCN10A; (+) strand; PAM type: YTN; PAM sequence: TTT
tattagaaaactaactgtgg

SEQ ID NO: 64548 - DNA, 20 bp, Artificial Sequence
  Description of Artificial Sequence: Synthetic oligonucleotide
  Target: SCN10A; (+) strand; PAM type: YTN; PAM sequence: TTT
attagaaaactaactgtggg

SEQ ID NO: 64549 - DNA, 20 bp, Artificial Sequence
  Description of Artificial Sequence: Synthetic oligonucleotide
  Target: SCN10A; (+) strand; PAM type: YTN; PAM sequence: TTA
ttagaaaactaactgtgggc

SEQ ID NO: 64550 - DNA, 20 bp, Artificial Sequence
  Description of Artificial Sequence: Synthetic oligonucleotide
  Target: SCN10A; (+) strand; PAM type: YTN; PAM sequence: TTA
gaaaactaactgtgggcctg

SEQ ID NO: 64551 - DNA, 20 bp, Artificial Sequence
  Description of Artificial Sequence: Synthetic oligonucleotide
  Target: SCN10A; (+) strand; PAM type: YTN; PAM sequence: CTA
actgtgggcctgccagggta

SEQ ID NO: 64552 - DNA, 20 bp, Artificial Sequence
  Description of Artificial Sequence: Synthetic oligonucleotide
  Target: SCN10A; (+) strand; PAM type: YTN; PAM sequence: CTG
tgggcctgccagggtatggg

SEQ ID NO: 64553 - DNA, 20 bp, Artificial Sequence
  Description of Artificial Sequence: Synthetic oligonucleotide
  Target: SCN10A; (+) strand; PAM type: YTN; PAM sequence: CTG
ccagggtatgggggtgtgat

SEQ ID NO: 64554 - DNA, 20 bp, Artificial Sequence
  Description of Artificial Sequence: Synthetic oligonucleotide
  Target: SCN10A; (+) strand; PAM type: YTN; PAM sequence: CTC
ctgctctcttgacgattgtg

SEQ ID NO: 64555 - DNA, 20 bp, Artificial Sequence
  Description of Artificial Sequence: Synthetic oligonucleotide
  Target: SCN10A; (+) strand; PAM type: YTN; PAM sequence: CTG
ctctcttgacgattgtgcat

SEQ ID NO: 64556 - DNA, 20 bp, Artificial Sequence
  Description of Artificial Sequence: Synthetic oligonucleotide
  Target: SCN10A; (+) strand; PAM type: YTN; PAM sequence: CTC
tcttgacgattgtgcatagg

SEQ ID NO: 64557 - DNA, 20 bp, Artificial Sequence
  Description of Artificial Sequence: Synthetic oligonucleotide
  Target: SCN10A; (+) strand; PAM type: YTN; PAM sequence: CTC
ttgacgattgtgcataggta

SEQ ID NO: 64558 - DNA, 20 bp, Artificial Sequence
  Description of Artificial Sequence: Synthetic oligonucleotide
  Target: SCN10A; (+) strand; PAM type: YTN; PAM sequence: CTT
gacgattgtgcataggtacc

SEQ ID NO: 64559 - DNA, 20 bp, Artificial Sequence
  Description of Artificial Sequence: Synthetic oligonucleotide
  Target: SCN10A; (+) strand; PAM type: YTN; PAM sequence: TTG
acgattgtgcataggtacct

SEQ ID NO: 64560 - DNA, 20 bp, Artificial Sequence
  Description of Artificial Sequence: Synthetic oligonucleotide
  Target: SCN10A; (+) strand; PAM type: YTN; PAM sequence: TTG
tgcataggtaccttatattg

SEQ ID NO: 64561 - DNA, 20 bp, Artificial Sequence
  Description of Artificial Sequence: Synthetic oligonucleotide
  Target: SCN10A; (+) strand; PAM type: YTN; PAM sequence: CTT
atattgaccattagcttagg

SEQ ID NO: 64562 - DNA, 20 bp, Artificial Sequence
  Description of Artificial Sequence: Synthetic oligonucleotide
  Target: SCN10A; (+) strand; PAM type: YTN; PAM sequence: TTA
tattgaccattagcttaggg

SEQ ID NO: 64563 - DNA, 20 bp, Artificial Sequence
  Description of Artificial Sequence: Synthetic oligonucleotide
  Target: SCN10A; (+) strand; PAM type: YTN; PAM sequence: TTG
accattagcttaggggccta

SEQ ID NO: 64564 - DNA, 20 bp, Artificial Sequence
  Description of Artificial Sequence: Synthetic oligonucleotide
  Target: SCN10A; (+) strand; PAM type: YTN; PAM sequence: TTA
gcttaggggcctacatcttg

SEQ ID NO: 64565 - DNA, 20 bp, Artificial Sequence
  Description of Artificial Sequence: Synthetic oligonucleotide
  Target: SCN10A; (+) strand; PAM type: YTN; PAM sequence: CTT
aggggcctacatcttgacat

SEQ ID NO: 64566 - DNA, 20 bp, Artificial Sequence
  Description of Artificial Sequence: Synthetic oligonucleotide
  Target: SCN10A; (+) strand; PAM type: YTN; PAM sequence: TTA
ggggcctacatcttgacatc

SEQ ID NO: 64567 - DNA, 20 bp, Artificial Sequence
  Description of Artificial Sequence: Synthetic oligonucleotide
  Target: SCN10A; (+) strand; PAM type: YTN; PAM sequence: CTA
catcttgacatcaatttcta

SEQ ID NO: 64568 - DNA, 20 bp, Artificial Sequence
  Description of Artificial Sequence: Synthetic oligonucleotide
  Target: SCN10A; (+) strand; PAM type: YTN; PAM sequence: CTT
gacatcaatttctagatacc

SEQ ID NO: 64569 - DNA, 20 bp, Artificial Sequence
  Description of Artificial Sequence: Synthetic oligonucleotide
  Target: SCN10A; (+) strand; PAM type: YTN; PAM sequence: TTG
acatcaatttctagatacct

SEQ ID NO: 64570 - DNA, 20 bp, Artificial Sequence
  Description of Artificial Sequence: Synthetic oligonucleotide
  Target: SCN10A; (+) strand; PAM type: YTN; PAM sequence: TTT
ctagatacctagagaaatct

SEQ ID NO: 64571 - DNA, 20 bp, Artificial Sequence
  Description of Artificial Sequence: Synthetic oligonucleotide
  Target: SCN10A; (+) strand; PAM type: YTN; PAM sequence: TTC
tagatacctagagaaatctg

SEQ ID NO: 64572 - DNA, 20 bp, Artificial Sequence
  Description of Artificial Sequence: Synthetic oligonucleotide
  Target: SCN10A; (+) strand; PAM type: YTN; PAM sequence: CTA
gatacctagagaaatctgtc

SEQ ID NO: 64573 - DNA, 20 bp, Artificial Sequence
  Description of Artificial Sequence: Synthetic oligonucleotide
  Target: SCN10A; (+) strand; PAM type: YTN; PAM sequence: CTA
gagaaatctgtccttctaaa

SEQ ID NO: 64574 - DNA, 20 bp, Artificial Sequence
  Description of Artificial Sequence: Synthetic oligonucleotide
  Target: SCN10A; (+) strand; PAM type: YTN; PAM sequence: CTG
tccttctaaaaatgtgattt

SEQ ID NO: 64575 - DNA, 20 bp, Artificial Sequence
  Description of Artificial Sequence: Synthetic oligonucleotide
  Target: SCN10A; (+) strand; PAM type: YTN; PAM sequence: CTT
ctaaaaatgtgatttaattc

SEQ ID NO: 64576 - DNA, 20 bp, Artificial Sequence
  Description of Artificial Sequence: Synthetic oligonucleotide
  Target: SCN10A; (+) strand; PAM type: YTN; PAM sequence: TTC
taaaaatgtgatttaattct

SEQ ID NO: 64577 - DNA, 20 bp, Artificial Sequence
  Description of Artificial Sequence: Synthetic oligonucleotide
  Target: SCN10A; (+) strand; PAM type: YTN; PAM sequence: CTA
aaaatgtgatttaattctga

SEQ ID NO: 64578 - DNA, 20 bp, Artificial Sequence
  Description of Artificial Sequence: Synthetic oligonucleotide
  Target: SCN10A; (+) strand; PAM type: YTN; PAM sequence: TTT
aattctgaccttgtaagatt

SEQ ID NO: 64579 - DNA, 20 bp, Artificial Sequence
  Description of Artificial Sequence: Synthetic oligonucleotide
  Target: SCN10A; (+) strand; PAM type: YTN; PAM sequence: TTA
attctgaccttgtaagattt

SEQ ID NO: 64580 - DNA, 20 bp, Artificial Sequence
  Description of Artificial Sequence: Synthetic oligonucleotide
  Target: SCN10A; (+) strand; PAM type: YTN; PAM sequence: TTC
tgaccttgtaagattttcaa

SEQ ID NO: 64581 - DNA, 20 bp, Artificial Sequence
  Description of Artificial Sequence: Synthetic oligonucleotide
  Target: SCN10A; (+) strand; PAM type: YTN; PAM sequence: CTG
accttgtaagattttcaagt

SEQ ID NO: 64582 - DNA, 20 bp, Artificial Sequence
  Description of Artificial Sequence: Synthetic oligonucleotide
  Target: SCN10A; (+) strand; PAM type: YTN; PAM sequence: CTT
gtaagattttcaagttatgg

SEQ ID NO: 64583 - DNA, 20 bp, Artificial Sequence
  Description of Artificial Sequence: Synthetic oligonucleotide
  Target: SCN10A; (+) strand; PAM type: YTN; PAM sequence: TTG
taagattttcaagttatgga

SEQ ID NO: 64584 - DNA, 20 bp, Artificial Sequence
  Description of Artificial Sequence: Synthetic oligonucleotide
  Target: SCN10A; (+) strand; PAM type: YTN; PAM sequence: TTT
tcaagttatggataaagagt

SEQ ID NO: 64585 - DNA, 20 bp, Artificial Sequence
  Description of Artificial Sequence: Synthetic oligonucleotide
  Target: SCN10A; (+) strand; PAM type: YTN; PAM sequence: TTT
caagttatggataaagagtc

SEQ ID NO: 64586 - DNA, 20 bp, Artificial Sequence
  Description of Artificial Sequence: Synthetic oligonucleotide
  Target: SCN10A; (+) strand; PAM type: YTN; PAM sequence: TTC
aagttatggataaagagtcc

SEQ ID NO: 64587 - DNA, 20 bp, Artificial Sequence
  Description of Artificial Sequence: Synthetic oligonucleotide
  Target: SCN10A; (+) strand; PAM type: YTN; PAM sequence: TTA
tggataaagagtcctaccag

SEQ ID NO: 64588 - DNA, 20 bp, Artificial Sequence
  Description of Artificial Sequence: Synthetic oligonucleotide
  Target: SCN10A; (+) strand; PAM type: YTN; PAM sequence: CTA
ccaggcctactctacccttc

SEQ ID NO: 64589 - DNA, 20 bp, Artificial Sequence
  Description of Artificial Sequence: Synthetic oligonucleotide
  Target: SCN10A; (+) strand; PAM type: YTN; PAM sequence: CTA
ctctacccttctcctccctg

SEQ ID NO: 64590 - DNA, 20 bp, Artificial Sequence
  Description of Artificial Sequence: Synthetic oligonucleotide
  Target: SCN10A; (+) strand; PAM type: YTN; PAM sequence: CTC
tacccttctcctccctggga

SEQ ID NO: 64591 - DNA, 20 bp, Artificial Sequence
  Description of Artificial Sequence: Synthetic oligonucleotide
  Target: SCN10A; (+) strand; PAM type: YTN; PAM sequence: CTA
cccttctcctccctgggatg

SEQ ID NO: 64592 - DNA, 20 bp, Artificial Sequence
  Description of Artificial Sequence: Synthetic oligonucleotide
  Target: SCN10A; (+) strand; PAM type: YTN; PAM sequence: CTT
ctcctccctgggatggtgac

SEQ ID NO: 64593 - DNA, 20 bp, Artificial Sequence
  Description of Artificial Sequence: Synthetic oligonucleotide
  Target: SCN10A; (+) strand; PAM type: YTN; PAM sequence: TTC
tcctccctgggatggtgaca

SEQ ID NO: 64594 - DNA, 20 bp, Artificial Sequence
  Description of Artificial Sequence: Synthetic oligonucleotide
  Target: SCN10A; (+) strand; PAM type: YTN; PAM sequence: CTC
ctccctgggatggtgacagt

SEQ ID NO: 64595 - DNA, 20 bp, Artificial Sequence
  Description of Artificial Sequence: Synthetic oligonucleotide
  Target: SCN10A; (+) strand; PAM type: YTN; PAM sequence: CTC
cctgggatggtgacagtacc

SEQ ID NO: 64596 - DNA, 20 bp, Artificial Sequence
  Description of Artificial Sequence: Synthetic oligonucleotide
  Target: SCN10A; (+) strand; PAM type: YTN; PAM sequence: CTG
ggatggtgacagtaccatca

SEQ ID NO: 64597 - DNA, 20 bp, Artificial Sequence
  Description of Artificial Sequence: Synthetic oligonucleotide
  Target: SCN10A; (+) strand; PAM type: YTN; PAM sequence: CTT
aggcagatgccatcaaccag

SEQ ID NO: 64598 - DNA, 20 bp, Artificial Sequence
  Description of Artificial Sequence: Synthetic oligonucleotide
  Target: SCN10A; (+) strand; PAM type: YTN; PAM sequence: TTA
ggcagatgccatcaaccagc

SEQ ID NO: 64599 - DNA, 20 bp, Artificial Sequence
  Description of Artificial Sequence: Synthetic oligonucleotide
  Target: SCN10A; (+) strand; PAM type: YTN; PAM sequence: TTT
catggcacagctgtgtctca

SEQ ID NO: 64600 - DNA, 20 bp, Artificial Sequence
  Description of Artificial Sequence: Synthetic oligonucleotide
  Target: SCN10A; (+) strand; PAM type: YTN; PAM sequence: TTC
atggcacagctgtgtctcag

SEQ ID NO: 64601 - DNA, 20 bp, Artificial Sequence
  Description of Artificial Sequence: Synthetic oligonucleotide
  Target: SCN10A; (+) strand; PAM type: YTN; PAM sequence: CTG
tgtctcaggacatgctttat

SEQ ID NO: 64602 - DNA, 20 bp, Artificial Sequence
  Description of Artificial Sequence: Synthetic oligonucleotide
  Target: SCN10A; (+) strand; PAM type: YTN; PAM sequence: CTC
aggacatgctttatttggtc

SEQ ID NO: 64603 - DNA, 20 bp, Artificial Sequence
  Description of Artificial Sequence: Synthetic oligonucleotide
  Target: SCN10A; (+) strand; PAM type: YTN; PAM sequence: CTT
tatttggtctttagagtgtt

SEQ ID NO: 64604 - DNA, 20 bp, Artificial Sequence
  Description of Artificial Sequence: Synthetic oligonucleotide
  Target: SCN10A; (+) strand; PAM type: YTN; PAM sequence: TTT
atttggtctttagagtgttt

SEQ ID NO: 64605 - DNA, 20 bp, Artificial Sequence
  Description of Artificial Sequence: Synthetic oligonucleotide
  Target: SCN10A; (+) strand; PAM type: YTN; PAM sequence: TTA
tttggtctttagagtgtttt

SEQ ID NO: 64606 - DNA, 20 bp, Artificial Sequence
  Description of Artificial Sequence: Synthetic oligonucleotide
  Target: SCN10A; (+) strand; PAM type: YTN; PAM sequence: TTT
ggtctttagagtgtttttaa

SEQ ID NO: 64607 - DNA, 20 bp, Artificial Sequence
  Description of Artificial Sequence: Synthetic oligonucleotide
  Target: SCN10A; (+) strand; PAM type: YTN; PAM sequence: TTG
gtctttagagtgtttttaaa

SEQ ID NO: 64608 - DNA, 20 bp, Artificial Sequence
  Description of Artificial Sequence: Synthetic oligonucleotide
  Target: SCN10A; (+) strand; PAM type: YTN; PAM sequence: CTT
tagagtgtttttaaaaactg

SEQ ID NO: 64609 - DNA, 20 bp, Artificial Sequence
  Description of Artificial Sequence: Synthetic oligonucleotide
  Target: SCN10A; (+) strand; PAM type: YTN; PAM sequence: TTT
agagtgtttttaaaaactgg

SEQ ID NO: 64610 - DNA, 20 bp, Artificial Sequence
  Description of Artificial Sequence: Synthetic oligonucleotide
  Target: SCN10A; (+) strand; PAM type: YTN; PAM sequence: TTA
gagtgtttttaaaaactgga

SEQ ID NO: 64611 - DNA, 20 bp, Artificial Sequence
  Description of Artificial Sequence: Synthetic oligonucleotide
  Target: SCN10A; (+) strand; PAM type: YTN; PAM sequence: TTT
ttaaaaactggattagtagc

SEQ ID NO: 64612 - DNA, 20 bp, Artificial Sequence
  Description of Artificial Sequence: Synthetic oligonucleotide
  Target: SCN10A; (+) strand; PAM type: YTN; PAM sequence: TTT
taaaaactggattagtagcc

SEQ ID NO: 64613 - DNA, 20 bp, Artificial Sequence
  Description of Artificial Sequence: Synthetic oligonucleotide
  Target: SCN10A; (+) strand; PAM type: YTN; PAM sequence: TTT
aaaaactggattagtagcca

SEQ ID NO: 64614 - DNA, 20 bp, Artificial Sequence
  Description of Artificial Sequence: Synthetic oligonucleotide
  Target: SCN10A; (+) strand; PAM type: YTN; PAM sequence: TTA
aaaactggattagtagccaa

SEQ ID NO: 64615 - DNA, 20 bp, Artificial Sequence
  Description of Artificial Sequence: Synthetic oligonucleotide
  Target: SCN10A; (+) strand; PAM type: YTN; PAM sequence: CTG
gattagtagccaatattaaa

SEQ ID NO: 64616 - DNA, 20 bp, Artificial Sequence
  Description of Artificial Sequence: Synthetic oligonucleotide
  Target: SCN10A; (+) strand; PAM type: YTN; PAM sequence: TTA
gtagccaatattaaagacat

SEQ ID NO: 64617 - DNA, 20 bp, Artificial Sequence
  Description of Artificial Sequence: Synthetic oligonucleotide
  Target: SCN10A; (+) strand; PAM type: YTN; PAM sequence: TTA
aagacatttgcacaaaaatc

SEQ ID NO: 64618 - DNA, 20 bp, Artificial Sequence
  Description of Artificial Sequence: Synthetic oligonucleotide
  Target: SCN10A; (+) strand; PAM type: YTN; PAM sequence: TTT
gcacaaaaatctggatttct

SEQ ID NO: 64619 - DNA, 20 bp, Artificial Sequence
  Description of Artificial Sequence: Synthetic oligonucleotide
  Target: SCN10A; (+) strand; PAM type: YTN; PAM sequence: TTG
cacaaaaatctggatttctg

SEQ ID NO: 64620 - DNA, 20 bp, Artificial Sequence
  Description of Artificial Sequence: Synthetic oligonucleotide
  Target: SCN10A; (+) strand; PAM type: YTN; PAM sequence: CTG
gatttctgacttttttggaa

SEQ ID NO: 64621 - DNA, 20 bp, Artificial Sequence
  Description of Artificial Sequence: Synthetic oligonucleotide
  Target: SCN10A; (+) strand; PAM type: YTN; PAM sequence: TTT
ctgacttttttggaaaatta

SEQ ID NO: 64622 - DNA, 20 bp, Artificial Sequence
  Description of Artificial Sequence: Synthetic oligonucleotide
  Target: SCN10A; (+) strand; PAM type: YTN; PAM sequence: TTC
tgacttttttggaaaattag

SEQ ID NO: 64623 - DNA, 20 bp, Artificial Sequence
  Description of Artificial Sequence: Synthetic oligonucleotide
  Target: SCN10A; (+) strand; PAM type: YTN; PAM sequence: CTG
acttttttggaaaattagta

SEQ ID NO: 64624 - DNA, 20 bp, Artificial Sequence
  Description of Artificial Sequence: Synthetic oligonucleotide
  Target: SCN10A; (+) strand; PAM type: YTN; PAM sequence: CTT
ttttggaaaattagtaactc

SEQ ID NO: 64625 - DNA, 20 bp, Artificial Sequence
  Description of Artificial Sequence: Synthetic oligonucleotide
  Target: SCN10A; (+) strand; PAM type: YTN; PAM sequence: TTT
tttggaaaattagtaactct

SEQ ID NO: 64626 - DNA, 20 bp, Artificial Sequence
  Description of Artificial Sequence: Synthetic oligonucleotide
  Target: SCN10A; (+) strand; PAM type: YTN; PAM sequence: TTT
ttggaaaattagtaactctg

SEQ ID NO: 64627 - DNA, 20 bp, Artificial Sequence
  Description of Artificial Sequence: Synthetic oligonucleotide
  Target: SCN10A; (+) strand; PAM type: YTN; PAM sequence: TTT
tggaaaattagtaactctga

SEQ ID NO: 64628 - DNA, 20 bp, Artificial Sequence
  Description of Artificial Sequence: Synthetic oligonucleotide
  Target: SCN10A; (+) strand; PAM type: YTN; PAM sequence: TTT
ggaaaattagtaactctgac

SEQ ID NO: 64629 - DNA, 20 bp, Artificial Sequence
  Description of Artificial Sequence: Synthetic oligonucleotide
  Target: SCN10A; (+) strand; PAM type: YTN; PAM sequence: TTG
gaaaattagtaactctgaca

SEQ ID NO: 64630 - DNA, 20 bp, Artificial Sequence
  Description of Artificial Sequence: Synthetic oligonucleotide
  Target: SCN10A; (+) strand; PAM type: YTN; PAM sequence: TTA
gtaactctgacaataatgga

SEQ ID NO: 64631 - DNA, 20 bp, Artificial Sequence
  Description of Artificial Sequence: Synthetic oligonucleotide
  Target: SCN10A; (+) strand; PAM type: YTN; PAM sequence: CTC
tgacaataatggacaggcca

SEQ ID NO: 64632 - DNA, 20 bp, Artificial Sequence
  Description of Artificial Sequence: Synthetic oligonucleotide
  Target: SCN10A; (+) strand; PAM type: YTN; PAM sequence: CTG
acaataatggacaggccata

SEQ ID NO: 64633 - DNA, 20 bp, Artificial Sequence
  Description of Artificial Sequence: Synthetic oligonucleotide
  Target: SCN10A; (+) strand; PAM type: YTN; PAM sequence: CTC
gtccttccctccctccctcc

SEQ ID NO: 64634 - DNA, 20 bp, Artificial Sequence
  Description of Artificial Sequence: Synthetic oligonucleotide
  Target: SCN10A; (+) strand; PAM type: YTN; PAM sequence: CTT
ccctccctccctccctctct

SEQ ID NO: 64635 - DNA, 20 bp, Artificial Sequence
  Description of Artificial Sequence: Synthetic oligonucleotide
  Target: SCN10A; (+) strand; PAM type: YTN; PAM sequence: TTC
cctccctccctccctctctc

SEQ ID NO: 64636 - DNA, 20 bp, Artificial Sequence
  Description of Artificial Sequence: Synthetic oligonucleotide
  Target: SCN10A; (+) strand; PAM type: YTN; PAM sequence: CTC
cctccctccctctctctctc

SEQ ID NO: 64637 - DNA, 20 bp, Artificial Sequence
  Description of Artificial Sequence: Synthetic oligonucleotide
  Target: SCN10A; (+) strand; PAM type: YTN; PAM sequence: CTC
cctccctctctctctccctc

SEQ ID NO: 64638 - DNA, 20 bp, Artificial Sequence
  Description of Artificial Sequence: Synthetic oligonucleotide
  Target: SCN10A; (+) strand; PAM type: YTN; PAM sequence: CTC
cctctctctctccctccctc

SEQ ID NO: 64639 - DNA, 20 bp, Artificial Sequence
  Description of Artificial Sequence: Synthetic oligonucleotide
  Target: SCN10A; (+) strand; PAM type: YTN; PAM sequence: CTC
tctctctccctccctccctc

SEQ ID NO: 64640 - DNA, 20 bp, Artificial Sequence
  Description of Artificial Sequence: Synthetic oligonucleotide
  Target: SCN10A; (+) strand; PAM type: YTN; PAM sequence: CTC
tctctccctccctccctccc

SEQ ID NO: 64641 - DNA, 20 bp, Artificial Sequence
  Description of Artificial Sequence: Synthetic oligonucleotide
  Target: SCN10A; (+) strand; PAM type: YTN; PAM sequence: CTC
tctccctccctccctccctc

SEQ ID NO: 64642 - DNA, 20 bp, Artificial Sequence
  Description of Artificial Sequence: Synthetic oligonucleotide
  Target: SCN10A; (+) strand; PAM type: YTN; PAM sequence: CTC
tccctccctccctccctctc

SEQ ID NO: 64643 - DNA, 20 bp, Artificial Sequence
  Description of Artificial Sequence: Synthetic oligonucleotide
  Target: SCN10A; (+) strand; PAM type: YTN; PAM sequence: CTC
cctccctccctccctctctc

SEQ ID NO: 64644 - DNA, 20 bp, Artificial Sequence
  Description of Artificial Sequence: Synthetic oligonucleotide
  Target: SCN10A; (+) strand; PAM type: YTN; PAM sequence: CTC
cctccctccctctctctctc

SEQ ID NO: 64645 - DNA, 20 bp, Artificial Sequence
  Description of Artificial Sequence: Synthetic oligonucleotide
  Target: SCN10A; (+) strand; PAM type: YTN; PAM sequence: CTC
cctccctctctctctccctc

SEQ ID NO: 64646 - DNA, 20 bp, Artificial Sequence
  Description of Artificial Sequence: Synthetic oligonucleotide
  Target: SCN10A; (+) strand; PAM type: YTN; PAM sequence: CTC
cctctctctctccctccctc

SEQ ID NO: 64647 - DNA, 20 bp, Artificial Sequence
  Description of Artificial Sequence: Synthetic oligonucleotide
  Target: SCN10A; (+) strand; PAM type: YTN; PAM sequence: CTC
tctctctccctccctccctc

SEQ ID NO: 64648 - DNA, 20 bp, Artificial Sequence
  Description of Artificial Sequence: Synthetic oligonucleotide
  Target: SCN10A; (+) strand; PAM type: YTN; PAM sequence: CTC
tctctccctccctccctccc

SEQ ID NO: 64649 - DNA, 20 bp, Artificial Sequence
  Description of Artificial Sequence: Synthetic oligonucleotide
  Target: SCN10A; (+) strand; PAM type: YTN; PAM sequence: CTC
tctccctccctccctccctt

SEQ ID NO: 64650 - DNA, 20 bp, Artificial Sequence
  Description of Artificial Sequence: Synthetic oligonucleotide
  Target: SCN10A; (+) strand; PAM type: YTN; PAM sequence: CTC
tccctccctccctcccttcc

SEQ ID NO: 64651 - DNA, 20 bp, Artificial Sequence
  Description of Artificial Sequence: Synthetic oligonucleotide
  Target: SCN10A; (+) strand; PAM type: YTN; PAM sequence: CTC
cctccctccctcccttcctc

SEQ ID NO: 64652 - DNA, 20 bp, Artificial Sequence
  Description of Artificial Sequence: Synthetic oligonucleotide
  Target: SCN10A; (+) strand; PAM type: YTN; PAM sequence: CTC
cctccctcccttcctctttc

SEQ ID NO: 64653 - DNA, 20 bp, Artificial Sequence
  Description of Artificial Sequence: Synthetic oligonucleotide
  Target: SCN10A; (+) strand; PAM type: YTN; PAM sequence: CTC
cctcccttcctctttctttc

SEQ ID NO: 64654 - DNA, 20 bp, Artificial Sequence
  Description of Artificial Sequence: Synthetic oligonucleotide
  Target: SCN10A; (+) strand; PAM type: YTN; PAM sequence: CTC
ccttcctctttctttctttc

SEQ ID NO: 64655 - DNA, 20 bp, Artificial Sequence
  Description of Artificial Sequence: Synthetic oligonucleotide
  Target: SCN10A; (+) strand; PAM type: YTN; PAM sequence: CTT
cctctttctttctttctttc

SEQ ID NO: 64656 - DNA, 20 bp, Artificial Sequence
  Description of Artificial Sequence: Synthetic oligonucleotide
  Target: SCN10A; (+) strand; PAM type: YTN; PAM sequence: TTC
ctctttctttctttctttct

SEQ ID NO: 64657 - DNA, 20 bp, Artificial Sequence
  Description of Artificial Sequence: Synthetic oligonucleotide
  Target: SCN10A; (+) strand; PAM type: YTN; PAM sequence: CTC
tttctttctttctttctttc

SEQ ID NO: 64658 - DNA, 20 bp, Artificial Sequence
  Description of Artificial Sequence: Synthetic oligonucleotide
  Target: SCN10A; (+) strand; PAM type: YTN; PAM sequence: CTT
tctttctttctttctttctt

SEQ ID NO: 64659 - DNA, 20 bp, Artificial Sequence
  Description of Artificial Sequence: Synthetic oligonucleotide
  Target: SCN10A; (+) strand; PAM type: YTN; PAM sequence: TTT
ctttctttctttctttcttt

SEQ ID NO: 64660 - DNA, 20 bp, Artificial Sequence
  Description of Artificial Sequence: Synthetic oligonucleotide
  Target: SCN10A; (+) strand; PAM type: YTN; PAM sequence: TTC
tttctttctttctttctttc

SEQ ID NO: 64661 - DNA, 20 bp, Artificial Sequence
  Description of Artificial Sequence: Synthetic oligonucleotide
  Target: SCN10A; (+) strand; PAM type: YTN; PAM sequence: CTT
tctttctttctttctttctt

SEQ ID NO: 64662 - DNA, 20 bp, Artificial Sequence
  Description of Artificial Sequence: Synthetic oligonucleotide
  Target: SCN10A; (+) strand; PAM type: YTN; PAM sequence: TTT
ctttctttctttctttcttt

SEQ ID NO: 64663 - DNA, 20 bp, Artificial Sequence
  Description of Artificial Sequence: Synthetic oligonucleotide
  Target: SCN10A; (+) strand; PAM type: YTN; PAM sequence: TTC
tttctttctttctttctttc

SEQ ID NO: 64664 - DNA, 20 bp, Artificial Sequence
  Description of Artificial Sequence: Synthetic oligonucleotide
  Target: SCN10A; (+) strand; PAM type: YTN; PAM sequence: CTT
tctttctttctttctttctt

SEQ ID NO: 64665 - DNA, 20 bp, Artificial Sequence
  Description of Artificial Sequence: Synthetic oligonucleotide
  Target: SCN10A; (+) strand; PAM type: YTN; PAM sequence: TTT
ctttctttctttctttcttt

SEQ ID NO: 64666 - DNA, 20 bp, Artificial Sequence
  Description of Artificial Sequence: Synthetic oligonucleotide
  Target: SCN10A; (+) strand; PAM type: YTN; PAM sequence: TTC
tttctttctttctttctttc

SEQ ID NO: 64667 - DNA, 20 bp, Artificial Sequence
  Description of Artificial Sequence: Synthetic oligonucleotide
  Target: SCN10A; (+) strand; PAM type: YTN; PAM sequence: CTT
tctttctttctttctttctc

SEQ ID NO: 64668 - DNA, 20 bp, Artificial Sequence
  Description of Artificial Sequence: Synthetic oligonucleotide
  Target: SCN10A; (+) strand; PAM type: YTN; PAM sequence: TTT
ctttctttctttctttctct

SEQ ID NO: 64669 - DNA, 20 bp, Artificial Sequence
  Description of Artificial Sequence: Synthetic oligonucleotide
  Target: SCN10A; (+) strand; PAM type: YTN; PAM sequence: TTC
tttctttctttctttctctt

SEQ ID NO: 64670 - DNA, 20 bp, Artificial Sequence
  Description of Artificial Sequence: Synthetic oligonucleotide
  Target: SCN10A; (+) strand; PAM type: YTN; PAM sequence: CTT
tctttctttctttctctttc

SEQ ID NO: 64671 - DNA, 20 bp, Artificial Sequence
  Description of Artificial Sequence: Synthetic oligonucleotide
  Target: SCN10A; (+) strand; PAM type: YTN; PAM sequence: TTT
ctttctttctttctctttct

SEQ ID NO: 64672 - DNA, 20 bp, Artificial Sequence
  Description of Artificial Sequence: Synthetic oligonucleotide
  Target: SCN10A; (+) strand; PAM type: YTN; PAM sequence: TTC
tttctttctttctctttctt

SEQ ID NO: 64673 - DNA, 20 bp, Artificial Sequence
  Description of Artificial Sequence: Synthetic oligonucleotide
  Target: SCN10A; (+) strand; PAM type: YTN; PAM sequence: CTT
tctttctttctctttcttct

SEQ ID NO: 64674 - DNA, 20 bp, Artificial Sequence
  Description of Artificial Sequence: Synthetic oligonucleotide
  Target: SCN10A; (+) strand; PAM type: YTN; PAM sequence: TTT
ctttctttctctttcttctt

SEQ ID NO: 64675 - DNA, 20 bp, Artificial Sequence
  Description of Artificial Sequence: Synthetic oligonucleotide
  Target: SCN10A; (+) strand; PAM type: YTN; PAM sequence: TTC
tttctttctctttcttcttt

SEQ ID NO: 64676 - DNA, 20 bp, Artificial Sequence
  Description of Artificial Sequence: Synthetic oligonucleotide
  Target: SCN10A; (+) strand; PAM type: YTN; PAM sequence: CTT
tctttctctttcttctttct

SEQ ID NO: 64677 - DNA, 20 bp, Artificial Sequence
  Description of Artificial Sequence: Synthetic oligonucleotide
  Target: SCN10A; (+) strand; PAM type: YTN; PAM sequence: TTT
ctttctctttcttctttctt

SEQ ID NO: 64678 - DNA, 20 bp, Artificial Sequence
  Description of Artificial Sequence: Synthetic oligonucleotide
  Target: SCN10A; (+) strand; PAM type: YTN; PAM sequence: TTC
tttctctttcttctttcttt

SEQ ID NO: 64679 - DNA, 20 bp, Artificial Sequence
  Description of Artificial Sequence: Synthetic oligonucleotide
  Target: SCN10A; (+) strand; PAM type: YTN; PAM sequence: CTT
tctctttcttctttctttct

SEQ ID NO: 64680 - DNA, 20 bp, Artificial Sequence
  Description of Artificial Sequence: Synthetic oligonucleotide
  Target: SCN10A; (+) strand; PAM type: YTN; PAM sequence: TTT
ctctttcttctttctttctt

SEQ ID NO: 64681 - DNA, 20 bp, Artificial Sequence
  Description of Artificial Sequence: Synthetic oligonucleotide
  Target: SCN10A; (+) strand; PAM type: YTN; PAM sequence: TTC
tctttcttctttctttcttt

SEQ ID NO: 64682 - DNA, 20 bp, Artificial Sequence
  Description of Artificial Sequence: Synthetic oligonucleotide
  Target: SCN10A; (+) strand; PAM type: YTN; PAM sequence: CTC
tttcttctttctttctttct

SEQ ID NO: 64683 - DNA, 20 bp, Artificial Sequence
  Description of Artificial Sequence: Synthetic oligonucleotide
  Target: SCN10A; (+) strand; PAM type: YTN; PAM sequence: CTT
tcttctttctttctttctct

SEQ ID NO: 64684 - DNA, 20 bp, Artificial Sequence
  Description of Artificial Sequence: Synthetic oligonucleotide
  Target: SCN10A; (+) strand; PAM type: YTN; PAM sequence: TTT
cttctttctttctttctctt

SEQ ID NO: 64685 - DNA, 20 bp, Artificial Sequence
  Description of Artificial Sequence: Synthetic oligonucleotide
  Target: SCN10A; (+) strand; PAM type: YTN; PAM sequence: TTC
ttctttctttctttctcttt

SEQ ID NO: 64686 - DNA, 20 bp, Artificial Sequence
  Description of Artificial Sequence: Synthetic oligonucleotide
  Target: SCN10A; (+) strand; PAM type: YTN; PAM sequence: CTT
ctttctttctttctcttttt

SEQ ID NO: 64687 - DNA, 20 bp, Artificial Sequence
  Description of Artificial Sequence: Synthetic oligonucleotide
  Target: SCN10A; (+) strand; PAM type: YTN; PAM sequence: TTC
tttctttctttctctttttc

SEQ ID NO: 64688 - DNA, 20 bp, Artificial Sequence
  Description of Artificial Sequence: Synthetic oligonucleotide
  Target: SCN10A; (+) strand; PAM type: YTN; PAM sequence: CTT
tctttctttctctttttctt

SEQ ID NO: 64689 - DNA, 20 bp, Artificial Sequence
  Description of Artificial Sequence: Synthetic oligonucleotide
  Target: SCN10A; (+) strand; PAM type: YTN; PAM sequence: TTT
ctttctttctctttttcttt

SEQ ID NO: 64690 - DNA, 20 bp, Artificial Sequence
  Description of Artificial Sequence: Synthetic oligonucleotide
  Target: SCN10A; (+) strand; PAM type: YTN; PAM sequence: TTC
tttctttctctttttctttc

SEQ ID NO: 64691 - DNA, 20 bp, Artificial Sequence
  Description of Artificial Sequence: Synthetic oligonucleotide
  Target: SCN10A; (+) strand; PAM type: YTN; PAM sequence: CTT
tctttctctttttctttctc

SEQ ID NO: 64692 - DNA, 20 bp, Artificial Sequence
  Description of Artificial Sequence: Synthetic oligonucleotide
  Target: SCN10A; (+) strand; PAM type: YTN; PAM sequence: TTT
ctttctctttttctttctct

SEQ ID NO: 64693 - DNA, 20 bp, Artificial Sequence
  Description of Artificial Sequence: Synthetic oligonucleotide
  Target: SCN10A; (+) strand; PAM type: YTN; PAM sequence: TTC
tttctctttttctttctctc

SEQ ID NO: 64694 - DNA, 20 bp, Artificial Sequence
  Description of Artificial Sequence: Synthetic oligonucleotide
  Target: SCN10A; (+) strand; PAM type: YTN; PAM sequence: CTT
tctctttttctttctctctc

SEQ ID NO: 64695 - DNA, 20 bp, Artificial Sequence
  Description of Artificial Sequence: Synthetic oligonucleotide
  Target: SCN10A; (+) strand; PAM type: YTN; PAM sequence: TTT
ctctttttctttctctctcc

SEQ ID NO: 64696 - DNA, 20 bp, Artificial Sequence
  Description of Artificial Sequence: Synthetic oligonucleotide
  Target: SCN10A; (+) strand; PAM type: YTN; PAM sequence: TTC
tctttttctttctctctccc

SEQ ID NO: 64697 - DNA, 20 bp, Artificial Sequence
  Description of Artificial Sequence: Synthetic oligonucleotide
  Target: SCN10A; (+) strand; PAM type: YTN; PAM sequence: CTC
tttttctttctctctccctc

SEQ ID NO: 64698 - DNA, 20 bp, Artificial Sequence
  Description of Artificial Sequence: Synthetic oligonucleotide
  Target: SCN10A; (+) strand; PAM type: YTN; PAM sequence: CTT
tttctttctctctccctctt

SEQ ID NO: 64699 - DNA, 20 bp, Artificial Sequence
  Description of Artificial Sequence: Synthetic oligonucleotide
  Target: SCN10A; (+) strand; PAM type: YTN; PAM sequence: TTT
ttctttctctctccctcttg

SEQ ID NO: 64700 - DNA, 20 bp, Artificial Sequence
  Description of Artificial Sequence: Synthetic oligonucleotide
  Target: SCN10A; (+) strand; PAM type: YTN; PAM sequence: TTT
tctttctctctccctcttgc

SEQ ID NO: 64701 - DNA, 20 bp, Artificial Sequence
  Description of Artificial Sequence: Synthetic oligonucleotide
  Target: SCN10A; (+) strand; PAM type: YTN; PAM sequence: TTT
ctttctctctccctcttgct

SEQ ID NO: 64702 - DNA, 20 bp, Artificial Sequence
  Description of Artificial Sequence: Synthetic oligonucleotide
  Target: SCN10A; (+) strand; PAM type: YTN; PAM sequence: TTC
tttctctctccctcttgctc

SEQ ID NO: 64703 - DNA, 20 bp, Artificial Sequence
  Description of Artificial Sequence: Synthetic oligonucleotide
  Target: SCN10A; (+) strand; PAM type: YTN; PAM sequence: CTT
tctctctccctcttgctctc

SEQ ID NO: 64704 - DNA, 20 bp, Artificial Sequence
  Description of Artificial Sequence: Synthetic oligonucleotide
  Target: SCN10A; (+) strand; PAM type: YTN; PAM sequence: TTT
ctctctccctcttgctctct

SEQ ID NO: 64705 - DNA, 20 bp, Artificial Sequence
  Description of Artificial Sequence: Synthetic oligonucleotide
  Target: SCN10A; (+) strand; PAM type: YTN; PAM sequence: TTC
tctctccctcttgctctctc

SEQ ID NO: 64706 - DNA, 20 bp, Artificial Sequence
  Description of Artificial Sequence: Synthetic oligonucleotide
  Target: SCN10A; (+) strand; PAM type: YTN; PAM sequence: CTC
tctccctcttgctctctctc

SEQ ID NO: 64707 - DNA, 20 bp, Artificial Sequence
  Description of Artificial Sequence: Synthetic oligonucleotide
  Target: SCN10A; (+) strand; PAM type: YTN; PAM sequence: CTC
tccctcttgctctctctctt

SEQ ID NO: 64708 - DNA, 20 bp, Artificial Sequence
  Description of Artificial Sequence: Synthetic oligonucleotide
  Target: SCN10A; (+) strand; PAM type: YTN; PAM sequence: CTC
cctcttgctctctctctttc

SEQ ID NO: 64709 - DNA, 20 bp, Artificial Sequence
  Description of Artificial Sequence: Synthetic oligonucleotide
  Target: SCN10A; (+) strand; PAM type: YTN; PAM sequence: CTC
ttgctctctctctttctttc

SEQ ID NO: 64710 - DNA, 20 bp, Artificial Sequence
  Description of Artificial Sequence: Synthetic oligonucleotide
  Target: SCN10A; (+) strand; PAM type: YTN; PAM sequence: CTT
gctctctctctttctttcat

SEQ ID NO: 64711 - DNA, 20 bp, Artificial Sequence
  Description of Artificial Sequence: Synthetic oligonucleotide
  Target: SCN10A; (+) strand; PAM type: YTN; PAM sequence: TTG
ctctctctctttctttcatc

SEQ ID NO: 64712 - DNA, 20 bp, Artificial Sequence
  Description of Artificial Sequence: Synthetic oligonucleotide
  Target: SCN10A; (+) strand; PAM type: YTN; PAM sequence: CTC
tctctctttctttcatctgt

SEQ ID NO: 64713 - DNA, 20 bp, Artificial Sequence
  Description of Artificial Sequence: Synthetic oligonucleotide
  Target: SCN10A; (+) strand; PAM type: YTN; PAM sequence: CTC
tctctttctttcatctgtct

SEQ ID NO: 64714 - DNA, 20 bp, Artificial Sequence
  Description of Artificial Sequence: Synthetic oligonucleotide
  Target: SCN10A; (+) strand; PAM type: YTN; PAM sequence: CTC
tctttctttcatctgtcttt

SEQ ID NO: 64715 - DNA, 20 bp, Artificial Sequence
  Description of Artificial Sequence: Synthetic oligonucleotide
  Target: SCN10A; (+) strand; PAM type: YTN; PAM sequence: CTC
tttctttcatctgtctttct

SEQ ID NO: 64716 - DNA, 20 bp, Artificial Sequence
  Description of Artificial Sequence: Synthetic oligonucleotide
  Target: SCN10A; (+) strand; PAM type: YTN; PAM sequence: CTT
tctttcatctgtctttctct

SEQ ID NO: 64717 - DNA, 20 bp, Artificial Sequence
  Description of Artificial Sequence: Synthetic oligonucleotide
  Target: SCN10A; (+) strand; PAM type: YTN; PAM sequence: TTT
ctttcatctgtctttctctc

SEQ ID NO: 64718 - DNA, 20 bp, Artificial Sequence
  Description of Artificial Sequence: Synthetic oligonucleotide
  Target: SCN10A; (+) strand; PAM type: YTN; PAM sequence: TTC
tttcatctgtctttctctcg

SEQ ID NO: 64719 - DNA, 20 bp, Artificial Sequence
  Description of Artificial Sequence: Synthetic oligonucleotide
  Target: SCN10A; (+) strand; PAM type: YTN; PAM sequence: CTT
tcatctgtctttctctcgct

SEQ ID NO: 64720 - DNA, 20 bp, Artificial Sequence
  Description of Artificial Sequence: Synthetic oligonucleotide
  Target: SCN10A; (+) strand; PAM type: YTN; PAM sequence: TTT
catctgtctttctctcgctt

SEQ ID NO: 64721 - DNA, 20 bp, Artificial Sequence
  Description of Artificial Sequence: Synthetic oligonucleotide
  Target: SCN10A; (+) strand; PAM type: YTN; PAM sequence: TTC
atctgtctttctctcgcttt

SEQ ID NO: 64722 - DNA, 20 bp, Artificial Sequence
  Description of Artificial Sequence: Synthetic oligonucleotide
  Target: SCN10A; (+) strand; PAM type: YTN; PAM sequence: CTG
tctttctctcgctttttcta

SEQ ID NO: 64723 - DNA, 20 bp, Artificial Sequence
  Description of Artificial Sequence: Synthetic oligonucleotide
  Target: SCN10A; (+) strand; PAM type: YTN; PAM sequence: CTT
tctctcgctttttctatctt

SEQ ID NO: 64724 - DNA, 20 bp, Artificial Sequence
  Description of Artificial Sequence: Synthetic oligonucleotide
  Target: SCN10A; (+) strand; PAM type: YTN; PAM sequence: TTT
ctctcgctttttctatcttt

SEQ ID NO: 64725 - DNA, 20 bp, Artificial Sequence
  Description of Artificial Sequence: Synthetic oligonucleotide
  Target: SCN10A; (+) strand; PAM type: YTN; PAM sequence: TTC
tctcgctttttctatcttta

SEQ ID NO: 64726 - DNA, 20 bp, Artificial Sequence
  Description of Artificial Sequence: Synthetic oligonucleotide
  Target: SCN10A; (+) strand; PAM type: YTN; PAM sequence: CTC
tcgctttttctatctttatt

SEQ ID NO: 64727 - DNA, 20 bp, Artificial Sequence
  Description of Artificial Sequence: Synthetic oligonucleotide
  Target: SCN10A; (+) strand; PAM type: YTN; PAM sequence: CTC
gctttttctatctttattcc

SEQ ID NO: 64728 - DNA, 20 bp, Artificial Sequence
  Description of Artificial Sequence: Synthetic oligonucleotide
  Target: SCN10A; (+) strand; PAM type: YTN; PAM sequence: CTT
tttctatctttattcctctc

SEQ ID NO: 64729 - DNA, 20 bp, Artificial Sequence
  Description of Artificial Sequence: Synthetic oligonucleotide
  Target: SCN10A; (+) strand; PAM type: YTN; PAM sequence: TTT
ttctatctttattcctctct

SEQ ID NO: 64730 - DNA, 20 bp, Artificial Sequence
  Description of Artificial Sequence: Synthetic oligonucleotide
  Target: SCN10A; (+) strand; PAM type: YTN; PAM sequence: TTT
tctatctttattcctctctc

SEQ ID NO: 64731 - DNA, 20 bp, Artificial Sequence
  Description of Artificial Sequence: Synthetic oligonucleotide
  Target: SCN10A; (+) strand; PAM type: YTN; PAM sequence: TTT
ctatctttattcctctctct

SEQ ID NO: 64732 - DNA, 20 bp, Artificial Sequence
  Description of Artificial Sequence: Synthetic oligonucleotide
  Target: SCN10A; (+) strand; PAM type: YTN; PAM sequence: TTC
tatctttattcctctctctc

SEQ ID NO: 64733 - DNA, 20 bp, Artificial Sequence
  Description of Artificial Sequence: Synthetic oligonucleotide
  Target: SCN10A; (+) strand; PAM type: YTN; PAM sequence: CTA
tctttattcctctctctctg

SEQ ID NO: 64734 - DNA, 20 bp, Artificial Sequence
  Description of Artificial Sequence: Synthetic oligonucleotide
  Target: SCN10A; (+) strand; PAM type: YTN; PAM sequence: CTT
tattcctctctctctgtgtc

SEQ ID NO: 64735 - DNA, 20 bp, Artificial Sequence
  Description of Artificial Sequence: Synthetic oligonucleotide
  Target: SCN10A; (+) strand; PAM type: YTN; PAM sequence: TTT
attcctctctctctgtgtct

SEQ ID NO: 64736 - DNA, 20 bp, Artificial Sequence
  Description of Artificial Sequence: Synthetic oligonucleotide
  Target: SCN10A; (+) strand; PAM type: YTN; PAM sequence: TTA
ttcctctctctctgtgtctc

SEQ ID NO: 64737 - DNA, 20 bp, Artificial Sequence
  Description of Artificial Sequence: Synthetic oligonucleotide
  Target: SCN10A; (+) strand; PAM type: YTN; PAM sequence: TTC
ctctctctctgtgtctcctt

SEQ ID NO: 64738 - DNA, 20 bp, Artificial Sequence
  Description of Artificial Sequence: Synthetic oligonucleotide
  Target: SCN10A; (+) strand; PAM type: YTN; PAM sequence: CTC
tctctctgtgtctcctttct

SEQ ID NO: 64739 - DNA, 20 bp, Artificial Sequence
  Description of Artificial Sequence: Synthetic oligonucleotide
  Target: SCN10A; (+) strand; PAM type: YTN; PAM sequence: CTC
tctctgtgtctcctttcttt

SEQ ID NO: 64740 - DNA, 20 bp, Artificial Sequence
  Description of Artificial Sequence: Synthetic oligonucleotide
  Target: SCN10A; (+) strand; PAM type: YTN; PAM sequence: CTC
tctgtgtctcctttcttttt

SEQ ID NO: 64741 - DNA, 20 bp, Artificial Sequence
  Description of Artificial Sequence: Synthetic oligonucleotide
  Target: SCN10A; (+) strand; PAM type: YTN; PAM sequence: CTC
tgtgtctcctttcttttttg

SEQ ID NO: 64742 - DNA, 20 bp, Artificial Sequence
  Description of Artificial Sequence: Synthetic oligonucleotide
  Target: SCN10A; (+) strand; PAM type: YTN; PAM sequence: CTG
tgtctcctttcttttttgag

SEQ ID NO: 64743 - DNA, 20 bp, Artificial Sequence
  Description of Artificial Sequence: Synthetic oligonucleotide
  Target: SCN10A; (+) strand; PAM type: YTN; PAM sequence: CTC
ctttcttttttgagacaggt

SEQ ID NO: 64744 - DNA, 20 bp, Artificial Sequence
  Description of Artificial Sequence: Synthetic oligonucleotide
  Target: SCN10A; (+) strand; PAM type: YTN; PAM sequence: CTT
tcttttttgagacaggttct

SEQ ID NO: 64745 - DNA, 20 bp, Artificial Sequence
  Description of Artificial Sequence: Synthetic oligonucleotide
  Target: SCN10A; (+) strand; PAM type: YTN; PAM sequence: TTT
cttttttgagacaggttctt

SEQ ID NO: 64746 - DNA, 20 bp, Artificial Sequence
  Description of Artificial Sequence: Synthetic oligonucleotide
  Target: SCN10A; (+) strand; PAM type: YTN; PAM sequence: TTC
ttttttgagacaggttctta

SEQ ID NO: 64747 - DNA, 20 bp, Artificial Sequence
  Description of Artificial Sequence: Synthetic oligonucleotide
  Target: SCN10A; (+) strand; PAM type: YTN; PAM sequence: CTT
ttttgagacaggttcttact

SEQ ID NO: 64748 - DNA, 20 bp, Artificial Sequence
  Description of Artificial Sequence: Synthetic oligonucleotide
  Target: SCN10A; (+) strand; PAM type: YTN; PAM sequence: TTT
tttgagacaggttcttactc

SEQ ID NO: 64749 - DNA, 20 bp, Artificial Sequence
  Description of Artificial Sequence: Synthetic oligonucleotide
  Target: SCN10A; (+) strand; PAM type: YTN; PAM sequence: TTT
ttgagacaggttcttactct

SEQ ID NO: 64750 - DNA, 20 bp, Artificial Sequence
  Description of Artificial Sequence: Synthetic oligonucleotide
  Target: SCN10A; (+) strand; PAM type: YTN; PAM sequence: TTT
tgagacaggttcttactctg

SEQ ID NO: 64751 - DNA, 20 bp, Artificial Sequence
  Description of Artificial Sequence: Synthetic oligonucleotide
  Target: SCN10A; (+) strand; PAM type: YTN; PAM sequence: TTT
gagacaggttcttactctgt

SEQ ID NO: 64752 - DNA, 20 bp, Artificial Sequence
  Description of Artificial Sequence: Synthetic oligonucleotide
  Target: SCN10A; (+) strand; PAM type: YTN; PAM sequence: TTG
agacaggttcttactctgtc

SEQ ID NO: 64753 - DNA, 20 bp, Artificial Sequence
  Description of Artificial Sequence: Synthetic oligonucleotide
  Target: SCN10A; (+) strand; PAM type: YTN; PAM sequence: TTC
ttactctgtctcccaggctg

SEQ ID NO: 64754 - DNA, 20 bp, Artificial Sequence
  Description of Artificial Sequence: Synthetic oligonucleotide
  Target: SCN10A; (+) strand; PAM type: YTN; PAM sequence: CTT
actctgtctcccaggctgga

SEQ ID NO: 64755 - DNA, 20 bp, Artificial Sequence
  Description of Artificial Sequence: Synthetic oligonucleotide
  Target: SCN10A; (+) strand; PAM type: YTN; PAM sequence: TTA
ctctgtctcccaggctggag

SEQ ID NO: 64756 - DNA, 20 bp, Artificial Sequence
  Description of Artificial Sequence: Synthetic oligonucleotide
  Target: SCN10A; (+) strand; PAM type: YTN; PAM sequence: CTC
tgtctcccaggctggagtgc

SEQ ID NO: 64757 - DNA, 20 bp, Artificial Sequence
  Description of Artificial Sequence: Synthetic oligonucleotide
  Target: SCN10A; (+) strand; PAM type: YTN; PAM sequence: CTG
tctcccaggctggagtgcag

SEQ ID NO: 64758 - DNA, 20 bp, Artificial Sequence
  Description of Artificial Sequence: Synthetic oligonucleotide
  Target: SCN10A; (+) strand; PAM type: YTN; PAM sequence: CTC
ccaggctggagtgcagtggc

SEQ ID NO: 64759 - DNA, 20 bp, Artificial Sequence
  Description of Artificial Sequence: Synthetic oligonucleotide
  Target: SCN10A; (+) strand; PAM type: YTN; PAM sequence: CTG
gagtgcagtggcacgatcat

SEQ ID NO: 64760 - DNA, 20 bp, Artificial Sequence
  Description of Artificial Sequence: Synthetic oligonucleotide
  Target: SCN10A; (+) strand; PAM type: YTN; PAM sequence: CTG
cagcctccacctccctggtc

SEQ ID NO: 64761 - DNA, 20 bp, Artificial Sequence
  Description of Artificial Sequence: Synthetic oligonucleotide
  Target: SCN10A; (+) strand; PAM type: YTN; PAM sequence: CTC
cacctccctggtctcaggtg

SEQ ID NO: 64762 - DNA, 20 bp, Artificial Sequence
  Description of Artificial Sequence: Synthetic oligonucleotide
  Target: SCN10A; (+) strand; PAM type: YTN; PAM sequence: CTC
cctggtctcaggtgatcctc

SEQ ID NO: 64763 - DNA, 20 bp, Artificial Sequence
  Description of Artificial Sequence: Synthetic oligonucleotide
  Target: SCN10A; (+) strand; PAM type: YTN; PAM sequence: CTG
gtctcaggtgatcctcccac

SEQ ID NO: 64764 - DNA, 20 bp, Artificial Sequence
  Description of Artificial Sequence: Synthetic oligonucleotide
  Target: SCN10A; (+) strand; PAM type: YTN; PAM sequence: CTC
aggtgatcctcccacctcag

SEQ ID NO: 64765 - DNA, 20 bp, Artificial Sequence
  Description of Artificial Sequence: Synthetic oligonucleotide
  Target: SCN10A; (+) strand; PAM type: YTN; PAM sequence: CTC
ccacctcagtcttctgagta

SEQ ID NO: 64766 - DNA, 20 bp, Artificial Sequence
  Description of Artificial Sequence: Synthetic oligonucleotide
  Target: SCN10A; (+) strand; PAM type: YTN; PAM sequence: CTC
agtcttctgagtagctagga

SEQ ID NO: 64767 - DNA, 20 bp, Artificial Sequence
  Description of Artificial Sequence: Synthetic oligonucleotide
  Target: SCN10A; (+) strand; PAM type: YTN; PAM sequence: CTT
ctgagtagctaggataacag

SEQ ID NO: 64768 - DNA, 20 bp, Artificial Sequence
  Description of Artificial Sequence: Synthetic oligonucleotide
  Target: SCN10A; (+) strand; PAM type: YTN; PAM sequence: TTC
tgagtagctaggataacaga

SEQ ID NO: 64769 - DNA, 20 bp, Artificial Sequence
  Description of Artificial Sequence: Synthetic oligonucleotide
  Target: SCN10A; (+) strand; PAM type: YTN; PAM sequence: CTG
agtagctaggataacagatg

SEQ ID NO: 64770 - DNA, 20 bp, Artificial Sequence
  Description of Artificial Sequence: Synthetic oligonucleotide
  Target: SCN10A; (+) strand; PAM type: YTN; PAM sequence: CTA
ggataacagatgtgcaccac

SEQ ID NO: 64771 - DNA, 20 bp, Artificial Sequence
  Description of Artificial Sequence: Synthetic oligonucleotide
  Target: SCN10A; (+) strand; PAM type: YTN; PAM sequence: CTG
gctaattttttcattttttg

SEQ ID NO: 64772 - DNA, 20 bp, Artificial Sequence
  Description of Artificial Sequence: Synthetic oligonucleotide
  Target: SCN10A; (+) strand; PAM type: YTN; PAM sequence: CTA
attttttcattttttgtaga

SEQ ID NO: 64773 - DNA, 20 bp, Artificial Sequence
  Description of Artificial Sequence: Synthetic oligonucleotide
  Target: SCN10A; (+) strand; PAM type: YTN; PAM sequence: TTT
tttcattttttgtagagacg

SEQ ID NO: 64774 - DNA, 20 bp, Artificial Sequence
  Description of Artificial Sequence: Synthetic oligonucleotide
  Target: SCN10A; (+) strand; PAM type: YTN; PAM sequence: TTT
ttcattttttgtagagacgg

SEQ ID NO: 64775 - DNA, 20 bp, Artificial Sequence
  Description of Artificial Sequence: Synthetic oligonucleotide
  Target: SCN10A; (+) strand; PAM type: YTN; PAM sequence: TTT
tcattttttgtagagacggg

SEQ ID NO: 64776 - DNA, 20 bp, Artificial Sequence
  Description of Artificial Sequence: Synthetic oligonucleotide
  Target: SCN10A; (+) strand; PAM type: YTN; PAM sequence: TTT
cattttttgtagagacgggg

SEQ ID NO: 64777 - DNA, 20 bp, Artificial Sequence
  Description of Artificial Sequence: Synthetic oligonucleotide
  Target: SCN10A; (+) strand; PAM type: YTN; PAM sequence: TTC
attttttgtagagacggggt

SEQ ID NO: 64778 - DNA, 20 bp, Artificial Sequence
  Description of Artificial Sequence: Synthetic oligonucleotide
  Target: SCN10A; (+) strand; PAM type: YTN; PAM sequence: TTT
tttgtagagacggggtttca

SEQ ID NO: 64779 - DNA, 20 bp, Artificial Sequence
  Description of Artificial Sequence: Synthetic oligonucleotide
  Target: SCN10A; (+) strand; PAM type: YTN; PAM sequence: TTT
ttgtagagacggggtttcac

SEQ ID NO: 64780 - DNA, 20 bp, Artificial Sequence
  Description of Artificial Sequence: Synthetic oligonucleotide
  Target: SCN10A; (+) strand; PAM type: YTN; PAM sequence: TTT
tgtagagacggggtttcacc

SEQ ID NO: 64781 - DNA, 20 bp, Artificial Sequence
  Description of Artificial Sequence: Synthetic oligonucleotide
  Target: SCN10A; (+) strand; PAM type: YTN; PAM sequence: TTT
gtagagacggggtttcacca

SEQ ID NO: 64782 - DNA, 20 bp, Artificial Sequence
  Description of Artificial Sequence: Synthetic oligonucleotide
  Target: SCN10A; (+) strand; PAM type: YTN; PAM sequence: TTG
tagagacggggtttcaccat

SEQ ID NO: 64783 - DNA, 20 bp, Artificial Sequence
  Description of Artificial Sequence: Synthetic oligonucleotide
  Target: SCN10A; (+) strand; PAM type: YTN; PAM sequence: TTT
caccatgttgcccttgaact

SEQ ID NO: 64784 - DNA, 20 bp, Artificial Sequence
  Description of Artificial Sequence: Synthetic oligonucleotide
  Target: SCN10A; (+) strand; PAM type: YTN; PAM sequence: TTC
accatgttgcccttgaactc

SEQ ID NO: 64785 - DNA, 20 bp, Artificial Sequence
  Description of Artificial Sequence: Synthetic oligonucleotide
  Target: SCN10A; (+) strand; PAM type: YTN; PAM sequence: TTG
cccttgaactcctgggctca

SEQ ID NO: 64786 - DNA, 20 bp, Artificial Sequence
  Description of Artificial Sequence: Synthetic oligonucleotide
  Target: SCN10A; (+) strand; PAM type: YTN; PAM sequence: CTT
gaactcctgggctcaagcga

SEQ ID NO: 64787 - DNA, 20 bp, Artificial Sequence
  Description of Artificial Sequence: Synthetic oligonucleotide
  Target: SCN10A; (+) strand; PAM type: YTN; PAM sequence: TTG
aactcctgggctcaagcgat

SEQ ID NO: 64788 - DNA, 20 bp, Artificial Sequence
  Description of Artificial Sequence: Synthetic oligonucleotide
  Target: SCN10A; (+) strand; PAM type: YTN; PAM sequence: CTC
ctgggctcaagcgatctgcc

SEQ ID NO: 64789 - DNA, 20 bp, Artificial Sequence
  Description of Artificial Sequence: Synthetic oligonucleotide
  Target: SCN10A; (+) strand; PAM type: YTN; PAM sequence: CTG
ggctcaagcgatctgcctgc

SEQ ID NO: 64790 - DNA, 20 bp, Artificial Sequence
  Description of Artificial Sequence: Synthetic oligonucleotide
  Target: SCN10A; (+) strand; PAM type: YTN; PAM sequence: CTC
aagcgatctgcctgcctcgg

SEQ ID NO: 64791 - DNA, 20 bp, Artificial Sequence
  Description of Artificial Sequence: Synthetic oligonucleotide
  Target: SCN10A; (+) strand; PAM type: YTN; PAM sequence: CTG
cctgcctcggcctcccaaag

SEQ ID NO: 64792 - DNA, 20 bp, Artificial Sequence
  Description of Artificial Sequence: Synthetic oligonucleotide
  Target: SCN10A; (+) strand; PAM type: YTN; PAM sequence: CTG
cctcggcctcccaaagtact

SEQ ID NO: 64793 - DNA, 20 bp, Artificial Sequence
  Description of Artificial Sequence: Synthetic oligonucleotide
  Target: SCN10A; (+) strand; PAM type: YTN; PAM sequence: CTC
ggcctcccaaagtactagga

SEQ ID NO: 64794 - DNA, 20 bp, Artificial Sequence
  Description of Artificial Sequence: Synthetic oligonucleotide
  Target: SCN10A; (+) strand; PAM type: YTN; PAM sequence: CTC
ccaaagtactaggattacag

SEQ ID NO: 64795 - DNA, 20 bp, Artificial Sequence
  Description of Artificial Sequence: Synthetic oligonucleotide
  Target: SCN10A; (+) strand; PAM type: YTN; PAM sequence: CTA
ggattacaggtgtgagccac

SEQ ID NO: 64796 - DNA, 20 bp, Artificial Sequence
  Description of Artificial Sequence: Synthetic oligonucleotide
  Target: SCN10A; (+) strand; PAM type: YTN; PAM sequence: TTA
caggtgtgagccactgcacc

SEQ ID NO: 64797 - DNA, 20 bp, Artificial Sequence
  Description of Artificial Sequence: Synthetic oligonucleotide
  Target: SCN10A; (+) strand; PAM type: YTN; PAM sequence: CTG
cacctggcctgagatggtca

SEQ ID NO: 64798 - DNA, 20 bp, Artificial Sequence
  Description of Artificial Sequence: Synthetic oligonucleotide
  Target: SCN10A; (+) strand; PAM type: YTN; PAM sequence: CTG
gcctgagatggtcacattga

SEQ ID NO: 64799 - DNA, 20 bp, Artificial Sequence
  Description of Artificial Sequence: Synthetic oligonucleotide
  Target: SCN10A; (+) strand; PAM type: YTN; PAM sequence: CTG
agatggtcacattgatttct

SEQ ID NO: 64800 - DNA, 20 bp, Artificial Sequence
  Description of Artificial Sequence: Synthetic oligonucleotide
  Target: SCN10A; (+) strand; PAM type: YTN; PAM sequence: TTG
atttctatgtaaacatccct

SEQ ID NO: 64801 - DNA, 20 bp, Artificial Sequence
  Description of Artificial Sequence: Synthetic oligonucleotide
  Target: SCN10A; (+) strand; PAM type: YTN; PAM sequence: TTT
ctatgtaaacatccctccca

SEQ ID NO: 64802 - DNA, 20 bp, Artificial Sequence
  Description of Artificial Sequence: Synthetic oligonucleotide
  Target: SCN10A; (+) strand; PAM type: YTN; PAM sequence: TTC
tatgtaaacatccctcccag

SEQ ID NO: 64803 - DNA, 20 bp, Artificial Sequence
  Description of Artificial Sequence: Synthetic oligonucleotide
  Target: SCN10A; (+) strand; PAM type: YTN; PAM sequence: CTA
tgtaaacatccctcccagga

SEQ ID NO: 64804 - DNA, 20 bp, Artificial Sequence
  Description of Artificial Sequence: Synthetic oligonucleotide
  Target: SCN10A; (+) strand; PAM type: YTN; PAM sequence: CTC
ccaggagttgtgcactgctt

SEQ ID NO: 64805 - DNA, 20 bp, Artificial Sequence
  Description of Artificial Sequence: Synthetic oligonucleotide
  Target: SCN10A; (+) strand; PAM type: YTN; PAM sequence: TTG
tgcactgctttgggtctgcc

SEQ ID NO: 64806 - DNA, 20 bp, Artificial Sequence
  Description of Artificial Sequence: Synthetic oligonucleotide
  Target: SCN10A; (+) strand; PAM type: YTN; PAM sequence: CTG
ctttgggtctgcctaggtga

SEQ ID NO: 64807 - DNA, 20 bp, Artificial Sequence
  Description of Artificial Sequence: Synthetic oligonucleotide
  Target: SCN10A; (+) strand; PAM type: YTN; PAM sequence: CTT
tgggtctgcctaggtgaaat

SEQ ID NO: 64808 - DNA, 20 bp, Artificial Sequence
  Description of Artificial Sequence: Synthetic oligonucleotide
  Target: SCN10A; (+) strand; PAM type: YTN; PAM sequence: TTT
gggtctgcctaggtgaaatg

SEQ ID NO: 64809 - DNA, 20 bp, Artificial Sequence
  Description of Artificial Sequence: Synthetic oligonucleotide
  Target: SCN10A; (+) strand; PAM type: YTN; PAM sequence: TTG
ggtctgcctaggtgaaatgg

SEQ ID NO: 64810 - DNA, 20 bp, Artificial Sequence
  Description of Artificial Sequence: Synthetic oligonucleotide
  Target: SCN10A; (+) strand; PAM type: YTN; PAM sequence: CTG
cctaggtgaaatggagtcat

SEQ ID NO: 64811 - DNA, 20 bp, Artificial Sequence
  Description of Artificial Sequence: Synthetic oligonucleotide
  Target: SCN10A; (+) strand; PAM type: YTN; PAM sequence: CTA
ggtgaaatggagtcatcttt

SEQ ID NO: 64812 - DNA, 20 bp, Artificial Sequence
  Description of Artificial Sequence: Synthetic oligonucleotide
  Target: SCN10A; (+) strand; PAM type: YTN; PAM sequence: CTT
tgcctgtctacctgaggcaa

SEQ ID NO: 64813 - DNA, 20 bp, Artificial Sequence
  Description of Artificial Sequence: Synthetic oligonucleotide
  Target: SCN10A; (+) strand; PAM type: YTN; PAM sequence: TTT
gcctgtctacctgaggcaaa

SEQ ID NO: 64814 - DNA, 20 bp, Artificial Sequence
  Description of Artificial Sequence: Synthetic oligonucleotide
  Target: SCN10A; (+) strand; PAM type: YTN; PAM sequence: TTG
cctgtctacctgaggcaaat

SEQ ID NO: 64815 - DNA, 20 bp, Artificial Sequence
  Description of Artificial Sequence: Synthetic oligonucleotide
  Target: SCN10A; (+) strand; PAM type: YTN; PAM sequence: CTG
tctacctgaggcaaatatcc

SEQ ID NO: 64816 - DNA, 20 bp, Artificial Sequence
  Description of Artificial Sequence: Synthetic oligonucleotide
  Target: SCN10A; (+) strand; PAM type: YTN; PAM sequence: CTA
cctgaggcaaatatccagtg

SEQ ID NO: 64817 - DNA, 20 bp, Artificial Sequence
  Description of Artificial Sequence: Synthetic oligonucleotide
  Target: SCN10A; (+) strand; PAM type: YTN; PAM sequence: CTG
aggcaaatatccagtgccca

SEQ ID NO: 64818 - DNA, 20 bp, Artificial Sequence
  Description of Artificial Sequence: Synthetic oligonucleotide
  Target: SCN10A; (+) strand; PAM type: YTN; PAM sequence: CTC
ttccatggctggctctatgt

SEQ ID NO: 64819 - DNA, 20 bp, Artificial Sequence
  Description of Artificial Sequence: Synthetic oligonucleotide
  Target: SCN10A; (+) strand; PAM type: YTN; PAM sequence: CTT
ccatggctggctctatgtca

SEQ ID NO: 64820 - DNA, 20 bp, Artificial Sequence
  Description of Artificial Sequence: Synthetic oligonucleotide
  Target: SCN10A; (+) strand; PAM type: YTN; PAM sequence: TTC
catggctggctctatgtcac

SEQ ID NO: 64821 - DNA, 20 bp, Artificial Sequence
  Description of Artificial Sequence: Synthetic oligonucleotide
  Target: SCN10A; (+) strand; PAM type: YTN; PAM sequence: CTG
gctctatgtcactgcacatg

SEQ ID NO: 64822 - DNA, 20 bp, Artificial Sequence
  Description of Artificial Sequence: Synthetic oligonucleotide
  Target: SCN10A; (+) strand; PAM type: YTN; PAM sequence: CTC
tatgtcactgcacatgggca

SEQ ID NO: 64823 - DNA, 20 bp, Artificial Sequence
  Description of Artificial Sequence: Synthetic oligonucleotide
  Target: SCN10A; (+) strand; PAM type: YTN; PAM sequence: CTA
tgtcactgcacatgggcatt

SEQ ID NO: 64824 - DNA, 20 bp, Artificial Sequence
  Description of Artificial Sequence: Synthetic oligonucleotide
  Target: SCN10A; (+) strand; PAM type: YTN; PAM sequence: CTG
cacatgggcatttgagtttg

SEQ ID NO: 64825 - DNA, 20 bp, Artificial Sequence
  Description of Artificial Sequence: Synthetic oligonucleotide
  Target: SCN10A; (+) strand; PAM type: YTN; PAM sequence: TTT
gagtttgccacccctaatcc

SEQ ID NO: 64826 - DNA, 20 bp, Artificial Sequence
  Description of Artificial Sequence: Synthetic oligonucleotide
  Target: SCN10A; (+) strand; PAM type: YTN; PAM sequence: TTG
agtttgccacccctaatcca

SEQ ID NO: 64827 - DNA, 20 bp, Artificial Sequence
  Description of Artificial Sequence: Synthetic oligonucleotide
  Target: SCN10A; (+) strand; PAM type: YTN; PAM sequence: TTT
gccacccctaatccaggtac

SEQ ID NO: 64828 - DNA, 20 bp, Artificial Sequence
  Description of Artificial Sequence: Synthetic oligonucleotide
  Target: SCN10A; (+) strand; PAM type: YTN; PAM sequence: TTG
ccacccctaatccaggtacg

SEQ ID NO: 64829 - DNA, 20 bp, Artificial Sequence
  Description of Artificial Sequence: Synthetic oligonucleotide
  Target: SCN10A; (+) strand; PAM type: YTN; PAM sequence: CTA
atccaggtacgccaagttca

SEQ ID NO: 64830 - DNA, 20 bp, Artificial Sequence
  Description of Artificial Sequence: Synthetic oligonucleotide
  Target: SCN10A; (+) strand; PAM type: YTN; PAM sequence: TTC
aggggctcagcactgtctca

SEQ ID NO: 64831 - DNA, 20 bp, Artificial Sequence
  Description of Artificial Sequence: Synthetic oligonucleotide
  Target: SCN10A; (+) strand; PAM type: YTN; PAM sequence: CTC
agcactgtctcactggcccc

SEQ ID NO: 64832 - DNA, 20 bp, Artificial Sequence
  Description of Artificial Sequence: Synthetic oligonucleotide
  Target: SCN10A; (+) strand; PAM type: YTN; PAM sequence: CTG
tctcactggcccctgtgata

SEQ ID NO: 64833 - DNA, 20 bp, Artificial Sequence
  Description of Artificial Sequence: Synthetic oligonucleotide
  Target: SCN10A; (+) strand; PAM type: YTN; PAM sequence: CTC
actggcccctgtgatagggt

SEQ ID NO: 64834 - DNA, 20 bp, Artificial Sequence
  Description of Artificial Sequence: Synthetic oligonucleotide
  Target: SCN10A; (+) strand; PAM type: YTN; PAM sequence: CTG
gcccctgtgatagggtccca

SEQ ID NO: 64835 - DNA, 20 bp, Artificial Sequence
  Description of Artificial Sequence: Synthetic oligonucleotide
  Target: SCN10A; (+) strand; PAM type: YTN; PAM sequence: CTG
tgatagggtcccaagcagat

SEQ ID NO: 64836 - DNA, 20 bp, Artificial Sequence
  Description of Artificial Sequence: Synthetic oligonucleotide
  Target: SCN10A; (+) strand; PAM type: YTN; PAM sequence: CTG
tcctagagtctcgttgcctc

SEQ ID NO: 64837 - DNA, 20 bp, Artificial Sequence
  Description of Artificial Sequence: Synthetic oligonucleotide
  Target: SCN10A; (+) strand; PAM type: YTN; PAM sequence: CTA
gagtctcgttgcctcctgaa

SEQ ID NO: 64838 - DNA, 20 bp, Artificial Sequence
  Description of Artificial Sequence: Synthetic oligonucleotide
  Target: SCN10A; (+) strand; PAM type: YTN; PAM sequence: CTC
gttgcctcctgaaccatgca

SEQ ID NO: 64839 - DNA, 20 bp, Artificial Sequence
  Description of Artificial Sequence: Synthetic oligonucleotide
  Target: SCN10A; (+) strand; PAM type: YTN; PAM sequence: TTG
cctcctgaaccatgcacccc

SEQ ID NO: 64840 - DNA, 20 bp, Artificial Sequence
  Description of Artificial Sequence: Synthetic oligonucleotide
  Target: SCN10A; (+) strand; PAM type: YTN; PAM sequence: CTC
ctgaaccatgcacccccttc

SEQ ID NO: 64841 - DNA, 20 bp, Artificial Sequence
  Description of Artificial Sequence: Synthetic oligonucleotide
  Target: SCN10A; (+) strand; PAM type: YTN; PAM sequence: CTG
aaccatgcacccccttcaac

SEQ ID NO: 64842 - DNA, 20 bp, Artificial Sequence
  Description of Artificial Sequence: Synthetic oligonucleotide
  Target: SCN10A; (+) strand; PAM type: YTN; PAM sequence: CTT
caacctctggatgccaacac

SEQ ID NO: 64843 - DNA, 20 bp, Artificial Sequence
  Description of Artificial Sequence: Synthetic oligonucleotide
  Target: SCN10A; (+) strand; PAM type: YTN; PAM sequence: TTC
aacctctggatgccaacact

SEQ ID NO: 64844 - DNA, 20 bp, Artificial Sequence
  Description of Artificial Sequence: Synthetic oligonucleotide
  Target: SCN10A; (+) strand; PAM type: YTN; PAM sequence: CTC
tggatgccaacacttgtcag

SEQ ID NO: 64845 - DNA, 20 bp, Artificial Sequence
  Description of Artificial Sequence: Synthetic oligonucleotide
  Target: SCN10A; (+) strand; PAM type: YTN; PAM sequence: CTG
gatgccaacacttgtcagga

SEQ ID NO: 64846 - DNA, 20 bp, Artificial Sequence
  Description of Artificial Sequence: Synthetic oligonucleotide
  Target: SCN10A; (+) strand; PAM type: YTN; PAM sequence: CTT
gtcaggaccttgggaagatt

SEQ ID NO: 64847 - DNA, 20 bp, Artificial Sequence
  Description of Artificial Sequence: Synthetic oligonucleotide
  Target: SCN10A; (+) strand; PAM type: YTN; PAM sequence: TTG
tcaggaccttgggaagattg

SEQ ID NO: 64848 - DNA, 20 bp, Artificial Sequence
  Description of Artificial Sequence: Synthetic oligonucleotide
  Target: SCN10A; (+) strand; PAM type: YTN; PAM sequence: CTT
gggaagattgttggatactc

SEQ ID NO: 64849 - DNA, 20 bp, Artificial Sequence
  Description of Artificial Sequence: Synthetic oligonucleotide
  Target: SCN10A; (+) strand; PAM type: YTN; PAM sequence: TTG
ggaagattgttggatactcc

SEQ ID NO: 64850 - DNA, 20 bp, Artificial Sequence
  Description of Artificial Sequence: Synthetic oligonucleotide
  Target: SCN10A; (+) strand; PAM type: YTN; PAM sequence: TTG
ttggatactcccctttgttt

SEQ ID NO: 64851 - DNA, 20 bp, Artificial Sequence
  Description of Artificial Sequence: Synthetic oligonucleotide
  Target: SCN10A; (+) strand; PAM type: YTN; PAM sequence: TTG
gatactcccctttgttttgt

SEQ ID NO: 64852 - DNA, 20 bp, Artificial Sequence
  Description of Artificial Sequence: Synthetic oligonucleotide
  Target: SCN10A; (+) strand; PAM type: YTN; PAM sequence: CTC
ccctttgttttgtcacctct

SEQ ID NO: 64853 - DNA, 20 bp, Artificial Sequence
  Description of Artificial Sequence: Synthetic oligonucleotide
  Target: SCN10A; (+) strand; PAM type: YTN; PAM sequence: CTT
tgttttgtcacctctcttca

SEQ ID NO: 64854 - DNA, 20 bp, Artificial Sequence
  Description of Artificial Sequence: Synthetic oligonucleotide
  Target: SCN10A; (+) strand; PAM type: YTN; PAM sequence: TTT
gttttgtcacctctcttcaa

SEQ ID NO: 64855 - DNA, 20 bp, Artificial Sequence
  Description of Artificial Sequence: Synthetic oligonucleotide
  Target: SCN10A; (+) strand; PAM type: YTN; PAM sequence: TTG
ttttgtcacctctcttcaag

SEQ ID NO: 64856 - DNA, 20 bp, Artificial Sequence
  Description of Artificial Sequence: Synthetic oligonucleotide
  Target: SCN10A; (+) strand; PAM type: YTN; PAM sequence: TTT
tgtcacctctcttcaagtct

SEQ ID NO: 64857 - DNA, 20 bp, Artificial Sequence
  Description of Artificial Sequence: Synthetic oligonucleotide
  Target: SCN10A; (+) strand; PAM type: YTN; PAM sequence: TTT
gtcacctctcttcaagtcta

SEQ ID NO: 64858 - DNA, 20 bp, Artificial Sequence
  Description of Artificial Sequence: Synthetic oligonucleotide
  Target: SCN10A; (+) strand; PAM type: YTN; PAM sequence: TTG
tcacctctcttcaagtctag

SEQ ID NO: 64859 - DNA, 20 bp, Artificial Sequence
  Description of Artificial Sequence: Synthetic oligonucleotide
  Target: SCN10A; (+) strand; PAM type: YTN; PAM sequence: CTC
tcttcaagtctagatgcagg

SEQ ID NO: 64860 - DNA, 20 bp, Artificial Sequence
  Description of Artificial Sequence: Synthetic oligonucleotide
  Target: SCN10A; (+) strand; PAM type: YTN; PAM sequence: CTC
ttcaagtctagatgcagggc

SEQ ID NO: 64861 - DNA, 20 bp, Artificial Sequence
  Description of Artificial Sequence: Synthetic oligonucleotide
  Target: SCN10A; (+) strand; PAM type: YTN; PAM sequence: CTT
caagtctagatgcagggctc

SEQ ID NO: 64862 - DNA, 20 bp, Artificial Sequence
  Description of Artificial Sequence: Synthetic oligonucleotide
  Target: SCN10A; (+) strand; PAM type: YTN; PAM sequence: TTC
aagtctagatgcagggctcc

SEQ ID NO: 64863 - DNA, 20 bp, Artificial Sequence
  Description of Artificial Sequence: Synthetic oligonucleotide
  Target: SCN10A; (+) strand; PAM type: YTN; PAM sequence: CTA
gatgcagggctcccagttaa

SEQ ID NO: 64864 - DNA, 20 bp, Artificial Sequence
  Description of Artificial Sequence: Synthetic oligonucleotide
  Target: SCN10A; (+) strand; PAM type: YTN; PAM sequence: CTC
ccagttaatactgagagatt

SEQ ID NO: 64865 - DNA, 20 bp, Artificial Sequence
  Description of Artificial Sequence: Synthetic oligonucleotide
  Target: SCN10A; (+) strand; PAM type: YTN; PAM sequence: TTA
atactgagagattcctgaga

SEQ ID NO: 64866 - DNA, 20 bp, Artificial Sequence
  Description of Artificial Sequence: Synthetic oligonucleotide
  Target: SCN10A; (+) strand; PAM type: YTN; PAM sequence: CTG
agagattcctgagagcaggc

SEQ ID NO: 64867 - DNA, 20 bp, Artificial Sequence
  Description of Artificial Sequence: Synthetic oligonucleotide
  Target: SCN10A; (+) strand; PAM type: YTN; PAM sequence: TTC
ctgagagcaggcggcctgcg

SEQ ID NO: 64868 - DNA, 20 bp, Artificial Sequence
  Description of Artificial Sequence: Synthetic oligonucleotide
  Target: SCN10A; (+) strand; PAM type: YTN; PAM sequence: CTG
agagcaggcggcctgcgcta

SEQ ID NO: 64869 - DNA, 20 bp, Artificial Sequence
  Description of Artificial Sequence: Synthetic oligonucleotide
  Target: SCN10A; (+) strand; PAM type: YTN; PAM sequence: CTG
cgctaacaagccgtgacatt

SEQ ID NO: 64870 - DNA, 20 bp, Artificial Sequence
  Description of Artificial Sequence: Synthetic oligonucleotide
  Target: SCN10A; (+) strand; PAM type: YTN; PAM sequence: CTA
acaagccgtgacatttcttc

SEQ ID NO: 64871 - DNA, 20 bp, Artificial Sequence
  Description of Artificial Sequence: Synthetic oligonucleotide
  Target: SCN10A; (+) strand; PAM type: YTN; PAM sequence: TTT
cttcaggcctctttcctatt

SEQ ID NO: 64872 - DNA, 20 bp, Artificial Sequence
  Description of Artificial Sequence: Synthetic oligonucleotide
  Target: SCN10A; (+) strand; PAM type: YTN; PAM sequence: TTC
ttcaggcctctttcctattc

SEQ ID NO: 64873 - DNA, 20 bp, Artificial Sequence
  Description of Artificial Sequence: Synthetic oligonucleotide
  Target: SCN10A; (+) strand; PAM type: YTN; PAM sequence: CTT
caggcctctttcctattccc

SEQ ID NO: 64874 - DNA, 20 bp, Artificial Sequence
  Description of Artificial Sequence: Synthetic oligonucleotide
  Target: SCN10A; (+) strand; PAM type: YTN; PAM sequence: TTC
aggcctctttcctattccca

SEQ ID NO: 64875 - DNA, 20 bp, Artificial Sequence
  Description of Artificial Sequence: Synthetic oligonucleotide
  Target: SCN10A; (+) strand; PAM type: YTN; PAM sequence: CTC
tttcctattcccaagagtca

SEQ ID NO: 64876 - DNA, 20 bp, Artificial Sequence
  Description of Artificial Sequence: Synthetic oligonucleotide
  Target: SCN10A; (+) strand; PAM type: YTN; PAM sequence: CTT
tcctattcccaagagtcagt

SEQ ID NO: 64877 - DNA, 20 bp, Artificial Sequence
  Description of Artificial Sequence: Synthetic oligonucleotide
  Target: SCN10A; (+) strand; PAM type: YTN; PAM sequence: TTT
cctattcccaagagtcagtg

SEQ ID NO: 64878 - DNA, 20 bp, Artificial Sequence
  Description of Artificial Sequence: Synthetic oligonucleotide
  Target: SCN10A; (+) strand; PAM type: YTN; PAM sequence: TTC
ctattcccaagagtcagtga

SEQ ID NO: 64879 - DNA, 20 bp, Artificial Sequence
  Description of Artificial Sequence: Synthetic oligonucleotide
  Target: SCN10A; (+) strand; PAM type: YTN; PAM sequence: CTA
ttcccaagagtcagtgagat

SEQ ID NO: 64880 - DNA, 20 bp, Artificial Sequence
  Description of Artificial Sequence: Synthetic oligonucleotide
  Target: SCN10A; (+) strand; PAM type: YTN; PAM sequence: TTC
ccaagagtcagtgagatgcc

SEQ ID NO: 64881 - DNA, 20 bp, Artificial Sequence
  Description of Artificial Sequence: Synthetic oligonucleotide
  Target: SCN10A; (+) strand; PAM type: YTN; PAM sequence: CTT
cctccagatggcctggagac

SEQ ID NO: 64882 - DNA, 20 bp, Artificial Sequence
  Description of Artificial Sequence: Synthetic oligonucleotide
  Target: SCN10A; (+) strand; PAM type: YTN; PAM sequence: TTC
ctccagatggcctggagacc

SEQ ID NO: 64883 - DNA, 20 bp, Artificial Sequence
  Description of Artificial Sequence: Synthetic oligonucleotide
  Target: SCN10A; (+) strand; PAM type: YTN; PAM sequence: CTC
cagatggcctggagacctag

SEQ ID NO: 64884 - DNA, 20 bp, Artificial Sequence
  Description of Artificial Sequence: Synthetic oligonucleotide
  Target: SCN10A; (+) strand; PAM type: YTN; PAM sequence: CTG
gagacctagtgacccgacac

SEQ ID NO: 64885 - DNA, 20 bp, Artificial Sequence
  Description of Artificial Sequence: Synthetic oligonucleotide
  Target: SCN10A; (+) strand; PAM type: YTN; PAM sequence: CTA
gtgacccgacactcctggga

SEQ ID NO: 64886 - DNA, 20 bp, Artificial Sequence
  Description of Artificial Sequence: Synthetic oligonucleotide
  Target: SCN10A; (+) strand; PAM type: YTN; PAM sequence: CTC
ctgggaatctgacaggtttg

SEQ ID NO: 64887 - DNA, 20 bp, Artificial Sequence
  Description of Artificial Sequence: Synthetic oligonucleotide
  Target: SCN10A; (+) strand; PAM type: YTN; PAM sequence: CTG
ggaatctgacaggtttggct

SEQ ID NO: 64888 - DNA, 20 bp, Artificial Sequence
  Description of Artificial Sequence: Synthetic oligonucleotide
  Target: SCN10A; (+) strand; PAM type: YTN; PAM sequence: CTG
acaggtttggctgacaaacc

SEQ ID NO: 64889 - DNA, 20 bp, Artificial Sequence
  Description of Artificial Sequence: Synthetic oligonucleotide
  Target: SCN10A; (+) strand; PAM type: YTN; PAM sequence: TTT
ggctgacaaacctgtggctc

SEQ ID NO: 64890 - DNA, 20 bp, Artificial Sequence
  Description of Artificial Sequence: Synthetic oligonucleotide
  Target: SCN10A; (+) strand; PAM type: YTN; PAM sequence: TTG
gctgacaaacctgtggctct

SEQ ID NO: 64891 - DNA, 20 bp, Artificial Sequence
  Description of Artificial Sequence: Synthetic oligonucleotide
  Target: SCN10A; (+) strand; PAM type: YTN; PAM sequence: CTG
acaaacctgtggctctgata

SEQ ID NO: 64892 - DNA, 20 bp, Artificial Sequence
  Description of Artificial Sequence: Synthetic oligonucleotide
  Target: SCN10A; (+) strand; PAM type: YTN; PAM sequence: CTG
tggctctgataaaagtgggt

SEQ ID NO: 64893 - DNA, 20 bp, Artificial Sequence
  Description of Artificial Sequence: Synthetic oligonucleotide
  Target: SCN10A; (+) strand; PAM type: YTN; PAM sequence: CTC
tgataaaagtgggtggcctg

SEQ ID NO: 64894 - DNA, 20 bp, Artificial Sequence
  Description of Artificial Sequence: Synthetic oligonucleotide
  Target: SCN10A; (+) strand; PAM type: YTN; PAM sequence: CTG
ataaaagtgggtggcctgtg

SEQ ID NO: 64895 - DNA, 20 bp, Artificial Sequence
  Description of Artificial Sequence: Synthetic oligonucleotide
  Target: SCN10A; (+) strand; PAM type: YTN; PAM sequence: CTG
tggcacttctcctgtagagg

SEQ ID NO: 64896 - DNA, 20 bp, Artificial Sequence
  Description of Artificial Sequence: Synthetic oligonucleotide
  Target: SCN10A; (+) strand; PAM type: YTN; PAM sequence: CTT
ctcctgtagagggcgtcctg

SEQ ID NO: 64897 - DNA, 20 bp, Artificial Sequence
  Description of Artificial Sequence: Synthetic oligonucleotide
  Target: SCN10A; (+) strand; PAM type: YTN; PAM sequence: TTC
tcctgtagagggcgtcctgg

SEQ ID NO: 64898 - DNA, 20 bp, Artificial Sequence
  Description of Artificial Sequence: Synthetic oligonucleotide
  Target: SCN10A; (+) strand; PAM type: YTN; PAM sequence: CTC
ctgtagagggcgtcctggag

SEQ ID NO: 64899 - DNA, 20 bp, Artificial Sequence
  Description of Artificial Sequence: Synthetic oligonucleotide
  Target: SCN10A; (+) strand; PAM type: YTN; PAM sequence: CTG
tagagggcgtcctggagctg

SEQ ID NO: 64900 - DNA, 20 bp, Artificial Sequence
  Description of Artificial Sequence: Synthetic oligonucleotide
  Target: SCN10A; (+) strand; PAM type: YTN; PAM sequence: CTG
gagctgagtttagagaagag

SEQ ID NO: 64901 - DNA, 20 bp, Artificial Sequence
  Description of Artificial Sequence: Synthetic oligonucleotide
  Target: SCN10A; (+) strand; PAM type: YTN; PAM sequence: CTG
agtttagagaagagccatca

SEQ ID NO: 64902 - DNA, 20 bp, Artificial Sequence
  Description of Artificial Sequence: Synthetic oligonucleotide
  Target: SCN10A; (+) strand; PAM type: YTN; PAM sequence: TTT
agagaagagccatcattgca

SEQ ID NO: 64903 - DNA, 20 bp, Artificial Sequence
  Description of Artificial Sequence: Synthetic oligonucleotide
  Target: SCN10A; (+) strand; PAM type: YTN; PAM sequence: TTA
gagaagagccatcattgcat

SEQ ID NO: 64904 - DNA, 20 bp, Artificial Sequence
  Description of Artificial Sequence: Synthetic oligonucleotide
  Target: SCN10A; (+) strand; PAM type: YTN; PAM sequence: TTG
catgtgagtgagactaatag

SEQ ID NO: 64905 - DNA, 20 bp, Artificial Sequence
  Description of Artificial Sequence: Synthetic oligonucleotide
  Target: SCN10A; (+) strand; PAM type: YTN; PAM sequence: CTA
ataggcaggttgaaggtgct

SEQ ID NO: 64906 - DNA, 20 bp, Artificial Sequence
  Description of Artificial Sequence: Synthetic oligonucleotide
  Target: SCN10A; (+) strand; PAM type: YTN; PAM sequence: TTG
aaggtgcttgagacattggg

SEQ ID NO: 64907 - DNA, 20 bp, Artificial Sequence
  Description of Artificial Sequence: Synthetic oligonucleotide
  Target: SCN10A; (+) strand; PAM type: YTN; PAM sequence: CTT
gagacattggggctgtgatt

SEQ ID NO: 64908 - DNA, 20 bp, Artificial Sequence
  Description of Artificial Sequence: Synthetic oligonucleotide
  Target: SCN10A; (+) strand; PAM type: YTN; PAM sequence: TTG
agacattggggctgtgattt

SEQ ID NO: 64909 - DNA, 20 bp, Artificial Sequence
  Description of Artificial Sequence: Synthetic oligonucleotide
  Target: SCN10A; (+) strand; PAM type: YTN; PAM sequence: TTG
gggctgtgatttcgggcaca

SEQ ID NO: 64910 - DNA, 20 bp, Artificial Sequence
  Description of Artificial Sequence: Synthetic oligonucleotide
  Target: SCN10A; (+) strand; PAM type: YTN; PAM sequence: CTG
tgatttcgggcacaagggaa

SEQ ID NO: 64911 - DNA, 20 bp, Artificial Sequence
  Description of Artificial Sequence: Synthetic oligonucleotide
  Target: SCN10A; (+) strand; PAM type: YTN; PAM sequence: TTT
cgggcacaagggaatcagag

SEQ ID NO: 64912 - DNA, 20 bp, Artificial Sequence
  Description of Artificial Sequence: Synthetic oligonucleotide
  Target: SCN10A; (+) strand; PAM type: YTN; PAM sequence: TTC
gggcacaagggaatcagaga

SEQ ID NO: 64913 - DNA, 20 bp, Artificial Sequence
  Description of Artificial Sequence: Synthetic oligonucleotide
  Target: SCN10A; (+) strand; PAM type: YTN; PAM sequence: CTT
ccttgaggctggaaggagct

SEQ ID NO: 64914 - DNA, 20 bp, Artificial Sequence
  Description of Artificial Sequence: Synthetic oligonucleotide
  Target: SCN10A; (+) strand; PAM type: YTN; PAM sequence: TTC
cttgaggctggaaggagctg

SEQ ID NO: 64915 - DNA, 20 bp, Artificial Sequence
  Description of Artificial Sequence: Synthetic oligonucleotide
  Target: SCN10A; (+) strand; PAM type: YTN; PAM sequence: CTT
gaggctggaaggagctgggg

SEQ ID NO: 64916 - DNA, 20 bp, Artificial Sequence
  Description of Artificial Sequence: Synthetic oligonucleotide
  Target: SCN10A; (+) strand; PAM type: YTN; PAM sequence: TTG
aggctggaaggagctggggc

SEQ ID NO: 64917 - DNA, 20 bp, Artificial Sequence
  Description of Artificial Sequence: Synthetic oligonucleotide
  Target: SCN10A; (+) strand; PAM type: YTN; PAM sequence: CTG
gaaggagctggggctctgga

SEQ ID NO: 64918 - DNA, 20 bp, Artificial Sequence
  Description of Artificial Sequence: Synthetic oligonucleotide
  Target: SCN10A; (+) strand; PAM type: YTN; PAM sequence: CTG
gggctctggagtcagacaac

SEQ ID NO: 64919 - DNA, 20 bp, Artificial Sequence
  Description of Artificial Sequence: Synthetic oligonucleotide
  Target: SCN10A; (+) strand; PAM type: YTN; PAM sequence: CTC
tggagtcagacaacctggat

SEQ ID NO: 64920 - DNA, 20 bp, Artificial Sequence
  Description of Artificial Sequence: Synthetic oligonucleotide
  Target: SCN10A; (+) strand; PAM type: YTN; PAM sequence: CTG
gagtcagacaacctggattt

SEQ ID NO: 64921 - DNA, 20 bp, Artificial Sequence
  Description of Artificial Sequence: Synthetic oligonucleotide
  Target: SCN10A; (+) strand; PAM type: YTN; PAM sequence: CTG
gatttgagatccaggtctgt

SEQ ID NO: 64922 - DNA, 20 bp, Artificial Sequence
  Description of Artificial Sequence: Synthetic oligonucleotide
  Target: SCN10A; (+) strand; PAM type: YTN; PAM sequence: TTT
gagatccaggtctgtggctt

SEQ ID NO: 64923 - DNA, 20 bp, Artificial Sequence
  Description of Artificial Sequence: Synthetic oligonucleotide
  Target: SCN10A; (+) strand; PAM type: YTN; PAM sequence: TTG
agatccaggtctgtggctta

SEQ ID NO: 64924 - DNA, 20 bp, Artificial Sequence
  Description of Artificial Sequence: Synthetic oligonucleotide
  Target: SCN10A; (+) strand; PAM type: YTN; PAM sequence: CTG
tggcttattcgcttgcttgg

SEQ ID NO: 64925 - DNA, 20 bp, Artificial Sequence
  Description of Artificial Sequence: Synthetic oligonucleotide
  Target: SCN10A; (+) strand; PAM type: YTN; PAM sequence: CTT
attcgcttgcttggcagatg

SEQ ID NO: 64926 - DNA, 20 bp, Artificial Sequence
  Description of Artificial Sequence: Synthetic oligonucleotide
  Target: SCN10A; (+) strand; PAM type: YTN; PAM sequence: TTA
ttcgcttgcttggcagatgg

SEQ ID NO: 64927 - DNA, 20 bp, Artificial Sequence
  Description of Artificial Sequence: Synthetic oligonucleotide
  Target: SCN10A; (+) strand; PAM type: YTN; PAM sequence: TTC
gcttgcttggcagatgggag

SEQ ID NO: 64928 - DNA, 20 bp, Artificial Sequence
  Description of Artificial Sequence: Synthetic oligonucleotide
  Target: SCN10A; (+) strand; PAM type: YTN; PAM sequence: CTT
gcttggcagatgggagactt

SEQ ID NO: 64929 - DNA, 20 bp, Artificial Sequence
  Description of Artificial Sequence: Synthetic oligonucleotide
  Target: SCN10A; (+) strand; PAM type: YTN; PAM sequence: TTG
cttggcagatgggagacttt

SEQ ID NO: 64930 - DNA, 20 bp, Artificial Sequence
  Description of Artificial Sequence: Synthetic oligonucleotide
  Target: SCN10A; (+) strand; PAM type: YTN; PAM sequence: CTT
ggcagatgggagactttcgg

SEQ ID NO: 64931 - DNA, 20 bp, Artificial Sequence
  Description of Artificial Sequence: Synthetic oligonucleotide
  Target: SCN10A; (+) strand; PAM type: YTN; PAM sequence: TTG
gcagatgggagactttcggg

SEQ ID NO: 64932 - DNA, 20 bp, Artificial Sequence
  Description of Artificial Sequence: Synthetic oligonucleotide
  Target: SCN10A; (+) strand; PAM type: YTN; PAM sequence: CTT
tcgggtcatcatggaaccat

SEQ ID NO: 64933 - DNA, 20 bp, Artificial Sequence
  Description of Artificial Sequence: Synthetic oligonucleotide
  Target: SCN10A; (+) strand; PAM type: YTN; PAM sequence: TTT
cgggtcatcatggaaccatt

SEQ ID NO: 64934 - DNA, 20 bp, Artificial Sequence
  Description of Artificial Sequence: Synthetic oligonucleotide
  Target: SCN10A; (+) strand; PAM type: YTN; PAM sequence: TTC
gggtcatcatggaaccattc

SEQ ID NO: 64935 - DNA, 20 bp, Artificial Sequence
  Description of Artificial Sequence: Synthetic oligonucleotide
  Target: SCN10A; (+) strand; PAM type: YTN; PAM sequence: TTC
tttttcctcacccacccctg

SEQ ID NO: 64936 - DNA, 20 bp, Artificial Sequence
  Description of Artificial Sequence: Synthetic oligonucleotide
  Target: SCN10A; (+) strand; PAM type: YTN; PAM sequence: CTT
tttcctcacccacccctgag

SEQ ID NO: 64937 - DNA, 20 bp, Artificial Sequence
  Description of Artificial Sequence: Synthetic oligonucleotide
  Target: SCN10A; (+) strand; PAM type: YTN; PAM sequence: TTT
ttcctcacccacccctgagg

SEQ ID NO: 64938 - DNA, 20 bp, Artificial Sequence
  Description of Artificial Sequence: Synthetic oligonucleotide
  Target: SCN10A; (+) strand; PAM type: YTN; PAM sequence: TTT
tcctcacccacccctgagga

SEQ ID NO: 64939 - DNA, 20 bp, Artificial Sequence
  Description of Artificial Sequence: Synthetic oligonucleotide
  Target: SCN10A; (+) strand; PAM type: YTN; PAM sequence: TTT
cctcacccacccctgaggat

SEQ ID NO: 64940 - DNA, 20 bp, Artificial Sequence
  Description of Artificial Sequence: Synthetic oligonucleotide
  Target: SCN10A; (+) strand; PAM type: YTN; PAM sequence: TTC
ctcacccacccctgaggatc

SEQ ID NO: 64941 - DNA, 20 bp, Artificial Sequence
  Description of Artificial Sequence: Synthetic oligonucleotide
  Target: SCN10A; (+) strand; PAM type: YTN; PAM sequence: CTC
acccacccctgaggatctta

SEQ ID NO: 64942 - DNA, 20 bp, Artificial Sequence
  Description of Artificial Sequence: Synthetic oligonucleotide
  Target: SCN10A; (+) strand; PAM type: YTN; PAM sequence: CTG
aggatcttaaaaacgactat

SEQ ID NO: 64943 - DNA, 20 bp, Artificial Sequence
  Description of Artificial Sequence: Synthetic oligonucleotide
  Target: SCN10A; (+) strand; PAM type: YTN; PAM sequence: CTT
aaaaacgactatctctcagg

SEQ ID NO: 64944 - DNA, 20 bp, Artificial Sequence
  Description of Artificial Sequence: Synthetic oligonucleotide
  Target: SCN10A; (+) strand; PAM type: YTN; PAM sequence: TTA
aaaacgactatctctcaggg

SEQ ID NO: 64945 - DNA, 20 bp, Artificial Sequence
  Description of Artificial Sequence: Synthetic oligonucleotide
  Target: SCN10A; (+) strand; PAM type: YTN; PAM sequence: CTA
tctctcagggttgttgtgag

SEQ ID NO: 64946 - DNA, 20 bp, Artificial Sequence
  Description of Artificial Sequence: Synthetic oligonucleotide
  Target: SCN10A; (+) strand; PAM type: YTN; PAM sequence: CTC
tcagggttgttgtgagcata

SEQ ID NO: 64947 - DNA, 20 bp, Artificial Sequence
  Description of Artificial Sequence: Synthetic oligonucleotide
  Target: SCN10A; (+) strand; PAM type: YTN; PAM sequence: CTC
agggttgttgtgagcataaa

SEQ ID NO: 64948 - DNA, 20 bp, Artificial Sequence
  Description of Artificial Sequence: Synthetic oligonucleotide
  Target: SCN10A; (+) strand; PAM type: YTN; PAM sequence: TTG
ttgtgagcataaaatgaggt

SEQ ID NO: 64949 - DNA, 20 bp, Artificial Sequence
  Description of Artificial Sequence: Synthetic oligonucleotide
  Target: SCN10A; (+) strand; PAM type: YTN; PAM sequence: TTG
tgagcataaaatgaggtgcg

SEQ ID NO: 64950 - DNA, 20 bp, Artificial Sequence
  Description of Artificial Sequence: Synthetic oligonucleotide
  Target: SCN10A; (+) strand; PAM type: YTN; PAM sequence: TTT
tttcaagtgtccagtgctat

SEQ ID NO: 64951 - DNA, 20 bp, Artificial Sequence
  Description of Artificial Sequence: Synthetic oligonucleotide
  Target: SCN10A; (+) strand; PAM type: YTN; PAM sequence: TTT
ttcaagtgtccagtgctatg

SEQ ID NO: 64952 - DNA, 20 bp, Artificial Sequence
  Description of Artificial Sequence: Synthetic oligonucleotide
  Target: SCN10A; (+) strand; PAM type: YTN; PAM sequence: TTT
tcaagtgtccagtgctatgc

SEQ ID NO: 64953 - DNA, 20 bp, Artificial Sequence
  Description of Artificial Sequence: Synthetic oligonucleotide
  Target: SCN10A; (+) strand; PAM type: YTN; PAM sequence: TTT
caagtgtccagtgctatgcc

SEQ ID NO: 64954 - DNA, 20 bp, Artificial Sequence
  Description of Artificial Sequence: Synthetic oligonucleotide
  Target: SCN10A; (+) strand; PAM type: YTN; PAM sequence: TTC
aagtgtccagtgctatgcct

SEQ ID NO: 64955 - DNA, 20 bp, Artificial Sequence
  Description of Artificial Sequence: Synthetic oligonucleotide
  Target: SCN10A; (+) strand; PAM type: YTN; PAM sequence: CTA
tgcctgacacattgtaagtg

SEQ ID NO: 64956 - DNA, 20 bp, Artificial Sequence
  Description of Artificial Sequence: Synthetic oligonucleotide
  Target: SCN10A; (+) strand; PAM type: YTN; PAM sequence: CTG
acacattgtaagtgctcagt

SEQ ID NO: 64957 - DNA, 20 bp, Artificial Sequence
  Description of Artificial Sequence: Synthetic oligonucleotide
  Target: SCN10A; (+) strand; PAM type: YTN; PAM sequence: TTG
taagtgctcagtaagtatta

SEQ ID NO: 64958 - DNA, 20 bp, Artificial Sequence
  Description of Artificial Sequence: Synthetic oligonucleotide
  Target: SCN10A; (+) strand; PAM type: YTN; PAM sequence: CTC
agtaagtattagctgctgtg

SEQ ID NO: 64959 - DNA, 20 bp, Artificial Sequence
  Description of Artificial Sequence: Synthetic oligonucleotide
  Target: SCN10A; (+) strand; PAM type: YTN; PAM sequence: TTA
gctgctgtgattattgctgt

SEQ ID NO: 64960 - DNA, 20 bp, Artificial Sequence
  Description of Artificial Sequence: Synthetic oligonucleotide
  Target: SCN10A; (+) strand; PAM type: YTN; PAM sequence: CTG
ctgtgattattgctgttatt

SEQ ID NO: 64961 - DNA, 20 bp, Artificial Sequence
  Description of Artificial Sequence: Synthetic oligonucleotide
  Target: SCN10A; (+) strand; PAM type: YTN; PAM sequence: CTG
tgattattgctgttattgtt

SEQ ID NO: 64962 - DNA, 20 bp, Artificial Sequence
  Description of Artificial Sequence: Synthetic oligonucleotide
  Target: SCN10A; (+) strand; PAM type: YTN; PAM sequence: TTA
ttgctgttattgttatttga

SEQ ID NO: 64963 - DNA, 20 bp, Artificial Sequence
  Description of Artificial Sequence: Synthetic oligonucleotide
  Target: SCN10A; (+) strand; PAM type: YTN; PAM sequence: TTG
ctgttattgttatttgataa

SEQ ID NO: 64964 - DNA, 20 bp, Artificial Sequence
  Description of Artificial Sequence: Synthetic oligonucleotide
  Target: SCN10A; (+) strand; PAM type: YTN; PAM sequence: CTG
ttattgttatttgataagag

SEQ ID NO: 64965 - DNA, 20 bp, Artificial Sequence
  Description of Artificial Sequence: Synthetic oligonucleotide
  Target: SCN10A; (+) strand; PAM type: YTN; PAM sequence: TTA
ttgttatttgataagagacg

SEQ ID NO: 64966 - DNA, 20 bp, Artificial Sequence
  Description of Artificial Sequence: Synthetic oligonucleotide
  Target: SCN10A; (+) strand; PAM type: YTN; PAM sequence: TTG
ttatttgataagagacgagg

SEQ ID NO: 64967 - DNA, 20 bp, Artificial Sequence
  Description of Artificial Sequence: Synthetic oligonucleotide
  Target: SCN10A; (+) strand; PAM type: YTN; PAM sequence: TTA
tttgataagagacgaggaca

SEQ ID NO: 64968 - DNA, 20 bp, Artificial Sequence
  Description of Artificial Sequence: Synthetic oligonucleotide
  Target: SCN10A; (+) strand; PAM type: YTN; PAM sequence: TTT
gataagagacgaggacagtg

SEQ ID NO: 64969 - DNA, 20 bp, Artificial Sequence
  Description of Artificial Sequence: Synthetic oligonucleotide
  Target: SCN10A; (+) strand; PAM type: YTN; PAM sequence: TTG
ataagagacgaggacagtgc

SEQ ID NO: 64970 - DNA, 20 bp, Artificial Sequence
  Description of Artificial Sequence: Synthetic oligonucleotide
  Target: SCN10A; (+) strand; PAM type: YTN; PAM sequence: CTT
ggaagtcccctcttggtgca

SEQ ID NO: 64971 - DNA, 20 bp, Artificial Sequence
  Description of Artificial Sequence: Synthetic oligonucleotide
  Target: SCN10A; (+) strand; PAM type: YTN; PAM sequence: TTG
gaagtcccctcttggtgcag

SEQ ID NO: 64972 - DNA, 20 bp, Artificial Sequence
  Description of Artificial Sequence: Synthetic oligonucleotide
  Target: SCN10A; (+) strand; PAM type: YTN; PAM sequence: CTC
ttggtgcagataagggagcc

SEQ ID NO: 64973 - DNA, 20 bp, Artificial Sequence
  Description of Artificial Sequence: Synthetic oligonucleotide
  Target: SCN10A; (+) strand; PAM type: YTN; PAM sequence: CTT
ggtgcagataagggagccaa

SEQ ID NO: 64974 - DNA, 20 bp, Artificial Sequence
  Description of Artificial Sequence: Synthetic oligonucleotide
  Target: SCN10A; (+) strand; PAM type: YTN; PAM sequence: TTG
gtgcagataagggagccaag

SEQ ID NO: 64975 - DNA, 20 bp, Artificial Sequence
  Description of Artificial Sequence: Synthetic oligonucleotide
  Target: SCN10A; (+) strand; PAM type: YTN; PAM sequence: CTC
tgagtcagcgaaaagctggg

SEQ ID NO: 64976 - DNA, 20 bp, Artificial Sequence
  Description of Artificial Sequence: Synthetic oligonucleotide
  Target: SCN10A; (+) strand; PAM type: YTN; PAM sequence: CTG
agtcagcgaaaagctggggc

SEQ ID NO: 64977 - DNA, 20 bp, Artificial Sequence
  Description of Artificial Sequence: Synthetic oligonucleotide
  Target: SCN10A; (+) strand; PAM type: YTN; PAM sequence: CTG
gggccacagacccaagtctc

SEQ ID NO: 64978 - DNA, 20 bp, Artificial Sequence
  Description of Artificial Sequence: Synthetic oligonucleotide
  Target: SCN10A; (+) strand; PAM type: YTN; PAM sequence: CTC
cagtcgcccaggagtcagac

SEQ ID NO: 64979 - DNA, 20 bp, Artificial Sequence
  Description of Artificial Sequence: Synthetic oligonucleotide
  Target: SCN10A; (+) strand; PAM type: YTN; PAM sequence: CTG
ctccctcccacaaggacagg

SEQ ID NO: 64980 - DNA, 20 bp, Artificial Sequence
  Description of Artificial Sequence: Synthetic oligonucleotide
  Target: SCN10A; (+) strand; PAM type: YTN; PAM sequence: CTC
cctcccacaaggacaggaga

SEQ ID NO: 64981 - DNA, 20 bp, Artificial Sequence
  Description of Artificial Sequence: Synthetic oligonucleotide
  Target: SCN10A; (+) strand; PAM type: YTN; PAM sequence: CTC
ccacaaggacaggagaggaa

SEQ ID NO: 64982 - DNA, 20 bp, Artificial Sequence
  Description of Artificial Sequence: Synthetic oligonucleotide
  Target: SCN10A; (+) strand; PAM type: YTN; PAM sequence: CTG
gctggtgcagtccccagagc

SEQ ID NO: 64983 - DNA, 20 bp, Artificial Sequence
  Description of Artificial Sequence: Synthetic oligonucleotide
  Target: SCN10A; (+) strand; PAM type: YTN; PAM sequence: CTG
gtgcagtccccagagcacag

SEQ ID NO: 64984 - DNA, 20 bp, Artificial Sequence
  Description of Artificial Sequence: Synthetic oligonucleotide
  Target: SCN10A; (+) strand; PAM type: YTN; PAM sequence: CTT
ccctgaatctgggtgggagt

SEQ ID NO: 64985 - DNA, 20 bp, Artificial Sequence
  Description of Artificial Sequence: Synthetic oligonucleotide
  Target: SCN10A; (+) strand; PAM type: YTN; PAM sequence: TTC
cctgaatctgggtgggagtt

SEQ ID NO: 64986 - DNA, 20 bp, Artificial Sequence
  Description of Artificial Sequence: Synthetic oligonucleotide
  Target: SCN10A; (+) strand; PAM type: YTN; PAM sequence: CTG
aatctgggtgggagtttccc

SEQ ID NO: 64987 - DNA, 20 bp, Artificial Sequence
  Description of Artificial Sequence: Synthetic oligonucleotide
  Target: SCN10A; (+) strand; PAM type: YTN; PAM sequence: CTG
ggtgggagtttccccaagcc

SEQ ID NO: 64988 - DNA, 20 bp, Artificial Sequence
  Description of Artificial Sequence: Synthetic oligonucleotide
  Target: SCN10A; (+) strand; PAM type: YTN; PAM sequence: TTT
ccccaagccatcaagagaaa

SEQ ID NO: 64989 - DNA, 20 bp, Artificial Sequence
  Description of Artificial Sequence: Synthetic oligonucleotide
  Target: SCN10A; (+) strand; PAM type: YTN; PAM sequence: TTC
cccaagccatcaagagaaaa

SEQ ID NO: 64990 - DNA, 20 bp, Artificial Sequence
  Description of Artificial Sequence: Synthetic oligonucleotide
  Target: SCN10A; (+) strand; PAM type: YTN; PAM sequence: TTA
ccaagcggaagctccgcagc

SEQ ID NO: 64991 - DNA, 20 bp, Artificial Sequence
  Description of Artificial Sequence: Synthetic oligonucleotide
  Target: SCN10A; (+) strand; PAM type: YTN; PAM sequence: CTC
cgcagcacagacaggcttcc

SEQ ID NO: 64992 - DNA, 20 bp, Artificial Sequence
  Description of Artificial Sequence: Synthetic oligonucleotide
  Target: SCN10A; (+) strand; PAM type: YTN; PAM sequence: CTT
cccttcttggccacgcccag

SEQ ID NO: 64993 - DNA, 20 bp, Artificial Sequence
  Description of Artificial Sequence: Synthetic oligonucleotide
  Target: SCN10A; (+) strand; PAM type: YTN; PAM sequence: TTC
ccttcttggccacgcccagc

SEQ ID NO: 64994 - DNA, 20 bp, Artificial Sequence
  Description of Artificial Sequence: Synthetic oligonucleotide
  Target: SCN10A; (+) strand; PAM type: YTN; PAM sequence: CTT
cttggccacgcccagctcta

SEQ ID NO: 64995 - DNA, 20 bp, Artificial Sequence
  Description of Artificial Sequence: Synthetic oligonucleotide
  Target: SCN10A; (+) strand; PAM type: YTN; PAM sequence: TTC
ttggccacgcccagctctag

SEQ ID NO: 64996 - DNA, 20 bp, Artificial Sequence
  Description of Artificial Sequence: Synthetic oligonucleotide
  Target: SCN10A; (+) strand; PAM type: YTN; PAM sequence: CTT
ggccacgcccagctctagca

SEQ ID NO: 64997 - DNA, 20 bp, Artificial Sequence
  Description of Artificial Sequence: Synthetic oligonucleotide
  Target: SCN10A; (+) strand; PAM type: YTN; PAM sequence: TTG
gccacgcccagctctagcag

SEQ ID NO: 64998 - DNA, 20 bp, Artificial Sequence
  Description of Artificial Sequence: Synthetic oligonucleotide
  Target: SCN10A; (+) strand; PAM type: YTN; PAM sequence: CTC
tagcagactcacagtgacga

SEQ ID NO: 64999 - DNA, 20 bp, Artificial Sequence
  Description of Artificial Sequence: Synthetic oligonucleotide
  Target: SCN10A; (+) strand; PAM type: YTN; PAM sequence: CTA
gcagactcacagtgacgatg

SEQ ID NO: 65000 - DNA, 20 bp, Artificial Sequence
  Description of Artificial Sequence: Synthetic oligonucleotide
  Target: SCN10A; (+) strand; PAM type: YTN; PAM sequence: CTC
acagtgacgatgatgcagtc

SEQ ID NO: 65001 - DNA, 20 bp, Artificial Sequence
  Description of Artificial Sequence: Synthetic oligonucleotide
  Target: SCN10A; (+) strand; PAM type: YTN; PAM sequence: TTC
cacttcttctggaaataata

SEQ ID NO: 65002 - DNA, 20 bp, Artificial Sequence
  Description of Artificial Sequence: Synthetic oligonucleotide
  Target: SCN10A; (+) strand; PAM type: YTN; PAM sequence: CTT
cttctggaaataatagtatg

SEQ ID NO: 65003 - DNA, 20 bp, Artificial Sequence
  Description of Artificial Sequence: Synthetic oligonucleotide
  Target: SCN10A; (+) strand; PAM type: YTN; PAM sequence: TTC
ttctggaaataatagtatgg

SEQ ID NO: 65004 - DNA, 20 bp, Artificial Sequence
  Description of Artificial Sequence: Synthetic oligonucleotide
  Target: SCN10A; (+) strand; PAM type: YTN; PAM sequence: CTT
ctggaaataatagtatgggt

SEQ ID NO: 65005 - DNA, 20 bp, Artificial Sequence
  Description of Artificial Sequence: Synthetic oligonucleotide
  Target: SCN10A; (+) strand; PAM type: YTN; PAM sequence: TTC
tggaaataatagtatgggtc

SEQ ID NO: 65006 - DNA, 20 bp, Artificial Sequence
  Description of Artificial Sequence: Synthetic oligonucleotide
  Target: SCN10A; (+) strand; PAM type: YTN; PAM sequence: CTG
gaaataatagtatgggtcga

SEQ ID NO: 65007 - DNA, 20 bp, Artificial Sequence
  Description of Artificial Sequence: Synthetic oligonucleotide
  Target: SCN10A; (+) strand; PAM type: YTN; PAM sequence: TTT
tgaagaccatttcagcagta

SEQ ID NO: 65008 - DNA, 20 bp, Artificial Sequence
  Description of Artificial Sequence: Synthetic oligonucleotide
  Target: SCN10A; (+) strand; PAM type: YTN; PAM sequence: TTT
gaagaccatttcagcagtaa

SEQ ID NO: 65009 - DNA, 20 bp, Artificial Sequence
  Description of Artificial Sequence: Synthetic oligonucleotide
  Target: SCN10A; (+) strand; PAM type: YTN; PAM sequence: TTG
aagaccatttcagcagtaaa

SEQ ID NO: 65010 - DNA, 20 bp, Artificial Sequence
  Description of Artificial Sequence: Synthetic oligonucleotide
  Target: SCN10A; (+) strand; PAM type: YTN; PAM sequence: TTT
cagcagtaaaaaatatggta

SEQ ID NO: 65011 - DNA, 20 bp, Artificial Sequence
  Description of Artificial Sequence: Synthetic oligonucleotide
  Target: SCN10A; (+) strand; PAM type: YTN; PAM sequence: TTC
agcagtaaaaaatatggtaa

SEQ ID NO: 65012 - DNA, 20 bp, Artificial Sequence
  Description of Artificial Sequence: Synthetic oligonucleotide
  Target: SCN10A; (+) strand; PAM type: YTN; PAM sequence: CTA
ggagtggaaacaagctttca

SEQ ID NO: 65013 - DNA, 20 bp, Artificial Sequence
  Description of Artificial Sequence: Synthetic oligonucleotide
  Target: SCN10A; (+) strand; PAM type: YTN; PAM sequence: CTT
tcatcacagtgggatctgtg

SEQ ID NO: 65014 - DNA, 20 bp, Artificial Sequence
  Description of Artificial Sequence: Synthetic oligonucleotide
  Target: SCN10A; (+) strand; PAM type: YTN; PAM sequence: TTT
catcacagtgggatctgtgg

SEQ ID NO: 65015 - DNA, 20 bp, Artificial Sequence
  Description of Artificial Sequence: Synthetic oligonucleotide
  Target: SCN10A; (+) strand; PAM type: YTN; PAM sequence: TTC
atcacagtgggatctgtggg

SEQ ID NO: 65016 - DNA, 20 bp, Artificial Sequence
  Description of Artificial Sequence: Synthetic oligonucleotide
  Target: SCN10A; (+) strand; PAM type: YTN; PAM sequence: CTG
tggggtcggaggcaatgata

SEQ ID NO: 65017 - DNA, 20 bp, Artificial Sequence
  Description of Artificial Sequence: Synthetic oligonucleotide
  Target: SCN10A; (+) strand; PAM type: YTN; PAM sequence: CTT
atttacaaaatagaaaatcc

SEQ ID NO: 65018 - DNA, 20 bp, Artificial Sequence
  Description of Artificial Sequence: Synthetic oligonucleotide
  Target: SCN10A; (+) strand; PAM type: YTN; PAM sequence: TTA
tttacaaaatagaaaatcct

SEQ ID NO: 65019 - DNA, 20 bp, Artificial Sequence
  Description of Artificial Sequence: Synthetic oligonucleotide
  Target: SCN10A; (+) strand; PAM type: YTN; PAM sequence: TTT
acaaaatagaaaatcctttt

SEQ ID NO: 65020 - DNA, 20 bp, Artificial Sequence
  Description of Artificial Sequence: Synthetic oligonucleotide
  Target: SCN10A; (+) strand; PAM type: YTN; PAM sequence: TTA
caaaatagaaaatccttttg

SEQ ID NO: 65021 - DNA, 20 bp, Artificial Sequence
  Description of Artificial Sequence: Synthetic oligonucleotide
  Target: SCN10A; (+) strand; PAM type: YTN; PAM sequence: CTT
ttgttttgttcagttgctat

SEQ ID NO: 65022 - DNA, 20 bp, Artificial Sequence
  Description of Artificial Sequence: Synthetic oligonucleotide
  Target: SCN10A; (+) strand; PAM type: YTN; PAM sequence: TTT
tgttttgttcagttgctatg

SEQ ID NO: 65023 - DNA, 20 bp, Artificial Sequence
  Description of Artificial Sequence: Synthetic oligonucleotide
  Target: SCN10A; (+) strand; PAM type: YTN; PAM sequence: TTT
gttttgttcagttgctatgt

SEQ ID NO: 65024 - DNA, 20 bp, Artificial Sequence
  Description of Artificial Sequence: Synthetic oligonucleotide
  Target: SCN10A; (+) strand; PAM type: YTN; PAM sequence: TTG
ttttgttcagttgctatgtt

SEQ ID NO: 65025 - DNA, 20 bp, Artificial Sequence
  Description of Artificial Sequence: Synthetic oligonucleotide
  Target: SCN10A; (+) strand; PAM type: YTN; PAM sequence: TTT
tgttcagttgctatgttatc

SEQ ID NO: 65026 - DNA, 20 bp, Artificial Sequence
  Description of Artificial Sequence: Synthetic oligonucleotide
  Target: SCN10A; (+) strand; PAM type: YTN; PAM sequence: TTT
gttcagttgctatgttatct

SEQ ID NO: 65027 - DNA, 20 bp, Artificial Sequence
  Description of Artificial Sequence: Synthetic oligonucleotide
  Target: SCN10A; (+) strand; PAM type: YTN; PAM sequence: TTG
ttcagttgctatgttatctg

SEQ ID NO: 65028 - DNA, 20 bp, Artificial Sequence
  Description of Artificial Sequence: Synthetic oligonucleotide
  Target: SCN10A; (+) strand; PAM type: YTN; PAM sequence: TTC
agttgctatgttatctgtgg

SEQ ID NO: 65029 - DNA, 20 bp, Artificial Sequence
  Description of Artificial Sequence: Synthetic oligonucleotide
  Target: SCN10A; (+) strand; PAM type: YTN; PAM sequence: TTG
ctatgttatctgtgggctcc

SEQ ID NO: 65030 - DNA, 20 bp, Artificial Sequence
  Description of Artificial Sequence: Synthetic oligonucleotide
  Target: SCN10A; (+) strand; PAM type: YTN; PAM sequence: CTA
tgttatctgtgggctcctga

SEQ ID NO: 65031 - DNA, 20 bp, Artificial Sequence
  Description of Artificial Sequence: Synthetic oligonucleotide
  Target: SCN10A; (+) strand; PAM type: YTN; PAM sequence: TTA
tctgtgggctcctgaggatt

SEQ ID NO: 65032 - DNA, 20 bp, Artificial Sequence
  Description of Artificial Sequence: Synthetic oligonucleotide
  Target: SCN10A; (+) strand; PAM type: YTN; PAM sequence: CTG
tgggctcctgaggattggcc

SEQ ID NO: 65033 - DNA, 20 bp, Artificial Sequence
  Description of Artificial Sequence: Synthetic oligonucleotide
  Target: SCN10A; (+) strand; PAM type: YTN; PAM sequence: CTC
ctgaggattggccagggtaa

SEQ ID NO: 65034 - DNA, 20 bp, Artificial Sequence
  Description of Artificial Sequence: Synthetic oligonucleotide
  Target: SCN10A; (+) strand; PAM type: YTN; PAM sequence: CTG
aggattggccagggtaacag

SEQ ID NO: 65035 - DNA, 20 bp, Artificial Sequence
  Description of Artificial Sequence: Synthetic oligonucleotide
  Target: SCN10A; (+) strand; PAM type: YTN; PAM sequence: TTG
gccagggtaacagtcaacgt

SEQ ID NO: 65036 - DNA, 20 bp, Artificial Sequence
  Description of Artificial Sequence: Synthetic oligonucleotide
  Target: SCN10A; (+) strand; PAM type: YTN; PAM sequence: TTT
ctgcaccattctcaggggct

SEQ ID NO: 65037 - DNA, 20 bp, Artificial Sequence
  Description of Artificial Sequence: Synthetic oligonucleotide
  Target: SCN10A; (+) strand; PAM type: YTN; PAM sequence: TTC
tgcaccattctcaggggctg

SEQ ID NO: 65038 - DNA, 20 bp, Artificial Sequence
  Description of Artificial Sequence: Synthetic oligonucleotide
  Target: SCN10A; (+) strand; PAM type: YTN; PAM sequence: CTG
caccattctcaggggctgtg

SEQ ID NO: 65039 - DNA, 20 bp, Artificial Sequence
  Description of Artificial Sequence: Synthetic oligonucleotide
  Target: SCN10A; (+) strand; PAM type: YTN; PAM sequence: TTC
tcaggggctgtgcatgctgc

SEQ ID NO: 65040 - DNA, 20 bp, Artificial Sequence
  Description of Artificial Sequence: Synthetic oligonucleotide
  Target: SCN10A; (+) strand; PAM type: YTN; PAM sequence: CTC
aggggctgtgcatgctgcag

SEQ ID NO: 65041 - DNA, 20 bp, Artificial Sequence
  Description of Artificial Sequence: Synthetic oligonucleotide
  Target: SCN10A; (+) strand; PAM type: YTN; PAM sequence: CTG
tgcatgctgcagtttttcca

SEQ ID NO: 65042 - DNA, 20 bp, Artificial Sequence
  Description of Artificial Sequence: Synthetic oligonucleotide
  Target: SCN10A; (+) strand; PAM type: YTN; PAM sequence: CTG
cagtttttccacgtgaatgg

SEQ ID NO: 65043 - DNA, 20 bp, Artificial Sequence
  Description of Artificial Sequence: Synthetic oligonucleotide
  Target: SCN10A; (+) strand; PAM type: YTN; PAM sequence: TTT
ttccacgtgaatggtggtgg

SEQ ID NO: 65044 - DNA, 20 bp, Artificial Sequence
  Description of Artificial Sequence: Synthetic oligonucleotide
  Target: SCN10A; (+) strand; PAM type: YTN; PAM sequence: TTT
tccacgtgaatggtggtggg

SEQ ID NO: 65045 - DNA, 20 bp, Artificial Sequence
  Description of Artificial Sequence: Synthetic oligonucleotide
  Target: SCN10A; (+) strand; PAM type: YTN; PAM sequence: TTT
ccacgtgaatggtggtggga

SEQ ID NO: 65046 - DNA, 20 bp, Artificial Sequence
  Description of Artificial Sequence: Synthetic oligonucleotide
  Target: SCN10A; (+) strand; PAM type: YTN; PAM sequence: TTC
cacgtgaatggtggtgggag

SEQ ID NO: 65047 - DNA, 20 bp, Artificial Sequence
  Description of Artificial Sequence: Synthetic oligonucleotide
  Target: SCN10A; (+) strand; PAM type: YTN; PAM sequence: CTT
taagatcattattataatat

SEQ ID NO: 65048 - DNA, 20 bp, Artificial Sequence
  Description of Artificial Sequence: Synthetic oligonucleotide
  Target: SCN10A; (+) strand; PAM type: YTN; PAM sequence: TTT
aagatcattattataatatc

SEQ ID NO: 65049 - DNA, 20 bp, Artificial Sequence
  Description of Artificial Sequence: Synthetic oligonucleotide
  Target: SCN10A; (+) strand; PAM type: YTN; PAM sequence: TTA
agatcattattataatatca

SEQ ID NO: 65050 - DNA, 20 bp, Artificial Sequence
  Description of Artificial Sequence: Synthetic oligonucleotide
  Target: SCN10A; (+) strand; PAM type: YTN; PAM sequence: TTA
ttataatatcattttgtcag

SEQ ID NO: 65051 - DNA, 20 bp, Artificial Sequence
  Description of Artificial Sequence: Synthetic oligonucleotide
  Target: SCN10A; (+) strand; PAM type: YTN; PAM sequence: TTA
taatatcattttgtcagtga

SEQ ID NO: 65052 - DNA, 20 bp, Artificial Sequence
  Description of Artificial Sequence: Synthetic oligonucleotide
  Target: SCN10A; (+) strand; PAM type: YTN; PAM sequence: TTT
tgtcagtgaagagtcagtct

SEQ ID NO: 65053 - DNA, 20 bp, Artificial Sequence
  Description of Artificial Sequence: Synthetic oligonucleotide
  Target: SCN10A; (+) strand; PAM type: YTN; PAM sequence: TTT
gtcagtgaagagtcagtctg

SEQ ID NO: 65054 - DNA, 20 bp, Artificial Sequence
  Description of Artificial Sequence: Synthetic oligonucleotide
  Target: SCN10A; (+) strand; PAM type: YTN; PAM sequence: TTG
tcagtgaagagtcagtctgg

SEQ ID NO: 65055 - DNA, 20 bp, Artificial Sequence
  Description of Artificial Sequence: Synthetic oligonucleotide
  Target: SCN10A; (+) strand; PAM type: YTN; PAM sequence: CTG
gttcagtagttaaaacgtgt

SEQ ID NO: 65056 - DNA, 20 bp, Artificial Sequence
  Description of Artificial Sequence: Synthetic oligonucleotide
  Target: SCN10A; (+) strand; PAM type: YTN; PAM sequence: TTC
agtagttaaaacgtgtgggt

SEQ ID NO: 65057 - DNA, 20 bp, Artificial Sequence
  Description of Artificial Sequence: Synthetic oligonucleotide
  Target: SCN10A; (+) strand; PAM type: YTN; PAM sequence: TTA
aaacgtgtgggttgtgggac

SEQ ID NO: 65058 - DNA, 20 bp, Artificial Sequence
  Description of Artificial Sequence: Synthetic oligonucleotide
  Target: SCN10A; (+) strand; PAM type: YTN; PAM sequence: TTG
tgggacatcacagacctgga

SEQ ID NO: 65059 - DNA, 20 bp, Artificial Sequence
  Description of Artificial Sequence: Synthetic oligonucleotide
  Target: SCN10A; (+) strand; PAM type: YTN; PAM sequence: CTG
gattaaaatcccagcccaga

SEQ ID NO: 65060 - DNA, 20 bp, Artificial Sequence
  Description of Artificial Sequence: Synthetic oligonucleotide
  Target: SCN10A; (+) strand; PAM type: YTN; PAM sequence: TTA
aaatcccagcccagacattt

SEQ ID NO: 65061 - DNA, 20 bp, Artificial Sequence
  Description of Artificial Sequence: Synthetic oligonucleotide
  Target: SCN10A; (+) strand; PAM type: YTN; PAM sequence: TTT
cctagcttatgtaagcttgg

SEQ ID NO: 65062 - DNA, 20 bp, Artificial Sequence
  Description of Artificial Sequence: Synthetic oligonucleotide
  Target: SCN10A; (+) strand; PAM type: YTN; PAM sequence: TTC
ctagcttatgtaagcttgga

SEQ ID NO: 65063 - DNA, 20 bp, Artificial Sequence
  Description of Artificial Sequence: Synthetic oligonucleotide
  Target: SCN10A; (+) strand; PAM type: YTN; PAM sequence: CTA
gcttatgtaagcttggacaa

SEQ ID NO: 65064 - DNA, 20 bp, Artificial Sequence
  Description of Artificial Sequence: Synthetic oligonucleotide
  Target: SCN10A; (+) strand; PAM type: YTN; PAM sequence: CTT
atgtaagcttggacaaataa

SEQ ID NO: 65065 - DNA, 20 bp, Artificial Sequence
  Description of Artificial Sequence: Synthetic oligonucleotide
  Target: SCN10A; (+) strand; PAM type: YTN; PAM sequence: TTA
tgtaagcttggacaaataat

SEQ ID NO: 65066 - DNA, 20 bp, Artificial Sequence
  Description of Artificial Sequence: Synthetic oligonucleotide
  Target: SCN10A; (+) strand; PAM type: YTN; PAM sequence: CTT
ggacaaataatgcatccttc

SEQ ID NO: 65067 - DNA, 20 bp, Artificial Sequence
  Description of Artificial Sequence: Synthetic oligonucleotide
  Target: SCN10A; (+) strand; PAM type: YTN; PAM sequence: TTG
gacaaataatgcatccttcc

SEQ ID NO: 65068 - DNA, 20 bp, Artificial Sequence
  Description of Artificial Sequence: Synthetic oligonucleotide
  Target: SCN10A; (+) strand; PAM type: YTN; PAM sequence: CTT
cctgtacctcaatttcctca

SEQ ID NO: 65069 - DNA, 20 bp, Artificial Sequence
  Description of Artificial Sequence: Synthetic oligonucleotide
  Target: SCN10A; (+) strand; PAM type: YTN; PAM sequence: TTC
ctgtacctcaatttcctcat

SEQ ID NO: 65070 - DNA, 20 bp, Artificial Sequence
  Description of Artificial Sequence: Synthetic oligonucleotide
  Target: SCN10A; (+) strand; PAM type: YTN; PAM sequence: CTG
tacctcaatttcctcatctg

SEQ ID NO: 65071 - DNA, 20 bp, Artificial Sequence
  Description of Artificial Sequence: Synthetic oligonucleotide
  Target: SCN10A; (+) strand; PAM type: YTN; PAM sequence: CTC
aatttcctcatctgtataat

SEQ ID NO: 65072 - DNA, 20 bp, Artificial Sequence
  Description of Artificial Sequence: Synthetic oligonucleotide
  Target: SCN10A; (+) strand; PAM type: YTN; PAM sequence: TTT
cctcatctgtataatgggca

SEQ ID NO: 65073 - DNA, 20 bp, Artificial Sequence
  Description of Artificial Sequence: Synthetic oligonucleotide
  Target: SCN10A; (+) strand; PAM type: YTN; PAM sequence: TTC
ctcatctgtataatgggcat

SEQ ID NO: 65074 - DNA, 20 bp, Artificial Sequence
  Description of Artificial Sequence: Synthetic oligonucleotide
  Target: SCN10A; (+) strand; PAM type: YTN; PAM sequence: CTC
atctgtataatgggcataaa

SEQ ID NO: 65075 - DNA, 20 bp, Artificial Sequence
  Description of Artificial Sequence: Synthetic oligonucleotide
  Target: SCN10A; (+) strand; PAM type: YTN; PAM sequence: CTG
tataatgggcataaaatgag

SEQ ID NO: 65076 - DNA, 20 bp, Artificial Sequence
  Description of Artificial Sequence: Synthetic oligonucleotide
  Target: SCN10A; (+) strand; PAM type: YTN; PAM sequence: TTC
ttaacaaagggcctggcaga

SEQ ID NO: 65077 - DNA, 20 bp, Artificial Sequence
  Description of Artificial Sequence: Synthetic oligonucleotide
  Target: SCN10A; (+) strand; PAM type: YTN; PAM sequence: CTT
aacaaagggcctggcagaca

SEQ ID NO: 65078 - DNA, 20 bp, Artificial Sequence
  Description of Artificial Sequence: Synthetic oligonucleotide
  Target: SCN10A; (+) strand; PAM type: YTN; PAM sequence: TTA
acaaagggcctggcagacag

SEQ ID NO: 65079 - DNA, 20 bp, Artificial Sequence
  Description of Artificial Sequence: Synthetic oligonucleotide
  Target: SCN10A; (+) strand; PAM type: YTN; PAM sequence: CTG
gcagacagtaattcattcat

SEQ ID NO: 65080 - DNA, 20 bp, Artificial Sequence
  Description of Artificial Sequence: Synthetic oligonucleotide
  Target: SCN10A; (+) strand; PAM type: YTN; PAM sequence: TTC
attcataagtaacagtgact

SEQ ID NO: 65081 - DNA, 20 bp, Artificial Sequence
  Description of Artificial Sequence: Synthetic oligonucleotide
  Target: SCN10A; (+) strand; PAM type: YTN; PAM sequence: TTC
ataagtaacagtgactagta

SEQ ID NO: 65082 - DNA, 20 bp, Artificial Sequence
  Description of Artificial Sequence: Synthetic oligonucleotide
  Target: SCN10A; (+) strand; PAM type: YTN; PAM sequence: CTA
gtaagaacaatgattcattg

SEQ ID NO: 65083 - DNA, 20 bp, Artificial Sequence
  Description of Artificial Sequence: Synthetic oligonucleotide
  Target: SCN10A; (+) strand; PAM type: YTN; PAM sequence: TTC
attgcctctaagattctttt

SEQ ID NO: 65084 - DNA, 20 bp, Artificial Sequence
  Description of Artificial Sequence: Synthetic oligonucleotide
  Target: SCN10A; (+) strand; PAM type: YTN; PAM sequence: TTG
cctctaagattcttttaggc

SEQ ID NO: 65085 - DNA, 20 bp, Artificial Sequence
  Description of Artificial Sequence: Synthetic oligonucleotide
  Target: SCN10A; (+) strand; PAM type: YTN; PAM sequence: CTC
taagattcttttaggctctg

SEQ ID NO: 65086 - DNA, 20 bp, Artificial Sequence
  Description of Artificial Sequence: Synthetic oligonucleotide
  Target: SCN10A; (+) strand; PAM type: YTN; PAM sequence: CTA
agattcttttaggctctgtg

SEQ ID NO: 65087 - DNA, 20 bp, Artificial Sequence
  Description of Artificial Sequence: Synthetic oligonucleotide
  Target: SCN10A; (+) strand; PAM type: YTN; PAM sequence: TTC
ttttaggctctgtgtgtctc

SEQ ID NO: 65088 - DNA, 20 bp, Artificial Sequence
  Description of Artificial Sequence: Synthetic oligonucleotide
  Target: SCN10A; (+) strand; PAM type: YTN; PAM sequence: CTT
ttaggctctgtgtgtctcta

SEQ ID NO: 65089 - DNA, 20 bp, Artificial Sequence
  Description of Artificial Sequence: Synthetic oligonucleotide
  Target: SCN10A; (+) strand; PAM type: YTN; PAM sequence: TTT
taggctctgtgtgtctctaa

SEQ ID NO: 65090 - DNA, 20 bp, Artificial Sequence
  Description of Artificial Sequence: Synthetic oligonucleotide
  Target: SCN10A; (+) strand; PAM type: YTN; PAM sequence: TTT
aggctctgtgtgtctctaat

SEQ ID NO: 65091 - DNA, 20 bp, Artificial Sequence
  Description of Artificial Sequence: Synthetic oligonucleotide
  Target: SCN10A; (+) strand; PAM type: YTN; PAM sequence: TTA
ggctctgtgtgtctctaatt

SEQ ID NO: 65092 - DNA, 20 bp, Artificial Sequence
  Description of Artificial Sequence: Synthetic oligonucleotide
  Target: SCN10A; (+) strand; PAM type: YTN; PAM sequence: CTC
tgtgtgtctctaattgtctt

SEQ ID NO: 65093 - DNA, 20 bp, Artificial Sequence
  Description of Artificial Sequence: Synthetic oligonucleotide
  Target: SCN10A; (+) strand; PAM type: YTN; PAM sequence: CTG
tgtgtctctaattgtcttaa

SEQ ID NO: 65094 - DNA, 20 bp, Artificial Sequence
  Description of Artificial Sequence: Synthetic oligonucleotide
  Target: SCN10A; (+) strand; PAM type: YTN; PAM sequence: CTC
taattgtcttaaataggaca

SEQ ID NO: 65095 - DNA, 20 bp, Artificial Sequence
  Description of Artificial Sequence: Synthetic oligonucleotide
  Target: SCN10A; (+) strand; PAM type: YTN; PAM sequence: CTA
attgtcttaaataggacaga

SEQ ID NO: 65096 - DNA, 20 bp, Artificial Sequence
  Description of Artificial Sequence: Synthetic oligonucleotide
  Target: SCN10A; (+) strand; PAM type: YTN; PAM sequence: TTG
tcttaaataggacagaattc

SEQ ID NO: 65097 - DNA, 20 bp, Artificial Sequence
  Description of Artificial Sequence: Synthetic oligonucleotide
  Target: SCN10A; (+) strand; PAM type: YTN; PAM sequence: CTT
aaataggacagaattctgac

SEQ ID NO: 65098 - DNA, 20 bp, Artificial Sequence
  Description of Artificial Sequence: Synthetic oligonucleotide
  Target: SCN10A; (+) strand; PAM type: YTN; PAM sequence: TTA
aataggacagaattctgaca

SEQ ID NO: 65099 - DNA, 20 bp, Artificial Sequence
  Description of Artificial Sequence: Synthetic oligonucleotide
  Target: SCN10A; (+) strand; PAM type: YTN; PAM sequence: TTC
tgacactgagagaggtcaga

SEQ ID NO: 65100 - DNA, 20 bp, Artificial Sequence
  Description of Artificial Sequence: Synthetic oligonucleotide
  Target: SCN10A; (+) strand; PAM type: YTN; PAM sequence: CTG
acactgagagaggtcagaac

SEQ ID NO: 65101 - DNA, 20 bp, Artificial Sequence
  Description of Artificial Sequence: Synthetic oligonucleotide
  Target: SCN10A; (+) strand; PAM type: YTN; PAM sequence: CTG
agagaggtcagaaccaggct

SEQ ID NO: 65102 - DNA, 20 bp, Artificial Sequence
  Description of Artificial Sequence: Synthetic oligonucleotide
  Target: SCN10A; (+) strand; PAM type: YTN; PAM sequence: CTC
gggtaacacaacaaccagca

SEQ ID NO: 65103 - DNA, 20 bp, Artificial Sequence
  Description of Artificial Sequence: Synthetic oligonucleotide
  Target: SCN10A; (+) strand; PAM type: YTN; PAM sequence: CTT
ttccttcatatctttttatc

SEQ ID NO: 65104 - DNA, 20 bp, Artificial Sequence
  Description of Artificial Sequence: Synthetic oligonucleotide
  Target: SCN10A; (+) strand; PAM type: YTN; PAM sequence: TTT
tccttcatatctttttatct

SEQ ID NO: 65105 - DNA, 20 bp, Artificial Sequence
  Description of Artificial Sequence: Synthetic oligonucleotide
  Target: SCN10A; (+) strand; PAM type: YTN; PAM sequence: TTT
ccttcatatctttttatctg

SEQ ID NO: 65106 - DNA, 20 bp, Artificial Sequence
  Description of Artificial Sequence: Synthetic oligonucleotide
  Target: SCN10A; (+) strand; PAM type: YTN; PAM sequence: TTC
cttcatatctttttatctga

SEQ ID NO: 65107 - DNA, 20 bp, Artificial Sequence
  Description of Artificial Sequence: Synthetic oligonucleotide
  Target: SCN10A; (+) strand; PAM type: YTN; PAM sequence: CTT
catatctttttatctgagcc

SEQ ID NO: 65108 - DNA, 20 bp, Artificial Sequence
  Description of Artificial Sequence: Synthetic oligonucleotide
  Target: SCN10A; (+) strand; PAM type: YTN; PAM sequence: TTC
atatctttttatctgagccc

SEQ ID NO: 65109 - DNA, 20 bp, Artificial Sequence
  Description of Artificial Sequence: Synthetic oligonucleotide
  Target: SCN10A; (+) strand; PAM type: YTN; PAM sequence: CTT
tttatctgagcccctcacca

SEQ ID NO: 65110 - DNA, 20 bp, Artificial Sequence
  Description of Artificial Sequence: Synthetic oligonucleotide
  Target: SCN10A; (+) strand; PAM type: YTN; PAM sequence: TTT
ttatctgagcccctcaccag

SEQ ID NO: 65111 - DNA, 20 bp, Artificial Sequence
  Description of Artificial Sequence: Synthetic oligonucleotide
  Target: SCN10A; (+) strand; PAM type: YTN; PAM sequence: TTT
tatctgagcccctcaccagc

SEQ ID NO: 65112 - DNA, 20 bp, Artificial Sequence
  Description of Artificial Sequence: Synthetic oligonucleotide
  Target: SCN10A; (+) strand; PAM type: YTN; PAM sequence: TTT
atctgagcccctcaccagcc

SEQ ID NO: 65113 - DNA, 20 bp, Artificial Sequence
  Description of Artificial Sequence: Synthetic oligonucleotide
  Target: SCN10A; (+) strand; PAM type: YTN; PAM sequence: TTA
tctgagcccctcaccagcct

SEQ ID NO: 65114 - DNA, 20 bp, Artificial Sequence
  Description of Artificial Sequence: Synthetic oligonucleotide
  Target: SCN10A; (+) strand; PAM type: YTN; PAM sequence: CTG
agcccctcaccagcctgaga

SEQ ID NO: 65115 - DNA, 20 bp, Artificial Sequence
  Description of Artificial Sequence: Synthetic oligonucleotide
  Target: SCN10A; (+) strand; PAM type: YTN; PAM sequence: CTC
accagcctgagaaacagaca

SEQ ID NO: 65116 - DNA, 20 bp, Artificial Sequence
  Description of Artificial Sequence: Synthetic oligonucleotide
  Target: SCN10A; (+) strand; PAM type: YTN; PAM sequence: CTG
agaaacagacaatgcatcct

SEQ ID NO: 65117 - DNA, 20 bp, Artificial Sequence
  Description of Artificial Sequence: Synthetic oligonucleotide
  Target: SCN10A; (+) strand; PAM type: YTN; PAM sequence: CTT
cttatggagaagaaaacagg

SEQ ID NO: 65118 - DNA, 20 bp, Artificial Sequence
  Description of Artificial Sequence: Synthetic oligonucleotide
  Target: SCN10A; (+) strand; PAM type: YTN; PAM sequence: TTC
ttatggagaagaaaacaggc

SEQ ID NO: 65119 - DNA, 20 bp, Artificial Sequence
  Description of Artificial Sequence: Synthetic oligonucleotide
  Target: SCN10A; (+) strand; PAM type: YTN; PAM sequence: CTT
atggagaagaaaacaggctg

SEQ ID NO: 65120 - DNA, 20 bp, Artificial Sequence
  Description of Artificial Sequence: Synthetic oligonucleotide
  Target: SCN10A; (+) strand; PAM type: YTN; PAM sequence: TTA
tggagaagaaaacaggctga

SEQ ID NO: 65121 - DNA, 20 bp, Artificial Sequence
  Description of Artificial Sequence: Synthetic oligonucleotide
  Target: SCN10A; (+) strand; PAM type: YTN; PAM sequence: CTG
agagtttaagtgactttctc

SEQ ID NO: 65122 - DNA, 20 bp, Artificial Sequence
  Description of Artificial Sequence: Synthetic oligonucleotide
  Target: SCN10A; (+) strand; PAM type: YTN; PAM sequence: TTT
aagtgactttctcatgccac

SEQ ID NO: 65123 - DNA, 20 bp, Artificial Sequence
  Description of Artificial Sequence: Synthetic oligonucleotide
  Target: SCN10A; (+) strand; PAM type: YTN; PAM sequence: TTA
agtgactttctcatgccaca

SEQ ID NO: 65124 - DNA, 20 bp, Artificial Sequence
  Description of Artificial Sequence: Synthetic oligonucleotide
  Target: SCN10A; (+) strand; PAM type: YTN; PAM sequence: CTT
tctcatgccacaagactgat

SEQ ID NO: 65125 - DNA, 20 bp, Artificial Sequence
  Description of Artificial Sequence: Synthetic oligonucleotide
  Target: SCN10A; (+) strand; PAM type: YTN; PAM sequence: TTT
ctcatgccacaagactgatt

SEQ ID NO: 65126 - DNA, 20 bp, Artificial Sequence
  Description of Artificial Sequence: Synthetic oligonucleotide
  Target: SCN10A; (+) strand; PAM type: YTN; PAM sequence: TTC
tcatgccacaagactgattc

SEQ ID NO: 65127 - DNA, 20 bp, Artificial Sequence
  Description of Artificial Sequence: Synthetic oligonucleotide
  Target: SCN10A; (+) strand; PAM type: YTN; PAM sequence: CTC
atgccacaagactgattcaa

SEQ ID NO: 65128 - DNA, 20 bp, Artificial Sequence
  Description of Artificial Sequence: Synthetic oligonucleotide
  Target: SCN10A; (+) strand; PAM type: YTN; PAM sequence: CTG
attcaaagagtatctatgga

SEQ ID NO: 65129 - DNA, 20 bp, Artificial Sequence
  Description of Artificial Sequence: Synthetic oligonucleotide
  Target: SCN10A; (+) strand; PAM type: YTN; PAM sequence: TTC
aaagagtatctatggagtgt

SEQ ID NO: 65130 - DNA, 20 bp, Artificial Sequence
  Description of Artificial Sequence: Synthetic oligonucleotide
  Target: SCN10A; (+) strand; PAM type: YTN; PAM sequence: CTA
tggagtgtcccttgtaggca

SEQ ID NO: 65131 - DNA, 20 bp, Artificial Sequence
  Description of Artificial Sequence: Synthetic oligonucleotide
  Target: SCN10A; (+) strand; PAM type: YTN; PAM sequence: CTT
gtaggcaagtcagtgtggtg

SEQ ID NO: 65132 - DNA, 20 bp, Artificial Sequence
  Description of Artificial Sequence: Synthetic oligonucleotide
  Target: SCN10A; (+) strand; PAM type: YTN; PAM sequence: TTG
taggcaagtcagtgtggtgt

SEQ ID NO: 65133 - DNA, 20 bp, Artificial Sequence
  Description of Artificial Sequence: Synthetic oligonucleotide
  Target: SCN10A; (+) strand; PAM type: YTN; PAM sequence: TTG
aggtcttgtgtcttccagag

SEQ ID NO: 65134 - DNA, 20 bp, Artificial Sequence
  Description of Artificial Sequence: Synthetic oligonucleotide
  Target: SCN10A; (+) strand; PAM type: YTN; PAM sequence: CTT
gtgtcttccagagacctggg

SEQ ID NO: 65135 - DNA, 20 bp, Artificial Sequence
  Description of Artificial Sequence: Synthetic oligonucleotide
  Target: SCN10A; (+) strand; PAM type: YTN; PAM sequence: TTG
tgtcttccagagacctgggt

SEQ ID NO: 65136 - DNA, 20 bp, Artificial Sequence
  Description of Artificial Sequence: Synthetic oligonucleotide
  Target: SCN10A; (+) strand; PAM type: YTN; PAM sequence: CTT
ccagagacctgggtccaccc

SEQ ID NO: 65137 - DNA, 20 bp, Artificial Sequence
  Description of Artificial Sequence: Synthetic oligonucleotide
  Target: SCN10A; (+) strand; PAM type: YTN; PAM sequence: TTC
cagagacctgggtccaccct

SEQ ID NO: 65138 - DNA, 20 bp, Artificial Sequence
  Description of Artificial Sequence: Synthetic oligonucleotide
  Target: SCN10A; (+) strand; PAM type: YTN; PAM sequence: CTG
ggtccaccctggatccaccc

SEQ ID NO: 65139 - DNA, 20 bp, Artificial Sequence
  Description of Artificial Sequence: Synthetic oligonucleotide
  Target: SCN10A; (+) strand; PAM type: YTN; PAM sequence: CTG
gatccaccctcaccagctat

SEQ ID NO: 65140 - DNA, 20 bp, Artificial Sequence
  Description of Artificial Sequence: Synthetic oligonucleotide
  Target: SCN10A; (+) strand; PAM type: YTN; PAM sequence: CTC
accagctatacaattttggg

SEQ ID NO: 65141 - DNA, 20 bp, Artificial Sequence
  Description of Artificial Sequence: Synthetic oligonucleotide
  Target: SCN10A; (+) strand; PAM type: YTN; PAM sequence: CTA
tacaattttgggcaggatat

SEQ ID NO: 65142 - DNA, 20 bp, Artificial Sequence
  Description of Artificial Sequence: Synthetic oligonucleotide
  Target: SCN10A; (+) strand; PAM type: YTN; PAM sequence: TTT
tgggcaggatatttaacctc

SEQ ID NO: 65143 - DNA, 20 bp, Artificial Sequence
  Description of Artificial Sequence: Synthetic oligonucleotide
  Target: SCN10A; (+) strand; PAM type: YTN; PAM sequence: TTT
gggcaggatatttaacctct

SEQ ID NO: 65144 - DNA, 20 bp, Artificial Sequence
  Description of Artificial Sequence: Synthetic oligonucleotide
  Target: SCN10A; (+) strand; PAM type: YTN; PAM sequence: TTG
ggcaggatatttaacctctc

SEQ ID NO: 65145 - DNA, 20 bp, Artificial Sequence
  Description of Artificial Sequence: Synthetic oligonucleotide
  Target: SCN10A; (+) strand; PAM type: YTN; PAM sequence: TTT
aacctctctgagtcttagtg

SEQ ID NO: 65146 - DNA, 20 bp, Artificial Sequence
  Description of Artificial Sequence: Synthetic oligonucleotide
  Target: SCN10A; (+) strand; PAM type: YTN; PAM sequence: TTA
acctctctgagtcttagtgc

SEQ ID NO: 65147 - DNA, 20 bp, Artificial Sequence
  Description of Artificial Sequence: Synthetic oligonucleotide
  Target: SCN10A; (+) strand; PAM type: YTN; PAM sequence: CTC
tctgagtcttagtgctctct

SEQ ID NO: 65148 - DNA, 20 bp, Artificial Sequence
  Description of Artificial Sequence: Synthetic oligonucleotide
  Target: SCN10A; (+) strand; PAM type: YTN; PAM sequence: CTC
tgagtcttagtgctctcttt

SEQ ID NO: 65149 - DNA, 20 bp, Artificial Sequence
  Description of Artificial Sequence: Synthetic oligonucleotide
  Target: SCN10A; (+) strand; PAM type: YTN; PAM sequence: CTG
agtcttagtgctctcttttg

SEQ ID NO: 65150 - DNA, 20 bp, Artificial Sequence
  Description of Artificial Sequence: Synthetic oligonucleotide
  Target: SCN10A; (+) strand; PAM type: YTN; PAM sequence: CTT
agtgctctcttttgtcatgt

SEQ ID NO: 65151 - DNA, 20 bp, Artificial Sequence
  Description of Artificial Sequence: Synthetic oligonucleotide
  Target: SCN10A; (+) strand; PAM type: YTN; PAM sequence: TTA
gtgctctcttttgtcatgtg

SEQ ID NO: 65152 - DNA, 20 bp, Artificial Sequence
  Description of Artificial Sequence: Synthetic oligonucleotide
  Target: SCN10A; (+) strand; PAM type: YTN; PAM sequence: CTC
tcttttgtcatgtgagggtg

SEQ ID NO: 65153 - DNA, 20 bp, Artificial Sequence
  Description of Artificial Sequence: Synthetic oligonucleotide
  Target: SCN10A; (+) strand; PAM type: YTN; PAM sequence: CTC
ttttgtcatgtgagggtgat

SEQ ID NO: 65154 - DNA, 20 bp, Artificial Sequence
  Description of Artificial Sequence: Synthetic oligonucleotide
  Target: SCN10A; (+) strand; PAM type: YTN; PAM sequence: CTT
ttgtcatgtgagggtgatgt

SEQ ID NO: 65155 - DNA, 20 bp, Artificial Sequence
  Description of Artificial Sequence: Synthetic oligonucleotide
  Target: SCN10A; (+) strand; PAM type: YTN; PAM sequence: TTT
tgtcatgtgagggtgatgtt

SEQ ID NO: 65156 - DNA, 20 bp, Artificial Sequence
  Description of Artificial Sequence: Synthetic oligonucleotide
  Target: SCN10A; (+) strand; PAM type: YTN; PAM sequence: TTT
gtcatgtgagggtgatgtta

SEQ ID NO: 65157 - DNA, 20 bp, Artificial Sequence
  Description of Artificial Sequence: Synthetic oligonucleotide
  Target: SCN10A; (+) strand; PAM type: YTN; PAM sequence: TTG
tcatgtgagggtgatgttaa

SEQ ID NO: 65158 - DNA, 20 bp, Artificial Sequence
  Description of Artificial Sequence: Synthetic oligonucleotide
  Target: SCN10A; (+) strand; PAM type: YTN; PAM sequence: TTA
acctcataatgttgttgtga

SEQ ID NO: 65159 - DNA, 20 bp, Artificial Sequence
  Description of Artificial Sequence: Synthetic oligonucleotide
  Target: SCN10A; (+) strand; PAM type: YTN; PAM sequence: CTC
ataatgttgttgtgacactg

SEQ ID NO: 65160 - DNA, 20 bp, Artificial Sequence
  Description of Artificial Sequence: Synthetic oligonucleotide
  Target: SCN10A; (+) strand; PAM type: YTN; PAM sequence: TTG
ttgtgacactgaaataacat

SEQ ID NO: 65161 - DNA, 20 bp, Artificial Sequence
  Description of Artificial Sequence: Synthetic oligonucleotide
  Target: SCN10A; (+) strand; PAM type: YTN; PAM sequence: TTG
tgacactgaaataacattca

SEQ ID NO: 65162 - DNA, 20 bp, Artificial Sequence
  Description of Artificial Sequence: Synthetic oligonucleotide
  Target: SCN10A; (+) strand; PAM type: YTN; PAM sequence: CTG
aaataacattcataaagcac

SEQ ID NO: 65163 - DNA, 20 bp, Artificial Sequence
  Description of Artificial Sequence: Synthetic oligonucleotide
  Target: SCN10A; (+) strand; PAM type: YTN; PAM sequence: TTC
ataaagcacctgactcattg

SEQ ID NO: 65164 - DNA, 20 bp, Artificial Sequence
  Description of Artificial Sequence: Synthetic oligonucleotide
  Target: SCN10A; (+) strand; PAM type: YTN; PAM sequence: CTG
actcattgcaggcaccaagc

SEQ ID NO: 65165 - DNA, 20 bp, Artificial Sequence
  Description of Artificial Sequence: Synthetic oligonucleotide
  Target: SCN10A; (+) strand; PAM type: YTN; PAM sequence: CTC
attgcaggcaccaagcacat

SEQ ID NO: 65166 - DNA, 20 bp, Artificial Sequence
  Description of Artificial Sequence: Synthetic oligonucleotide
  Target: SCN10A; (+) strand; PAM type: YTN; PAM sequence: TTG
caggcaccaagcacatgact

SEQ ID NO: 65167 - DNA, 20 bp, Artificial Sequence
  Description of Artificial Sequence: Synthetic oligonucleotide
  Target: SCN10A; (+) strand; PAM type: YTN; PAM sequence: CTT
tcttgctttaaaaaagtggc

SEQ ID NO: 65168 - DNA, 20 bp, Artificial Sequence
  Description of Artificial Sequence: Synthetic oligonucleotide
  Target: SCN10A; (+) strand; PAM type: YTN; PAM sequence: TTT
cttgctttaaaaaagtggca

SEQ ID NO: 65169 - DNA, 20 bp, Artificial Sequence
  Description of Artificial Sequence: Synthetic oligonucleotide
  Target: SCN10A; (+) strand; PAM type: YTN; PAM sequence: TTC
ttgctttaaaaaagtggcac

SEQ ID NO: 65170 - DNA, 20 bp, Artificial Sequence
  Description of Artificial Sequence: Synthetic oligonucleotide
  Target: SCN10A; (+) strand; PAM type: YTN; PAM sequence: CTT
gctttaaaaaagtggcactt

SEQ ID NO: 65171 - DNA, 20 bp, Artificial Sequence
  Description of Artificial Sequence: Synthetic oligonucleotide
  Target: SCN10A; (+) strand; PAM type: YTN; PAM sequence: TTG
ctttaaaaaagtggcacttt

SEQ ID NO: 65172 - DNA, 20 bp, Artificial Sequence
  Description of Artificial Sequence: Synthetic oligonucleotide
  Target: SCN10A; (+) strand; PAM type: YTN; PAM sequence: CTT
taaaaaagtggcactttcct

SEQ ID NO: 65173 - DNA, 20 bp, Artificial Sequence
  Description of Artificial Sequence: Synthetic oligonucleotide
  Target: SCN10A; (+) strand; PAM type: YTN; PAM sequence: TTT
aaaaaagtggcactttcctc

SEQ ID NO: 65174 - DNA, 20 bp, Artificial Sequence
  Description of Artificial Sequence: Synthetic oligonucleotide
  Target: SCN10A; (+) strand; PAM type: YTN; PAM sequence: TTA
aaaaagtggcactttcctct

SEQ ID NO: 65175 - DNA, 20 bp, Artificial Sequence
  Description of Artificial Sequence: Synthetic oligonucleotide
  Target: SCN10A; (+) strand; PAM type: YTN; PAM sequence: CTT
tcctctgacactgtgggaaa

SEQ ID NO: 65176 - DNA, 20 bp, Artificial Sequence
  Description of Artificial Sequence: Synthetic oligonucleotide
  Target: SCN10A; (+) strand; PAM type: YTN; PAM sequence: TTT
cctctgacactgtgggaaag

SEQ ID NO: 65177 - DNA, 20 bp, Artificial Sequence
  Description of Artificial Sequence: Synthetic oligonucleotide
  Target: SCN10A; (+) strand; PAM type: YTN; PAM sequence: TTC
ctctgacactgtgggaaagg

SEQ ID NO: 65178 - DNA, 20 bp, Artificial Sequence
  Description of Artificial Sequence: Synthetic oligonucleotide
  Target: SCN10A; (+) strand; PAM type: YTN; PAM sequence: CTC
tgacactgtgggaaaggcct

SEQ ID NO: 65179 - DNA, 20 bp, Artificial Sequence
  Description of Artificial Sequence: Synthetic oligonucleotide
  Target: SCN10A; (+) strand; PAM type: YTN; PAM sequence: CTG
acactgtgggaaaggccttt

SEQ ID NO: 65180 - DNA, 20 bp, Artificial Sequence
  Description of Artificial Sequence: Synthetic oligonucleotide
  Target: SCN10A; (+) strand; PAM type: YTN; PAM sequence: CTG
tgggaaaggccttttctctc

SEQ ID NO: 65181 - DNA, 20 bp, Artificial Sequence
  Description of Artificial Sequence: Synthetic oligonucleotide
  Target: SCN10A; (+) strand; PAM type: YTN; PAM sequence: CTT
ttctctctcttgcttccact

SEQ ID NO: 65182 - DNA, 20 bp, Artificial Sequence
  Description of Artificial Sequence: Synthetic oligonucleotide
  Target: SCN10A; (+) strand; PAM type: YTN; PAM sequence: TTT
tctctctcttgcttccactt

SEQ ID NO: 65183 - DNA, 20 bp, Artificial Sequence
  Description of Artificial Sequence: Synthetic oligonucleotide
  Target: SCN10A; (+) strand; PAM type: YTN; PAM sequence: TTT
ctctctcttgcttccacttt

SEQ ID NO: 65184 - DNA, 20 bp, Artificial Sequence
  Description of Artificial Sequence: Synthetic oligonucleotide
  Target: SCN10A; (+) strand; PAM type: YTN; PAM sequence: TTC
tctctcttgcttccactttt

SEQ ID NO: 65185 - DNA, 20 bp, Artificial Sequence
  Description of Artificial Sequence: Synthetic oligonucleotide
  Target: SCN10A; (+) strand; PAM type: YTN; PAM sequence: CTC
tctcttgcttccacttttct

SEQ ID NO: 65186 - DNA, 20 bp, Artificial Sequence
  Description of Artificial Sequence: Synthetic oligonucleotide
  Target: SCN10A; (+) strand; PAM type: YTN; PAM sequence: CTC
tcttgcttccacttttctaa

SEQ ID NO: 65187 - DNA, 20 bp, Artificial Sequence
  Description of Artificial Sequence: Synthetic oligonucleotide
  Target: SCN10A; (+) strand; PAM type: YTN; PAM sequence: CTC
ttgcttccacttttctaact

SEQ ID NO: 65188 - DNA, 20 bp, Artificial Sequence
  Description of Artificial Sequence: Synthetic oligonucleotide
  Target: SCN10A; (+) strand; PAM type: YTN; PAM sequence: CTT
gcttccacttttctaactgt

SEQ ID NO: 65189 - DNA, 20 bp, Artificial Sequence
  Description of Artificial Sequence: Synthetic oligonucleotide
  Target: SCN10A; (+) strand; PAM type: YTN; PAM sequence: TTG
cttccacttttctaactgta

SEQ ID NO: 65190 - DNA, 20 bp, Artificial Sequence
  Description of Artificial Sequence: Synthetic oligonucleotide
  Target: SCN10A; (+) strand; PAM type: YTN; PAM sequence: CTT
ccacttttctaactgtagaa

SEQ ID NO: 65191 - DNA, 20 bp, Artificial Sequence
  Description of Artificial Sequence: Synthetic oligonucleotide
  Target: SCN10A; (+) strand; PAM type: YTN; PAM sequence: TTC
cacttttctaactgtagaat

SEQ ID NO: 65192 - DNA, 20 bp, Artificial Sequence
  Description of Artificial Sequence: Synthetic oligonucleotide
  Target: SCN10A; (+) strand; PAM type: YTN; PAM sequence: CTT
ttctaactgtagaatgaggg

SEQ ID NO: 65193 - DNA, 20 bp, Artificial Sequence
  Description of Artificial Sequence: Synthetic oligonucleotide
  Target: SCN10A; (+) strand; PAM type: YTN; PAM sequence: TTT
tctaactgtagaatgagggt

SEQ ID NO: 65194 - DNA, 20 bp, Artificial Sequence
  Description of Artificial Sequence: Synthetic oligonucleotide
  Target: SCN10A; (+) strand; PAM type: YTN; PAM sequence: TTT
ctaactgtagaatgagggtg

SEQ ID NO: 65195 - DNA, 20 bp, Artificial Sequence
  Description of Artificial Sequence: Synthetic oligonucleotide
  Target: SCN10A; (+) strand; PAM type: YTN; PAM sequence: TTC
taactgtagaatgagggtgt

SEQ ID NO: 65196 - DNA, 20 bp, Artificial Sequence
  Description of Artificial Sequence: Synthetic oligonucleotide
  Target: SCN10A; (+) strand; PAM type: YTN; PAM sequence: CTA
actgtagaatgagggtgtgg

SEQ ID NO: 65197 - DNA, 20 bp, Artificial Sequence
  Description of Artificial Sequence: Synthetic oligonucleotide
  Target: SCN10A; (+) strand; PAM type: YTN; PAM sequence: CTG
tagaatgagggtgtgggctc

SEQ ID NO: 65198 - DNA, 20 bp, Artificial Sequence
  Description of Artificial Sequence: Synthetic oligonucleotide
  Target: SCN10A; (+) strand; PAM type: YTN; PAM sequence: CTC
aaatgtctattccataaggc

SEQ ID NO: 65199 - DNA, 20 bp, Artificial Sequence
  Description of Artificial Sequence: Synthetic oligonucleotide
  Target: SCN10A; (+) strand; PAM type: YTN; PAM sequence: CTA
ttccataaggccctctgtgg

SEQ ID NO: 65200 - DNA, 20 bp, Artificial Sequence
  Description of Artificial Sequence: Synthetic oligonucleotide
  Target: SCN10A; (+) strand; PAM type: YTN; PAM sequence: TTC
cataaggccctctgtggtct

SEQ ID NO: 65201 - DNA, 20 bp, Artificial Sequence
  Description of Artificial Sequence: Synthetic oligonucleotide
  Target: SCN10A; (+) strand; PAM type: YTN; PAM sequence: CTC
tgtggtcttaggctgacttc

SEQ ID NO: 65202 - DNA, 20 bp, Artificial Sequence
  Description of Artificial Sequence: Synthetic oligonucleotide
  Target: SCN10A; (+) strand; PAM type: YTN; PAM sequence: CTG
tggtcttaggctgacttctt

SEQ ID NO: 65203 - DNA, 20 bp, Artificial Sequence
  Description of Artificial Sequence: Synthetic oligonucleotide
  Target: SCN10A; (+) strand; PAM type: YTN; PAM sequence: CTT
aggctgacttcttgggaata

SEQ ID NO: 65204 - DNA, 20 bp, Artificial Sequence
  Description of Artificial Sequence: Synthetic oligonucleotide
  Target: SCN10A; (+) strand; PAM type: YTN; PAM sequence: TTA
ggctgacttcttgggaataa

SEQ ID NO: 65205 - DNA, 20 bp, Artificial Sequence
  Description of Artificial Sequence: Synthetic oligonucleotide
  Target: SCN10A; (+) strand; PAM type: YTN; PAM sequence: CTG
acttcttgggaataagcatt

SEQ ID NO: 65206 - DNA, 20 bp, Artificial Sequence
  Description of Artificial Sequence: Synthetic oligonucleotide
  Target: SCN10A; (+) strand; PAM type: YTN; PAM sequence: CTT
cttgggaataagcattctct

SEQ ID NO: 65207 - DNA, 20 bp, Artificial Sequence
  Description of Artificial Sequence: Synthetic oligonucleotide
  Target: SCN10A; (+) strand; PAM type: YTN; PAM sequence: TTC
ttgggaataagcattctctt

SEQ ID NO: 65208 - DNA, 20 bp, Artificial Sequence
  Description of Artificial Sequence: Synthetic oligonucleotide
  Target: SCN10A; (+) strand; PAM type: YTN; PAM sequence: CTT
gggaataagcattctcttct

SEQ ID NO: 65209 - DNA, 20 bp, Artificial Sequence
  Description of Artificial Sequence: Synthetic oligonucleotide
  Target: SCN10A; (+) strand; PAM type: YTN; PAM sequence: TTG
ggaataagcattctcttctc

SEQ ID NO: 65210 - DNA, 20 bp, Artificial Sequence
  Description of Artificial Sequence: Synthetic oligonucleotide
  Target: SCN10A; (+) strand; PAM type: YTN; PAM sequence: TTC
tcttctctttccatttttcc

SEQ ID NO: 65211 - DNA, 20 bp, Artificial Sequence
  Description of Artificial Sequence: Synthetic oligonucleotide
  Target: SCN10A; (+) strand; PAM type: YTN; PAM sequence: CTC
ttctctttccatttttcctt

SEQ ID NO: 65212 - DNA, 20 bp, Artificial Sequence
  Description of Artificial Sequence: Synthetic oligonucleotide
  Target: SCN10A; (+) strand; PAM type: YTN; PAM sequence: CTT
ctctttccatttttcctttt

SEQ ID NO: 65213 - DNA, 20 bp, Artificial Sequence
  Description of Artificial Sequence: Synthetic oligonucleotide
  Target: SCN10A; (+) strand; PAM type: YTN; PAM sequence: TTC
tctttccatttttccttttc

SEQ ID NO: 65214 - DNA, 20 bp, Artificial Sequence
  Description of Artificial Sequence: Synthetic oligonucleotide
  Target: SCN10A; (+) strand; PAM type: YTN; PAM sequence: CTC
tttccatttttccttttcat

SEQ ID NO: 65215 - DNA, 20 bp, Artificial Sequence
  Description of Artificial Sequence: Synthetic oligonucleotide
  Target: SCN10A; (+) strand; PAM type: YTN; PAM sequence: CTT
tccatttttccttttcatat

SEQ ID NO: 65216 - DNA, 20 bp, Artificial Sequence
  Description of Artificial Sequence: Synthetic oligonucleotide
  Target: SCN10A; (+) strand; PAM type: YTN; PAM sequence: TTT
ccatttttccttttcatatc

SEQ ID NO: 65217 - DNA, 20 bp, Artificial Sequence
  Description of Artificial Sequence: Synthetic oligonucleotide
  Target: SCN10A; (+) strand; PAM type: YTN; PAM sequence: TTC
catttttccttttcatatca

SEQ ID NO: 65218 - DNA, 20 bp, Artificial Sequence
  Description of Artificial Sequence: Synthetic oligonucleotide
  Target: SCN10A; (+) strand; PAM type: YTN; PAM sequence: TTT
ttccttttcatatcaacttt

SEQ ID NO: 65219 - DNA, 20 bp, Artificial Sequence
  Description of Artificial Sequence: Synthetic oligonucleotide
  Target: SCN10A; (+) strand; PAM type: YTN; PAM sequence: TTT
tccttttcatatcaacttta

SEQ ID NO: 65220 - DNA, 20 bp, Artificial Sequence
  Description of Artificial Sequence: Synthetic oligonucleotide
  Target: SCN10A; (+) strand; PAM type: YTN; PAM sequence: TTT
ccttttcatatcaactttag

SEQ ID NO: 65221 - DNA, 20 bp, Artificial Sequence
  Description of Artificial Sequence: Synthetic oligonucleotide
  Target: SCN10A; (+) strand; PAM type: YTN; PAM sequence: TTC
cttttcatatcaactttagg

SEQ ID NO: 65222 - DNA, 20 bp, Artificial Sequence
  Description of Artificial Sequence: Synthetic oligonucleotide
  Target: SCN10A; (+) strand; PAM type: YTN; PAM sequence: CTT
ttcatatcaactttaggatg

SEQ ID NO: 65223 - DNA, 20 bp, Artificial Sequence
  Description of Artificial Sequence: Synthetic oligonucleotide
  Target: SCN10A; (+) strand; PAM type: YTN; PAM sequence: TTT
tcatatcaactttaggatgt

SEQ ID NO: 65224 - DNA, 20 bp, Artificial Sequence
  Description of Artificial Sequence: Synthetic oligonucleotide
  Target: SCN10A; (+) strand; PAM type: YTN; PAM sequence: TTT
catatcaactttaggatgtg

SEQ ID NO: 65225 - DNA, 20 bp, Artificial Sequence
  Description of Artificial Sequence: Synthetic oligonucleotide
  Target: SCN10A; (+) strand; PAM type: YTN; PAM sequence: TTC
atatcaactttaggatgtga

SEQ ID NO: 65226 - DNA, 20 bp, Artificial Sequence
  Description of Artificial Sequence: Synthetic oligonucleotide
  Target: SCN10A; (+) strand; PAM type: YTN; PAM sequence: CTT
taggatgtgacctcagccta

SEQ ID NO: 65227 - DNA, 20 bp, Artificial Sequence
  Description of Artificial Sequence: Synthetic oligonucleotide
  Target: SCN10A; (+) strand; PAM type: YTN; PAM sequence: TTT
aggatgtgacctcagcctag

SEQ ID NO: 65228 - DNA, 20 bp, Artificial Sequence
  Description of Artificial Sequence: Synthetic oligonucleotide
  Target: SCN10A; (+) strand; PAM type: YTN; PAM sequence: TTA
ggatgtgacctcagcctagg

SEQ ID NO: 65229 - DNA, 20 bp, Artificial Sequence
  Description of Artificial Sequence: Synthetic oligonucleotide
  Target: SCN10A; (+) strand; PAM type: YTN; PAM sequence: CTC
agcctaggtgctgccaaaac

SEQ ID NO: 65230 - DNA, 20 bp, Artificial Sequence
  Description of Artificial Sequence: Synthetic oligonucleotide
  Target: SCN10A; (+) strand; PAM type: YTN; PAM sequence: CTA
ggtgctgccaaaacatgagg

SEQ ID NO: 65231 - DNA, 20 bp, Artificial Sequence
  Description of Artificial Sequence: Synthetic oligonucleotide
  Target: SCN10A; (+) strand; PAM type: YTN; PAM sequence: CTG
ccaaaacatgaggcatgctg

SEQ ID NO: 65232 - DNA, 20 bp, Artificial Sequence
  Description of Artificial Sequence: Synthetic oligonucleotide
  Target: SCN10A; (+) strand; PAM type: YTN; PAM sequence: CTG
attccaccatgttccagaac

SEQ ID NO: 65233 - DNA, 20 bp, Artificial Sequence
  Description of Artificial Sequence: Synthetic oligonucleotide
  Target: SCN10A; (+) strand; PAM type: YTN; PAM sequence: TTC
caccatgttccagaacctac

SEQ ID NO: 65234 - DNA, 20 bp, Artificial Sequence
  Description of Artificial Sequence: Synthetic oligonucleotide
  Target: SCN10A; (+) strand; PAM type: YTN; PAM sequence: TTC
cagaacctactgctgcccct

SEQ ID NO: 65235 - DNA, 20 bp, Artificial Sequence
  Description of Artificial Sequence: Synthetic oligonucleotide
  Target: SCN10A; (+) strand; PAM type: YTN; PAM sequence: CTA
ctgctgcccctttcacagcc

SEQ ID NO: 65236 - DNA, 20 bp, Artificial Sequence
  Description of Artificial Sequence: Synthetic oligonucleotide
  Target: SCN10A; (+) strand; PAM type: YTN; PAM sequence: CTG
ctgcccctttcacagccctg

SEQ ID NO: 65237 - DNA, 20 bp, Artificial Sequence
  Description of Artificial Sequence: Synthetic oligonucleotide
  Target: SCN10A; (+) strand; PAM type: YTN; PAM sequence: CTG
cccctttcacagccctggat

SEQ ID NO: 65238 - DNA, 20 bp, Artificial Sequence
  Description of Artificial Sequence: Synthetic oligonucleotide
  Target: SCN10A; (+) strand; PAM type: YTN; PAM sequence: CTT
tcacagccctggattatggc

SEQ ID NO: 65239 - DNA, 20 bp, Artificial Sequence
  Description of Artificial Sequence: Synthetic oligonucleotide
  Target: SCN10A; (+) strand; PAM type: YTN; PAM sequence: TTT
cacagccctggattatggcg

SEQ ID NO: 65240 - DNA, 20 bp, Artificial Sequence
  Description of Artificial Sequence: Synthetic oligonucleotide
  Target: SCN10A; (+) strand; PAM type: YTN; PAM sequence: TTC
acagccctggattatggcgg

SEQ ID NO: 65241 - DNA, 20 bp, Artificial Sequence
  Description of Artificial Sequence: Synthetic oligonucleotide
  Target: SCN10A; (+) strand; PAM type: YTN; PAM sequence: CTG
gattatggcggagggagtgg

SEQ ID NO: 65242 - DNA, 20 bp, Artificial Sequence
  Description of Artificial Sequence: Synthetic oligonucleotide
  Target: SCN10A; (+) strand; PAM type: YTN; PAM sequence: TTA
tggcggagggagtggtttct

SEQ ID NO: 65243 - DNA, 20 bp, Artificial Sequence
  Description of Artificial Sequence: Synthetic oligonucleotide
  Target: SCN10A; (+) strand; PAM type: YTN; PAM sequence: TTT
ctagggacaagtagtcacat

SEQ ID NO: 65244 - DNA, 20 bp, Artificial Sequence
  Description of Artificial Sequence: Synthetic oligonucleotide
  Target: SCN10A; (+) strand; PAM type: YTN; PAM sequence: TTC
tagggacaagtagtcacatt

SEQ ID NO: 65245 - DNA, 20 bp, Artificial Sequence
  Description of Artificial Sequence: Synthetic oligonucleotide
  Target: SCN10A; (+) strand; PAM type: YTN; PAM sequence: CTA
gggacaagtagtcacatttc

SEQ ID NO: 65246 - DNA, 20 bp, Artificial Sequence
  Description of Artificial Sequence: Synthetic oligonucleotide
  Target: SCN10A; (+) strand; PAM type: YTN; PAM sequence: TTT
cctctgggccttccccctcc

SEQ ID NO: 65247 - DNA, 20 bp, Artificial Sequence
  Description of Artificial Sequence: Synthetic oligonucleotide
  Target: SCN10A; (+) strand; PAM type: YTN; PAM sequence: TTC
ctctgggccttccccctcca

SEQ ID NO: 65248 - DNA, 20 bp, Artificial Sequence
  Description of Artificial Sequence: Synthetic oligonucleotide
  Target: SCN10A; (+) strand; PAM type: YTN; PAM sequence: CTC
tgggccttccccctccacct

SEQ ID NO: 65249 - DNA, 20 bp, Artificial Sequence
  Description of Artificial Sequence: Synthetic oligonucleotide
  Target: SCN10A; (+) strand; PAM type: YTN; PAM sequence: CTG
ggccttccccctccacctaa

SEQ ID NO: 65250 - DNA, 20 bp, Artificial Sequence
  Description of Artificial Sequence: Synthetic oligonucleotide
  Target: SCN10A; (+) strand; PAM type: YTN; PAM sequence: CTT
ccccctccacctaagtctgc

SEQ ID NO: 65251 - DNA, 20 bp, Artificial Sequence
  Description of Artificial Sequence: Synthetic oligonucleotide
  Target: SCN10A; (+) strand; PAM type: YTN; PAM sequence: TTC
cccctccacctaagtctgca

SEQ ID NO: 65252 - DNA, 20 bp, Artificial Sequence
  Description of Artificial Sequence: Synthetic oligonucleotide
  Target: SCN10A; (+) strand; PAM type: YTN; PAM sequence: CTC
cacctaagtctgcagcctat

SEQ ID NO: 65253 - DNA, 20 bp, Artificial Sequence
  Description of Artificial Sequence: Synthetic oligonucleotide
  Target: SCN10A; (+) strand; PAM type: YTN; PAM sequence: CTA
agtctgcagcctataagaag

SEQ ID NO: 65254 - DNA, 20 bp, Artificial Sequence
  Description of Artificial Sequence: Synthetic oligonucleotide
  Target: SCN10A; (+) strand; PAM type: YTN; PAM sequence: CTG
cagcctataagaagctggac

SEQ ID NO: 65255 - DNA, 20 bp, Artificial Sequence
  Description of Artificial Sequence: Synthetic oligonucleotide
  Target: SCN10A; (+) strand; PAM type: YTN; PAM sequence: CTA
taagaagctggaccccaaag

SEQ ID NO: 65256 - DNA, 20 bp, Artificial Sequence
  Description of Artificial Sequence: Synthetic oligonucleotide
  Target: SCN10A; (+) strand; PAM type: YTN; PAM sequence: CTG
gaccccaaagccagacagtt

SEQ ID NO: 65257 - DNA, 20 bp, Artificial Sequence
  Description of Artificial Sequence: Synthetic oligonucleotide
  Target: SCN10A; (+) strand; PAM type: YTN; PAM sequence: TTC
tggtgaatccagtaggtcac

SEQ ID NO: 65258 - DNA, 20 bp, Artificial Sequence
  Description of Artificial Sequence: Synthetic oligonucleotide
  Target: SCN10A; (+) strand; PAM type: YTN; PAM sequence: CTG
gtgaatccagtaggtcacct

SEQ ID NO: 65259 - DNA, 20 bp, Artificial Sequence
  Description of Artificial Sequence: Synthetic oligonucleotide
  Target: SCN10A; (+) strand; PAM type: YTN; PAM sequence: CTC
cagcttggtggaccctgctg

SEQ ID NO: 65260 - DNA, 20 bp, Artificial Sequence
  Description of Artificial Sequence: Synthetic oligonucleotide
  Target: SCN10A; (+) strand; PAM type: YTN; PAM sequence: CTT
ggtggaccctgctgcggaca

SEQ ID NO: 65261 - DNA, 20 bp, Artificial Sequence
  Description of Artificial Sequence: Synthetic oligonucleotide
  Target: SCN10A; (+) strand; PAM type: YTN; PAM sequence: TTG
gtggaccctgctgcggacat

SEQ ID NO: 65262 - DNA, 20 bp, Artificial Sequence
  Description of Artificial Sequence: Synthetic oligonucleotide
  Target: SCN10A; (+) strand; PAM type: YTN; PAM sequence: CTG
ctgcggacatgaaggcagga

SEQ ID NO: 65263 - DNA, 20 bp, Artificial Sequence
  Description of Artificial Sequence: Synthetic oligonucleotide
  Target: SCN10A; (+) strand; PAM type: YTN; PAM sequence: CTG
cggacatgaaggcaggatgc

SEQ ID NO: 65264 - DNA, 20 bp, Artificial Sequence
  Description of Artificial Sequence: Synthetic oligonucleotide
  Target: SCN10A; (+) strand; PAM type: YTN; PAM sequence: CTG
accctttctagcttctgcct

SEQ ID NO: 65265 - DNA, 20 bp, Artificial Sequence
  Description of Artificial Sequence: Synthetic oligonucleotide
  Target: SCN10A; (+) strand; PAM type: YTN; PAM sequence: CTT
tctagcttctgcctatcatg

SEQ ID NO: 65266 - DNA, 20 bp, Artificial Sequence
  Description of Artificial Sequence: Synthetic oligonucleotide
  Target: SCN10A; (+) strand; PAM type: YTN; PAM sequence: TTT
ctagcttctgcctatcatgt

SEQ ID NO: 65267 - DNA, 20 bp, Artificial Sequence
  Description of Artificial Sequence: Synthetic oligonucleotide
  Target: SCN10A; (+) strand; PAM type: YTN; PAM sequence: TTC
tagcttctgcctatcatgtg

SEQ ID NO: 65268 - DNA, 20 bp, Artificial Sequence
  Description of Artificial Sequence: Synthetic oligonucleotide
  Target: SCN10A; (+) strand; PAM type: YTN; PAM sequence: CTA
gcttctgcctatcatgtgtg

SEQ ID NO: 65269 - DNA, 20 bp, Artificial Sequence
  Description of Artificial Sequence: Synthetic oligonucleotide
  Target: SCN10A; (+) strand; PAM type: YTN; PAM sequence: CTT
ctgcctatcatgtgtgcgtg

SEQ ID NO: 65270 - DNA, 20 bp, Artificial Sequence
  Description of Artificial Sequence: Synthetic oligonucleotide
  Target: SCN10A; (+) strand; PAM type: YTN; PAM sequence: TTC
tgcctatcatgtgtgcgtgt

SEQ ID NO: 65271 - DNA, 20 bp, Artificial Sequence
  Description of Artificial Sequence: Synthetic oligonucleotide
  Target: SCN10A; (+) strand; PAM type: YTN; PAM sequence: CTG
cctatcatgtgtgcgtgtgt

SEQ ID NO: 65272 - DNA, 20 bp, Artificial Sequence
  Description of Artificial Sequence: Synthetic oligonucleotide
  Target: SCN10A; (+) strand; PAM type: YTN; PAM sequence: CTA
tcatgtgtgcgtgtgtttga

SEQ ID NO: 65273 - DNA, 20 bp, Artificial Sequence
  Description of Artificial Sequence: Synthetic oligonucleotide
  Target: SCN10A; (+) strand; PAM type: YTN; PAM sequence: TTT
gaacacacacacacacacac

SEQ ID NO: 65274 - DNA, 20 bp, Artificial Sequence
  Description of Artificial Sequence: Synthetic oligonucleotide
  Target: SCN10A; (+) strand; PAM type: YTN; PAM sequence: TTG
aacacacacacacacacaca

SEQ ID NO: 65275 - DNA, 20 bp, Artificial Sequence
  Description of Artificial Sequence: Synthetic oligonucleotide
  Target: SCN10A; (+) strand; PAM type: YTN; PAM sequence: CTT
gtgaggtggcttaattcagg

SEQ ID NO: 65276 - DNA, 20 bp, Artificial Sequence
  Description of Artificial Sequence: Synthetic oligonucleotide
  Target: SCN10A; (+) strand; PAM type: YTN; PAM sequence: TTG
tgaggtggcttaattcaggg

SEQ ID NO: 65277 - DNA, 20 bp, Artificial Sequence
  Description of Artificial Sequence: Synthetic oligonucleotide
  Target: SCN10A; (+) strand; PAM type: YTN; PAM sequence: CTT
aattcaggggttaagaaaag

SEQ ID NO: 65278 - DNA, 20 bp, Artificial Sequence
  Description of Artificial Sequence: Synthetic oligonucleotide
  Target: SCN10A; (+) strand; PAM type: YTN; PAM sequence: TTA
attcaggggttaagaaaagc

SEQ ID NO: 65279 - DNA, 20 bp, Artificial Sequence
  Description of Artificial Sequence: Synthetic oligonucleotide
  Target: SCN10A; (+) strand; PAM type: YTN; PAM sequence: TTC
aggggttaagaaaagcgggc

SEQ ID NO: 65280 - DNA, 20 bp, Artificial Sequence
  Description of Artificial Sequence: Synthetic oligonucleotide
  Target: SCN10A; (+) strand; PAM type: YTN; PAM sequence: TTA
agaaaagcgggcttggcagc

SEQ ID NO: 65281 - DNA, 20 bp, Artificial Sequence
  Description of Artificial Sequence: Synthetic oligonucleotide
  Target: SCN10A; (+) strand; PAM type: YTN; PAM sequence: CTT
ggcagccggtctgtctgggt

SEQ ID NO: 65282 - DNA, 20 bp, Artificial Sequence
  Description of Artificial Sequence: Synthetic oligonucleotide
  Target: SCN10A; (+) strand; PAM type: YTN; PAM sequence: TTG
gcagccggtctgtctgggtt

SEQ ID NO: 65283 - DNA, 20 bp, Artificial Sequence
  Description of Artificial Sequence: Synthetic oligonucleotide
  Target: SCN10A; (+) strand; PAM type: YTN; PAM sequence: CTG
tctgggttcaaattctgatg

SEQ ID NO: 65284 - DNA, 20 bp, Artificial Sequence
  Description of Artificial Sequence: Synthetic oligonucleotide
  Target: SCN10A; (+) strand; PAM type: YTN; PAM sequence: CTG
ggttcaaattctgatgtggc

SEQ ID NO: 65285 - DNA, 20 bp, Artificial Sequence
  Description of Artificial Sequence: Synthetic oligonucleotide
  Target: SCN10A; (+) strand; PAM type: YTN; PAM sequence: TTC
aaattctgatgtggccacta

SEQ ID NO: 65286 - DNA, 20 bp, Artificial Sequence
  Description of Artificial Sequence: Synthetic oligonucleotide
  Target: SCN10A; (+) strand; PAM type: YTN; PAM sequence: TTC
tgatgtggccactaaactca

SEQ ID NO: 65287 - DNA, 20 bp, Artificial Sequence
  Description of Artificial Sequence: Synthetic oligonucleotide
  Target: SCN10A; (+) strand; PAM type: YTN; PAM sequence: CTG
atgtggccactaaactcaac

SEQ ID NO: 65288 - DNA, 20 bp, Artificial Sequence
  Description of Artificial Sequence: Synthetic oligonucleotide
  Target: SCN10A; (+) strand; PAM type: YTN; PAM sequence: CTA
aactcaactctatgatcttg

SEQ ID NO: 65289 - DNA, 20 bp, Artificial Sequence
  Description of Artificial Sequence: Synthetic oligonucleotide
  Target: SCN10A; (+) strand; PAM type: YTN; PAM sequence: CTC
aactctatgatcttgggaag

SEQ ID NO: 65290 - DNA, 20 bp, Artificial Sequence
  Description of Artificial Sequence: Synthetic oligonucleotide
  Target: SCN10A; (+) strand; PAM type: YTN; PAM sequence: CTC
tatgatcttgggaagattat

SEQ ID NO: 65291 - DNA, 20 bp, Artificial Sequence
  Description of Artificial Sequence: Synthetic oligonucleotide
  Target: SCN10A; (+) strand; PAM type: YTN; PAM sequence: CTA
tgatcttgggaagattattt

SEQ ID NO: 65292 - DNA, 20 bp, Artificial Sequence
  Description of Artificial Sequence: Synthetic oligonucleotide
  Target: SCN10A; (+) strand; PAM type: YTN; PAM sequence: CTT
gggaagattatttaaccttt

SEQ ID NO: 65293 - DNA, 20 bp, Artificial Sequence
  Description of Artificial Sequence: Synthetic oligonucleotide
  Target: SCN10A; (+) strand; PAM type: YTN; PAM sequence: TTG
ggaagattatttaacctttt

SEQ ID NO: 65294 - DNA, 20 bp, Artificial Sequence
  Description of Artificial Sequence: Synthetic oligonucleotide
  Target: SCN10A; (+) strand; PAM type: YTN; PAM sequence: TTA
tttaaccttttgcatctcca

SEQ ID NO: 65295 - DNA, 20 bp, Artificial Sequence
  Description of Artificial Sequence: Synthetic oligonucleotide
  Target: SCN10A; (+) strand; PAM type: YTN; PAM sequence: TTT
aaccttttgcatctccattt

SEQ ID NO: 65296 - DNA, 20 bp, Artificial Sequence
  Description of Artificial Sequence: Synthetic oligonucleotide
  Target: SCN10A; (+) strand; PAM type: YTN; PAM sequence: TTA
accttttgcatctccatttt

SEQ ID NO: 65297 - DNA, 20 bp, Artificial Sequence
  Description of Artificial Sequence: Synthetic oligonucleotide
  Target: SCN10A; (+) strand; PAM type: YTN; PAM sequence: CTT
ttgcatctccatttttccat

SEQ ID NO: 65298 - DNA, 20 bp, Artificial Sequence
  Description of Artificial Sequence: Synthetic oligonucleotide
  Target: SCN10A; (+) strand; PAM type: YTN; PAM sequence: TTT
tgcatctccatttttccatc

SEQ ID NO: 65299 - DNA, 20 bp, Artificial Sequence
  Description of Artificial Sequence: Synthetic oligonucleotide
  Target: SCN10A; (+) strand; PAM type: YTN; PAM sequence: TTT
gcatctccatttttccatct

SEQ ID NO: 65300 - DNA, 20 bp, Artificial Sequence
  Description of Artificial Sequence: Synthetic oligonucleotide
  Target: SCN10A; (+) strand; PAM type: YTN; PAM sequence: TTG
catctccatttttccatctg

SEQ ID NO: 65301 - DNA, 20 bp, Artificial Sequence
  Description of Artificial Sequence: Synthetic oligonucleotide
  Target: SCN10A; (+) strand; PAM type: YTN; PAM sequence: CTC
catttttccatctgggaaag

SEQ ID NO: 65302 - DNA, 20 bp, Artificial Sequence
  Description of Artificial Sequence: Synthetic oligonucleotide
  Target: SCN10A; (+) strand; PAM type: YTN; PAM sequence: TTT
ttccatctgggaaagggaat

SEQ ID NO: 65303 - DNA, 20 bp, Artificial Sequence
  Description of Artificial Sequence: Synthetic oligonucleotide
  Target: SCN10A; (+) strand; PAM type: YTN; PAM sequence: TTT
tccatctgggaaagggaata

SEQ ID NO: 65304 - DNA, 20 bp, Artificial Sequence
  Description of Artificial Sequence: Synthetic oligonucleotide
  Target: SCN10A; (+) strand; PAM type: YTN; PAM sequence: TTT
ccatctgggaaagggaataa

SEQ ID NO: 65305 - DNA, 20 bp, Artificial Sequence
  Description of Artificial Sequence: Synthetic oligonucleotide
  Target: SCN10A; (+) strand; PAM type: YTN; PAM sequence: TTC
catctgggaaagggaataac

SEQ ID NO: 65306 - DNA, 20 bp, Artificial Sequence
  Description of Artificial Sequence: Synthetic oligonucleotide
  Target: SCN10A; (+) strand; PAM type: YTN; PAM sequence: CTG
ggaaagggaataacaagagt

SEQ ID NO: 65307 - DNA, 20 bp, Artificial Sequence
  Description of Artificial Sequence: Synthetic oligonucleotide
  Target: SCN10A; (+) strand; PAM type: YTN; PAM sequence: CTA
ccatgtagggttgttgtgaa

SEQ ID NO: 65308 - DNA, 20 bp, Artificial Sequence
  Description of Artificial Sequence: Synthetic oligonucleotide
  Target: SCN10A; (+) strand; PAM type: YTN; PAM sequence: TTG
ttgtgaaaataaaatgagat

SEQ ID NO: 65309 - DNA, 20 bp, Artificial Sequence
  Description of Artificial Sequence: Synthetic oligonucleotide
  Target: SCN10A; (+) strand; PAM type: YTN; PAM sequence: TTG
tgaaaataaaatgagataat

SEQ ID NO: 65310 - DNA, 20 bp, Artificial Sequence
  Description of Artificial Sequence: Synthetic oligonucleotide
  Target: SCN10A; (+) strand; PAM type: YTN; PAM sequence: CTG
agtattattactattcctgt

SEQ ID NO: 65311 - DNA, 20 bp, Artificial Sequence
  Description of Artificial Sequence: Synthetic oligonucleotide
  Target: SCN10A; (+) strand; PAM type: YTN; PAM sequence: TTA
ttactattcctgtgggtggg

SEQ ID NO: 65312 - DNA, 20 bp, Artificial Sequence
  Description of Artificial Sequence: Synthetic oligonucleotide
  Target: SCN10A; (+) strand; PAM type: YTN; PAM sequence: TTA
ctattcctgtgggtggggca

SEQ ID NO: 65313 - DNA, 20 bp, Artificial Sequence
  Description of Artificial Sequence: Synthetic oligonucleotide
  Target: SCN10A; (+) strand; PAM type: YTN; PAM sequence: CTA
ttcctgtgggtggggcaagg

SEQ ID NO: 65314 - DNA, 20 bp, Artificial Sequence
  Description of Artificial Sequence: Synthetic oligonucleotide
  Target: SCN10A; (+) strand; PAM type: YTN; PAM sequence: TTC
ctgtgggtggggcaaggttg

SEQ ID NO: 65315 - DNA, 20 bp, Artificial Sequence
  Description of Artificial Sequence: Synthetic oligonucleotide
  Target: SCN10A; (+) strand; PAM type: YTN; PAM sequence: CTG
tgggtggggcaaggttggag

SEQ ID NO: 65316 - DNA, 20 bp, Artificial Sequence
  Description of Artificial Sequence: Synthetic oligonucleotide
  Target: SCN10A; (+) strand; PAM type: YTN; PAM sequence: TTG
gagcagttgttgtccctctg

SEQ ID NO: 65317 - DNA, 20 bp, Artificial Sequence
  Description of Artificial Sequence: Synthetic oligonucleotide
  Target: SCN10A; (+) strand; PAM type: YTN; PAM sequence: TTG
ttgtccctctgagtcagata

SEQ ID NO: 65318 - DNA, 20 bp, Artificial Sequence
  Description of Artificial Sequence: Synthetic oligonucleotide
  Target: SCN10A; (+) strand; PAM type: YTN; PAM sequence: TTG
tccctctgagtcagatactt

SEQ ID NO: 65319 - DNA, 20 bp, Artificial Sequence
  Description of Artificial Sequence: Synthetic oligonucleotide
  Target: SCN10A; (+) strand; PAM type: YTN; PAM sequence: CTC
tgagtcagatactttatcca

SEQ ID NO: 65320 - DNA, 20 bp, Artificial Sequence
  Description of Artificial Sequence: Synthetic oligonucleotide
  Target: SCN10A; (+) strand; PAM type: YTN; PAM sequence: CTG
agtcagatactttatccagt

SEQ ID NO: 65321 - DNA, 20 bp, Artificial Sequence
  Description of Artificial Sequence: Synthetic oligonucleotide
  Target: SCN10A; (+) strand; PAM type: YTN; PAM sequence: CTT
tatccagtatatagtgaaat

SEQ ID NO: 65322 - DNA, 20 bp, Artificial Sequence
  Description of Artificial Sequence: Synthetic oligonucleotide
  Target: SCN10A; (+) strand; PAM type: YTN; PAM sequence: TTT
atccagtatatagtgaaatc

SEQ ID NO: 65323 - DNA, 20 bp, Artificial Sequence
  Description of Artificial Sequence: Synthetic oligonucleotide
  Target: SCN10A; (+) strand; PAM type: YTN; PAM sequence: TTA
tccagtatatagtgaaatcc

SEQ ID NO: 65324 - DNA, 20 bp, Artificial Sequence
  Description of Artificial Sequence: Synthetic oligonucleotide
  Target: SCN10A; (+) strand; PAM type: YTN; PAM sequence: TTG
tatcttgttaagagtaaata

SEQ ID NO: 65325 - DNA, 20 bp, Artificial Sequence
  Description of Artificial Sequence: Synthetic oligonucleotide
  Target: SCN10A; (+) strand; PAM type: YTN; PAM sequence: CTT
gttaagagtaaataatacta

SEQ ID NO: 65326 - DNA, 20 bp, Artificial Sequence
  Description of Artificial Sequence: Synthetic oligonucleotide
  Target: SCN10A; (+) strand; PAM type: YTN; PAM sequence: TTG
ttaagagtaaataatactaa

SEQ ID NO: 65327 - DNA, 20 bp, Artificial Sequence
  Description of Artificial Sequence: Synthetic oligonucleotide
  Target: SCN10A; (+) strand; PAM type: YTN; PAM sequence: TTA
agagtaaataatactaacaa

SEQ ID NO: 65328 - DNA, 20 bp, Artificial Sequence
  Description of Artificial Sequence: Synthetic oligonucleotide
  Target: SCN10A; (+) strand; PAM type: YTN; PAM sequence: CTA
acaagtgatggaggaaaatt

SEQ ID NO: 65329 - DNA, 20 bp, Artificial Sequence
  Description of Artificial Sequence: Synthetic oligonucleotide
  Target: SCN10A; (+) strand; PAM type: YTN; PAM sequence: TTT
aaagcagcatgatgtctaaa

SEQ ID NO: 65330 - DNA, 20 bp, Artificial Sequence
  Description of Artificial Sequence: Synthetic oligonucleotide
  Target: SCN10A; (+) strand; PAM type: YTN; PAM sequence: TTA
aagcagcatgatgtctaaac

SEQ ID NO: 65331 - DNA, 20 bp, Artificial Sequence
  Description of Artificial Sequence: Synthetic oligonucleotide
  Target: SCN10A; (+) strand; PAM type: YTN; PAM sequence: CTA
aactagatgccaaagaaaag

SEQ ID NO: 65332 - DNA, 20 bp, Artificial Sequence
  Description of Artificial Sequence: Synthetic oligonucleotide
  Target: SCN10A; (+) strand; PAM type: YTN; PAM sequence: CTA
gatgccaaagaaaagttccg

SEQ ID NO: 65333 - DNA, 20 bp, Artificial Sequence
  Description of Artificial Sequence: Synthetic oligonucleotide
  Target: SCN10A; (+) strand; PAM type: YTN; PAM sequence: TTC
cgacttcctgatgcttttgt

SEQ ID NO: 65334 - DNA, 20 bp, Artificial Sequence
  Description of Artificial Sequence: Synthetic oligonucleotide
  Target: SCN10A; (+) strand; PAM type: YTN; PAM sequence: CTT
cctgatgcttttgttacaac

SEQ ID NO: 65335 - DNA, 20 bp, Artificial Sequence
  Description of Artificial Sequence: Synthetic oligonucleotide
  Target: SCN10A; (+) strand; PAM type: YTN; PAM sequence: TTC
ctgatgcttttgttacaaca

SEQ ID NO: 65336 - DNA, 20 bp, Artificial Sequence
  Description of Artificial Sequence: Synthetic oligonucleotide
  Target: SCN10A; (+) strand; PAM type: YTN; PAM sequence: CTG
atgcttttgttacaacagca

SEQ ID NO: 65337 - DNA, 20 bp, Artificial Sequence
  Description of Artificial Sequence: Synthetic oligonucleotide
  Target: SCN10A; (+) strand; PAM type: YTN; PAM sequence: CTT
ttgttacaacagcaaccttg

SEQ ID NO: 65338 - DNA, 20 bp, Artificial Sequence
  Description of Artificial Sequence: Synthetic oligonucleotide
  Target: SCN10A; (+) strand; PAM type: YTN; PAM sequence: TTT
tgttacaacagcaaccttgt

SEQ ID NO: 65339 - DNA, 20 bp, Artificial Sequence
  Description of Artificial Sequence: Synthetic oligonucleotide
  Target: SCN10A; (+) strand; PAM type: YTN; PAM sequence: TTT
gttacaacagcaaccttgtt

SEQ ID NO: 65340 - DNA, 20 bp, Artificial Sequence
  Description of Artificial Sequence: Synthetic oligonucleotide
  Target: SCN10A; (+) strand; PAM type: YTN; PAM sequence: TTG
ttacaacagcaaccttgttt

SEQ ID NO: 65341 - DNA, 20 bp, Artificial Sequence
  Description of Artificial Sequence: Synthetic oligonucleotide
  Target: SCN10A; (+) strand; PAM type: YTN; PAM sequence: TTA
caacagcaaccttgtttcca

SEQ ID NO: 65342 - DNA, 20 bp, Artificial Sequence
  Description of Artificial Sequence: Synthetic oligonucleotide
  Target: SCN10A; (+) strand; PAM type: YTN; PAM sequence: CTT
gtttccatgtttcctccctt

SEQ ID NO: 65343 - DNA, 20 bp, Artificial Sequence
  Description of Artificial Sequence: Synthetic oligonucleotide
  Target: SCN10A; (+) strand; PAM type: YTN; PAM sequence: TTG
tttccatgtttcctcccttc

SEQ ID NO: 65344 - DNA, 20 bp, Artificial Sequence
  Description of Artificial Sequence: Synthetic oligonucleotide
  Target: SCN10A; (+) strand; PAM type: YTN; PAM sequence: TTT
ccatgtttcctcccttccac

SEQ ID NO: 65345 - DNA, 20 bp, Artificial Sequence
  Description of Artificial Sequence: Synthetic oligonucleotide
  Target: SCN10A; (+) strand; PAM type: YTN; PAM sequence: TTC
catgtttcctcccttccact

SEQ ID NO: 65346 - DNA, 20 bp, Artificial Sequence
  Description of Artificial Sequence: Synthetic oligonucleotide
  Target: SCN10A; (+) strand; PAM type: YTN; PAM sequence: TTT
cctcccttccactgtcttcc

SEQ ID NO: 65347 - DNA, 20 bp, Artificial Sequence
  Description of Artificial Sequence: Synthetic oligonucleotide
  Target: SCN10A; (+) strand; PAM type: YTN; PAM sequence: TTC
ctcccttccactgtcttccc

SEQ ID NO: 65348 - DNA, 20 bp, Artificial Sequence
  Description of Artificial Sequence: Synthetic oligonucleotide
  Target: SCN10A; (+) strand; PAM type: YTN; PAM sequence: CTC
ccttccactgtcttcccctt

SEQ ID NO: 65349 - DNA, 20 bp, Artificial Sequence
  Description of Artificial Sequence: Synthetic oligonucleotide
  Target: SCN10A; (+) strand; PAM type: YTN; PAM sequence: CTT
ccactgtcttccccttccct

SEQ ID NO: 65350 - DNA, 20 bp, Artificial Sequence
  Description of Artificial Sequence: Synthetic oligonucleotide
  Target: SCN10A; (+) strand; PAM type: YTN; PAM sequence: TTC
cactgtcttccccttccctc

SEQ ID NO: 65351 - DNA, 20 bp, Artificial Sequence
  Description of Artificial Sequence: Synthetic oligonucleotide
  Target: SCN10A; (+) strand; PAM type: YTN; PAM sequence: CTG
tcttccccttccctccccaa

SEQ ID NO: 65352 - DNA, 20 bp, Artificial Sequence
  Description of Artificial Sequence: Synthetic oligonucleotide
  Target: SCN10A; (+) strand; PAM type: YTN; PAM sequence: CTT
ccccttccctccccaactct

SEQ ID NO: 65353 - DNA, 20 bp, Artificial Sequence
  Description of Artificial Sequence: Synthetic oligonucleotide
  Target: SCN10A; (+) strand; PAM type: YTN; PAM sequence: TTC
cccttccctccccaactctt

SEQ ID NO: 65354 - DNA, 20 bp, Artificial Sequence
  Description of Artificial Sequence: Synthetic oligonucleotide
  Target: SCN10A; (+) strand; PAM type: YTN; PAM sequence: CTT
ccctccccaactctttttct

SEQ ID NO: 65355 - DNA, 20 bp, Artificial Sequence
  Description of Artificial Sequence: Synthetic oligonucleotide
  Target: SCN10A; (+) strand; PAM type: YTN; PAM sequence: TTC
cctccccaactctttttctc

SEQ ID NO: 65356 - DNA, 20 bp, Artificial Sequence
  Description of Artificial Sequence: Synthetic oligonucleotide
  Target: SCN10A; (+) strand; PAM type: YTN; PAM sequence: CTC
cccaactctttttctcctta

SEQ ID NO: 65357 - DNA, 20 bp, Artificial Sequence
  Description of Artificial Sequence: Synthetic oligonucleotide
  Target: SCN10A; (+) strand; PAM type: YTN; PAM sequence: CTC
tttttctccttaagtgacaa

SEQ ID NO: 65358 - DNA, 20 bp, Artificial Sequence
  Description of Artificial Sequence: Synthetic oligonucleotide
  Target: SCN10A; (+) strand; PAM type: YTN; PAM sequence: CTT
tttctccttaagtgacaaca

SEQ ID NO: 65359 - DNA, 20 bp, Artificial Sequence
  Description of Artificial Sequence: Synthetic oligonucleotide
  Target: SCN10A; (+) strand; PAM type: YTN; PAM sequence: TTT
ttctccttaagtgacaacat

SEQ ID NO: 65360 - DNA, 20 bp, Artificial Sequence
  Description of Artificial Sequence: Synthetic oligonucleotide
  Target: SCN10A; (+) strand; PAM type: YTN; PAM sequence: TTT
tctccttaagtgacaacatt

SEQ ID NO: 65361 - DNA, 20 bp, Artificial Sequence
  Description of Artificial Sequence: Synthetic oligonucleotide
  Target: SCN10A; (+) strand; PAM type: YTN; PAM sequence: TTT
ctccttaagtgacaacattg

SEQ ID NO: 65362 - DNA, 20 bp, Artificial Sequence
  Description of Artificial Sequence: Synthetic oligonucleotide
  Target: SCN10A; (+) strand; PAM type: YTN; PAM sequence: TTC
tccttaagtgacaacattga

SEQ ID NO: 65363 - DNA, 20 bp, Artificial Sequence
  Description of Artificial Sequence: Synthetic oligonucleotide
  Target: SCN10A; (+) strand; PAM type: YTN; PAM sequence: CTC
cttaagtgacaacattgaaa

SEQ ID NO: 65364 - DNA, 20 bp, Artificial Sequence
  Description of Artificial Sequence: Synthetic oligonucleotide
  Target: SCN10A; (+) strand; PAM type: YTN; PAM sequence: CTT
aagtgacaacattgaaaatc

SEQ ID NO: 65365 - DNA, 20 bp, Artificial Sequence
  Description of Artificial Sequence: Synthetic oligonucleotide
  Target: SCN10A; (+) strand; PAM type: YTN; PAM sequence: TTA
agtgacaacattgaaaatcg

SEQ ID NO: 65366 - DNA, 20 bp, Artificial Sequence
  Description of Artificial Sequence: Synthetic oligonucleotide
  Target: SCN10A; (+) strand; PAM type: YTN; PAM sequence: TTG
aaaatcgtggctactgttaa

SEQ ID NO: 65367 - DNA, 20 bp, Artificial Sequence
  Description of Artificial Sequence: Synthetic oligonucleotide
  Target: SCN10A; (+) strand; PAM type: YTN; PAM sequence: CTA
ctgttaattgtggtcataaa

SEQ ID NO: 65368 - DNA, 20 bp, Artificial Sequence
  Description of Artificial Sequence: Synthetic oligonucleotide
  Target: SCN10A; (+) strand; PAM type: YTN; PAM sequence: CTG
ttaattgtggtcataaaagt

SEQ ID NO: 65369 - DNA, 20 bp, Artificial Sequence
  Description of Artificial Sequence: Synthetic oligonucleotide
  Target: SCN10A; (+) strand; PAM type: YTN; PAM sequence: TTA
attgtggtcataaaagtaat

SEQ ID NO: 65370 - DNA, 20 bp, Artificial Sequence
  Description of Artificial Sequence: Synthetic oligonucleotide
  Target: SCN10A; (+) strand; PAM type: YTN; PAM sequence: TTG
tggtcataaaagtaattaca

SEQ ID NO: 65371 - DNA, 20 bp, Artificial Sequence
  Description of Artificial Sequence: Synthetic oligonucleotide
  Target: SCN10A; (+) strand; PAM type: YTN; PAM sequence: TTA
cattggaaggaaacagacaa

SEQ ID NO: 65372 - DNA, 20 bp, Artificial Sequence
  Description of Artificial Sequence: Synthetic oligonucleotide
  Target: SCN10A; (+) strand; PAM type: YTN; PAM sequence: TTG
gaaggaaacagacaagtcca

SEQ ID NO: 65373 - DNA, 20 bp, Artificial Sequence
  Description of Artificial Sequence: Synthetic oligonucleotide
  Target: SCN10A; (+) strand; PAM type: YTN; PAM sequence: TTG
tctttagataaaaaagtgac

SEQ ID NO: 65374 - DNA, 20 bp, Artificial Sequence
  Description of Artificial Sequence: Synthetic oligonucleotide
  Target: SCN10A; (+) strand; PAM type: YTN; PAM sequence: CTT
tagataaaaaagtgacattt

SEQ ID NO: 65375 - DNA, 20 bp, Artificial Sequence
  Description of Artificial Sequence: Synthetic oligonucleotide
  Target: SCN10A; (+) strand; PAM type: YTN; PAM sequence: TTT
agataaaaaagtgacattta

SEQ ID NO: 65376 - DNA, 20 bp, Artificial Sequence
  Description of Artificial Sequence: Synthetic oligonucleotide
  Target: SCN10A; (+) strand; PAM type: YTN; PAM sequence: TTA
gataaaaaagtgacatttat

SEQ ID NO: 65377 - DNA, 20 bp, Artificial Sequence
  Description of Artificial Sequence: Synthetic oligonucleotide
  Target: SCN10A; (+) strand; PAM type: YTN; PAM sequence: TTT
atcctcatttcaaggtagag

SEQ ID NO: 65378 - DNA, 20 bp, Artificial Sequence
  Description of Artificial Sequence: Synthetic oligonucleotide
  Target: SCN10A; (+) strand; PAM type: YTN; PAM sequence: TTA
tcctcatttcaaggtagagg

SEQ ID NO: 65379 - DNA, 20 bp, Artificial Sequence
  Description of Artificial Sequence: Synthetic oligonucleotide
  Target: SCN10A; (+) strand; PAM type: YTN; PAM sequence: CTC
atttcaaggtagaggcaact

SEQ ID NO: 65380 - DNA, 20 bp, Artificial Sequence
  Description of Artificial Sequence: Synthetic oligonucleotide
  Target: SCN10A; (+) strand; PAM type: YTN; PAM sequence: TTT
caaggtagaggcaactgaga

SEQ ID NO: 65381 - DNA, 20 bp, Artificial Sequence
  Description of Artificial Sequence: Synthetic oligonucleotide
  Target: SCN10A; (+) strand; PAM type: YTN; PAM sequence: TTC
aaggtagaggcaactgagat

SEQ ID NO: 65382 - DNA, 20 bp, Artificial Sequence
  Description of Artificial Sequence: Synthetic oligonucleotide
  Target: SCN10A; (+) strand; PAM type: YTN; PAM sequence: CTG
agatccagaaaattcaagtg

SEQ ID NO: 65383 - DNA, 20 bp, Artificial Sequence
  Description of Artificial Sequence: Synthetic oligonucleotide
  Target: SCN10A; (+) strand; PAM type: YTN; PAM sequence: TTC
aagtggttgtcctatgtttt

SEQ ID NO: 65384 - DNA, 20 bp, Artificial Sequence
  Description of Artificial Sequence: Synthetic oligonucleotide
  Target: SCN10A; (+) strand; PAM type: YTN; PAM sequence: TTG
tcctatgttttgtaaagggc

SEQ ID NO: 65385 - DNA, 20 bp, Artificial Sequence
  Description of Artificial Sequence: Synthetic oligonucleotide
  Target: SCN10A; (+) strand; PAM type: YTN; PAM sequence: CTA
tgttttgtaaagggcaacta

SEQ ID NO: 65386 - DNA, 20 bp, Artificial Sequence
  Description of Artificial Sequence: Synthetic oligonucleotide
  Target: SCN10A; (+) strand; PAM type: YTN; PAM sequence: TTT
tgtaaagggcaactagctgc

SEQ ID NO: 65387 - DNA, 20 bp, Artificial Sequence
  Description of Artificial Sequence: Synthetic oligonucleotide
  Target: SCN10A; (+) strand; PAM type: YTN; PAM sequence: TTT
gtaaagggcaactagctgcc

SEQ ID NO: 65388 - DNA, 20 bp, Artificial Sequence
  Description of Artificial Sequence: Synthetic oligonucleotide
  Target: SCN10A; (+) strand; PAM type: YTN; PAM sequence: TTG
taaagggcaactagctgcct

SEQ ID NO: 65389 - DNA, 20 bp, Artificial Sequence
  Description of Artificial Sequence: Synthetic oligonucleotide
  Target: SCN10A; (+) strand; PAM type: YTN; PAM sequence: CTA
gctgcctctggctccaggct

SEQ ID NO: 65390 - DNA, 20 bp, Artificial Sequence
  Description of Artificial Sequence: Synthetic oligonucleotide
  Target: SCN10A; (+) strand; PAM type: YTN; PAM sequence: CTG
cctctggctccaggctctcc

SEQ ID NO: 65391 - DNA, 20 bp, Artificial Sequence
  Description of Artificial Sequence: Synthetic oligonucleotide
  Target: SCN10A; (+) strand; PAM type: YTN; PAM sequence: CTC
tggctccaggctctcctggt

SEQ ID NO: 65392 - DNA, 20 bp, Artificial Sequence
  Description of Artificial Sequence: Synthetic oligonucleotide
  Target: SCN10A; (+) strand; PAM type: YTN; PAM sequence: CTG
gctccaggctctcctggttc

SEQ ID NO: 65393 - DNA, 20 bp, Artificial Sequence
  Description of Artificial Sequence: Synthetic oligonucleotide
  Target: SCN10A; (+) strand; PAM type: YTN; PAM sequence: CTC
caggctctcctggttcactt

SEQ ID NO: 65394 - DNA, 20 bp, Artificial Sequence
  Description of Artificial Sequence: Synthetic oligonucleotide
  Target: SCN10A; (+) strand; PAM type: YTN; PAM sequence: CTC
tcctggttcactttcctgtg

SEQ ID NO: 65395 - DNA, 20 bp, Artificial Sequence
  Description of Artificial Sequence: Synthetic oligonucleotide
  Target: SCN10A; (+) strand; PAM type: YTN; PAM sequence: CTC
ctggttcactttcctgtgct

SEQ ID NO: 65396 - DNA, 20 bp, Artificial Sequence
  Description of Artificial Sequence: Synthetic oligonucleotide
  Target: SCN10A; (+) strand; PAM type: YTN; PAM sequence: CTG
gttcactttcctgtgcttgt

SEQ ID NO: 65397 - DNA, 20 bp, Artificial Sequence
  Description of Artificial Sequence: Synthetic oligonucleotide
  Target: SCN10A; (+) strand; PAM type: YTN; PAM sequence: TTC
actttcctgtgcttgttcat

SEQ ID NO: 65398 - DNA, 20 bp, Artificial Sequence
  Description of Artificial Sequence: Synthetic oligonucleotide
  Target: SCN10A; (+) strand; PAM type: YTN; PAM sequence: CTT
tcctgtgcttgttcatccca

SEQ ID NO: 65399 - DNA, 20 bp, Artificial Sequence
  Description of Artificial Sequence: Synthetic oligonucleotide
  Target: SCN10A; (+) strand; PAM type: YTN; PAM sequence: TTT
cctgtgcttgttcatcccaa

SEQ ID NO: 65400 - DNA, 20 bp, Artificial Sequence
  Description of Artificial Sequence: Synthetic oligonucleotide
  Target: SCN10A; (+) strand; PAM type: YTN; PAM sequence: TTC
ctgtgcttgttcatcccaaa

SEQ ID NO: 65401 - DNA, 20 bp, Artificial Sequence
  Description of Artificial Sequence: Synthetic oligonucleotide
  Target: SCN10A; (+) strand; PAM type: YTN; PAM sequence: CTG
tgcttgttcatcccaaagcc

SEQ ID NO: 65402 - DNA, 20 bp, Artificial Sequence
  Description of Artificial Sequence: Synthetic oligonucleotide
  Target: SCN10A; (+) strand; PAM type: YTN; PAM sequence: CTT
gttcatcccaaagccattcc

SEQ ID NO: 65403 - DNA, 20 bp, Artificial Sequence
  Description of Artificial Sequence: Synthetic oligonucleotide
  Target: SCN10A; (+) strand; PAM type: YTN; PAM sequence: TTG
ttcatcccaaagccattccc

SEQ ID NO: 65404 - DNA, 20 bp, Artificial Sequence
  Description of Artificial Sequence: Synthetic oligonucleotide
  Target: SCN10A; (+) strand; PAM type: YTN; PAM sequence: TTC
atcccaaagccattcccacc

SEQ ID NO: 65405 - DNA, 20 bp, Artificial Sequence
  Description of Artificial Sequence: Synthetic oligonucleotide
  Target: SCN10A; (+) strand; PAM type: YTN; PAM sequence: TTC
ccaccagctcagcctgggtc

SEQ ID NO: 65406 - DNA, 20 bp, Artificial Sequence
  Description of Artificial Sequence: Synthetic oligonucleotide
  Target: SCN10A; (+) strand; PAM type: YTN; PAM sequence: CTC
agcctgggtcctcccacact

SEQ ID NO: 65407 - DNA, 20 bp, Artificial Sequence
  Description of Artificial Sequence: Synthetic oligonucleotide
  Target: SCN10A; (+) strand; PAM type: YTN; PAM sequence: CTG
ggtcctcccacacttgacct

SEQ ID NO: 65408 - DNA, 20 bp, Artificial Sequence
  Description of Artificial Sequence: Synthetic oligonucleotide
  Target: SCN10A; (+) strand; PAM type: YTN; PAM sequence: CTC
ccacacttgacctcctgaac

SEQ ID NO: 65409 - DNA, 20 bp, Artificial Sequence
  Description of Artificial Sequence: Synthetic oligonucleotide
  Target: SCN10A; (+) strand; PAM type: YTN; PAM sequence: CTT
gacctcctgaacccagtgtc

SEQ ID NO: 65410 - DNA, 20 bp, Artificial Sequence
  Description of Artificial Sequence: Synthetic oligonucleotide
  Target: SCN10A; (+) strand; PAM type: YTN; PAM sequence: TTG
acctcctgaacccagtgtcc

SEQ ID NO: 65411 - DNA, 20 bp, Artificial Sequence
  Description of Artificial Sequence: Synthetic oligonucleotide
  Target: SCN10A; (+) strand; PAM type: YTN; PAM sequence: CTC
ctgaacccagtgtccacatg

SEQ ID NO: 65412 - DNA, 20 bp, Artificial Sequence
  Description of Artificial Sequence: Synthetic oligonucleotide
  Target: SCN10A; (+) strand; PAM type: YTN; PAM sequence: CTG
aacccagtgtccacatgtct

SEQ ID NO: 65413 - DNA, 20 bp, Artificial Sequence
  Description of Artificial Sequence: Synthetic oligonucleotide
  Target: SCN10A; (+) strand; PAM type: YTN; PAM sequence: CTC
ctgcactgctgctctgctct

SEQ ID NO: 65414 - DNA, 20 bp, Artificial Sequence
  Description of Artificial Sequence: Synthetic oligonucleotide
  Target: SCN10A; (+) strand; PAM type: YTN; PAM sequence: CTG
cactgctgctctgctctcag

SEQ ID NO: 65415 - DNA, 20 bp, Artificial Sequence
  Description of Artificial Sequence: Synthetic oligonucleotide
  Target: SCN10A; (+) strand; PAM type: YTN; PAM sequence: CTG
ctgctctgctctcagctaac

SEQ ID NO: 65416 - DNA, 20 bp, Artificial Sequence
  Description of Artificial Sequence: Synthetic oligonucleotide
  Target: SCN10A; (+) strand; PAM type: YTN; PAM sequence: CTG
ctctgctctcagctaactgg

SEQ ID NO: 65417 - DNA, 20 bp, Artificial Sequence
  Description of Artificial Sequence: Synthetic oligonucleotide
  Target: SCN10A; (+) strand; PAM type: YTN; PAM sequence: CTC
tgctctcagctaactggctc

SEQ ID NO: 65418 - DNA, 20 bp, Artificial Sequence
  Description of Artificial Sequence: Synthetic oligonucleotide
  Target: SCN10A; (+) strand; PAM type: YTN; PAM sequence: CTG
ctctcagctaactggctcaa

SEQ ID NO: 65419 - DNA, 20 bp, Artificial Sequence
  Description of Artificial Sequence: Synthetic oligonucleotide
  Target: SCN10A; (+) strand; PAM type: YTN; PAM sequence: CTC
tcagctaactggctcaacac

SEQ ID NO: 65420 - DNA, 20 bp, Artificial Sequence
  Description of Artificial Sequence: Synthetic oligonucleotide
  Target: SCN10A; (+) strand; PAM type: YTN; PAM sequence: CTC
agctaactggctcaacacac

SEQ ID NO: 65421 - DNA, 20 bp, Artificial Sequence
  Description of Artificial Sequence: Synthetic oligonucleotide
  Target: SCN10A; (+) strand; PAM type: YTN; PAM sequence: CTA
actggctcaacacactaacc

SEQ ID NO: 65422 - DNA, 20 bp, Artificial Sequence
  Description of Artificial Sequence: Synthetic oligonucleotide
  Target: SCN10A; (+) strand; PAM type: YTN; PAM sequence: CTG
gctcaacacactaaccaata

SEQ ID NO: 65423 - DNA, 20 bp, Artificial Sequence
  Description of Artificial Sequence: Synthetic oligonucleotide
  Target: SCN10A; (+) strand; PAM type: YTN; PAM sequence: CTC
aacacactaaccaataaggg

SEQ ID NO: 65424 - DNA, 20 bp, Artificial Sequence
  Description of Artificial Sequence: Synthetic oligonucleotide
  Target: SCN10A; (+) strand; PAM type: YTN; PAM sequence: CTA
accaataagggcatgcccca

SEQ ID NO: 65425 - DNA, 20 bp, Artificial Sequence
  Description of Artificial Sequence: Synthetic oligonucleotide
  Target: SCN10A; (+) strand; PAM type: YTN; PAM sequence: CTG
caccctgccatcatccccac

SEQ ID NO: 65426 - DNA, 20 bp, Artificial Sequence
  Description of Artificial Sequence: Synthetic oligonucleotide
  Target: SCN10A; (+) strand; PAM type: YTN; PAM sequence: CTG
ccatcatccccaccccgccc

SEQ ID NO: 65427 - DNA, 20 bp, Artificial Sequence
  Description of Artificial Sequence: Synthetic oligonucleotide
  Target: SCN10A; (+) strand; PAM type: YTN; PAM sequence: CTC
acgatgttgcctatctggag

SEQ ID NO: 65428 - DNA, 20 bp, Artificial Sequence
  Description of Artificial Sequence: Synthetic oligonucleotide
  Target: SCN10A; (+) strand; PAM type: YTN; PAM sequence: TTG
cctatctggagcatggcttc

SEQ ID NO: 65429 - DNA, 20 bp, Artificial Sequence
  Description of Artificial Sequence: Synthetic oligonucleotide
  Target: SCN10A; (+) strand; PAM type: YTN; PAM sequence: CTA
tctggagcatggcttcgaag

SEQ ID NO: 65430 - DNA, 20 bp, Artificial Sequence
  Description of Artificial Sequence: Synthetic oligonucleotide
  Target: SCN10A; (+) strand; PAM type: YTN; PAM sequence: CTG
gagcatggcttcgaaggtag

SEQ ID NO: 65431 - DNA, 20 bp, Artificial Sequence
  Description of Artificial Sequence: Synthetic oligonucleotide
  Target: SCN10A; (+) strand; PAM type: YTN; PAM sequence: CTT
cgaaggtagggctcatgcca

SEQ ID NO: 65432 - DNA, 20 bp, Artificial Sequence
  Description of Artificial Sequence: Synthetic oligonucleotide
  Target: SCN10A; (+) strand; PAM type: YTN; PAM sequence: TTC
gaaggtagggctcatgccat

SEQ ID NO: 65433 - DNA, 20 bp, Artificial Sequence
  Description of Artificial Sequence: Synthetic oligonucleotide
  Target: SCN10A; (+) strand; PAM type: YTN; PAM sequence: CTC
atgccatggtgctccatggc

SEQ ID NO: 65434 - DNA, 20 bp, Artificial Sequence
  Description of Artificial Sequence: Synthetic oligonucleotide
  Target: SCN10A; (+) strand; PAM type: YTN; PAM sequence: CTC
catggccatgaagatggtgt

SEQ ID NO: 65435 - DNA, 20 bp, Artificial Sequence
  Description of Artificial Sequence: Synthetic oligonucleotide
  Target: SCN10A; (+) strand; PAM type: YTN; PAM sequence: TTC
accacgatgcacaaggtgat

SEQ ID NO: 65436 - DNA, 20 bp, Artificial Sequence
  Description of Artificial Sequence: Synthetic oligonucleotide
  Target: SCN10A; (+) strand; PAM type: YTN; PAM sequence: CTC
tgcaaagggatccgtcacaa

SEQ ID NO: 65437 - DNA, 20 bp, Artificial Sequence
  Description of Artificial Sequence: Synthetic oligonucleotide
  Target: SCN10A; (+) strand; PAM type: YTN; PAM sequence: CTG
caaagggatccgtcacaagc

SEQ ID NO: 65438 - DNA, 20 bp, Artificial Sequence
  Description of Artificial Sequence: Synthetic oligonucleotide
  Target: SCN10A; (+) strand; PAM type: YTN; PAM sequence: TTG
tcttgagcttcacccacatg

SEQ ID NO: 65439 - DNA, 20 bp, Artificial Sequence
  Description of Artificial Sequence: Synthetic oligonucleotide
  Target: SCN10A; (+) strand; PAM type: YTN; PAM sequence: CTT
gagcttcacccacatggggc

SEQ ID NO: 65440 - DNA, 20 bp, Artificial Sequence
  Description of Artificial Sequence: Synthetic oligonucleotide
  Target: SCN10A; (+) strand; PAM type: YTN; PAM sequence: TTG
agcttcacccacatggggca

SEQ ID NO: 65441 - DNA, 20 bp, Artificial Sequence
  Description of Artificial Sequence: Synthetic oligonucleotide
  Target: SCN10A; (+) strand; PAM type: YTN; PAM sequence: CTT
cacccacatggggcagcaat

SEQ ID NO: 65442 - DNA, 20 bp, Artificial Sequence
  Description of Artificial Sequence: Synthetic oligonucleotide
  Target: SCN10A; (+) strand; PAM type: YTN; PAM sequence: TTC
acccacatggggcagcaatc

SEQ ID NO: 65443 - DNA, 20 bp, Artificial Sequence
  Description of Artificial Sequence: Synthetic oligonucleotide
  Target: SCN10A; (+) strand; PAM type: YTN; PAM sequence: CTT
ctgagacaagctggtcaagc

SEQ ID NO: 65444 - DNA, 20 bp, Artificial Sequence
  Description of Artificial Sequence: Synthetic oligonucleotide
  Target: SCN10A; (+) strand; PAM type: YTN; PAM sequence: TTC
tgagacaagctggtcaagca

SEQ ID NO: 65445 - DNA, 20 bp, Artificial Sequence
  Description of Artificial Sequence: Synthetic oligonucleotide
  Target: SCN10A; (+) strand; PAM type: YTN; PAM sequence: CTG
agacaagctggtcaagcagg

SEQ ID NO: 65446 - DNA, 20 bp, Artificial Sequence
  Description of Artificial Sequence: Synthetic oligonucleotide
  Target: SCN10A; (+) strand; PAM type: YTN; PAM sequence: CTG
gtcaagcagggtgggcactt

SEQ ID NO: 65447 - DNA, 20 bp, Artificial Sequence
  Description of Artificial Sequence: Synthetic oligonucleotide
  Target: SCN10A; (+) strand; PAM type: YTN; PAM sequence: CTT
ctgttcagactcctcgagtt

SEQ ID NO: 65448 - DNA, 20 bp, Artificial Sequence
  Description of Artificial Sequence: Synthetic oligonucleotide
  Target: SCN10A; (+) strand; PAM type: YTN; PAM sequence: TTC
tgttcagactcctcgagttc

SEQ ID NO: 65449 - DNA, 20 bp, Artificial Sequence
  Description of Artificial Sequence: Synthetic oligonucleotide
  Target: SCN10A; (+) strand; PAM type: YTN; PAM sequence: CTG
ttcagactcctcgagttctg

SEQ ID NO: 65450 - DNA, 20 bp, Artificial Sequence
  Description of Artificial Sequence: Synthetic oligonucleotide
  Target: SCN10A; (+) strand; PAM type: YTN; PAM sequence: TTC
agactcctcgagttctgcat

SEQ ID NO: 65451 - DNA, 20 bp, Artificial Sequence
  Description of Artificial Sequence: Synthetic oligonucleotide
  Target: SCN10A; (+) strand; PAM type: YTN; PAM sequence: CTC
ctcgagttctgcattatagt

SEQ ID NO: 65452 - DNA, 20 bp, Artificial Sequence
  Description of Artificial Sequence: Synthetic oligonucleotide
  Target: SCN10A; (+) strand; PAM type: YTN; PAM sequence: CTC
gagttctgcattatagtgtg

SEQ ID NO: 65453 - DNA, 20 bp, Artificial Sequence
  Description of Artificial Sequence: Synthetic oligonucleotide
  Target: SCN10A; (+) strand; PAM type: YTN; PAM sequence: TTC
tgcattatagtgtggtcaat

SEQ ID NO: 65454 - DNA, 20 bp, Artificial Sequence
  Description of Artificial Sequence: Synthetic oligonucleotide
  Target: SCN10A; (+) strand; PAM type: YTN; PAM sequence: CTG
cattatagtgtggtcaatga

SEQ ID NO: 65455 - DNA, 20 bp, Artificial Sequence
  Description of Artificial Sequence: Synthetic oligonucleotide
  Target: SCN10A; (+) strand; PAM type: YTN; PAM sequence: TTA
tagtgtggtcaatgacagct

SEQ ID NO: 65456 - DNA, 20 bp, Artificial Sequence
  Description of Artificial Sequence: Synthetic oligonucleotide
  Target: SCN10A; (+) strand; PAM type: YTN; PAM sequence: CTG
tcagccatgtgtcaccttgg

SEQ ID NO: 65457 - DNA, 20 bp, Artificial Sequence
  Description of Artificial Sequence: Synthetic oligonucleotide
  Target: SCN10A; (+) strand; PAM type: YTN; PAM sequence: CTT
ggaccccaattctgcggtca

SEQ ID NO: 65458 - DNA, 20 bp, Artificial Sequence
  Description of Artificial Sequence: Synthetic oligonucleotide
  Target: SCN10A; (+) strand; PAM type: YTN; PAM sequence: TTG
gaccccaattctgcggtcat

SEQ ID NO: 65459 - DNA, 20 bp, Artificial Sequence
  Description of Artificial Sequence: Synthetic oligonucleotide
  Target: SCN10A; (+) strand; PAM type: YTN; PAM sequence: TTC
tgcggtcatcctctagacct

SEQ ID NO: 65460 - DNA, 20 bp, Artificial Sequence
  Description of Artificial Sequence: Synthetic oligonucleotide
  Target: SCN10A; (+) strand; PAM type: YTN; PAM sequence: CTG
cggtcatcctctagaccttg

SEQ ID NO: 65461 - DNA, 20 bp, Artificial Sequence
  Description of Artificial Sequence: Synthetic oligonucleotide
  Target: SCN10A; (+) strand; PAM type: YTN; PAM sequence: CTC
tagaccttgttgttaataat

SEQ ID NO: 65462 - DNA, 20 bp, Artificial Sequence
  Description of Artificial Sequence: Synthetic oligonucleotide
  Target: SCN10A; (+) strand; PAM type: YTN; PAM sequence: CTA
gaccttgttgttaataataa

SEQ ID NO: 65463 - DNA, 20 bp, Artificial Sequence
  Description of Artificial Sequence: Synthetic oligonucleotide
  Target: SCN10A; (+) strand; PAM type: YTN; PAM sequence: CTT
gttgttaataataagtacca

SEQ ID NO: 65464 - DNA, 20 bp, Artificial Sequence
  Description of Artificial Sequence: Synthetic oligonucleotide
  Target: SCN10A; (+) strand; PAM type: YTN; PAM sequence: TTG
ttgttaataataagtaccac

SEQ ID NO: 65465 - DNA, 20 bp, Artificial Sequence
  Description of Artificial Sequence: Synthetic oligonucleotide
  Target: SCN10A; (+) strand; PAM type: YTN; PAM sequence: TTG
ttaataataagtaccacctc

SEQ ID NO: 65466 - DNA, 20 bp, Artificial Sequence
  Description of Artificial Sequence: Synthetic oligonucleotide
  Target: SCN10A; (+) strand; PAM type: YTN; PAM sequence: TTA
ataataagtaccacctccaa

SEQ ID NO: 65467 - DNA, 20 bp, Artificial Sequence
  Description of Artificial Sequence: Synthetic oligonucleotide
  Target: SCN10A; (+) strand; PAM type: YTN; PAM sequence: CTC
caacattttgacttcagccc

SEQ ID NO: 65468 - DNA, 20 bp, Artificial Sequence
  Description of Artificial Sequence: Synthetic oligonucleotide
  Target: SCN10A; (+) strand; PAM type: YTN; PAM sequence: TTT
tgacttcagccctctctctg

SEQ ID NO: 65469 - DNA, 20 bp, Artificial Sequence
  Description of Artificial Sequence: Synthetic oligonucleotide
  Target: SCN10A; (+) strand; PAM type: YTN; PAM sequence: TTT
gacttcagccctctctctgt

SEQ ID NO: 65470 - DNA, 20 bp, Artificial Sequence
  Description of Artificial Sequence: Synthetic oligonucleotide
  Target: SCN10A; (+) strand; PAM type: YTN; PAM sequence: TTG
acttcagccctctctctgtc

SEQ ID NO: 65471 - DNA, 20 bp, Artificial Sequence
  Description of Artificial Sequence: Synthetic oligonucleotide
  Target: SCN10A; (+) strand; PAM type: YTN; PAM sequence: CTT
cagccctctctctgtctctg

SEQ ID NO: 65472 - DNA, 20 bp, Artificial Sequence
  Description of Artificial Sequence: Synthetic oligonucleotide
  Target: SCN10A; (+) strand; PAM type: YTN; PAM sequence: TTC
agccctctctctgtctctgg

SEQ ID NO: 65473 - DNA, 20 bp, Artificial Sequence
  Description of Artificial Sequence: Synthetic oligonucleotide
  Target: SCN10A; (+) strand; PAM type: YTN; PAM sequence: CTC
tctctgtctctggtattcat

SEQ ID NO: 65474 - DNA, 20 bp, Artificial Sequence
  Description of Artificial Sequence: Synthetic oligonucleotide
  Target: SCN10A; (+) strand; PAM type: YTN; PAM sequence: CTC
tctgtctctggtattcattt

SEQ ID NO: 65475 - DNA, 20 bp, Artificial Sequence
  Description of Artificial Sequence: Synthetic oligonucleotide
  Target: SCN10A; (+) strand; PAM type: YTN; PAM sequence: CTC
tgtctctggtattcatttcc

SEQ ID NO: 65476 - DNA, 20 bp, Artificial Sequence
  Description of Artificial Sequence: Synthetic oligonucleotide
  Target: SCN10A; (+) strand; PAM type: YTN; PAM sequence: CTG
tctctggtattcatttccta

SEQ ID NO: 65477 - DNA, 20 bp, Artificial Sequence
  Description of Artificial Sequence: Synthetic oligonucleotide
  Target: SCN10A; (+) strand; PAM type: YTN; PAM sequence: CTC
tggtattcatttcctatatt

SEQ ID NO: 65478 - DNA, 20 bp, Artificial Sequence
  Description of Artificial Sequence: Synthetic oligonucleotide
  Target: SCN10A; (+) strand; PAM type: YTN; PAM sequence: CTG
gtattcatttcctatatttt

SEQ ID NO: 65479 - DNA, 20 bp, Artificial Sequence
  Description of Artificial Sequence: Synthetic oligonucleotide
  Target: SCN10A; (+) strand; PAM type: YTN; PAM sequence: TTC
atttcctatattttgaactc

SEQ ID NO: 65480 - DNA, 20 bp, Artificial Sequence
  Description of Artificial Sequence: Synthetic oligonucleotide
  Target: SCN10A; (+) strand; PAM type: YTN; PAM sequence: TTT
cctatattttgaactccttt

SEQ ID NO: 65481 - DNA, 20 bp, Artificial Sequence
  Description of Artificial Sequence: Synthetic oligonucleotide
  Target: SCN10A; (+) strand; PAM type: YTN; PAM sequence: TTC
ctatattttgaactccttta

SEQ ID NO: 65482 - DNA, 20 bp, Artificial Sequence
  Description of Artificial Sequence: Synthetic oligonucleotide
  Target: SCN10A; (+) strand; PAM type: YTN; PAM sequence: CTA
tattttgaactcctttagtc

SEQ ID NO: 65483 - DNA, 20 bp, Artificial Sequence
  Description of Artificial Sequence: Synthetic oligonucleotide
  Target: SCN10A; (+) strand; PAM type: YTN; PAM sequence: TTT
tgaactcctttagtcctgca

SEQ ID NO: 65484 - DNA, 20 bp, Artificial Sequence
  Description of Artificial Sequence: Synthetic oligonucleotide
  Target: SCN10A; (+) strand; PAM type: YTN; PAM sequence: TTT
gaactcctttagtcctgcaa

SEQ ID NO: 65485 - DNA, 20 bp, Artificial Sequence
  Description of Artificial Sequence: Synthetic oligonucleotide
  Target: SCN10A; (+) strand; PAM type: YTN; PAM sequence: TTG
aactcctttagtcctgcaac

SEQ ID NO: 65486 - DNA, 20 bp, Artificial Sequence
  Description of Artificial Sequence: Synthetic oligonucleotide
  Target: SCN10A; (+) strand; PAM type: YTN; PAM sequence: CTC
ctttagtcctgcaactccaa

SEQ ID NO: 65487 - DNA, 20 bp, Artificial Sequence
  Description of Artificial Sequence: Synthetic oligonucleotide
  Target: SCN10A; (+) strand; PAM type: YTN; PAM sequence: CTT
tagtcctgcaactccaatta

SEQ ID NO: 65488 - DNA, 20 bp, Artificial Sequence
  Description of Artificial Sequence: Synthetic oligonucleotide
  Target: SCN10A; (+) strand; PAM type: YTN; PAM sequence: TTT
agtcctgcaactccaattaa

SEQ ID NO: 65489 - DNA, 20 bp, Artificial Sequence
  Description of Artificial Sequence: Synthetic oligonucleotide
  Target: SCN10A; (+) strand; PAM type: YTN; PAM sequence: TTA
gtcctgcaactccaattaat

SEQ ID NO: 65490 - DNA, 20 bp, Artificial Sequence
  Description of Artificial Sequence: Synthetic oligonucleotide
  Target: SCN10A; (+) strand; PAM type: YTN; PAM sequence: CTG
caactccaattaatatctgc

SEQ ID NO: 65491 - DNA, 20 bp, Artificial Sequence
  Description of Artificial Sequence: Synthetic oligonucleotide
  Target: SCN10A; (+) strand; PAM type: YTN; PAM sequence: CTC
caattaatatctgccccatc

SEQ ID NO: 65492 - DNA, 20 bp, Artificial Sequence
  Description of Artificial Sequence: Synthetic oligonucleotide
  Target: SCN10A; (+) strand; PAM type: YTN; PAM sequence: TTA
atatctgccccatccagtcc

SEQ ID NO: 65493 - DNA, 20 bp, Artificial Sequence
  Description of Artificial Sequence: Synthetic oligonucleotide
  Target: SCN10A; (+) strand; PAM type: YTN; PAM sequence: CTG
ccccatccagtcctttaaac

SEQ ID NO: 65494 - DNA, 20 bp, Artificial Sequence
  Description of Artificial Sequence: Synthetic oligonucleotide
  Target: SCN10A; (+) strand; PAM type: YTN; PAM sequence: CTT
taaactgctgacattacata

SEQ ID NO: 65495 - DNA, 20 bp, Artificial Sequence
  Description of Artificial Sequence: Synthetic oligonucleotide
  Target: SCN10A; (+) strand; PAM type: YTN; PAM sequence: TTT
aaactgctgacattacatat

SEQ ID NO: 65496 - DNA, 20 bp, Artificial Sequence
  Description of Artificial Sequence: Synthetic oligonucleotide
  Target: SCN10A; (+) strand; PAM type: YTN; PAM sequence: TTA
aactgctgacattacatatt

SEQ ID NO: 65497 - DNA, 20 bp, Artificial Sequence
  Description of Artificial Sequence: Synthetic oligonucleotide
  Target: SCN10A; (+) strand; PAM type: YTN; PAM sequence: CTG
ctgacattacatatttttac

SEQ ID NO: 65498 - DNA, 20 bp, Artificial Sequence
  Description of Artificial Sequence: Synthetic oligonucleotide
  Target: SCN10A; (+) strand; PAM type: YTN; PAM sequence: CTG
acattacatatttttactgc

SEQ ID NO: 65499 - DNA, 20 bp, Artificial Sequence
  Description of Artificial Sequence: Synthetic oligonucleotide
  Target: SCN10A; (+) strand; PAM type: YTN; PAM sequence: TTA
catatttttactgcccatca

SEQ ID NO: 65500 - DNA, 20 bp, Artificial Sequence
  Description of Artificial Sequence: Synthetic oligonucleotide
  Target: SCN10A; (+) strand; PAM type: YTN; PAM sequence: TTT
ttactgcccatcacctatat

SEQ ID NO: 65501 - DNA, 20 bp, Artificial Sequence
  Description of Artificial Sequence: Synthetic oligonucleotide
  Target: SCN10A; (+) strand; PAM type: YTN; PAM sequence: TTT
tactgcccatcacctatatc

SEQ ID NO: 65502 - DNA, 20 bp, Artificial Sequence
  Description of Artificial Sequence: Synthetic oligonucleotide
  Target: SCN10A; (+) strand; PAM type: YTN; PAM sequence: TTT
actgcccatcacctatatca

SEQ ID NO: 65503 - DNA, 20 bp, Artificial Sequence
  Description of Artificial Sequence: Synthetic oligonucleotide
  Target: SCN10A; (+) strand; PAM type: YTN; PAM sequence: TTA
ctgcccatcacctatatcat

SEQ ID NO: 65504 - DNA, 20 bp, Artificial Sequence
  Description of Artificial Sequence: Synthetic oligonucleotide
  Target: SCN10A; (+) strand; PAM type: YTN; PAM sequence: CTG
cccatcacctatatcatgtc

SEQ ID NO: 65505 - DNA, 20 bp, Artificial Sequence
  Description of Artificial Sequence: Synthetic oligonucleotide
  Target: SCN10A; (+) strand; PAM type: YTN; PAM sequence: CTA
tatcatgtccttacttctca

SEQ ID NO: 65506 - DNA, 20 bp, Artificial Sequence
  Description of Artificial Sequence: Synthetic oligonucleotide
  Target: SCN10A; (+) strand; PAM type: YTN; PAM sequence: CTT
acttctcaatttgcccagct

SEQ ID NO: 65507 - DNA, 20 bp, Artificial Sequence
  Description of Artificial Sequence: Synthetic oligonucleotide
  Target: SCN10A; (+) strand; PAM type: YTN; PAM sequence: TTA
cttctcaatttgcccagctt

SEQ ID NO: 65508 - DNA, 20 bp, Artificial Sequence
  Description of Artificial Sequence: Synthetic oligonucleotide
  Target: SCN10A; (+) strand; PAM type: YTN; PAM sequence: CTT
ctcaatttgcccagcttaga

SEQ ID NO: 65509 - DNA, 20 bp, Artificial Sequence
  Description of Artificial Sequence: Synthetic oligonucleotide
  Target: SCN10A; (+) strand; PAM type: YTN; PAM sequence: TTC
tcaatttgcccagcttagat

SEQ ID NO: 65510 - DNA, 20 bp, Artificial Sequence
  Description of Artificial Sequence: Synthetic oligonucleotide
  Target: SCN10A; (+) strand; PAM type: YTN; PAM sequence: CTC
aatttgcccagcttagattt

SEQ ID NO: 65511 - DNA, 20 bp, Artificial Sequence
  Description of Artificial Sequence: Synthetic oligonucleotide
  Target: SCN10A; (+) strand; PAM type: YTN; PAM sequence: TTT
gcccagcttagatttcacat

SEQ ID NO: 65512 - DNA, 20 bp, Artificial Sequence
  Description of Artificial Sequence: Synthetic oligonucleotide
  Target: SCN10A; (+) strand; PAM type: YTN; PAM sequence: TTG
cccagcttagatttcacatc

SEQ ID NO: 65513 - DNA, 20 bp, Artificial Sequence
  Description of Artificial Sequence: Synthetic oligonucleotide
  Target: SCN10A; (+) strand; PAM type: YTN; PAM sequence: CTT
agatttcacatccatctctc

SEQ ID NO: 65514 - DNA, 20 bp, Artificial Sequence
  Description of Artificial Sequence: Synthetic oligonucleotide
  Target: SCN10A; (+) strand; PAM type: YTN; PAM sequence: TTA
gatttcacatccatctctct

SEQ ID NO: 65515 - DNA, 20 bp, Artificial Sequence
  Description of Artificial Sequence: Synthetic oligonucleotide
  Target: SCN10A; (+) strand; PAM type: YTN; PAM sequence: TTT
cacatccatctctctaacta

SEQ ID NO: 65516 - DNA, 20 bp, Artificial Sequence
  Description of Artificial Sequence: Synthetic oligonucleotide
  Target: SCN10A; (+) strand; PAM type: YTN; PAM sequence: TTC
acatccatctctctaactac

SEQ ID NO: 65517 - DNA, 20 bp, Artificial Sequence
  Description of Artificial Sequence: Synthetic oligonucleotide
  Target: SCN10A; (+) strand; PAM type: YTN; PAM sequence: CTC
tctaactactcccttgtagg

SEQ ID NO: 65518 - DNA, 20 bp, Artificial Sequence
  Description of Artificial Sequence: Synthetic oligonucleotide
  Target: SCN10A; (+) strand; PAM type: YTN; PAM sequence: CTC
taactactcccttgtaggca

SEQ ID NO: 65519 - DNA, 20 bp, Artificial Sequence
  Description of Artificial Sequence: Synthetic oligonucleotide
  Target: SCN10A; (+) strand; PAM type: YTN; PAM sequence: CTA
actactcccttgtaggcacc

SEQ ID NO: 65520 - DNA, 20 bp, Artificial Sequence
  Description of Artificial Sequence: Synthetic oligonucleotide
  Target: SCN10A; (+) strand; PAM type: YTN; PAM sequence: CTA
ctcccttgtaggcaccctca

SEQ ID NO: 65521 - DNA, 20 bp, Artificial Sequence
  Description of Artificial Sequence: Synthetic oligonucleotide
  Target: SCN10A; (+) strand; PAM type: YTN; PAM sequence: CTC
ccttgtaggcaccctcaatt

SEQ ID NO: 65522 - DNA, 20 bp, Artificial Sequence
  Description of Artificial Sequence: Synthetic oligonucleotide
  Target: SCN10A; (+) strand; PAM type: YTN; PAM sequence: CTT
gtaggcaccctcaattcctt

SEQ ID NO: 65523 - DNA, 20 bp, Artificial Sequence
  Description of Artificial Sequence: Synthetic oligonucleotide
  Target: SCN10A; (+) strand; PAM type: YTN; PAM sequence: TTG
taggcaccctcaattccttt

SEQ ID NO: 65524 - DNA, 20 bp, Artificial Sequence
  Description of Artificial Sequence: Synthetic oligonucleotide
  Target: SCN10A; (+) strand; PAM type: YTN; PAM sequence: CTC
aattcctttgcccctctcct

SEQ ID NO: 65525 - DNA, 20 bp, Artificial Sequence
  Description of Artificial Sequence: Synthetic oligonucleotide
  Target: SCN10A; (+) strand; PAM type: YTN; PAM sequence: TTC
ctttgcccctctcctccttc

SEQ ID NO: 65526 - DNA, 20 bp, Artificial Sequence
  Description of Artificial Sequence: Synthetic oligonucleotide
  Target: SCN10A; (+) strand; PAM type: YTN; PAM sequence: CTT
tgcccctctcctccttcatt

SEQ ID NO: 65527 - DNA, 20 bp, Artificial Sequence
  Description of Artificial Sequence: Synthetic oligonucleotide
  Target: SCN10A; (+) strand; PAM type: YTN; PAM sequence: TTT
gcccctctcctccttcattg

SEQ ID NO: 65528 - DNA, 20 bp, Artificial Sequence
  Description of Artificial Sequence: Synthetic oligonucleotide
  Target: SCN10A; (+) strand; PAM type: YTN; PAM sequence: TTG
cccctctcctccttcattgt

SEQ ID NO: 65529 - DNA, 20 bp, Artificial Sequence
  Description of Artificial Sequence: Synthetic oligonucleotide
  Target: SCN10A; (+) strand; PAM type: YTN; PAM sequence: CTC
tcctccttcattgtacttgc

SEQ ID NO: 65530 - DNA, 20 bp, Artificial Sequence
  Description of Artificial Sequence: Synthetic oligonucleotide
  Target: SCN10A; (+) strand; PAM type: YTN; PAM sequence: CTC
ctccttcattgtacttgcct

SEQ ID NO: 65531 - DNA, 20 bp, Artificial Sequence
  Description of Artificial Sequence: Synthetic oligonucleotide
  Target: SCN10A; (+) strand; PAM type: YTN; PAM sequence: CTC
cttcattgtacttgcctggc

SEQ ID NO: 65532 - DNA, 20 bp, Artificial Sequence
  Description of Artificial Sequence: Synthetic oligonucleotide
  Target: SCN10A; (+) strand; PAM type: YTN; PAM sequence: CTT
cattgtacttgcctggcaaa

SEQ ID NO: 65533 - DNA, 20 bp, Artificial Sequence
  Description of Artificial Sequence: Synthetic oligonucleotide
  Target: SCN10A; (+) strand; PAM type: YTN; PAM sequence: TTC
attgtacttgcctggcaaaa

SEQ ID NO: 65534 - DNA, 20 bp, Artificial Sequence
  Description of Artificial Sequence: Synthetic oligonucleotide
  Target: SCN10A; (+) strand; PAM type: YTN; PAM sequence: TTG
tacttgcctggcaaaacctg

SEQ ID NO: 65535 - DNA, 20 bp, Artificial Sequence
  Description of Artificial Sequence: Synthetic oligonucleotide
  Target: SCN10A; (+) strand; PAM type: YTN; PAM sequence: CTT
gcctggcaaaacctgaactg

SEQ ID NO: 65536 - DNA, 20 bp, Artificial Sequence
  Description of Artificial Sequence: Synthetic oligonucleotide
  Target: SCN10A; (+) strand; PAM type: YTN; PAM sequence: TTG
cctggcaaaacctgaactgt

SEQ ID NO: 65537 - DNA, 20 bp, Artificial Sequence
  Description of Artificial Sequence: Synthetic oligonucleotide
  Target: SCN10A; (+) strand; PAM type: YTN; PAM sequence: CTG
gcaaaacctgaactgtgaat

SEQ ID NO: 65538 - DNA, 20 bp, Artificial Sequence
  Description of Artificial Sequence: Synthetic oligonucleotide
  Target: SCN10A; (+) strand; PAM type: YTN; PAM sequence: CTG
aactgtgaatagacccaatt

SEQ ID NO: 65539 - DNA, 20 bp, Artificial Sequence
  Description of Artificial Sequence: Synthetic oligonucleotide
  Target: SCN10A; (+) strand; PAM type: YTN; PAM sequence: CTG
tgaatagacccaatttgtag

SEQ ID NO: 65540 - DNA, 20 bp, Artificial Sequence
  Description of Artificial Sequence: Synthetic oligonucleotide
  Target: SCN10A; (+) strand; PAM type: YTN; PAM sequence: TTT
gtagactactctgtacttgc

SEQ ID NO: 65541 - DNA, 20 bp, Artificial Sequence
  Description of Artificial Sequence: Synthetic oligonucleotide
  Target: SCN10A; (+) strand; PAM type: YTN; PAM sequence: TTG
tagactactctgtacttgca

SEQ ID NO: 65542 - DNA, 20 bp, Artificial Sequence
  Description of Artificial Sequence: Synthetic oligonucleotide
  Target: SCN10A; (+) strand; PAM type: YTN; PAM sequence: CTA
ctctgtacttgcacccaacc

SEQ ID NO: 65543 - DNA, 20 bp, Artificial Sequence
  Description of Artificial Sequence: Synthetic oligonucleotide
  Target: SCN10A; (+) strand; PAM type: YTN; PAM sequence: CTC
tgtacttgcacccaaccagc

SEQ ID NO: 65544 - DNA, 20 bp, Artificial Sequence
  Description of Artificial Sequence: Synthetic oligonucleotide
  Target: SCN10A; (+) strand; PAM type: YTN; PAM sequence: CTG
tacttgcacccaaccagctg

SEQ ID NO: 65545 - DNA, 20 bp, Artificial Sequence
  Description of Artificial Sequence: Synthetic oligonucleotide
  Target: SCN10A; (+) strand; PAM type: YTN; PAM sequence: CTT
gcacccaaccagctggacct

SEQ ID NO: 65546 - DNA, 20 bp, Artificial Sequence
  Description of Artificial Sequence: Synthetic oligonucleotide
  Target: SCN10A; (+) strand; PAM type: YTN; PAM sequence: TTG
cacccaaccagctggacctg

SEQ ID NO: 65547 - DNA, 20 bp, Artificial Sequence
  Description of Artificial Sequence: Synthetic oligonucleotide
  Target: SCN10A; (+) strand; PAM type: YTN; PAM sequence: CTG
gacctggctggaaaaaatac

SEQ ID NO: 65548 - DNA, 20 bp, Artificial Sequence
  Description of Artificial Sequence: Synthetic oligonucleotide
  Target: SCN10A; (+) strand; PAM type: YTN; PAM sequence: CTG
gctggaaaaaatacacaact

SEQ ID NO: 65549 - DNA, 20 bp, Artificial Sequence
  Description of Artificial Sequence: Synthetic oligonucleotide
  Target: SCN10A; (+) strand; PAM type: YTN; PAM sequence: CTG
gaaaaaatacacaactatgc

SEQ ID NO: 65550 - DNA, 20 bp, Artificial Sequence
  Description of Artificial Sequence: Synthetic oligonucleotide
  Target: SCN10A; (+) strand; PAM type: YTN; PAM sequence: CTA
tgcttaccaaccctcctaga

SEQ ID NO: 65551 - DNA, 20 bp, Artificial Sequence
  Description of Artificial Sequence: Synthetic oligonucleotide
  Target: SCN10A; (+) strand; PAM type: YTN; PAM sequence: CTT
accaaccctcctagagatct

SEQ ID NO: 65552 - DNA, 20 bp, Artificial Sequence
  Description of Artificial Sequence: Synthetic oligonucleotide
  Target: SCN10A; (+) strand; PAM type: YTN; PAM sequence: TTA
ccaaccctcctagagatctg

SEQ ID NO: 65553 - DNA, 20 bp, Artificial Sequence
  Description of Artificial Sequence: Synthetic oligonucleotide
  Target: SCN10A; (+) strand; PAM type: YTN; PAM sequence: CTC
ctagagatctgtgagcccca

SEQ ID NO: 65554 - DNA, 20 bp, Artificial Sequence
  Description of Artificial Sequence: Synthetic oligonucleotide
  Target: SCN10A; (+) strand; PAM type: YTN; PAM sequence: CTA
gagatctgtgagccccagcc

SEQ ID NO: 65555 - DNA, 20 bp, Artificial Sequence
  Description of Artificial Sequence: Synthetic oligonucleotide
  Target: SCN10A; (+) strand; PAM type: YTN; PAM sequence: CTG
tgagccccagccttgccctg

SEQ ID NO: 65556 - DNA, 20 bp, Artificial Sequence
  Description of Artificial Sequence: Synthetic oligonucleotide
  Target: SCN10A; (+) strand; PAM type: YTN; PAM sequence: CTT
gccctgcccagaaatctggc

SEQ ID NO: 65557 - DNA, 20 bp, Artificial Sequence
  Description of Artificial Sequence: Synthetic oligonucleotide
  Target: SCN10A; (+) strand; PAM type: YTN; PAM sequence: TTG
ccctgcccagaaatctggct

SEQ ID NO: 65558 - DNA, 20 bp, Artificial Sequence
  Description of Artificial Sequence: Synthetic oligonucleotide
  Target: SCN10A; (+) strand; PAM type: YTN; PAM sequence: CTG
cccagaaatctggctgtgtt

SEQ ID NO: 65559 - DNA, 20 bp, Artificial Sequence
  Description of Artificial Sequence: Synthetic oligonucleotide
  Target: SCN10A; (+) strand; PAM type: YTN; PAM sequence: CTG
gctgtgtttctatattatat

SEQ ID NO: 65560 - DNA, 20 bp, Artificial Sequence
  Description of Artificial Sequence: Synthetic oligonucleotide
  Target: SCN10A; (+) strand; PAM type: YTN; PAM sequence: CTG
tgtttctatattatattcca

SEQ ID NO: 65561 - DNA, 20 bp, Artificial Sequence
  Description of Artificial Sequence: Synthetic oligonucleotide
  Target: SCN10A; (+) strand; PAM type: YTN; PAM sequence: TTT
ctatattatattccattcct

SEQ ID NO: 65562 - DNA, 20 bp, Artificial Sequence
  Description of Artificial Sequence: Synthetic oligonucleotide
  Target: SCN10A; (+) strand; PAM type: YTN; PAM sequence: TTC
tatattatattccattcctt

SEQ ID NO: 65563 - DNA, 20 bp, Artificial Sequence
  Description of Artificial Sequence: Synthetic oligonucleotide
  Target: SCN10A; (+) strand; PAM type: YTN; PAM sequence: CTA
tattatattccattccttca

SEQ ID NO: 65564 - DNA, 20 bp, Artificial Sequence
  Description of Artificial Sequence: Synthetic oligonucleotide
  Target: SCN10A; (+) strand; PAM type: YTN; PAM sequence: TTA
tattccattccttcattctt

SEQ ID NO: 65565 - DNA, 20 bp, Artificial Sequence
  Description of Artificial Sequence: Synthetic oligonucleotide
  Target: SCN10A; (+) strand; PAM type: YTN; PAM sequence: TTC
cattccttcattcttccaga

SEQ ID NO: 65566 - DNA, 20 bp, Artificial Sequence
  Description of Artificial Sequence: Synthetic oligonucleotide
  Target: SCN10A; (+) strand; PAM type: YTN; PAM sequence: TTC
cttcattcttccagatgact

SEQ ID NO: 65567 - DNA, 20 bp, Artificial Sequence
  Description of Artificial Sequence: Synthetic oligonucleotide
  Target: SCN10A; (+) strand; PAM type: YTN; PAM sequence: CTT
cattcttccagatgactgtt

SEQ ID NO: 65568 - DNA, 20 bp, Artificial Sequence
  Description of Artificial Sequence: Synthetic oligonucleotide
  Target: SCN10A; (+) strand; PAM type: YTN; PAM sequence: TTC
attcttccagatgactgttt

SEQ ID NO: 65569 - DNA, 20 bp, Artificial Sequence
  Description of Artificial Sequence: Synthetic oligonucleotide
  Target: SCN10A; (+) strand; PAM type: YTN; PAM sequence: TTC
ttccagatgactgtttctca

SEQ ID NO: 65570 - DNA, 20 bp, Artificial Sequence
  Description of Artificial Sequence: Synthetic oligonucleotide
  Target: SCN10A; (+) strand; PAM type: YTN; PAM sequence: CTT
ccagatgactgtttctcact

SEQ ID NO: 65571 - DNA, 20 bp, Artificial Sequence
  Description of Artificial Sequence: Synthetic oligonucleotide
  Target: SCN10A; (+) strand; PAM type: YTN; PAM sequence: TTC
cagatgactgtttctcactt

SEQ ID NO: 65572 - DNA, 20 bp, Artificial Sequence
  Description of Artificial Sequence: Synthetic oligonucleotide
  Target: SCN10A; (+) strand; PAM type: YTN; PAM sequence: CTG
tttctcacttcctcttcccc

SEQ ID NO: 65573 - DNA, 20 bp, Artificial Sequence
  Description of Artificial Sequence: Synthetic oligonucleotide
  Target: SCN10A; (+) strand; PAM type: YTN; PAM sequence: TTT
ctcacttcctcttcccccgt

SEQ ID NO: 65574 - DNA, 20 bp, Artificial Sequence
  Description of Artificial Sequence: Synthetic oligonucleotide
  Target: SCN10A; (+) strand; PAM type: YTN; PAM sequence: TTC
tcacttcctcttcccccgtc

SEQ ID NO: 65575 - DNA, 20 bp, Artificial Sequence
  Description of Artificial Sequence: Synthetic oligonucleotide
  Target: SCN10A; (+) strand; PAM type: YTN; PAM sequence: CTC
acttcctcttcccccgtcta

SEQ ID NO: 65576 - DNA, 20 bp, Artificial Sequence
  Description of Artificial Sequence: Synthetic oligonucleotide
  Target: SCN10A; (+) strand; PAM type: YTN; PAM sequence: CTT
cctcttcccccgtctaacct

SEQ ID NO: 65577 - DNA, 20 bp, Artificial Sequence
  Description of Artificial Sequence: Synthetic oligonucleotide
  Target: SCN10A; (+) strand; PAM type: YTN; PAM sequence: TTC
ctcttcccccgtctaacctc

SEQ ID NO: 65578 - DNA, 20 bp, Artificial Sequence
  Description of Artificial Sequence: Synthetic oligonucleotide
  Target: SCN10A; (+) strand; PAM type: YTN; PAM sequence: CTC
ttcccccgtctaacctccgg

SEQ ID NO: 65579 - DNA, 20 bp, Artificial Sequence
  Description of Artificial Sequence: Synthetic oligonucleotide
  Target: SCN10A; (+) strand; PAM type: YTN; PAM sequence: CTT
cccccgtctaacctccggct

SEQ ID NO: 65580 - DNA, 20 bp, Artificial Sequence
  Description of Artificial Sequence: Synthetic oligonucleotide
  Target: SCN10A; (+) strand; PAM type: YTN; PAM sequence: TTC
ccccgtctaacctccggctc

SEQ ID NO: 65581 - DNA, 20 bp, Artificial Sequence
  Description of Artificial Sequence: Synthetic oligonucleotide
  Target: SCN10A; (+) strand; PAM type: YTN; PAM sequence: CTA
acctccggctcttctttcta

SEQ ID NO: 65582 - DNA, 20 bp, Artificial Sequence
  Description of Artificial Sequence: Synthetic oligonucleotide
  Target: SCN10A; (+) strand; PAM type: YTN; PAM sequence: CTC
cggctcttctttctacttac

SEQ ID NO: 65583 - DNA, 20 bp, Artificial Sequence
  Description of Artificial Sequence: Synthetic oligonucleotide
  Target: SCN10A; (+) strand; PAM type: YTN; PAM sequence: CTC
ttctttctacttactctctg

SEQ ID NO: 65584 - DNA, 20 bp, Artificial Sequence
  Description of Artificial Sequence: Synthetic oligonucleotide
  Target: SCN10A; (+) strand; PAM type: YTN; PAM sequence: CTT
ctttctacttactctctgtt

SEQ ID NO: 65585 - DNA, 20 bp, Artificial Sequence
  Description of Artificial Sequence: Synthetic oligonucleotide
  Target: SCN10A; (+) strand; PAM type: YTN; PAM sequence: TTC
tttctacttactctctgttg

SEQ ID NO: 65586 - DNA, 20 bp, Artificial Sequence
  Description of Artificial Sequence: Synthetic oligonucleotide
  Target: SCN10A; (+) strand; PAM type: YTN; PAM sequence: CTT
tctacttactctctgttgat

SEQ ID NO: 65587 - DNA, 20 bp, Artificial Sequence
  Description of Artificial Sequence: Synthetic oligonucleotide
  Target: SCN10A; (+) strand; PAM type: YTN; PAM sequence: TTT
ctacttactctctgttgatg

SEQ ID NO: 65588 - DNA, 20 bp, Artificial Sequence
  Description of Artificial Sequence: Synthetic oligonucleotide
  Target: SCN10A; (+) strand; PAM type: YTN; PAM sequence: TTC
tacttactctctgttgatga

SEQ ID NO: 65589 - DNA, 20 bp, Artificial Sequence
  Description of Artificial Sequence: Synthetic oligonucleotide
  Target: SCN10A; (+) strand; PAM type: YTN; PAM sequence: CTA
cttactctctgttgatgagc

SEQ ID NO: 65590 - DNA, 20 bp, Artificial Sequence
  Description of Artificial Sequence: Synthetic oligonucleotide
  Target: SCN10A; (+) strand; PAM type: YTN; PAM sequence: CTT
actctctgttgatgagctcc

SEQ ID NO: 65591 - DNA, 20 bp, Artificial Sequence
  Description of Artificial Sequence: Synthetic oligonucleotide
  Target: SCN10A; (+) strand; PAM type: YTN; PAM sequence: TTA
ctctctgttgatgagctccc

SEQ ID NO: 65592 - DNA, 20 bp, Artificial Sequence
  Description of Artificial Sequence: Synthetic oligonucleotide
  Target: SCN10A; (+) strand; PAM type: YTN; PAM sequence: CTC
tctgttgatgagctcccttt

SEQ ID NO: 65593 - DNA, 20 bp, Artificial Sequence
  Description of Artificial Sequence: Synthetic oligonucleotide
  Target: SCN10A; (+) strand; PAM type: YTN; PAM sequence: CTC
tgttgatgagctccctttta

SEQ ID NO: 65594 - DNA, 20 bp, Artificial Sequence
  Description of Artificial Sequence: Synthetic oligonucleotide
  Target: SCN10A; (+) strand; PAM type: YTN; PAM sequence: CTG
ttgatgagctcccttttatt

SEQ ID NO: 65595 - DNA, 20 bp, Artificial Sequence
  Description of Artificial Sequence: Synthetic oligonucleotide
  Target: SCN10A; (+) strand; PAM type: YTN; PAM sequence: TTG
atgagctcccttttatttca

SEQ ID NO: 65596 - DNA, 20 bp, Artificial Sequence
  Description of Artificial Sequence: Synthetic oligonucleotide
  Target: SCN10A; (+) strand; PAM type: YTN; PAM sequence: CTC
ccttttatttcactcagaat

SEQ ID NO: 65597 - DNA, 20 bp, Artificial Sequence
  Description of Artificial Sequence: Synthetic oligonucleotide
  Target: SCN10A; (+) strand; PAM type: YTN; PAM sequence: CTT
ttatttcactcagaatatag

SEQ ID NO: 65598 - DNA, 20 bp, Artificial Sequence
  Description of Artificial Sequence: Synthetic oligonucleotide
  Target: SCN10A; (+) strand; PAM type: YTN; PAM sequence: TTT
tatttcactcagaatataga

SEQ ID NO: 65599 - DNA, 20 bp, Artificial Sequence
  Description of Artificial Sequence: Synthetic oligonucleotide
  Target: SCN10A; (+) strand; PAM type: YTN; PAM sequence: TTT
atttcactcagaatatagac

SEQ ID NO: 65600 - DNA, 20 bp, Artificial Sequence
  Description of Artificial Sequence: Synthetic oligonucleotide
  Target: SCN10A; (+) strand; PAM type: YTN; PAM sequence: TTA
tttcactcagaatatagact

SEQ ID NO: 65601 - DNA, 20 bp, Artificial Sequence
  Description of Artificial Sequence: Synthetic oligonucleotide
  Target: SCN10A; (+) strand; PAM type: YTN; PAM sequence: TTT
cactcagaatatagactagt

SEQ ID NO: 65602 - DNA, 20 bp, Artificial Sequence
  Description of Artificial Sequence: Synthetic oligonucleotide
  Target: SCN10A; (+) strand; PAM type: YTN; PAM sequence: TTC
actcagaatatagactagtt

SEQ ID NO: 65603 - DNA, 20 bp, Artificial Sequence
  Description of Artificial Sequence: Synthetic oligonucleotide
  Target: SCN10A; (+) strand; PAM type: YTN; PAM sequence: CTC
agaatatagactagttcaca

SEQ ID NO: 65604 - DNA, 20 bp, Artificial Sequence
  Description of Artificial Sequence: Synthetic oligonucleotide
  Target: SCN10A; (+) strand; PAM type: YTN; PAM sequence: CTA
gttcacaaaagaacttcccc

SEQ ID NO: 65605 - DNA, 20 bp, Artificial Sequence
  Description of Artificial Sequence: Synthetic oligonucleotide
  Target: SCN10A; (+) strand; PAM type: YTN; PAM sequence: TTC
acaaaagaacttccccttct

SEQ ID NO: 65606 - DNA, 20 bp, Artificial Sequence
  Description of Artificial Sequence: Synthetic oligonucleotide
  Target: SCN10A; (+) strand; PAM type: YTN; PAM sequence: CTT
ccccttcttcctaccactaa

SEQ ID NO: 65607 - DNA, 20 bp, Artificial Sequence
  Description of Artificial Sequence: Synthetic oligonucleotide
  Target: SCN10A; (+) strand; PAM type: YTN; PAM sequence: TTC
cccttcttcctaccactaaa

SEQ ID NO: 65608 - DNA, 20 bp, Artificial Sequence
  Description of Artificial Sequence: Synthetic oligonucleotide
  Target: SCN10A; (+) strand; PAM type: YTN; PAM sequence: CTT
cttcctaccactaaatctct

SEQ ID NO: 65609 - DNA, 20 bp, Artificial Sequence
  Description of Artificial Sequence: Synthetic oligonucleotide
  Target: SCN10A; (+) strand; PAM type: YTN; PAM sequence: TTC
ttcctaccactaaatctctg

SEQ ID NO: 65610 - DNA, 20 bp, Artificial Sequence
  Description of Artificial Sequence: Synthetic oligonucleotide
  Target: SCN10A; (+) strand; PAM type: YTN; PAM sequence: CTT
cctaccactaaatctctggc

SEQ ID NO: 65611 - DNA, 20 bp, Artificial Sequence
  Description of Artificial Sequence: Synthetic oligonucleotide
  Target: SCN10A; (+) strand; PAM type: YTN; PAM sequence: TTC
ctaccactaaatctctggca

SEQ ID NO: 65612 - DNA, 20 bp, Artificial Sequence
  Description of Artificial Sequence: Synthetic oligonucleotide
  Target: SCN10A; (+) strand; PAM type: YTN; PAM sequence: CTA
ccactaaatctctggcatat

SEQ ID NO: 65613 - DNA, 20 bp, Artificial Sequence
  Description of Artificial Sequence: Synthetic oligonucleotide
  Target: SCN10A; (+) strand; PAM type: YTN; PAM sequence: CTA
aatctctggcatatctgcaa

SEQ ID NO: 65614 - DNA, 20 bp, Artificial Sequence
  Description of Artificial Sequence: Synthetic oligonucleotide
  Target: SCN10A; (+) strand; PAM type: YTN; PAM sequence: CTC
tggcatatctgcaagtccac

SEQ ID NO: 65615 - DNA, 20 bp, Artificial Sequence
  Description of Artificial Sequence: Synthetic oligonucleotide
  Target: SCN10A; (+) strand; PAM type: YTN; PAM sequence: CTG
gcatatctgcaagtccacct

SEQ ID NO: 65616 - DNA, 20 bp, Artificial Sequence
  Description of Artificial Sequence: Synthetic oligonucleotide
  Target: SCN10A; (+) strand; PAM type: YTN; PAM sequence: CTG
caagtccacctggtattctg

SEQ ID NO: 65617 - DNA, 20 bp, Artificial Sequence
  Description of Artificial Sequence: Synthetic oligonucleotide
  Target: SCN10A; (+) strand; PAM type: YTN; PAM sequence: CTG
gtattctgtcttcgtgcccc

SEQ ID NO: 65618 - DNA, 20 bp, Artificial Sequence
  Description of Artificial Sequence: Synthetic oligonucleotide
  Target: SCN10A; (+) strand; PAM type: YTN; PAM sequence: TTC
tgtcttcgtgccccacacag

SEQ ID NO: 65619 - DNA, 20 bp, Artificial Sequence
  Description of Artificial Sequence: Synthetic oligonucleotide
  Target: SCN10A; (+) strand; PAM type: YTN; PAM sequence: CTG
tcttcgtgccccacacagtg

SEQ ID NO: 65620 - DNA, 20 bp, Artificial Sequence
  Description of Artificial Sequence: Synthetic oligonucleotide
  Target: SCN10A; (+) strand; PAM type: YTN; PAM sequence: CTT
cgtgccccacacagtgcgtg

SEQ ID NO: 65621 - DNA, 20 bp, Artificial Sequence
  Description of Artificial Sequence: Synthetic oligonucleotide
  Target: SCN10A; (+) strand; PAM type: YTN; PAM sequence: TTC
gtgccccacacagtgcgtgg

SEQ ID NO: 65622 - DNA, 20 bp, Artificial Sequence
  Description of Artificial Sequence: Synthetic oligonucleotide
  Target: SCN10A; (+) strand; PAM type: YTN; PAM sequence: CTC
tacccctcccacttgtgccg

SEQ ID NO: 65623 - DNA, 20 bp, Artificial Sequence
  Description of Artificial Sequence: Synthetic oligonucleotide
  Target: SCN10A; (+) strand; PAM type: YTN; PAM sequence: CTA
cccctcccacttgtgccggg

SEQ ID NO: 65624 - DNA, 20 bp, Artificial Sequence
  Description of Artificial Sequence: Synthetic oligonucleotide
  Target: SCN10A; (+) strand; PAM type: YTN; PAM sequence: CTC
ccacttgtgccgggctcttt

SEQ ID NO: 65625 - DNA, 20 bp, Artificial Sequence
  Description of Artificial Sequence: Synthetic oligonucleotide
  Target: SCN10A; (+) strand; PAM type: YTN; PAM sequence: CTT
gtgccgggctctttcctctc

SEQ ID NO: 65626 - DNA, 20 bp, Artificial Sequence
  Description of Artificial Sequence: Synthetic oligonucleotide
  Target: SCN10A; (+) strand; PAM type: YTN; PAM sequence: TTG
tgccgggctctttcctctcc

SEQ ID NO: 65627 - DNA, 20 bp, Artificial Sequence
  Description of Artificial Sequence: Synthetic oligonucleotide
  Target: SCN10A; (+) strand; PAM type: YTN; PAM sequence: CTC
tttcctctcccacctattca

SEQ ID NO: 65628 - DNA, 20 bp, Artificial Sequence
  Description of Artificial Sequence: Synthetic oligonucleotide
  Target: SCN10A; (+) strand; PAM type: YTN; PAM sequence: CTT
tcctctcccacctattcaag

SEQ ID NO: 65629 - DNA, 20 bp, Artificial Sequence
  Description of Artificial Sequence: Synthetic oligonucleotide
  Target: SCN10A; (+) strand; PAM type: YTN; PAM sequence: TTT
cctctcccacctattcaagg

SEQ ID NO: 65630 - DNA, 20 bp, Artificial Sequence
  Description of Artificial Sequence: Synthetic oligonucleotide
  Target: SCN10A; (+) strand; PAM type: YTN; PAM sequence: TTC
ctctcccacctattcaaggc

SEQ ID NO: 65631 - DNA, 20 bp, Artificial Sequence
  Description of Artificial Sequence: Synthetic oligonucleotide
  Target: SCN10A; (+) strand; PAM type: YTN; PAM sequence: CTC
tcccacctattcaaggcctg

SEQ ID NO: 65632 - DNA, 20 bp, Artificial Sequence
  Description of Artificial Sequence: Synthetic oligonucleotide
  Target: SCN10A; (+) strand; PAM type: YTN; PAM sequence: CTC
ccacctattcaaggcctgca

SEQ ID NO: 65633 - DNA, 20 bp, Artificial Sequence
  Description of Artificial Sequence: Synthetic oligonucleotide
  Target: SCN10A; (+) strand; PAM type: YTN; PAM sequence: CTA
ttcaaggcctgcatcatcca

SEQ ID NO: 65634 - DNA, 20 bp, Artificial Sequence
  Description of Artificial Sequence: Synthetic oligonucleotide
  Target: SCN10A; (+) strand; PAM type: YTN; PAM sequence: TTC
aaggcctgcatcatccagac

SEQ ID NO: 65635 - DNA, 20 bp, Artificial Sequence
  Description of Artificial Sequence: Synthetic oligonucleotide
  Target: SCN10A; (+) strand; PAM type: YTN; PAM sequence: CTG
catcatccagacctgtctcc

SEQ ID NO: 65636 - DNA, 20 bp, Artificial Sequence
  Description of Artificial Sequence: Synthetic oligonucleotide
  Target: SCN10A; (+) strand; PAM type: YTN; PAM sequence: CTG
tctcccttccagaccattgc

SEQ ID NO: 65637 - DNA, 20 bp, Artificial Sequence
  Description of Artificial Sequence: Synthetic oligonucleotide
  Target: SCN10A; (+) strand; PAM type: YTN; PAM sequence: CTC
ccttccagaccattgccatg

SEQ ID NO: 65638 - DNA, 20 bp, Artificial Sequence
  Description of Artificial Sequence: Synthetic oligonucleotide
  Target: SCN10A; (+) strand; PAM type: YTN; PAM sequence: CTT
ccagaccattgccatgagca

SEQ ID NO: 65639 - DNA, 20 bp, Artificial Sequence
  Description of Artificial Sequence: Synthetic oligonucleotide
  Target: SCN10A; (+) strand; PAM type: YTN; PAM sequence: TTC
cagaccattgccatgagcag

SEQ ID NO: 65640 - DNA, 20 bp, Artificial Sequence
  Description of Artificial Sequence: Synthetic oligonucleotide
  Target: SCN10A; (+) strand; PAM type: YTN; PAM sequence: TTG
ccatgagcaggtaaacatgc

SEQ ID NO: 65641 - DNA, 20 bp, Artificial Sequence
  Description of Artificial Sequence: Synthetic oligonucleotide
  Target: SCN10A; (+) strand; PAM type: YTN; PAM sequence: CTT
taattatctcgcggctttga

SEQ ID NO: 65642 - DNA, 20 bp, Artificial Sequence
  Description of Artificial Sequence: Synthetic oligonucleotide
  Target: SCN10A; (+) strand; PAM type: YTN; PAM sequence: TTT
aattatctcgcggctttgaa

SEQ ID NO: 65643 - DNA, 20 bp, Artificial Sequence
  Description of Artificial Sequence: Synthetic oligonucleotide
  Target: SCN10A; (+) strand; PAM type: YTN; PAM sequence: TTA
attatctcgcggctttgaaa

SEQ ID NO: 65644 - DNA, 20 bp, Artificial Sequence
  Description of Artificial Sequence: Synthetic oligonucleotide
  Target: SCN10A; (+) strand; PAM type: YTN; PAM sequence: TTA
tctcgcggctttgaaaaagt

SEQ ID NO: 65645 - DNA, 20 bp, Artificial Sequence
  Description of Artificial Sequence: Synthetic oligonucleotide
  Target: SCN10A; (+) strand; PAM type: YTN; PAM sequence: CTC
gcggctttgaaaaagtctct

SEQ ID NO: 65646 - DNA, 20 bp, Artificial Sequence
  Description of Artificial Sequence: Synthetic oligonucleotide
  Target: SCN10A; (+) strand; PAM type: YTN; PAM sequence: CTT
tgaaaaagtctctctggacc

SEQ ID NO: 65647 - DNA, 20 bp, Artificial Sequence
  Description of Artificial Sequence: Synthetic oligonucleotide
  Target: SCN10A; (+) strand; PAM type: YTN; PAM sequence: TTT
gaaaaagtctctctggaccc

SEQ ID NO: 65648 - DNA, 20 bp, Artificial Sequence
  Description of Artificial Sequence: Synthetic oligonucleotide
  Target: SCN10A; (+) strand; PAM type: YTN; PAM sequence: TTG
aaaaagtctctctggacccc

SEQ ID NO: 65649 - DNA, 20 bp, Artificial Sequence
  Description of Artificial Sequence: Synthetic oligonucleotide
  Target: SCN10A; (+) strand; PAM type: YTN; PAM sequence: CTC
tctggaccccatgctctctt

SEQ ID NO: 65650 - DNA, 20 bp, Artificial Sequence
  Description of Artificial Sequence: Synthetic oligonucleotide
  Target: SCN10A; (+) strand; PAM type: YTN; PAM sequence: CTC
tggaccccatgctctctttc

SEQ ID NO: 65651 - DNA, 20 bp, Artificial Sequence
  Description of Artificial Sequence: Synthetic oligonucleotide
  Target: SCN10A; (+) strand; PAM type: YTN; PAM sequence: CTG
gaccccatgctctctttcat

SEQ ID NO: 65652 - DNA, 20 bp, Artificial Sequence
  Description of Artificial Sequence: Synthetic oligonucleotide
  Target: SCN10A; (+) strand; PAM type: YTN; PAM sequence: CTC
tctttcattactgcttcttt

SEQ ID NO: 65653 - DNA, 20 bp, Artificial Sequence
  Description of Artificial Sequence: Synthetic oligonucleotide
  Target: SCN10A; (+) strand; PAM type: YTN; PAM sequence: CTC
tttcattactgcttctttga

SEQ ID NO: 65654 - DNA, 20 bp, Artificial Sequence
  Description of Artificial Sequence: Synthetic oligonucleotide
  Target: SCN10A; (+) strand; PAM type: YTN; PAM sequence: CTT
tcattactgcttctttgaca

SEQ ID NO: 65655 - DNA, 20 bp, Artificial Sequence
  Description of Artificial Sequence: Synthetic oligonucleotide
  Target: SCN10A; (+) strand; PAM type: YTN; PAM sequence: TTT
cattactgcttctttgacag

SEQ ID NO: 65656 - DNA, 20 bp, Artificial Sequence
  Description of Artificial Sequence: Synthetic oligonucleotide
  Target: SCN10A; (+) strand; PAM type: YTN; PAM sequence: TTC
attactgcttctttgacagt

SEQ ID NO: 65657 - DNA, 20 bp, Artificial Sequence
  Description of Artificial Sequence: Synthetic oligonucleotide
  Target: SCN10A; (+) strand; PAM type: YTN; PAM sequence: TTA
ctgcttctttgacagtaaaa

SEQ ID NO: 65658 - DNA, 20 bp, Artificial Sequence
  Description of Artificial Sequence: Synthetic oligonucleotide
  Target: SCN10A; (+) strand; PAM type: YTN; PAM sequence: CTG
cttctttgacagtaaaattc

SEQ ID NO: 65659 - DNA, 20 bp, Artificial Sequence
  Description of Artificial Sequence: Synthetic oligonucleotide
  Target: SCN10A; (+) strand; PAM type: YTN; PAM sequence: CTT
ctttgacagtaaaattcctt

SEQ ID NO: 65660 - DNA, 20 bp, Artificial Sequence
  Description of Artificial Sequence: Synthetic oligonucleotide
  Target: SCN10A; (+) strand; PAM type: YTN; PAM sequence: TTC
tttgacagtaaaattccttg

SEQ ID NO: 65661 - DNA, 20 bp, Artificial Sequence
  Description of Artificial Sequence: Synthetic oligonucleotide
  Target: SCN10A; (+) strand; PAM type: YTN; PAM sequence: CTT
tgacagtaaaattccttgca

SEQ ID NO: 65662 - DNA, 20 bp, Artificial Sequence
  Description of Artificial Sequence: Synthetic oligonucleotide
  Target: SCN10A; (+) strand; PAM type: YTN; PAM sequence: TTT
gacagtaaaattccttgcaa

SEQ ID NO: 65663 - DNA, 20 bp, Artificial Sequence
  Description of Artificial Sequence: Synthetic oligonucleotide
  Target: SCN10A; (+) strand; PAM type: YTN; PAM sequence: TTG
acagtaaaattccttgcaag

SEQ ID NO: 65664 - DNA, 20 bp, Artificial Sequence
  Description of Artificial Sequence: Synthetic oligonucleotide
  Target: SCN10A; (+) strand; PAM type: YTN; PAM sequence: TTC
cttgcaagagttttctacac

SEQ ID NO: 65665 - DNA, 20 bp, Artificial Sequence
  Description of Artificial Sequence: Synthetic oligonucleotide
  Target: SCN10A; (+) strand; PAM type: YTN; PAM sequence: CTT
gcaagagttttctacactta

SEQ ID NO: 65666 - DNA, 20 bp, Artificial Sequence
  Description of Artificial Sequence: Synthetic oligonucleotide
  Target: SCN10A; (+) strand; PAM type: YTN; PAM sequence: TTG
caagagttttctacacttaa

SEQ ID NO: 65667 - DNA, 20 bp, Artificial Sequence
  Description of Artificial Sequence: Synthetic oligonucleotide
  Target: SCN10A; (+) strand; PAM type: YTN; PAM sequence: TTT
tctacacttaaccttctaca

SEQ ID NO: 65668 - DNA, 20 bp, Artificial Sequence
  Description of Artificial Sequence: Synthetic oligonucleotide
  Target: SCN10A; (+) strand; PAM type: YTN; PAM sequence: TTT
ctacacttaaccttctacag

SEQ ID NO: 65669 - DNA, 20 bp, Artificial Sequence
  Description of Artificial Sequence: Synthetic oligonucleotide
  Target: SCN10A; (+) strand; PAM type: YTN; PAM sequence: TTC
tacacttaaccttctacagc

SEQ ID NO: 65670 - DNA, 20 bp, Artificial Sequence
  Description of Artificial Sequence: Synthetic oligonucleotide
  Target: SCN10A; (+) strand; PAM type: YTN; PAM sequence: CTA
cacttaaccttctacagctc

SEQ ID NO: 65671 - DNA, 20 bp, Artificial Sequence
  Description of Artificial Sequence: Synthetic oligonucleotide
  Target: SCN10A; (+) strand; PAM type: YTN; PAM sequence: CTT
aaccttctacagctccttac

SEQ ID NO: 65672 - DNA, 20 bp, Artificial Sequence
  Description of Artificial Sequence: Synthetic oligonucleotide
  Target: SCN10A; (+) strand; PAM type: YTN; PAM sequence: TTA
accttctacagctccttacc

SEQ ID NO: 65673 - DNA, 20 bp, Artificial Sequence
  Description of Artificial Sequence: Synthetic oligonucleotide
  Target: SCN10A; (+) strand; PAM type: YTN; PAM sequence: CTT
ctacagctccttacctcttt

SEQ ID NO: 65674 - DNA, 20 bp, Artificial Sequence
  Description of Artificial Sequence: Synthetic oligonucleotide
  Target: SCN10A; (+) strand; PAM type: YTN; PAM sequence: TTC
tacagctccttacctctttt

SEQ ID NO: 65675 - DNA, 20 bp, Artificial Sequence
  Description of Artificial Sequence: Synthetic oligonucleotide
  Target: SCN10A; (+) strand; PAM type: YTN; PAM sequence: CTA
cagctccttacctctttttt

SEQ ID NO: 65676 - DNA, 20 bp, Artificial Sequence
  Description of Artificial Sequence: Synthetic oligonucleotide
  Target: SCN10A; (+) strand; PAM type: YTN; PAM sequence: CTC
cttacctctttttttctctg

SEQ ID NO: 65677 - DNA, 20 bp, Artificial Sequence
  Description of Artificial Sequence: Synthetic oligonucleotide
  Target: SCN10A; (+) strand; PAM type: YTN; PAM sequence: CTT
acctctttttttctctgcag

SEQ ID NO: 65678 - DNA, 20 bp, Artificial Sequence
  Description of Artificial Sequence: Synthetic oligonucleotide
  Target: SCN10A; (+) strand; PAM type: YTN; PAM sequence: TTA
cctctttttttctctgcagc

SEQ ID NO: 65679 - DNA, 20 bp, Artificial Sequence
  Description of Artificial Sequence: Synthetic oligonucleotide
  Target: SCN10A; (+) strand; PAM type: YTN; PAM sequence: CTC
tttttttctctgcagcccct

SEQ ID NO: 65680 - DNA, 20 bp, Artificial Sequence
  Description of Artificial Sequence: Synthetic oligonucleotide
  Target: SCN10A; (+) strand; PAM type: YTN; PAM sequence: CTT
tttttctctgcagcccctgg

SEQ ID NO: 65681 - DNA, 20 bp, Artificial Sequence
  Description of Artificial Sequence: Synthetic oligonucleotide
  Target: SCN10A; (+) strand; PAM type: YTN; PAM sequence: TTT
ttttctctgcagcccctgga

SEQ ID NO: 65682 - DNA, 20 bp, Artificial Sequence
  Description of Artificial Sequence: Synthetic oligonucleotide
  Target: SCN10A; (+) strand; PAM type: YTN; PAM sequence: TTT
tttctctgcagcccctggaa

SEQ ID NO: 65683 - DNA, 20 bp, Artificial Sequence
  Description of Artificial Sequence: Synthetic oligonucleotide
  Target: SCN10A; (+) strand; PAM type: YTN; PAM sequence: TTT
ttctctgcagcccctggaat

SEQ ID NO: 65684 - DNA, 20 bp, Artificial Sequence
  Description of Artificial Sequence: Synthetic oligonucleotide
  Target: SCN10A; (+) strand; PAM type: YTN; PAM sequence: TTT
tctctgcagcccctggaatc

SEQ ID NO: 65685 - DNA, 20 bp, Artificial Sequence
  Description of Artificial Sequence: Synthetic oligonucleotide
  Target: SCN10A; (+) strand; PAM type: YTN; PAM sequence: TTT
ctctgcagcccctggaatct

SEQ ID NO: 65686 - DNA, 20 bp, Artificial Sequence
  Description of Artificial Sequence: Synthetic oligonucleotide
  Target: SCN10A; (+) strand; PAM type: YTN; PAM sequence: TTC
tctgcagcccctggaatctg

SEQ ID NO: 65687 - DNA, 20 bp, Artificial Sequence
  Description of Artificial Sequence: Synthetic oligonucleotide
  Target: SCN10A; (+) strand; PAM type: YTN; PAM sequence: CTC
tgcagcccctggaatctgac

SEQ ID NO: 65688 - DNA, 20 bp, Artificial Sequence
  Description of Artificial Sequence: Synthetic oligonucleotide
  Target: SCN10A; (+) strand; PAM type: YTN; PAM sequence: CTG
cagcccctggaatctgactt

SEQ ID NO: 65689 - DNA, 20 bp, Artificial Sequence
  Description of Artificial Sequence: Synthetic oligonucleotide
  Target: SCN10A; (+) strand; PAM type: YTN; PAM sequence: CTG
gaatctgactttaactgctt

SEQ ID NO: 65690 - DNA, 20 bp, Artificial Sequence
  Description of Artificial Sequence: Synthetic oligonucleotide
  Target: SCN10A; (+) strand; PAM type: YTN; PAM sequence: CTG
actttaactgcttccaaatt

SEQ ID NO: 65691 - DNA, 20 bp, Artificial Sequence
  Description of Artificial Sequence: Synthetic oligonucleotide
  Target: SCN10A; (+) strand; PAM type: YTN; PAM sequence: CTT
taactgcttccaaattcaaa

SEQ ID NO: 65692 - DNA, 20 bp, Artificial Sequence
  Description of Artificial Sequence: Synthetic oligonucleotide
  Target: SCN10A; (+) strand; PAM type: YTN; PAM sequence: TTT
aactgcttccaaattcaaat

SEQ ID NO: 65693 - DNA, 20 bp, Artificial Sequence
  Description of Artificial Sequence: Synthetic oligonucleotide
  Target: SCN10A; (+) strand; PAM type: YTN; PAM sequence: TTA
actgcttccaaattcaaata

SEQ ID NO: 65694 - DNA, 20 bp, Artificial Sequence
  Description of Artificial Sequence: Synthetic oligonucleotide
  Target: SCN10A; (+) strand; PAM type: YTN; PAM sequence: CTG
cttccaaattcaaataattg

SEQ ID NO: 65695 - DNA, 20 bp, Artificial Sequence
  Description of Artificial Sequence: Synthetic oligonucleotide
  Target: SCN10A; (+) strand; PAM type: YTN; PAM sequence: CTT
ccaaattcaaataattgatt

SEQ ID NO: 65696 - DNA, 20 bp, Artificial Sequence
  Description of Artificial Sequence: Synthetic oligonucleotide
  Target: SCN10A; (+) strand; PAM type: YTN; PAM sequence: TTC
caaattcaaataattgattt

SEQ ID NO: 65697 - DNA, 20 bp, Artificial Sequence
  Description of Artificial Sequence: Synthetic oligonucleotide
  Target: SCN10A; (+) strand; PAM type: YTN; PAM sequence: TTC
aaataattgatttccagttc

SEQ ID NO: 65698 - DNA, 20 bp, Artificial Sequence
  Description of Artificial Sequence: Synthetic oligonucleotide
  Target: SCN10A; (+) strand; PAM type: YTN; PAM sequence: TTG
atttccagttctcatcttac

SEQ ID NO: 65699 - DNA, 20 bp, Artificial Sequence
  Description of Artificial Sequence: Synthetic oligonucleotide
  Target: SCN10A; (+) strand; PAM type: YTN; PAM sequence: TTT
ccagttctcatcttaccctt

SEQ ID NO: 65700 - DNA, 20 bp, Artificial Sequence
  Description of Artificial Sequence: Synthetic oligonucleotide
  Target: SCN10A; (+) strand; PAM type: YTN; PAM sequence: TTC
cagttctcatcttaccctta

SEQ ID NO: 65701 - DNA, 20 bp, Artificial Sequence
  Description of Artificial Sequence: Synthetic oligonucleotide
  Target: SCN10A; (+) strand; PAM type: YTN; PAM sequence: TTC
tcatcttacccttataacat

SEQ ID NO: 65702 - DNA, 20 bp, Artificial Sequence
  Description of Artificial Sequence: Synthetic oligonucleotide
  Target: SCN10A; (+) strand; PAM type: YTN; PAM sequence: CTC
atcttacccttataacattt

SEQ ID NO: 65703 - DNA, 20 bp, Artificial Sequence
  Description of Artificial Sequence: Synthetic oligonucleotide
  Target: SCN10A; (+) strand; PAM type: YTN; PAM sequence: CTT
acccttataacatttgacag

SEQ ID NO: 65704 - DNA, 20 bp, Artificial Sequence
  Description of Artificial Sequence: Synthetic oligonucleotide
  Target: SCN10A; (+) strand; PAM type: YTN; PAM sequence: TTA
cccttataacatttgacaga

SEQ ID NO: 65705 - DNA, 20 bp, Artificial Sequence
  Description of Artificial Sequence: Synthetic oligonucleotide
  Target: SCN10A; (+) strand; PAM type: YTN; PAM sequence: CTT
ataacatttgacagaattta

SEQ ID NO: 65706 - DNA, 20 bp, Artificial Sequence
  Description of Artificial Sequence: Synthetic oligonucleotide
  Target: SCN10A; (+) strand; PAM type: YTN; PAM sequence: TTA
taacatttgacagaatttat

SEQ ID NO: 65707 - DNA, 20 bp, Artificial Sequence
  Description of Artificial Sequence: Synthetic oligonucleotide
  Target: SCN10A; (+) strand; PAM type: YTN; PAM sequence: TTT
gacagaatttatattgttct

SEQ ID NO: 65708 - DNA, 20 bp, Artificial Sequence
  Description of Artificial Sequence: Synthetic oligonucleotide
  Target: SCN10A; (+) strand; PAM type: YTN; PAM sequence: TTG
acagaatttatattgttctc

SEQ ID NO: 65709 - DNA, 20 bp, Artificial Sequence
  Description of Artificial Sequence: Synthetic oligonucleotide
  Target: SCN10A; (+) strand; PAM type: YTN; PAM sequence: TTT
atattgttctctttgaaacc

SEQ ID NO: 65710 - DNA, 20 bp, Artificial Sequence
  Description of Artificial Sequence: Synthetic oligonucleotide
  Target: SCN10A; (+) strand; PAM type: YTN; PAM sequence: TTA
tattgttctctttgaaacca

SEQ ID NO: 65711 - DNA, 20 bp, Artificial Sequence
  Description of Artificial Sequence: Synthetic oligonucleotide
  Target: SCN10A; (+) strand; PAM type: YTN; PAM sequence: TTG
ttctctttgaaaccagtgtt

SEQ ID NO: 65712 - DNA, 20 bp, Artificial Sequence
  Description of Artificial Sequence: Synthetic oligonucleotide
  Target: SCN10A; (+) strand; PAM type: YTN; PAM sequence: TTC
tctttgaaaccagtgttcat

SEQ ID NO: 65713 - DNA, 20 bp, Artificial Sequence
  Description of Artificial Sequence: Synthetic oligonucleotide
  Target: SCN10A; (+) strand; PAM type: YTN; PAM sequence: CTC
tttgaaaccagtgttcattt

SEQ ID NO: 65714 - DNA, 20 bp, Artificial Sequence
  Description of Artificial Sequence: Synthetic oligonucleotide
  Target: SCN10A; (+) strand; PAM type: YTN; PAM sequence: CTT
tgaaaccagtgttcatttgg

SEQ ID NO: 65715 - DNA, 20 bp, Artificial Sequence
  Description of Artificial Sequence: Synthetic oligonucleotide
  Target: SCN10A; (+) strand; PAM type: YTN; PAM sequence: TTT
gaaaccagtgttcatttggc

SEQ ID NO: 65716 - DNA, 20 bp, Artificial Sequence
  Description of Artificial Sequence: Synthetic oligonucleotide
  Target: SCN10A; (+) strand; PAM type: YTN; PAM sequence: TTG
aaaccagtgttcatttggct

SEQ ID NO: 65717 - DNA, 20 bp, Artificial Sequence
  Description of Artificial Sequence: Synthetic oligonucleotide
  Target: SCN10A; (+) strand; PAM type: YTN; PAM sequence: TTC
atttggctctggggactgca

SEQ ID NO: 65718 - DNA, 20 bp, Artificial Sequence
  Description of Artificial Sequence: Synthetic oligonucleotide
  Target: SCN10A; (+) strand; PAM type: YTN; PAM sequence: TTT
ggctctggggactgcatcat

SEQ ID NO: 65719 - DNA, 20 bp, Artificial Sequence
  Description of Artificial Sequence: Synthetic oligonucleotide
  Target: SCN10A; (+) strand; PAM type: YTN; PAM sequence: TTG
gctctggggactgcatcatc

SEQ ID NO: 65720 - DNA, 20 bp, Artificial Sequence
  Description of Artificial Sequence: Synthetic oligonucleotide
  Target: SCN10A; (+) strand; PAM type: YTN; PAM sequence: CTC
tggggactgcatcatctctt

SEQ ID NO: 65721 - DNA, 20 bp, Artificial Sequence
  Description of Artificial Sequence: Synthetic oligonucleotide
  Target: SCN10A; (+) strand; PAM type: YTN; PAM sequence: CTG
gggactgcatcatctcttgc

SEQ ID NO: 65722 - DNA, 20 bp, Artificial Sequence
  Description of Artificial Sequence: Synthetic oligonucleotide
  Target: SCN10A; (+) strand; PAM type: YTN; PAM sequence: CTG
catcatctcttgctttttct

SEQ ID NO: 65723 - DNA, 20 bp, Artificial Sequence
  Description of Artificial Sequence: Synthetic oligonucleotide
  Target: SCN10A; (+) strand; PAM type: YTN; PAM sequence: CTC
ttgctttttctcccatattt

SEQ ID NO: 65724 - DNA, 20 bp, Artificial Sequence
  Description of Artificial Sequence: Synthetic oligonucleotide
  Target: SCN10A; (+) strand; PAM type: YTN; PAM sequence: CTT
gctttttctcccatatttct

SEQ ID NO: 65725 - DNA, 20 bp, Artificial Sequence
  Description of Artificial Sequence: Synthetic oligonucleotide
  Target: SCN10A; (+) strand; PAM type: YTN; PAM sequence: TTG
ctttttctcccatatttctc

SEQ ID NO: 65726 - DNA, 20 bp, Artificial Sequence
  Description of Artificial Sequence: Synthetic oligonucleotide
  Target: SCN10A; (+) strand; PAM type: YTN; PAM sequence: CTT
tttctcccatatttctccac

SEQ ID NO: 65727 - DNA, 20 bp, Artificial Sequence
  Description of Artificial Sequence: Synthetic oligonucleotide
  Target: SCN10A; (+) strand; PAM type: YTN; PAM sequence: TTT
ttctcccatatttctccact

SEQ ID NO: 65728 - DNA, 20 bp, Artificial Sequence
  Description of Artificial Sequence: Synthetic oligonucleotide
  Target: SCN10A; (+) strand; PAM type: YTN; PAM sequence: TTT
tctcccatatttctccactt

SEQ ID NO: 65729 - DNA, 20 bp, Artificial Sequence
  Description of Artificial Sequence: Synthetic oligonucleotide
  Target: SCN10A; (+) strand; PAM type: YTN; PAM sequence: TTT
ctcccatatttctccacttc

SEQ ID NO: 65730 - DNA, 20 bp, Artificial Sequence
  Description of Artificial Sequence: Synthetic oligonucleotide
  Target: SCN10A; (+) strand; PAM type: YTN; PAM sequence: TTC
tcccatatttctccacttct

SEQ ID NO: 65731 - DNA, 20 bp, Artificial Sequence
  Description of Artificial Sequence: Synthetic oligonucleotide
  Target: SCN10A; (+) strand; PAM type: YTN; PAM sequence: CTC
ccatatttctccacttcttt

SEQ ID NO: 65732 - DNA, 20 bp, Artificial Sequence
  Description of Artificial Sequence: Synthetic oligonucleotide
  Target: SCN10A; (+) strand; PAM type: YTN; PAM sequence: TTT
ctccacttcttttcactttc

SEQ ID NO: 65733 - DNA, 20 bp, Artificial Sequence
  Description of Artificial Sequence: Synthetic oligonucleotide
  Target: SCN10A; (+) strand; PAM type: YTN; PAM sequence: TTC
tccacttcttttcactttct

SEQ ID NO: 65734 - DNA, 20 bp, Artificial Sequence
  Description of Artificial Sequence: Synthetic oligonucleotide
  Target: SCN10A; (+) strand; PAM type: YTN; PAM sequence: CTC
cacttcttttcactttctgt

SEQ ID NO: 65735 - DNA, 20 bp, Artificial Sequence
  Description of Artificial Sequence: Synthetic oligonucleotide
  Target: SCN10A; (+) strand; PAM type: YTN; PAM sequence: CTT
cttttcactttctgtttttg

SEQ ID NO: 65736 - DNA, 20 bp, Artificial Sequence
  Description of Artificial Sequence: Synthetic oligonucleotide
  Target: SCN10A; (+) strand; PAM type: YTN; PAM sequence: TTC
ttttcactttctgtttttgt

SEQ ID NO: 65737 - DNA, 20 bp, Artificial Sequence
  Description of Artificial Sequence: Synthetic oligonucleotide
  Target: SCN10A; (+) strand; PAM type: YTN; PAM sequence: CTT
ttcactttctgtttttgtct

SEQ ID NO: 65738 - DNA, 20 bp, Artificial Sequence
  Description of Artificial Sequence: Synthetic oligonucleotide
  Target: SCN10A; (+) strand; PAM type: YTN; PAM sequence: TTT
tcactttctgtttttgtctc

SEQ ID NO: 65739 - DNA, 20 bp, Artificial Sequence
  Description of Artificial Sequence: Synthetic oligonucleotide
  Target: SCN10A; (+) strand; PAM type: YTN; PAM sequence: TTT
cactttctgtttttgtctcc

SEQ ID NO: 65740 - DNA, 20 bp, Artificial Sequence
  Description of Artificial Sequence: Synthetic oligonucleotide
  Target: SCN10A; (+) strand; PAM type: YTN; PAM sequence: TTC
actttctgtttttgtctccc

SEQ ID NO: 65741 - DNA, 20 bp, Artificial Sequence
  Description of Artificial Sequence: Synthetic oligonucleotide
  Target: SCN10A; (+) strand; PAM type: YTN; PAM sequence: CTT
tctgtttttgtctccctttt

SEQ ID NO: 65742 - DNA, 20 bp, Artificial Sequence
  Description of Artificial Sequence: Synthetic oligonucleotide
  Target: SCN10A; (+) strand; PAM type: YTN; PAM sequence: TTT
ctgtttttgtctcccttttc

SEQ ID NO: 65743 - DNA, 20 bp, Artificial Sequence
  Description of Artificial Sequence: Synthetic oligonucleotide
  Target: SCN10A; (+) strand; PAM type: YTN; PAM sequence: TTC
tgtttttgtctcccttttcc

SEQ ID NO: 65744 - DNA, 20 bp, Artificial Sequence
  Description of Artificial Sequence: Synthetic oligonucleotide
  Target: SCN10A; (+) strand; PAM type: YTN; PAM sequence: CTG
tttttgtctcccttttcctt

SEQ ID NO: 65745 - DNA, 20 bp, Artificial Sequence
  Description of Artificial Sequence: Synthetic oligonucleotide
  Target: SCN10A; (+) strand; PAM type: YTN; PAM sequence: TTT
ttgtctcccttttcctttcc

SEQ ID NO: 65746 - DNA, 20 bp, Artificial Sequence
  Description of Artificial Sequence: Synthetic oligonucleotide
  Target: SCN10A; (+) strand; PAM type: YTN; PAM sequence: TTT
tgtctcccttttcctttcct

SEQ ID NO: 65747 - DNA, 20 bp, Artificial Sequence
  Description of Artificial Sequence: Synthetic oligonucleotide
  Target: SCN10A; (+) strand; PAM type: YTN; PAM sequence: TTT
gtctcccttttcctttcctg

SEQ ID NO: 65748 - DNA, 20 bp, Artificial Sequence
  Description of Artificial Sequence: Synthetic oligonucleotide
  Target: SCN10A; (+) strand; PAM type: YTN; PAM sequence: TTG
tctcccttttcctttcctgc

SEQ ID NO: 65749 - DNA, 20 bp, Artificial Sequence
  Description of Artificial Sequence: Synthetic oligonucleotide
  Target: SCN10A; (+) strand; PAM type: YTN; PAM sequence: CTC
ccttttcctttcctgcttgt

SEQ ID NO: 65750 - DNA, 20 bp, Artificial Sequence
  Description of Artificial Sequence: Synthetic oligonucleotide
  Target: SCN10A; (+) strand; PAM type: YTN; PAM sequence: CTT
ttcctttcctgcttgtaaat

SEQ ID NO: 65751 - DNA, 20 bp, Artificial Sequence
  Description of Artificial Sequence: Synthetic oligonucleotide
  Target: SCN10A; (+) strand; PAM type: YTN; PAM sequence: TTT
tcctttcctgcttgtaaatg

SEQ ID NO: 65752 - DNA, 20 bp, Artificial Sequence
  Description of Artificial Sequence: Synthetic oligonucleotide
  Target: SCN10A; (+) strand; PAM type: YTN; PAM sequence: TTT
cctttcctgcttgtaaatgt

SEQ ID NO: 65753 - DNA, 20 bp, Artificial Sequence
  Description of Artificial Sequence: Synthetic oligonucleotide
  Target: SCN10A; (+) strand; PAM type: YTN; PAM sequence: TTC
ctttcctgcttgtaaatgtt

SEQ ID NO: 65754 - DNA, 20 bp, Artificial Sequence
  Description of Artificial Sequence: Synthetic oligonucleotide
  Target: SCN10A; (+) strand; PAM type: YTN; PAM sequence: CTT
tcctgcttgtaaatgttgaa

SEQ ID NO: 65755 - DNA, 20 bp, Artificial Sequence
  Description of Artificial Sequence: Synthetic oligonucleotide
  Target: SCN10A; (+) strand; PAM type: YTN; PAM sequence: TTT
cctgcttgtaaatgttgaat

SEQ ID NO: 65756 - DNA, 20 bp, Artificial Sequence
  Description of Artificial Sequence: Synthetic oligonucleotide
  Target: SCN10A; (+) strand; PAM type: YTN; PAM sequence: TTC
ctgcttgtaaatgttgaata

SEQ ID NO: 65757 - DNA, 20 bp, Artificial Sequence
  Description of Artificial Sequence: Synthetic oligonucleotide
  Target: SCN10A; (+) strand; PAM type: YTN; PAM sequence: CTG
cttgtaaatgttgaataact

SEQ ID NO: 65758 - DNA, 20 bp, Artificial Sequence
  Description of Artificial Sequence: Synthetic oligonucleotide
  Target: SCN10A; (+) strand; PAM type: YTN; PAM sequence: CTT
gtaaatgttgaataactcaa

SEQ ID NO: 65759 - DNA, 20 bp, Artificial Sequence
  Description of Artificial Sequence: Synthetic oligonucleotide
  Target: SCN10A; (+) strand; PAM type: YTN; PAM sequence: TTG
taaatgttgaataactcaag

SEQ ID NO: 65760 - DNA, 20 bp, Artificial Sequence
  Description of Artificial Sequence: Synthetic oligonucleotide
  Target: SCN10A; (+) strand; PAM type: YTN; PAM sequence: TTG
aataactcaagcattctcac

SEQ ID NO: 65761 - DNA, 20 bp, Artificial Sequence
  Description of Artificial Sequence: Synthetic oligonucleotide
  Target: SCN10A; (+) strand; PAM type: YTN; PAM sequence: CTC
aagcattctcaccttagctt

SEQ ID NO: 65762 - DNA, 20 bp, Artificial Sequence
  Description of Artificial Sequence: Synthetic oligonucleotide
  Target: SCN10A; (+) strand; PAM type: YTN; PAM sequence: TTC
tcaccttagcttctctgtgt

SEQ ID NO: 65763 - DNA, 20 bp, Artificial Sequence
  Description of Artificial Sequence: Synthetic oligonucleotide
  Target: SCN10A; (+) strand; PAM type: YTN; PAM sequence: CTC
accttagcttctctgtgttt

SEQ ID NO: 65764 - DNA, 20 bp, Artificial Sequence
  Description of Artificial Sequence: Synthetic oligonucleotide
  Target: SCN10A; (+) strand; PAM type: YTN; PAM sequence: CTT
agcttctctgtgtttttgaa

SEQ ID NO: 65765 - DNA, 20 bp, Artificial Sequence
  Description of Artificial Sequence: Synthetic oligonucleotide
  Target: SCN10A; (+) strand; PAM type: YTN; PAM sequence: TTA
gcttctctgtgtttttgaat

SEQ ID NO: 65766 - DNA, 20 bp, Artificial Sequence
  Description of Artificial Sequence: Synthetic oligonucleotide
  Target: SCN10A; (+) strand; PAM type: YTN; PAM sequence: CTT
ctctgtgtttttgaatctca

SEQ ID NO: 65767 - DNA, 20 bp, Artificial Sequence
  Description of Artificial Sequence: Synthetic oligonucleotide
  Target: SCN10A; (+) strand; PAM type: YTN; PAM sequence: TTC
tctgtgtttttgaatctcat

SEQ ID NO: 65768 - DNA, 20 bp, Artificial Sequence
  Description of Artificial Sequence: Synthetic oligonucleotide
  Target: SCN10A; (+) strand; PAM type: YTN; PAM sequence: CTC
tgtgtttttgaatctcatag

SEQ ID NO: 65769 - DNA, 20 bp, Artificial Sequence
  Description of Artificial Sequence: Synthetic oligonucleotide
  Target: SCN10A; (+) strand; PAM type: YTN; PAM sequence: CTG
tgtttttgaatctcatagcc

SEQ ID NO: 65770 - DNA, 20 bp, Artificial Sequence
  Description of Artificial Sequence: Synthetic oligonucleotide
  Target: SCN10A; (+) strand; PAM type: YTN; PAM sequence: TTT
ttgaatctcatagccctaaa

SEQ ID NO: 65771 - DNA, 20 bp, Artificial Sequence
  Description of Artificial Sequence: Synthetic oligonucleotide
  Target: SCN10A; (+) strand; PAM type: YTN; PAM sequence: TTT
tgaatctcatagccctaaaa

SEQ ID NO: 65772 - DNA, 20 bp, Artificial Sequence
  Description of Artificial Sequence: Synthetic oligonucleotide
  Target: SCN10A; (+) strand; PAM type: YTN; PAM sequence: TTT
gaatctcatagccctaaaaa

SEQ ID NO: 65773 - DNA, 20 bp, Artificial Sequence
  Description of Artificial Sequence: Synthetic oligonucleotide
  Target: SCN10A; (+) strand; PAM type: YTN; PAM sequence: TTG
aatctcatagccctaaaaaa

SEQ ID NO: 65774 - DNA, 20 bp, Artificial Sequence
  Description of Artificial Sequence: Synthetic oligonucleotide
  Target: SCN10A; (+) strand; PAM type: YTN; PAM sequence: CTC
atagccctaaaaaaccatct

SEQ ID NO: 65775 - DNA, 20 bp, Artificial Sequence
  Description of Artificial Sequence: Synthetic oligonucleotide
  Target: SCN10A; (+) strand; PAM type: YTN; PAM sequence: CTA
aaaaaccatctctatgccaa

SEQ ID NO: 65776 - DNA, 20 bp, Artificial Sequence
  Description of Artificial Sequence: Synthetic oligonucleotide
  Target: SCN10A; (+) strand; PAM type: YTN; PAM sequence: CTC
tatgccaattcccaccaaat

SEQ ID NO: 65777 - DNA, 20 bp, Artificial Sequence
  Description of Artificial Sequence: Synthetic oligonucleotide
  Target: SCN10A; (+) strand; PAM type: YTN; PAM sequence: CTA
tgccaattcccaccaaatta

SEQ ID NO: 65778 - DNA, 20 bp, Artificial Sequence
  Description of Artificial Sequence: Synthetic oligonucleotide
  Target: SCN10A; (+) strand; PAM type: YTN; PAM sequence: TTC
ccaccaaattatgtgtccaa

SEQ ID NO: 65779 - DNA, 20 bp, Artificial Sequence
  Description of Artificial Sequence: Synthetic oligonucleotide
  Target: SCN10A; (+) strand; PAM type: YTN; PAM sequence: TTA
tgtgtccaatttctgatccc

SEQ ID NO: 65780 - DNA, 20 bp, Artificial Sequence
  Description of Artificial Sequence: Synthetic oligonucleotide
  Target: SCN10A; (+) strand; PAM type: YTN; PAM sequence: TTT
ctgatcccttcctgaacact

SEQ ID NO: 65781 - DNA, 20 bp, Artificial Sequence
  Description of Artificial Sequence: Synthetic oligonucleotide
  Target: SCN10A; (+) strand; PAM type: YTN; PAM sequence: TTC
tgatcccttcctgaacacta

SEQ ID NO: 65782 - DNA, 20 bp, Artificial Sequence
  Description of Artificial Sequence: Synthetic oligonucleotide
  Target: SCN10A; (+) strand; PAM type: YTN; PAM sequence: CTG
atcccttcctgaacactagg

SEQ ID NO: 65783 - DNA, 20 bp, Artificial Sequence
  Description of Artificial Sequence: Synthetic oligonucleotide
  Target: SCN10A; (+) strand; PAM type: YTN; PAM sequence: CTT
cctgaacactaggcttatct

SEQ ID NO: 65784 - DNA, 20 bp, Artificial Sequence
  Description of Artificial Sequence: Synthetic oligonucleotide
  Target: SCN10A; (+) strand; PAM type: YTN; PAM sequence: TTC
ctgaacactaggcttatctc

SEQ ID NO: 65785 - DNA, 20 bp, Artificial Sequence
  Description of Artificial Sequence: Synthetic oligonucleotide
  Target: SCN10A; (+) strand; PAM type: YTN; PAM sequence: CTG
aacactaggcttatctctct

SEQ ID NO: 65786 - DNA, 20 bp, Artificial Sequence
  Description of Artificial Sequence: Synthetic oligonucleotide
  Target: SCN10A; (+) strand; PAM type: YTN; PAM sequence: CTA
ggcttatctctctacctgcc

SEQ ID NO: 65787 - DNA, 20 bp, Artificial Sequence
  Description of Artificial Sequence: Synthetic oligonucleotide
  Target: SCN10A; (+) strand; PAM type: YTN; PAM sequence: CTT
atctctctacctgcctccgt

SEQ ID NO: 65788 - DNA, 20 bp, Artificial Sequence
  Description of Artificial Sequence: Synthetic oligonucleotide
  Target: SCN10A; (+) strand; PAM type: YTN; PAM sequence: TTA
tctctctacctgcctccgtt

SEQ ID NO: 65789 - DNA, 20 bp, Artificial Sequence
  Description of Artificial Sequence: Synthetic oligonucleotide
  Target: SCN10A; (+) strand; PAM type: YTN; PAM sequence: CTC
tctacctgcctccgttaaat

SEQ ID NO: 65790 - DNA, 20 bp, Artificial Sequence
  Description of Artificial Sequence: Synthetic oligonucleotide
  Target: SCN10A; (+) strand; PAM type: YTN; PAM sequence: CTC
tacctgcctccgttaaatct

SEQ ID NO: 65791 - DNA, 20 bp, Artificial Sequence
  Description of Artificial Sequence: Synthetic oligonucleotide
  Target: SCN10A; (+) strand; PAM type: YTN; PAM sequence: CTA
cctgcctccgttaaatctcc

SEQ ID NO: 65792 - DNA, 20 bp, Artificial Sequence
  Description of Artificial Sequence: Synthetic oligonucleotide
  Target: SCN10A; (+) strand; PAM type: YTN; PAM sequence: CTG
cctccgttaaatctccatgt

SEQ ID NO: 65793 - DNA, 20 bp, Artificial Sequence
  Description of Artificial Sequence: Synthetic oligonucleotide
  Target: SCN10A; (+) strand; PAM type: YTN; PAM sequence: CTC
cgttaaatctccatgtggat

SEQ ID NO: 65794 - DNA, 20 bp, Artificial Sequence
  Description of Artificial Sequence: Synthetic oligonucleotide
  Target: SCN10A; (+) strand; PAM type: YTN; PAM sequence: TTA
aatctccatgtggatgtgta

SEQ ID NO: 65795 - DNA, 20 bp, Artificial Sequence
  Description of Artificial Sequence: Synthetic oligonucleotide
  Target: SCN10A; (+) strand; PAM type: YTN; PAM sequence: CTC
catgtggatgtgtaactgtg

SEQ ID NO: 65796 - DNA, 20 bp, Artificial Sequence
  Description of Artificial Sequence: Synthetic oligonucleotide
  Target: SCN10A; (+) strand; PAM type: YTN; PAM sequence: CTG
tgttcacctcgatggagggc

SEQ ID NO: 65797 - DNA, 20 bp, Artificial Sequence
  Description of Artificial Sequence: Synthetic oligonucleotide
  Target: SCN10A; (+) strand; PAM type: YTN; PAM sequence: TTC
acctcgatggagggcaattt

SEQ ID NO: 65798 - DNA, 20 bp, Artificial Sequence
  Description of Artificial Sequence: Synthetic oligonucleotide
  Target: SCN10A; (+) strand; PAM type: YTN; PAM sequence: CTC
gatggagggcaatttcttag

SEQ ID NO: 65799 - DNA, 20 bp, Artificial Sequence
  Description of Artificial Sequence: Synthetic oligonucleotide
  Target: SCN10A; (+) strand; PAM type: YTN; PAM sequence: TTT
cttagctttaggtttatcta

SEQ ID NO: 65800 - DNA, 20 bp, Artificial Sequence
  Description of Artificial Sequence: Synthetic oligonucleotide
  Target: SCN10A; (+) strand; PAM type: YTN; PAM sequence: TTC
ttagctttaggtttatctat

SEQ ID NO: 65801 - DNA, 20 bp, Artificial Sequence
  Description of Artificial Sequence: Synthetic oligonucleotide
  Target: SCN10A; (+) strand; PAM type: YTN; PAM sequence: CTT
agctttaggtttatctataa

SEQ ID NO: 65802 - DNA, 20 bp, Artificial Sequence
  Description of Artificial Sequence: Synthetic oligonucleotide
  Target: SCN10A; (+) strand; PAM type: YTN; PAM sequence: TTA
gctttaggtttatctataaa

SEQ ID NO: 65803 - DNA, 20 bp, Artificial Sequence
  Description of Artificial Sequence: Synthetic oligonucleotide
  Target: SCN10A; (+) strand; PAM type: YTN; PAM sequence: CTT
taggtttatctataaattcc

SEQ ID NO: 65804 - DNA, 20 bp, Artificial Sequence
  Description of Artificial Sequence: Synthetic oligonucleotide
  Target: SCN10A; (+) strand; PAM type: YTN; PAM sequence: TTT
aggtttatctataaattcct

SEQ ID NO: 65805 - DNA, 20 bp, Artificial Sequence
  Description of Artificial Sequence: Synthetic oligonucleotide
  Target: SCN10A; (+) strand; PAM type: YTN; PAM sequence: TTA
ggtttatctataaattcctc

SEQ ID NO: 65806 - DNA, 20 bp, Artificial Sequence
  Description of Artificial Sequence: Synthetic oligonucleotide
  Target: SCN10A; (+) strand; PAM type: YTN; PAM sequence: TTT
atctataaattcctcggcaa

SEQ ID NO: 65807 - DNA, 20 bp, Artificial Sequence
  Description of Artificial Sequence: Synthetic oligonucleotide
  Target: SCN10A; (+) strand; PAM type: YTN; PAM sequence: TTA
tctataaattcctcggcaag

SEQ ID NO: 65808 - DNA, 20 bp, Artificial Sequence
  Description of Artificial Sequence: Synthetic oligonucleotide
  Target: SCN10A; (+) strand; PAM type: YTN; PAM sequence: CTA
taaattcctcggcaagacat

SEQ ID NO: 65809 - DNA, 20 bp, Artificial Sequence
  Description of Artificial Sequence: Synthetic oligonucleotide
  Target: SCN10A; (+) strand; PAM type: YTN; PAM sequence: TTC
ctcggcaagacatgcatctt

SEQ ID NO: 65810 - DNA, 20 bp, Artificial Sequence
  Description of Artificial Sequence: Synthetic oligonucleotide
  Target: SCN10A; (+) strand; PAM type: YTN; PAM sequence: CTC
ggcaagacatgcatcttgaa

SEQ ID NO: 65811 - DNA, 20 bp, Artificial Sequence
  Description of Artificial Sequence: Synthetic oligonucleotide
  Target: SCN10A; (+) strand; PAM type: YTN; PAM sequence: CTT
gaacagatatcagcctatgt

SEQ ID NO: 65812 - DNA, 20 bp, Artificial Sequence
  Description of Artificial Sequence: Synthetic oligonucleotide
  Target: SCN10A; (+) strand; PAM type: YTN; PAM sequence: TTG
aacagatatcagcctatgtg

SEQ ID NO: 65813 - DNA, 20 bp, Artificial Sequence
  Description of Artificial Sequence: Synthetic oligonucleotide
  Target: SCN10A; (+) strand; PAM type: YTN; PAM sequence: CTA
tgtgggcaaagaaagatgat

SEQ ID NO: 65814 - DNA, 20 bp, Artificial Sequence
  Description of Artificial Sequence: Synthetic oligonucleotide
  Target: SCN10A; (+) strand; PAM type: YTN; PAM sequence: TTG
tttataataataatggaaaa

SEQ ID NO: 65815 - DNA, 20 bp, Artificial Sequence
  Description of Artificial Sequence: Synthetic oligonucleotide
  Target: SCN10A; (+) strand; PAM type: YTN; PAM sequence: TTT
ataataataatggaaaacaa

SEQ ID NO: 65816 - DNA, 20 bp, Artificial Sequence
  Description of Artificial Sequence: Synthetic oligonucleotide
  Target: SCN10A; (+) strand; PAM type: YTN; PAM sequence: TTA
taataataatggaaaacaac

SEQ ID NO: 65817 - DNA, 20 bp, Artificial Sequence
  Description of Artificial Sequence: Synthetic oligonucleotide
  Target: SCN10A; (+) strand; PAM type: YTN; PAM sequence: CTG
ataaagcataatacattgtg

SEQ ID NO: 65818 - DNA, 20 bp, Artificial Sequence
  Description of Artificial Sequence: Synthetic oligonucleotide
  Target: SCN10A; (+) strand; PAM type: YTN; PAM sequence: TTG
tgaaaaagaatgaggcagat

SEQ ID NO: 65819 - DNA, 20 bp, Artificial Sequence
  Description of Artificial Sequence: Synthetic oligonucleotide
  Target: SCN10A; (+) strand; PAM type: YTN; PAM sequence: TTT
atttgtggtgatgtagaaaa

SEQ ID NO: 65820 - DNA, 20 bp, Artificial Sequence
  Description of Artificial Sequence: Synthetic oligonucleotide
  Target: SCN10A; (+) strand; PAM type: YTN; PAM sequence: TTA
tttgtggtgatgtagaaaaa

SEQ ID NO: 65821 - DNA, 20 bp, Artificial Sequence
  Description of Artificial Sequence: Synthetic oligonucleotide
  Target: SCN10A; (+) strand; PAM type: YTN; PAM sequence: TTT
gtggtgatgtagaaaaatat

SEQ ID NO: 65822 - DNA, 20 bp, Artificial Sequence
  Description of Artificial Sequence: Synthetic oligonucleotide
  Target: SCN10A; (+) strand; PAM type: YTN; PAM sequence: TTG
tggtgatgtagaaaaatatg

SEQ ID NO: 65823 - DNA, 20 bp, Artificial Sequence
  Description of Artificial Sequence: Synthetic oligonucleotide
  Target: SCN10A; (+) strand; PAM type: YTN; PAM sequence: CTT
atatatgcatagaacattgc

SEQ ID NO: 65824 - DNA, 20 bp, Artificial Sequence
  Description of Artificial Sequence: Synthetic oligonucleotide
  Target: SCN10A; (+) strand; PAM type: YTN; PAM sequence: TTA
tatatgcatagaacattgct

SEQ ID NO: 65825 - DNA, 20 bp, Artificial Sequence
  Description of Artificial Sequence: Synthetic oligonucleotide
  Target: SCN10A; (+) strand; PAM type: YTN; PAM sequence: TTG
cttgaagaatataagataaa

SEQ ID NO: 65826 - DNA, 20 bp, Artificial Sequence
  Description of Artificial Sequence: Synthetic oligonucleotide
  Target: SCN10A; (+) strand; PAM type: YTN; PAM sequence: CTT
gaagaatataagataaactg

SEQ ID NO: 65827 - DNA, 20 bp, Artificial Sequence
  Description of Artificial Sequence: Synthetic oligonucleotide
  Target: SCN10A; (+) strand; PAM type: YTN; PAM sequence: TTG
aagaatataagataaactgg

SEQ ID NO: 65828 - DNA, 20 bp, Artificial Sequence
  Description of Artificial Sequence: Synthetic oligonucleotide
  Target: SCN10A; (+) strand; PAM type: YTN; PAM sequence: CTG
gagtgggaggggggtgcacc

SEQ ID NO: 65829 - DNA, 20 bp, Artificial Sequence
  Description of Artificial Sequence: Synthetic oligonucleotide
  Target: SCN10A; (+) strand; PAM type: YTN; PAM sequence: CTG
gggagcaggaagggtctata

SEQ ID NO: 65830 - DNA, 20 bp, Artificial Sequence
  Description of Artificial Sequence: Synthetic oligonucleotide
  Target: SCN10A; (+) strand; PAM type: YTN; PAM sequence: CTA
tagtgggaaggagacatagt

SEQ ID NO: 65831 - DNA, 20 bp, Artificial Sequence
  Description of Artificial Sequence: Synthetic oligonucleotide
  Target: SCN10A; (+) strand; PAM type: YTN; PAM sequence: TTG
tcattgcatacacacttgca

SEQ ID NO: 65832 - DNA, 20 bp, Artificial Sequence
  Description of Artificial Sequence: Synthetic oligonucleotide
  Target: SCN10A; (+) strand; PAM type: YTN; PAM sequence: TTG
catacacacttgcagtgttt

SEQ ID NO: 65833 - DNA, 20 bp, Artificial Sequence
  Description of Artificial Sequence: Synthetic oligonucleotide
  Target: SCN10A; (+) strand; PAM type: YTN; PAM sequence: CTT
gcagtgtttagggttttttt

SEQ ID NO: 65834 - DNA, 20 bp, Artificial Sequence
  Description of Artificial Sequence: Synthetic oligonucleotide
  Target: SCN10A; (+) strand; PAM type: YTN; PAM sequence: TTG
cagtgtttagggtttttttt

SEQ ID NO: 65835 - DNA, 20 bp, Artificial Sequence
  Description of Artificial Sequence: Synthetic oligonucleotide
  Target: SCN10A; (+) strand; PAM type: YTN; PAM sequence: TTT
agggttttttttactatatg

SEQ ID NO: 65836 - DNA, 20 bp, Artificial Sequence
  Description of Artificial Sequence: Synthetic oligonucleotide
  Target: SCN10A; (+) strand; PAM type: YTN; PAM sequence: TTA
gggttttttttactatatgc

SEQ ID NO: 65837 - DNA, 20 bp, Artificial Sequence
  Description of Artificial Sequence: Synthetic oligonucleotide
  Target: SCN10A; (+) strand; PAM type: YTN; PAM sequence: TTT
tttttactatatgcacttga

SEQ ID NO: 65838 - DNA, 20 bp, Artificial Sequence
  Description of Artificial Sequence: Synthetic oligonucleotide
  Target: SCN10A; (+) strand; PAM type: YTN; PAM sequence: TTT
ttttactatatgcacttgaa

SEQ ID NO: 65839 - DNA, 20 bp, Artificial Sequence
  Description of Artificial Sequence: Synthetic oligonucleotide
  Target: SCN10A; (+) strand; PAM type: YTN; PAM sequence: TTT
tttactatatgcacttgaaa

SEQ ID NO: 65840 - DNA, 20 bp, Artificial Sequence
  Description of Artificial Sequence: Synthetic oligonucleotide
  Target: SCN10A; (+) strand; PAM type: YTN; PAM sequence: TTT
ttactatatgcacttgaaaa

SEQ ID NO: 65841 - DNA, 20 bp, Artificial Sequence
  Description of Artificial Sequence: Synthetic oligonucleotide
  Target: SCN10A; (+) strand; PAM type: YTN; PAM sequence: TTT
tactatatgcacttgaaaaa

SEQ ID NO: 65842 - DNA, 20 bp, Artificial Sequence
  Description of Artificial Sequence: Synthetic oligonucleotide
  Target: SCN10A; (+) strand; PAM type: YTN; PAM sequence: TTT
actatatgcacttgaaaaat

SEQ ID NO: 65843 - DNA, 20 bp, Artificial Sequence
  Description of Artificial Sequence: Synthetic oligonucleotide
  Target: SCN10A; (+) strand; PAM type: YTN; PAM sequence: TTA
ctatatgcacttgaaaaatc

SEQ ID NO: 65844 - DNA, 20 bp, Artificial Sequence
  Description of Artificial Sequence: Synthetic oligonucleotide
  Target: SCN10A; (+) strand; PAM type: YTN; PAM sequence: CTA
tatgcacttgaaaaatcagt

SEQ ID NO: 65845 - DNA, 20 bp, Artificial Sequence
  Description of Artificial Sequence: Synthetic oligonucleotide
  Target: SCN10A; (+) strand; PAM type: YTN; PAM sequence: CTT
gaaaaatcagtttagagaaa

SEQ ID NO: 65846 - DNA, 20 bp, Artificial Sequence
  Description of Artificial Sequence: Synthetic oligonucleotide
  Target: SCN10A; (+) strand; PAM type: YTN; PAM sequence: TTG
aaaaatcagtttagagaaat

SEQ ID NO: 65847 - DNA, 20 bp, Artificial Sequence
  Description of Artificial Sequence: Synthetic oligonucleotide
  Target: SCN10A; (+) strand; PAM type: YTN; PAM sequence: TTT
agagaaataactgtgtgccc

SEQ ID NO: 65848 - DNA, 20 bp, Artificial Sequence
  Description of Artificial Sequence: Synthetic oligonucleotide
  Target: SCN10A; (+) strand; PAM type: YTN; PAM sequence: TTA
gagaaataactgtgtgcccc

SEQ ID NO: 65849 - DNA, 20 bp, Artificial Sequence
  Description of Artificial Sequence: Synthetic oligonucleotide
  Target: SCN10A; (+) strand; PAM type: YTN; PAM sequence: CTG
tgtgcccccaaattttgcta

SEQ ID NO: 65850 - DNA, 20 bp, Artificial Sequence
  Description of Artificial Sequence: Synthetic oligonucleotide
  Target: SCN10A; (+) strand; PAM type: YTN; PAM sequence: TTT
tgctaacagtgttttttcct

SEQ ID NO: 65851 - DNA, 20 bp, Artificial Sequence
  Description of Artificial Sequence: Synthetic oligonucleotide
  Target: SCN10A; (+) strand; PAM type: YTN; PAM sequence: TTT
gctaacagtgttttttcctg

SEQ ID NO: 65852 - DNA, 20 bp, Artificial Sequence
  Description of Artificial Sequence: Synthetic oligonucleotide
  Target: SCN10A; (+) strand; PAM type: YTN; PAM sequence: TTG
ctaacagtgttttttcctga

SEQ ID NO: 65853 - DNA, 20 bp, Artificial Sequence
  Description of Artificial Sequence: Synthetic oligonucleotide
  Target: SCN10A; (+) strand; PAM type: YTN; PAM sequence: CTA
acagtgttttttcctgataa

SEQ ID NO: 65854 - DNA, 20 bp, Artificial Sequence
  Description of Artificial Sequence: Synthetic oligonucleotide
  Target: SCN10A; (+) strand; PAM type: YTN; PAM sequence: TTT
tttcctgataatttaaaaat

SEQ ID NO: 65855 - DNA, 20 bp, Artificial Sequence
  Description of Artificial Sequence: Synthetic oligonucleotide
  Target: SCN10A; (+) strand; PAM type: YTN; PAM sequence: TTT
ttcctgataatttaaaaatg

SEQ ID NO: 65856 - DNA, 20 bp, Artificial Sequence
  Description of Artificial Sequence: Synthetic oligonucleotide
  Target: SCN10A; (+) strand; PAM type: YTN; PAM sequence: TTT
tcctgataatttaaaaatgt

SEQ ID NO: 65857 - DNA, 20 bp, Artificial Sequence
  Description of Artificial Sequence: Synthetic oligonucleotide
  Target: SCN10A; (+) strand; PAM type: YTN; PAM sequence: TTT
cctgataatttaaaaatgtg

SEQ ID NO: 65858 - DNA, 20 bp, Artificial Sequence
  Description of Artificial Sequence: Synthetic oligonucleotide
  Target: SCN10A; (+) strand; PAM type: YTN; PAM sequence: TTC
ctgataatttaaaaatgtgt

SEQ ID NO: 65859 - DNA, 20 bp, Artificial Sequence
  Description of Artificial Sequence: Synthetic oligonucleotide
  Target: SCN10A; (+) strand; PAM type: YTN; PAM sequence: CTG
ataatttaaaaatgtgtatg

SEQ ID NO: 65860 - DNA, 20 bp, Artificial Sequence
  Description of Artificial Sequence: Synthetic oligonucleotide
  Target: SCN10A; (+) strand; PAM type: YTN; PAM sequence: TTT
aaaaatgtgtatgtagtcaa

SEQ ID NO: 65861 - DNA, 20 bp, Artificial Sequence
  Description of Artificial Sequence: Synthetic oligonucleotide
  Target: SCN10A; (+) strand; PAM type: YTN; PAM sequence: TTA
aaaatgtgtatgtagtcaag

SEQ ID NO: 65862 - DNA, 20 bp, Artificial Sequence
  Description of Artificial Sequence: Synthetic oligonucleotide
  Target: SCN10A; (+) strand; PAM type: YTN; PAM sequence: TTT
atcagtagtatttttatttg

SEQ ID NO: 65863 - DNA, 20 bp, Artificial Sequence
  Description of Artificial Sequence: Synthetic oligonucleotide
  Target: SCN10A; (+) strand; PAM type: YTN; PAM sequence: TTA
tcagtagtatttttatttgt

SEQ ID NO: 65864 - DNA, 20 bp, Artificial Sequence
  Description of Artificial Sequence: Synthetic oligonucleotide
  Target: SCN10A; (+) strand; PAM type: YTN; PAM sequence: TTT
ttatttgttttctttttttt

SEQ ID NO: 65865 - DNA, 20 bp, Artificial Sequence
  Description of Artificial Sequence: Synthetic oligonucleotide
  Target: SCN10A; (+) strand; PAM type: YTN; PAM sequence: TTT
tatttgttttcttttttttt

SEQ ID NO: 65866 - DNA, 20 bp, Artificial Sequence
  Description of Artificial Sequence: Synthetic oligonucleotide
  Target: SCN10A; (+) strand; PAM type: YTN; PAM sequence: TTT
atttgttttctttttttttc

SEQ ID NO: 65867 - DNA, 20 bp, Artificial Sequence
  Description of Artificial Sequence: Synthetic oligonucleotide
  Target: SCN10A; (+) strand; PAM type: YTN; PAM sequence: TTA
tttgttttctttttttttca

SEQ ID NO: 65868 - DNA, 20 bp, Artificial Sequence
  Description of Artificial Sequence: Synthetic oligonucleotide
  Target: SCN10A; (+) strand; PAM type: YTN; PAM sequence: TTT
gttttctttttttttcaatt

SEQ ID NO: 65869 - DNA, 20 bp, Artificial Sequence
  Description of Artificial Sequence: Synthetic oligonucleotide
  Target: SCN10A; (+) strand; PAM type: YTN; PAM sequence: TTG
ttttctttttttttcaattt

SEQ ID NO: 65870 - DNA, 20 bp, Artificial Sequence
  Description of Artificial Sequence: Synthetic oligonucleotide
  Target: SCN10A; (+) strand; PAM type: YTN; PAM sequence: TTT
tctttttttttcaattttct

SEQ ID NO: 65871 - DNA, 20 bp, Artificial Sequence
  Description of Artificial Sequence: Synthetic oligonucleotide
  Target: SCN10A; (+) strand; PAM type: YTN; PAM sequence: TTT
ctttttttttcaattttctt

SEQ ID NO: 65872 - DNA, 20 bp, Artificial Sequence
  Description of Artificial Sequence: Synthetic oligonucleotide
  Target: SCN10A; (+) strand; PAM type: YTN; PAM sequence: TTC
tttttttttcaattttcttc

SEQ ID NO: 65873 - DNA, 20 bp, Artificial Sequence
  Description of Artificial Sequence: Synthetic oligonucleotide
  Target: SCN10A; (+) strand; PAM type: YTN; PAM sequence: CTT
tttttttcaattttcttcat

SEQ ID NO: 65874 - DNA, 20 bp, Artificial Sequence
  Description of Artificial Sequence: Synthetic oligonucleotide
  Target: SCN10A; (+) strand; PAM type: YTN; PAM sequence: TTT
ttttttcaattttcttcatt

SEQ ID NO: 65875 - DNA, 20 bp, Artificial Sequence
  Description of Artificial Sequence: Synthetic oligonucleotide
  Target: SCN10A; (+) strand; PAM type: YTN; PAM sequence: TTT
tttttcaattttcttcattt

SEQ ID NO: 65876 - DNA, 20 bp, Artificial Sequence
  Description of Artificial Sequence: Synthetic oligonucleotide
  Target: SCN10A; (+) strand; PAM type: YTN; PAM sequence: TTT
ttttcaattttcttcatttt

SEQ ID NO: 65877 - DNA, 20 bp, Artificial Sequence
  Description of Artificial Sequence: Synthetic oligonucleotide
  Target: SCN10A; (+) strand; PAM type: YTN; PAM sequence: TTT
tttcaattttcttcattttt

SEQ ID NO: 65878 - DNA, 20 bp, Artificial Sequence
  Description of Artificial Sequence: Synthetic oligonucleotide
  Target: SCN10A; (+) strand; PAM type: YTN; PAM sequence: TTT
ttcaattttcttcatttttt

SEQ ID NO: 65879 - DNA, 20 bp, Artificial Sequence
  Description of Artificial Sequence: Synthetic oligonucleotide
  Target: SCN10A; (+) strand; PAM type: YTN; PAM sequence: TTT
tcaattttcttcattttttt

SEQ ID NO: 65880 - DNA, 20 bp, Artificial Sequence
  Description of Artificial Sequence: Synthetic oligonucleotide
  Target: SCN10A; (+) strand; PAM type: YTN; PAM sequence: TTT
caattttcttcattttttta

SEQ ID NO: 65881 - DNA, 20 bp, Artificial Sequence
  Description of Artificial Sequence: Synthetic oligonucleotide
  Target: SCN10A; (+) strand; PAM type: YTN; PAM sequence: TTC
aattttcttcatttttttat

SEQ ID NO: 65882 - DNA, 20 bp, Artificial Sequence
  Description of Artificial Sequence: Synthetic oligonucleotide
  Target: SCN10A; (+) strand; PAM type: YTN; PAM sequence: TTT
tcttcatttttttattttaa

SEQ ID NO: 65883 - DNA, 20 bp, Artificial Sequence
  Description of Artificial Sequence: Synthetic oligonucleotide
  Target: SCN10A; (+) strand; PAM type: YTN; PAM sequence: TTT
cttcatttttttattttaaa

SEQ ID NO: 65884 - DNA, 20 bp, Artificial Sequence
  Description of Artificial Sequence: Synthetic oligonucleotide
  Target: SCN10A; (+) strand; PAM type: YTN; PAM sequence: TTC
ttcatttttttattttaaat

SEQ ID NO: 65885 - DNA, 20 bp, Artificial Sequence
  Description of Artificial Sequence: Synthetic oligonucleotide
  Target: SCN10A; (+) strand; PAM type: YTN; PAM sequence: CTT
catttttttattttaaattt

SEQ ID NO: 65886 - DNA, 20 bp, Artificial Sequence
  Description of Artificial Sequence: Synthetic oligonucleotide
  Target: SCN10A; (+) strand; PAM type: YTN; PAM sequence: TTC
atttttttattttaaatttt

SEQ ID NO: 65887 - DNA, 20 bp, Artificial Sequence
  Description of Artificial Sequence: Synthetic oligonucleotide
  Target: SCN10A; (+) strand; PAM type: YTN; PAM sequence: TTT
ttttattttaaatttttttc

SEQ ID NO: 65888 - DNA, 20 bp, Artificial Sequence
  Description of Artificial Sequence: Synthetic oligonucleotide
  Target: SCN10A; (+) strand; PAM type: YTN; PAM sequence: TTT
tttattttaaatttttttct

SEQ ID NO: 65889 - DNA, 20 bp, Artificial Sequence
  Description of Artificial Sequence: Synthetic oligonucleotide
  Target: SCN10A; (+) strand; PAM type: YTN; PAM sequence: TTT
ttattttaaatttttttctt

SEQ ID NO: 65890 - DNA, 20 bp, Artificial Sequence
  Description of Artificial Sequence: Synthetic oligonucleotide
  Target: SCN10A; (+) strand; PAM type: YTN; PAM sequence: TTT
tattttaaatttttttcttt

SEQ ID NO: 65891 - DNA, 20 bp, Artificial Sequence
  Description of Artificial Sequence: Synthetic oligonucleotide
  Target: SCN10A; (+) strand; PAM type: YTN; PAM sequence: TTT
attttaaatttttttctttt

SEQ ID NO: 65892 - DNA, 20 bp, Artificial Sequence
  Description of Artificial Sequence: Synthetic oligonucleotide
  Target: SCN10A; (+) strand; PAM type: YTN; PAM sequence: TTA
ttttaaatttttttcttttt

SEQ ID NO: 65893 - DNA, 20 bp, Artificial Sequence
  Description of Artificial Sequence: Synthetic oligonucleotide
  Target: SCN10A; (+) strand; PAM type: YTN; PAM sequence: TTT
taaatttttttcttttttta

SEQ ID NO: 65894 - DNA, 20 bp, Artificial Sequence
  Description of Artificial Sequence: Synthetic oligonucleotide
  Target: SCN10A; (+) strand; PAM type: YTN; PAM sequence: TTT
aaatttttttctttttttaa

SEQ ID NO: 65895 - DNA, 20 bp, Artificial Sequence
  Description of Artificial Sequence: Synthetic oligonucleotide
  Target: SCN10A; (+) strand; PAM type: YTN; PAM sequence: TTA
aatttttttctttttttaaa

SEQ ID NO: 65896 - DNA, 20 bp, Artificial Sequence
  Description of Artificial Sequence: Synthetic oligonucleotide
  Target: SCN10A; (+) strand; PAM type: YTN; PAM sequence: TTT
ttttctttttttaaattata

SEQ ID NO: 65897 - DNA, 20 bp, Artificial Sequence
  Description of Artificial Sequence: Synthetic oligonucleotide
  Target: SCN10A; (+) strand; PAM type: YTN; PAM sequence: TTT
tttctttttttaaattatac

SEQ ID NO: 65898 - DNA, 20 bp, Artificial Sequence
  Description of Artificial Sequence: Synthetic oligonucleotide
  Target: SCN10A; (+) strand; PAM type: YTN; PAM sequence: TTT
ttctttttttaaattatact

SEQ ID NO: 65899 - DNA, 20 bp, Artificial Sequence
  Description of Artificial Sequence: Synthetic oligonucleotide
  Target: SCN10A; (+) strand; PAM type: YTN; PAM sequence: TTT
tctttttttaaattatactt

SEQ ID NO: 65900 - DNA, 20 bp, Artificial Sequence
  Description of Artificial Sequence: Synthetic oligonucleotide
  Target: SCN10A; (+) strand; PAM type: YTN; PAM sequence: TTT
ctttttttaaattatacttt

SEQ ID NO: 65901 - DNA, 20 bp, Artificial Sequence
  Description of Artificial Sequence: Synthetic oligonucleotide
  Target: SCN10A; (+) strand; PAM type: YTN; PAM sequence: TTC
tttttttaaattatacttta

SEQ ID NO: 65902 - DNA, 20 bp, Artificial Sequence
  Description of Artificial Sequence: Synthetic oligonucleotide
  Target: SCN10A; (+) strand; PAM type: YTN; PAM sequence: CTT
tttttaaattatactttaag

SEQ ID NO: 65903 - DNA, 20 bp, Artificial Sequence
  Description of Artificial Sequence: Synthetic oligonucleotide
  Target: SCN10A; (+) strand; PAM type: YTN; PAM sequence: TTT
ttttaaattatactttaagt

SEQ ID NO: 65904 - DNA, 20 bp, Artificial Sequence
  Description of Artificial Sequence: Synthetic oligonucleotide
  Target: SCN10A; (+) strand; PAM type: YTN; PAM sequence: TTT
tttaaattatactttaagtt

SEQ ID NO: 65905 - DNA, 20 bp, Artificial Sequence
  Description of Artificial Sequence: Synthetic oligonucleotide
  Target: SCN10A; (+) strand; PAM type: YTN; PAM sequence: TTT
ttaaattatactttaagttt

SEQ ID NO: 65906 - DNA, 20 bp, Artificial Sequence
  Description of Artificial Sequence: Synthetic oligonucleotide
  Target: SCN10A; (+) strand; PAM type: YTN; PAM sequence: TTT
taaattatactttaagtttt

SEQ ID NO: 65907 - DNA, 20 bp, Artificial Sequence
  Description of Artificial Sequence: Synthetic oligonucleotide
  Target: SCN10A; (+) strand; PAM type: YTN; PAM sequence: TTT
aaattatactttaagtttta

SEQ ID NO: 65908 - DNA, 20 bp, Artificial Sequence
  Description of Artificial Sequence: Synthetic oligonucleotide
  Target: SCN10A; (+) strand; PAM type: YTN; PAM sequence: TTA
aattatactttaagttttag

SEQ ID NO: 65909 - DNA, 20 bp, Artificial Sequence
  Description of Artificial Sequence: Synthetic oligonucleotide
  Target: SCN10A; (+) strand; PAM type: YTN; PAM sequence: TTA
tactttaagttttagggtaa

SEQ ID NO: 65910 - DNA, 20 bp, Artificial Sequence
  Description of Artificial Sequence: Synthetic oligonucleotide
  Target: SCN10A; (+) strand; PAM type: YTN; PAM sequence: CTT
taagttttagggtaaatgtg

SEQ ID NO: 65911 - DNA, 20 bp, Artificial Sequence
  Description of Artificial Sequence: Synthetic oligonucleotide
  Target: SCN10A; (+) strand; PAM type: YTN; PAM sequence: TTT
aagttttagggtaaatgtgc

SEQ ID NO: 65912 - DNA, 20 bp, Artificial Sequence
  Description of Artificial Sequence: Synthetic oligonucleotide
  Target: SCN10A; (+) strand; PAM type: YTN; PAM sequence: TTA
agttttagggtaaatgtgca

SEQ ID NO: 65913 - DNA, 20 bp, Artificial Sequence
  Description of Artificial Sequence: Synthetic oligonucleotide
  Target: SCN10A; (+) strand; PAM type: YTN; PAM sequence: TTT
tagggtaaatgtgcacatta

SEQ ID NO: 65914 - DNA, 20 bp, Artificial Sequence
  Description of Artificial Sequence: Synthetic oligonucleotide
  Target: SCN10A; (+) strand; PAM type: YTN; PAM sequence: TTT
agggtaaatgtgcacattat

SEQ ID NO: 65915 - DNA, 20 bp, Artificial Sequence
  Description of Artificial Sequence: Synthetic oligonucleotide
  Target: SCN10A; (+) strand; PAM type: YTN; PAM sequence: TTA
gggtaaatgtgcacattatg

SEQ ID NO: 65916 - DNA, 20 bp, Artificial Sequence
  Description of Artificial Sequence: Synthetic oligonucleotide
  Target: SCN10A; (+) strand; PAM type: YTN; PAM sequence: TTA
tgcaggttagccacatatgc

SEQ ID NO: 65917 - DNA, 20 bp, Artificial Sequence
  Description of Artificial Sequence: Synthetic oligonucleotide
  Target: SCN10A; (+) strand; PAM type: YTN; PAM sequence: TTA
gccacatatgcatacatgcc

SEQ ID NO: 65918 - DNA, 20 bp, Artificial Sequence
  Description of Artificial Sequence: Synthetic oligonucleotide
  Target: SCN10A; (+) strand; PAM type: YTN; PAM sequence: CTT
acatatgaagcttttctcac

SEQ ID NO: 65919 - DNA, 20 bp, Artificial Sequence
  Description of Artificial Sequence: Synthetic oligonucleotide
  Target: SCN10A; (+) strand; PAM type: YTN; PAM sequence: TTA
catatgaagcttttctcact

SEQ ID NO: 65920 - DNA, 20 bp, Artificial Sequence
  Description of Artificial Sequence: Synthetic oligonucleotide
  Target: SCN10A; (+) strand; PAM type: YTN; PAM sequence: CTT
ttctcactacaaggcttgga

SEQ ID NO: 65921 - DNA, 20 bp, Artificial Sequence
  Description of Artificial Sequence: Synthetic oligonucleotide
  Target: SCN10A; (+) strand; PAM type: YTN; PAM sequence: TTT
tctcactacaaggcttggaa

SEQ ID NO: 65922 - DNA, 20 bp, Artificial Sequence
  Description of Artificial Sequence: Synthetic oligonucleotide
  Target: SCN10A; (+) strand; PAM type: YTN; PAM sequence: TTT
ctcactacaaggcttggaaa

SEQ ID NO: 65923 - DNA, 20 bp, Artificial Sequence
  Description of Artificial Sequence: Synthetic oligonucleotide
  Target: SCN10A; (+) strand; PAM type: YTN; PAM sequence: TTC
tcactacaaggcttggaaaa

SEQ ID NO: 65924 - DNA, 20 bp, Artificial Sequence
  Description of Artificial Sequence: Synthetic oligonucleotide
  Target: SCN10A; (+) strand; PAM type: YTN; PAM sequence: CTC
actacaaggcttggaaaata

SEQ ID NO: 65925 - DNA, 20 bp, Artificial Sequence
  Description of Artificial Sequence: Synthetic oligonucleotide
  Target: SCN10A; (+) strand; PAM type: YTN; PAM sequence: CTA
caaggcttggaaaatacctt

SEQ ID NO: 65926 - DNA, 20 bp, Artificial Sequence
  Description of Artificial Sequence: Synthetic oligonucleotide
  Target: SCN10A; (+) strand; PAM type: YTN; PAM sequence: CTT
ggaaaataccttctccatgt

SEQ ID NO: 65927 - DNA, 20 bp, Artificial Sequence
  Description of Artificial Sequence: Synthetic oligonucleotide
  Target: SCN10A; (+) strand; PAM type: YTN; PAM sequence: TTG
gaaaataccttctccatgtt

SEQ ID NO: 65928 - DNA, 20 bp, Artificial Sequence
  Description of Artificial Sequence: Synthetic oligonucleotide
  Target: SCN10A; (+) strand; PAM type: YTN; PAM sequence: CTT
ctccatgtttttttctttct

SEQ ID NO: 65929 - DNA, 20 bp, Artificial Sequence
  Description of Artificial Sequence: Synthetic oligonucleotide
  Target: SCN10A; (+) strand; PAM type: YTN; PAM sequence: TTC
tccatgtttttttctttctt

SEQ ID NO: 65930 - DNA, 20 bp, Artificial Sequence
  Description of Artificial Sequence: Synthetic oligonucleotide
  Target: SCN10A; (+) strand; PAM type: YTN; PAM sequence: CTC
catgtttttttctttctttt

SEQ ID NO: 65931 - DNA, 20 bp, Artificial Sequence
  Description of Artificial Sequence: Synthetic oligonucleotide
  Target: SCN10A; (+) strand; PAM type: YTN; PAM sequence: TTT
ttttctttcttttgtagttt

SEQ ID NO: 65932 - DNA, 20 bp, Artificial Sequence
  Description of Artificial Sequence: Synthetic oligonucleotide
  Target: SCN10A; (+) strand; PAM type: YTN; PAM sequence: TTT
tttctttcttttgtagtttc

SEQ ID NO: 65933 - DNA, 20 bp, Artificial Sequence
  Description of Artificial Sequence: Synthetic oligonucleotide
  Target: SCN10A; (+) strand; PAM type: YTN; PAM sequence: TTT
ttctttcttttgtagtttca

SEQ ID NO: 65934 - DNA, 20 bp, Artificial Sequence
  Description of Artificial Sequence: Synthetic oligonucleotide
  Target: SCN10A; (+) strand; PAM type: YTN; PAM sequence: TTT
tctttcttttgtagtttcac

SEQ ID NO: 65935 - DNA, 20 bp, Artificial Sequence
  Description of Artificial Sequence: Synthetic oligonucleotide
  Target: SCN10A; (+) strand; PAM type: YTN; PAM sequence: TTT
ctttcttttgtagtttcact

SEQ ID NO: 65936 - DNA, 20 bp, Artificial Sequence
  Description of Artificial Sequence: Synthetic oligonucleotide
  Target: SCN10A; (+) strand; PAM type: YTN; PAM sequence: TTC
tttcttttgtagtttcactt

SEQ ID NO: 65937 - DNA, 20 bp, Artificial Sequence
  Description of Artificial Sequence: Synthetic oligonucleotide
  Target: SCN10A; (+) strand; PAM type: YTN; PAM sequence: CTT
tcttttgtagtttcactttt

SEQ ID NO: 65938 - DNA, 20 bp, Artificial Sequence
  Description of Artificial Sequence: Synthetic oligonucleotide
  Target: SCN10A; (+) strand; PAM type: YTN; PAM sequence: TTT
cttttgtagtttcacttttt

SEQ ID NO: 65939 - DNA, 20 bp, Artificial Sequence
  Description of Artificial Sequence: Synthetic oligonucleotide
  Target: SCN10A; (+) strand; PAM type: YTN; PAM sequence: TTC
ttttgtagtttcactttttt

SEQ ID NO: 65940 - DNA, 20 bp, Artificial Sequence
  Description of Artificial Sequence: Synthetic oligonucleotide
  Target: SCN10A; (+) strand; PAM type: YTN; PAM sequence: CTT
ttgtagtttcacttttttca

SEQ ID NO: 65941 - DNA, 20 bp, Artificial Sequence
  Description of Artificial Sequence: Synthetic oligonucleotide
  Target: SCN10A; (+) strand; PAM type: YTN; PAM sequence: TTT
tgtagtttcacttttttcac

SEQ ID NO: 65942 - DNA, 20 bp, Artificial Sequence
  Description of Artificial Sequence: Synthetic oligonucleotide
  Target: SCN10A; (+) strand; PAM type: YTN; PAM sequence: TTT
gtagtttcacttttttcact

SEQ ID NO: 65943 - DNA, 20 bp, Artificial Sequence
  Description of Artificial Sequence: Synthetic oligonucleotide
  Target: SCN10A; (+) strand; PAM type: YTN; PAM sequence: TTG
tagtttcacttttttcactt

SEQ ID NO: 65944 - DNA, 20 bp, Artificial Sequence
  Description of Artificial Sequence: Synthetic oligonucleotide
  Target: SCN10A; (+) strand; PAM type: YTN; PAM sequence: TTT
cacttttttcacttaaaact

SEQ ID NO: 65945 - DNA, 20 bp, Artificial Sequence
  Description of Artificial Sequence: Synthetic oligonucleotide
  Target: SCN10A; (+) strand; PAM type: YTN; PAM sequence: TTC
acttttttcacttaaaactt

SEQ ID NO: 65946 - DNA, 20 bp, Artificial Sequence
  Description of Artificial Sequence: Synthetic oligonucleotide
  Target: SCN10A; (+) strand; PAM type: YTN; PAM sequence: CTT
ttttcacttaaaactttggt

SEQ ID NO: 65947 - DNA, 20 bp, Artificial Sequence
  Description of Artificial Sequence: Synthetic oligonucleotide
  Target: SCN10A; (+) strand; PAM type: YTN; PAM sequence: TTT
tttcacttaaaactttggtg

SEQ ID NO: 65948 - DNA, 20 bp, Artificial Sequence
  Description of Artificial Sequence: Synthetic oligonucleotide
  Target: SCN10A; (+) strand; PAM type: YTN; PAM sequence: TTT
ttcacttaaaactttggtgc

SEQ ID NO: 65949 - DNA, 20 bp, Artificial Sequence
  Description of Artificial Sequence: Synthetic oligonucleotide
  Target: SCN10A; (+) strand; PAM type: YTN; PAM sequence: TTT
tcacttaaaactttggtgca

SEQ ID NO: 65950 - DNA, 20 bp, Artificial Sequence
  Description of Artificial Sequence: Synthetic oligonucleotide
  Target: SCN10A; (+) strand; PAM type: YTN; PAM sequence: TTT
cacttaaaactttggtgcat

SEQ ID NO: 65951 - DNA, 20 bp, Artificial Sequence
  Description of Artificial Sequence: Synthetic oligonucleotide
  Target: SCN10A; (+) strand; PAM type: YTN; PAM sequence: TTC
acttaaaactttggtgcatt

SEQ ID NO: 65952 - DNA, 20 bp, Artificial Sequence
  Description of Artificial Sequence: Synthetic oligonucleotide
  Target: SCN10A; (+) strand; PAM type: YTN; PAM sequence: CTT
aaaactttggtgcatttgaa

SEQ ID NO: 65953 - DNA, 20 bp, Artificial Sequence
  Description of Artificial Sequence: Synthetic oligonucleotide
  Target: SCN10A; (+) strand; PAM type: YTN; PAM sequence: TTA
aaactttggtgcatttgaaa

SEQ ID NO: 65954 - DNA, 20 bp, Artificial Sequence
  Description of Artificial Sequence: Synthetic oligonucleotide
  Target: SCN10A; (+) strand; PAM type: YTN; PAM sequence: CTT
tggtgcatttgaaatttatt

SEQ ID NO: 65955 - DNA, 20 bp, Artificial Sequence
  Description of Artificial Sequence: Synthetic oligonucleotide
  Target: SCN10A; (+) strand; PAM type: YTN; PAM sequence: TTT
ggtgcatttgaaatttattt

SEQ ID NO: 65956 - DNA, 20 bp, Artificial Sequence
  Description of Artificial Sequence: Synthetic oligonucleotide
  Target: SCN10A; (+) strand; PAM type: YTN; PAM sequence: TTG
gtgcatttgaaatttatttt

SEQ ID NO: 65957 - DNA, 20 bp, Artificial Sequence
  Description of Artificial Sequence: Synthetic oligonucleotide
  Target: SCN10A; (+) strand; PAM type: YTN; PAM sequence: TTT
gaaatttattttgggtaaag

SEQ ID NO: 65958 - DNA, 20 bp, Artificial Sequence
  Description of Artificial Sequence: Synthetic oligonucleotide
  Target: SCN10A; (+) strand; PAM type: YTN; PAM sequence: TTG
aaatttattttgggtaaaga

SEQ ID NO: 65959 - DNA, 20 bp, Artificial Sequence
  Description of Artificial Sequence: Synthetic oligonucleotide
  Target: SCN10A; (+) strand; PAM type: YTN; PAM sequence: TTT
attttgggtaaagagtaaga

SEQ ID NO: 65960 - DNA, 20 bp, Artificial Sequence
  Description of Artificial Sequence: Synthetic oligonucleotide
  Target: SCN10A; (+) strand; PAM type: YTN; PAM sequence: TTA
ttttgggtaaagagtaagat

SEQ ID NO: 65961 - DNA, 20 bp, Artificial Sequence
  Description of Artificial Sequence: Synthetic oligonucleotide
  Target: SCN10A; (+) strand; PAM type: YTN; PAM sequence: TTT
tgggtaaagagtaagatatt

SEQ ID NO: 65962 - DNA, 20 bp, Artificial Sequence
  Description of Artificial Sequence: Synthetic oligonucleotide
  Target: SCN10A; (+) strand; PAM type: YTN; PAM sequence: TTT
gggtaaagagtaagatattg

SEQ ID NO: 65963 - DNA, 20 bp, Artificial Sequence
  Description of Artificial Sequence: Synthetic oligonucleotide
  Target: SCN10A; (+) strand; PAM type: YTN; PAM sequence: TTG
ggtaaagagtaagatattga

SEQ ID NO: 65964 - DNA, 20 bp, Artificial Sequence
  Description of Artificial Sequence: Synthetic oligonucleotide
  Target: SCN10A; (+) strand; PAM type: YTN; PAM sequence: TTG
atgtggtttattttttcctg

SEQ ID NO: 65965 - DNA, 20 bp, Artificial Sequence
  Description of Artificial Sequence: Synthetic oligonucleotide
  Target: SCN10A; (+) strand; PAM type: YTN; PAM sequence: TTT
attttttcctgtctctgatt

SEQ ID NO: 65966 - DNA, 20 bp, Artificial Sequence
  Description of Artificial Sequence: Synthetic oligonucleotide
  Target: SCN10A; (+) strand; PAM type: YTN; PAM sequence: TTA
ttttttcctgtctctgatta

SEQ ID NO: 65967 - DNA, 20 bp, Artificial Sequence
  Description of Artificial Sequence: Synthetic oligonucleotide
  Target: SCN10A; (+) strand; PAM type: YTN; PAM sequence: TTT
tttcctgtctctgattattt

SEQ ID NO: 65968 - DNA, 20 bp, Artificial Sequence
  Description of Artificial Sequence: Synthetic oligonucleotide
  Target: SCN10A; (+) strand; PAM type: YTN; PAM sequence: TTT
ttcctgtctctgattattta

SEQ ID NO: 65969 - DNA, 20 bp, Artificial Sequence
  Description of Artificial Sequence: Synthetic oligonucleotide
  Target: SCN10A; (+) strand; PAM type: YTN; PAM sequence: TTT
tcctgtctctgattatttat

SEQ ID NO: 65970 - DNA, 20 bp, Artificial Sequence
  Description of Artificial Sequence: Synthetic oligonucleotide
  Target: SCN10A; (+) strand; PAM type: YTN; PAM sequence: TTT
cctgtctctgattatttata

SEQ ID NO: 65971 - DNA, 20 bp, Artificial Sequence
  Description of Artificial Sequence: Synthetic oligonucleotide
  Target: SCN10A; (+) strand; PAM type: YTN; PAM sequence: TTC
ctgtctctgattatttatat

SEQ ID NO: 65972 - DNA, 20 bp, Artificial Sequence
  Description of Artificial Sequence: Synthetic oligonucleotide
  Target: SCN10A; (+) strand; PAM type: YTN; PAM sequence: CTG
tctctgattatttatatcaa

SEQ ID NO: 65973 - DNA, 20 bp, Artificial Sequence
  Description of Artificial Sequence: Synthetic oligonucleotide
  Target: SCN10A; (+) strand; PAM type: YTN; PAM sequence: CTC
tgattatttatatcaacatt

SEQ ID NO: 65974 - DNA, 20 bp, Artificial Sequence
  Description of Artificial Sequence: Synthetic oligonucleotide
  Target: SCN10A; (+) strand; PAM type: YTN; PAM sequence: CTG
attatttatatcaacattac

SEQ ID NO: 65975 - DNA, 20 bp, Artificial Sequence
  Description of Artificial Sequence: Synthetic oligonucleotide
  Target: SCN10A; (+) strand; PAM type: YTN; PAM sequence: TTA
tttatatcaacattacttat

SEQ ID NO: 65976 - DNA, 20 bp, Artificial Sequence
  Description of Artificial Sequence: Synthetic oligonucleotide
  Target: SCN10A; (+) strand; PAM type: YTN; PAM sequence: TTT
atatcaacattacttattga

SEQ ID NO: 65977 - DNA, 20 bp, Artificial Sequence
  Description of Artificial Sequence: Synthetic oligonucleotide
  Target: SCN10A; (+) strand; PAM type: YTN; PAM sequence: TTA
tatcaacattacttattgaa

SEQ ID NO: 65978 - DNA, 20 bp, Artificial Sequence
  Description of Artificial Sequence: Synthetic oligonucleotide
  Target: SCN10A; (+) strand; PAM type: YTN; PAM sequence: TTA
cttattgaataatttttcat

SEQ ID NO: 65979 - DNA, 20 bp, Artificial Sequence
  Description of Artificial Sequence: Synthetic oligonucleotide
  Target: SCN10A; (+) strand; PAM type: YTN; PAM sequence: CTT
attgaataatttttcatttt

SEQ ID NO: 65980 - DNA, 20 bp, Artificial Sequence
  Description of Artificial Sequence: Synthetic oligonucleotide
  Target: SCN10A; (+) strand; PAM type: YTN; PAM sequence: TTA
ttgaataatttttcattttc

SEQ ID NO: 65981 - DNA, 20 bp, Artificial Sequence
  Description of Artificial Sequence: Synthetic oligonucleotide
  Target: SCN10A; (+) strand; PAM type: YTN; PAM sequence: TTG
aataatttttcattttccca

SEQ ID NO: 65982 - DNA, 20 bp, Artificial Sequence
  Description of Artificial Sequence: Synthetic oligonucleotide
  Target: SCN10A; (+) strand; PAM type: YTN; PAM sequence: TTT
ttcattttcccaagatttga

SEQ ID NO: 65983 - DNA, 20 bp, Artificial Sequence
  Description of Artificial Sequence: Synthetic oligonucleotide
  Target: SCN10A; (+) strand; PAM type: YTN; PAM sequence: TTT
tcattttcccaagatttgaa

SEQ ID NO: 65984 - DNA, 20 bp, Artificial Sequence
  Description of Artificial Sequence: Synthetic oligonucleotide
  Target: SCN10A; (+) strand; PAM type: YTN; PAM sequence: TTT
cattttcccaagatttgaaa

SEQ ID NO: 65985 - DNA, 20 bp, Artificial Sequence
  Description of Artificial Sequence: Synthetic oligonucleotide
  Target: SCN10A; (+) strand; PAM type: YTN; PAM sequence: TTC
attttcccaagatttgaaat

SEQ ID NO: 65986 - DNA, 20 bp, Artificial Sequence
  Description of Artificial Sequence: Synthetic oligonucleotide
  Target: SCN10A; (+) strand; PAM type: YTN; PAM sequence: TTT
tcccaagatttgaaatgtca

SEQ ID NO: 65987 - DNA, 20 bp, Artificial Sequence
  Description of Artificial Sequence: Synthetic oligonucleotide
  Target: SCN10A; (+) strand; PAM type: YTN; PAM sequence: TTT
cccaagatttgaaatgtcat

SEQ ID NO: 65988 - DNA, 20 bp, Artificial Sequence
  Description of Artificial Sequence: Synthetic oligonucleotide
  Target: SCN10A; (+) strand; PAM type: YTN; PAM sequence: TTC
ccaagatttgaaatgtcatt

SEQ ID NO: 65989 - DNA, 20 bp, Artificial Sequence
  Description of Artificial Sequence: Synthetic oligonucleotide
  Target: SCN10A; (+) strand; PAM type: YTN; PAM sequence: TTT
gaaatgtcatttttgtcatg

SEQ ID NO: 65990 - DNA, 20 bp, Artificial Sequence
  Description of Artificial Sequence: Synthetic oligonucleotide
  Target: SCN10A; (+) strand; PAM type: YTN; PAM sequence: TTG
aaatgtcatttttgtcatgt

SEQ ID NO: 65991 - DNA, 20 bp, Artificial Sequence
  Description of Artificial Sequence: Synthetic oligonucleotide
  Target: SCN10A; (+) strand; PAM type: YTN; PAM sequence: TTT
ttgtcatgttattaccattt

SEQ ID NO: 65992 - DNA, 20 bp, Artificial Sequence
  Description of Artificial Sequence: Synthetic oligonucleotide
  Target: SCN10A; (+) strand; PAM type: YTN; PAM sequence: TTT
tgtcatgttattaccattta

SEQ ID NO: 65993 - DNA, 20 bp, Artificial Sequence
  Description of Artificial Sequence: Synthetic oligonucleotide
  Target: SCN10A; (+) strand; PAM type: YTN; PAM sequence: TTT
gtcatgttattaccatttat

SEQ ID NO: 65994 - DNA, 20 bp, Artificial Sequence
  Description of Artificial Sequence: Synthetic oligonucleotide
  Target: SCN10A; (+) strand; PAM type: YTN; PAM sequence: TTG
tcatgttattaccatttatg

SEQ ID NO: 65995 - DNA, 20 bp, Artificial Sequence
  Description of Artificial Sequence: Synthetic oligonucleotide
  Target: SCN10A; (+) strand; PAM type: YTN; PAM sequence: TTA
ttaccatttatgttcatgtg

SEQ ID NO: 65996 - DNA, 20 bp, Artificial Sequence
  Description of Artificial Sequence: Synthetic oligonucleotide
  Target: SCN10A; (+) strand; PAM type: YTN; PAM sequence: TTA
ccatttatgttcatgtgttt

SEQ ID NO: 65997 - DNA, 20 bp, Artificial Sequence
  Description of Artificial Sequence: Synthetic oligonucleotide
  Target: SCN10A; (+) strand; PAM type: YTN; PAM sequence: TTT
atgttcatgtgttttcatat

SEQ ID NO: 65998 - DNA, 20 bp, Artificial Sequence
  Description of Artificial Sequence: Synthetic oligonucleotide
  Target: SCN10A; (+) strand; PAM type: YTN; PAM sequence: TTA
tgttcatgtgttttcatata

SEQ ID NO: 65999 - DNA, 20 bp, Artificial Sequence
  Description of Artificial Sequence: Synthetic oligonucleotide
  Target: SCN10A; (+) strand; PAM type: YTN; PAM sequence: TTC
atgtgttttcatatacacat

SEQ ID NO: 66000 - DNA, 20 bp, Artificial Sequence
  Description of Artificial Sequence: Synthetic oligonucleotide
  Target: SCN10A; (+) strand; PAM type: YTN; PAM sequence: TTT
tcatatacacatgtccattt

SEQ ID NO: 66001 - DNA, 20 bp, Artificial Sequence
  Description of Artificial Sequence: Synthetic oligonucleotide
  Target: SCN10A; (+) strand; PAM type: YTN; PAM sequence: TTT
catatacacatgtccatttc

SEQ ID NO: 66002 - DNA, 20 bp, Artificial Sequence
  Description of Artificial Sequence: Synthetic oligonucleotide
  Target: SCN10A; (+) strand; PAM type: YTN; PAM sequence: TTC
atatacacatgtccatttct

SEQ ID NO: 66003 - DNA, 20 bp, Artificial Sequence
  Description of Artificial Sequence: Synthetic oligonucleotide
  Target: SCN10A; (+) strand; PAM type: YTN; PAM sequence: TTT
ctcttccacagatcagacta

SEQ ID NO: 66004 - DNA, 20 bp, Artificial Sequence
  Description of Artificial Sequence: Synthetic oligonucleotide
  Target: SCN10A; (+) strand; PAM type: YTN; PAM sequence: TTC
tcttccacagatcagactat

SEQ ID NO: 66005 - DNA, 20 bp, Artificial Sequence
  Description of Artificial Sequence: Synthetic oligonucleotide
  Target: SCN10A; (+) strand; PAM type: YTN; PAM sequence: CTC
ttccacagatcagactattt

SEQ ID NO: 66006 - DNA, 20 bp, Artificial Sequence
  Description of Artificial Sequence: Synthetic oligonucleotide
  Target: SCN10A; (+) strand; PAM type: YTN; PAM sequence: CTT
ccacagatcagactatttat

SEQ ID NO: 66007 - DNA, 20 bp, Artificial Sequence
  Description of Artificial Sequence: Synthetic oligonucleotide
  Target: SCN10A; (+) strand; PAM type: YTN; PAM sequence: TTC
cacagatcagactatttatt

SEQ ID NO: 66008 - DNA, 20 bp, Artificial Sequence
  Description of Artificial Sequence: Synthetic oligonucleotide
  Target: SCN10A; (+) strand; PAM type: YTN; PAM sequence: CTA
tttattttcactgtcatgct

SEQ ID NO: 66009 - DNA, 20 bp, Artificial Sequence
  Description of Artificial Sequence: Synthetic oligonucleotide
  Target: SCN10A; (+) strand; PAM type: YTN; PAM sequence: TTT
attttcactgtcatgctgtt

SEQ ID NO: 66010 - DNA, 20 bp, Artificial Sequence
  Description of Artificial Sequence: Synthetic oligonucleotide
  Target: SCN10A; (+) strand; PAM type: YTN; PAM sequence: TTA
ttttcactgtcatgctgttt

SEQ ID NO: 66011 - DNA, 20 bp, Artificial Sequence
  Description of Artificial Sequence: Synthetic oligonucleotide
  Target: SCN10A; (+) strand; PAM type: YTN; PAM sequence: TTT
tcactgtcatgctgttttaa

SEQ ID NO: 66012 - DNA, 20 bp, Artificial Sequence
  Description of Artificial Sequence: Synthetic oligonucleotide
  Target: SCN10A; (+) strand; PAM type: YTN; PAM sequence: TTT
cactgtcatgctgttttaat

SEQ ID NO: 66013 - DNA, 20 bp, Artificial Sequence
  Description of Artificial Sequence: Synthetic oligonucleotide
  Target: SCN10A; (+) strand; PAM type: YTN; PAM sequence: TTC
actgtcatgctgttttaatc

SEQ ID NO: 66014 - DNA, 20 bp, Artificial Sequence
  Description of Artificial Sequence: Synthetic oligonucleotide
  Target: SCN10A; (+) strand; PAM type: YTN; PAM sequence: CTG
tcatgctgttttaatcactg

SEQ ID NO: 66015 - DNA, 20 bp, Artificial Sequence
  Description of Artificial Sequence: Synthetic oligonucleotide
  Target: SCN10A; (+) strand; PAM type: YTN; PAM sequence: CTG
ttttaatcactgactggatt

SEQ ID NO: 66016 - DNA, 20 bp, Artificial Sequence
  Description of Artificial Sequence: Synthetic oligonucleotide
  Target: SCN10A; (+) strand; PAM type: YTN; PAM sequence: TTT
taatcactgactggatttta

SEQ ID NO: 66017 - DNA, 20 bp, Artificial Sequence
  Description of Artificial Sequence: Synthetic oligonucleotide
  Target: SCN10A; (+) strand; PAM type: YTN; PAM sequence: TTT
aatcactgactggattttag

SEQ ID NO: 66018 - DNA, 20 bp, Artificial Sequence
  Description of Artificial Sequence: Synthetic oligonucleotide
  Target: SCN10A; (+) strand; PAM type: YTN; PAM sequence: TTA
atcactgactggattttaga

SEQ ID NO: 66019 - DNA, 20 bp, Artificial Sequence
  Description of Artificial Sequence: Synthetic oligonucleotide
  Target: SCN10A; (+) strand; PAM type: YTN; PAM sequence: CTG
actggattttagaaactaca

SEQ ID NO: 66020 - DNA, 20 bp, Artificial Sequence
  Description of Artificial Sequence: Synthetic oligonucleotide
  Target: SCN10A; (+) strand; PAM type: YTN; PAM sequence: CTG
gattttagaaactacagatg

SEQ ID NO: 66021 - DNA, 20 bp, Artificial Sequence
  Description of Artificial Sequence: Synthetic oligonucleotide
  Target: SCN10A; (+) strand; PAM type: YTN; PAM sequence: TTT
tagaaactacagatgtccaa

SEQ ID NO: 66022 - DNA, 20 bp, Artificial Sequence
  Description of Artificial Sequence: Synthetic oligonucleotide
  Target: SCN10A; (+) strand; PAM type: YTN; PAM sequence: TTT
agaaactacagatgtccaaa

SEQ ID NO: 66023 - DNA, 20 bp, Artificial Sequence
  Description of Artificial Sequence: Synthetic oligonucleotide
  Target: SCN10A; (+) strand; PAM type: YTN; PAM sequence: TTA
gaaactacagatgtccaaac

SEQ ID NO: 66024 - DNA, 20 bp, Artificial Sequence
  Description of Artificial Sequence: Synthetic oligonucleotide
  Target: SCN10A; (+) strand; PAM type: YTN; PAM sequence: CTA
cagatgtccaaactggcaaa

SEQ ID NO: 66025 - DNA, 20 bp, Artificial Sequence
  Description of Artificial Sequence: Synthetic oligonucleotide
  Target: SCN10A; (+) strand; PAM type: YTN; PAM sequence: CTG
gcaaagcatagttctctaaa

SEQ ID NO: 66026 - DNA, 20 bp, Artificial Sequence
  Description of Artificial Sequence: Synthetic oligonucleotide
  Target: SCN10A; (+) strand; PAM type: YTN; PAM sequence: TTC
tctaaagaagttggcacatc

SEQ ID NO: 66027 - DNA, 20 bp, Artificial Sequence
  Description of Artificial Sequence: Synthetic oligonucleotide
  Target: SCN10A; (+) strand; PAM type: YTN; PAM sequence: CTC
taaagaagttggcacatcct

SEQ ID NO: 66028 - DNA, 20 bp, Artificial Sequence
  Description of Artificial Sequence: Synthetic oligonucleotide
  Target: SCN10A; (+) strand; PAM type: YTN; PAM sequence: CTA
aagaagttggcacatcctgg

SEQ ID NO: 66029 - DNA, 20 bp, Artificial Sequence
  Description of Artificial Sequence: Synthetic oligonucleotide
  Target: SCN10A; (+) strand; PAM type: YTN; PAM sequence: TTG
gcacatcctgggaccaaaat

SEQ ID NO: 66030 - DNA, 20 bp, Artificial Sequence
  Description of Artificial Sequence: Synthetic oligonucleotide
  Target: SCN10A; (+) strand; PAM type: YTN; PAM sequence: CTG
ggaccaaaatcaacaatccc

SEQ ID NO: 66031 - DNA, 20 bp, Artificial Sequence
  Description of Artificial Sequence: Synthetic oligonucleotide
  Target: SCN10A; (+) strand; PAM type: YTN; PAM sequence: CTG
tttggaacaaaagcaagaac

SEQ ID NO: 66032 - DNA, 20 bp, Artificial Sequence
  Description of Artificial Sequence: Synthetic oligonucleotide
  Target: SCN10A; (+) strand; PAM type: YTN; PAM sequence: TTT
ggaacaaaagcaagaacttc

SEQ ID NO: 66033 - DNA, 20 bp, Artificial Sequence
  Description of Artificial Sequence: Synthetic oligonucleotide
  Target: SCN10A; (+) strand; PAM type: YTN; PAM sequence: TTG
gaacaaaagcaagaacttcc

SEQ ID NO: 66034 - DNA, 20 bp, Artificial Sequence
  Description of Artificial Sequence: Synthetic oligonucleotide
  Target: SCN10A; (+) strand; PAM type: YTN; PAM sequence: CTT
ccctggacctattttggcac

SEQ ID NO: 66035 - DNA, 20 bp, Artificial Sequence
  Description of Artificial Sequence: Synthetic oligonucleotide
  Target: SCN10A; (+) strand; PAM type: YTN; PAM sequence: TTC
cctggacctattttggcact

SEQ ID NO: 66036 - DNA, 20 bp, Artificial Sequence
  Description of Artificial Sequence: Synthetic oligonucleotide
  Target: SCN10A; (+) strand; PAM type: YTN; PAM sequence: CTG
gacctattttggcactaaaa

SEQ ID NO: 66037 - DNA, 20 bp, Artificial Sequence
  Description of Artificial Sequence: Synthetic oligonucleotide
  Target: SCN10A; (+) strand; PAM type: YTN; PAM sequence: CTA
ttttggcactaaaaagaagc

SEQ ID NO: 66038 - DNA, 20 bp, Artificial Sequence
  Description of Artificial Sequence: Synthetic oligonucleotide
  Target: SCN10A; (+) strand; PAM type: YTN; PAM sequence: TTT
tggcactaaaaagaagcaca

SEQ ID NO: 66039 - DNA, 20 bp, Artificial Sequence
  Description of Artificial Sequence: Synthetic oligonucleotide
  Target: SCN10A; (+) strand; PAM type: YTN; PAM sequence: TTT
ggcactaaaaagaagcacag

SEQ ID NO: 66040 - DNA, 20 bp, Artificial Sequence
  Description of Artificial Sequence: Synthetic oligonucleotide
  Target: SCN10A; (+) strand; PAM type: YTN; PAM sequence: TTG
gcactaaaaagaagcacagg

SEQ ID NO: 66041 - DNA, 20 bp, Artificial Sequence
  Description of Artificial Sequence: Synthetic oligonucleotide
  Target: SCN10A; (+) strand; PAM type: YTN; PAM sequence: CTA
aaaagaagcacaggaagtag

SEQ ID NO: 66042 - DNA, 20 bp, Artificial Sequence
  Description of Artificial Sequence: Synthetic oligonucleotide
  Target: SCN10A; (+) strand; PAM type: YTN; PAM sequence: CTT
tagatgtgccattttggcag

SEQ ID NO: 66043 - DNA, 20 bp, Artificial Sequence
  Description of Artificial Sequence: Synthetic oligonucleotide
  Target: SCN10A; (+) strand; PAM type: YTN; PAM sequence: TTT
agatgtgccattttggcagg

SEQ ID NO: 66044 - DNA, 20 bp, Artificial Sequence
  Description of Artificial Sequence: Synthetic oligonucleotide
  Target: SCN10A; (+) strand; PAM type: YTN; PAM sequence: TTA
gatgtgccattttggcagga

SEQ ID NO: 66045 - DNA, 20 bp, Artificial Sequence
  Description of Artificial Sequence: Synthetic oligonucleotide
  Target: SCN10A; (+) strand; PAM type: YTN; PAM sequence: TTT
tggcaggaagcagccacctg

SEQ ID NO: 66046 - DNA, 20 bp, Artificial Sequence
  Description of Artificial Sequence: Synthetic oligonucleotide
  Target: SCN10A; (+) strand; PAM type: YTN; PAM sequence: TTT
ggcaggaagcagccacctgt

SEQ ID NO: 66047 - DNA, 20 bp, Artificial Sequence
  Description of Artificial Sequence: Synthetic oligonucleotide
  Target: SCN10A; (+) strand; PAM type: YTN; PAM sequence: TTG
gcaggaagcagccacctgtg

SEQ ID NO: 66048 - DNA, 20 bp, Artificial Sequence
  Description of Artificial Sequence: Synthetic oligonucleotide
  Target: SCN10A; (+) strand; PAM type: YTN; PAM sequence: CTG
tgaggcatgatgggaaaaga

SEQ ID NO: 66049 - DNA, 20 bp, Artificial Sequence
  Description of Artificial Sequence: Synthetic oligonucleotide
  Target: SCN10A; (+) strand; PAM type: YTN; PAM sequence: CTT
tgtaaacagccttgacattg

SEQ ID NO: 66050 - DNA, 20 bp, Artificial Sequence
  Description of Artificial Sequence: Synthetic oligonucleotide
  Target: SCN10A; (+) strand; PAM type: YTN; PAM sequence: TTT
gtaaacagccttgacattgt

SEQ ID NO: 66051 - DNA, 20 bp, Artificial Sequence
  Description of Artificial Sequence: Synthetic oligonucleotide
  Target: SCN10A; (+) strand; PAM type: YTN; PAM sequence: TTG
taaacagccttgacattgtt

SEQ ID NO: 66052 - DNA, 20 bp, Artificial Sequence
  Description of Artificial Sequence: Synthetic oligonucleotide
  Target: SCN10A; (+) strand; PAM type: YTN; PAM sequence: CTT
gacattgttgaacttgattg

SEQ ID NO: 66053 - DNA, 20 bp, Artificial Sequence
  Description of Artificial Sequence: Synthetic oligonucleotide
  Target: SCN10A; (+) strand; PAM type: YTN; PAM sequence: TTG
acattgttgaacttgattga

SEQ ID NO: 66054 - DNA, 20 bp, Artificial Sequence
  Description of Artificial Sequence: Synthetic oligonucleotide
  Target: SCN10A; (+) strand; PAM type: YTN; PAM sequence: TTG
ttgaacttgattgattgcag

SEQ ID NO: 66055 - DNA, 20 bp, Artificial Sequence
  Description of Artificial Sequence: Synthetic oligonucleotide
  Target: SCN10A; (+) strand; PAM type: YTN; PAM sequence: TTG
aacttgattgattgcagaga

SEQ ID NO: 66056 - DNA, 20 bp, Artificial Sequence
  Description of Artificial Sequence: Synthetic oligonucleotide
  Target: SCN10A; (+) strand; PAM type: YTN; PAM sequence: CTT
gattgattgcagagacacag

SEQ ID NO: 66057 - DNA, 20 bp, Artificial Sequence
  Description of Artificial Sequence: Synthetic oligonucleotide
  Target: SCN10A; (+) strand; PAM type: YTN; PAM sequence: TTG
attgattgcagagacacaga

SEQ ID NO: 66058 - DNA, 20 bp, Artificial Sequence
  Description of Artificial Sequence: Synthetic oligonucleotide
  Target: SCN10A; (+) strand; PAM type: YTN; PAM sequence: TTG
attgcagagacacagagact

SEQ ID NO: 66059 - DNA, 20 bp, Artificial Sequence
  Description of Artificial Sequence: Synthetic oligonucleotide
  Target: SCN10A; (+) strand; PAM type: YTN; PAM sequence: TTG
cagagacacagagactaaaa

SEQ ID NO: 66060 - DNA, 20 bp, Artificial Sequence
  Description of Artificial Sequence: Synthetic oligonucleotide
  Target: SCN10A; (+) strand; PAM type: YTN; PAM sequence: CTA
aaagtatctacttgccagct

SEQ ID NO: 66061 - DNA, 20 bp, Artificial Sequence
  Description of Artificial Sequence: Synthetic oligonucleotide
  Target: SCN10A; (+) strand; PAM type: YTN; PAM sequence: CTA
cttgccagcttaaaacatga

SEQ ID NO: 66062 - DNA, 20 bp, Artificial Sequence
  Description of Artificial Sequence: Synthetic oligonucleotide
  Target: SCN10A; (+) strand; PAM type: YTN; PAM sequence: CTT
gccagcttaaaacatgacca

SEQ ID NO: 66063 - DNA, 20 bp, Artificial Sequence
  Description of Artificial Sequence: Synthetic oligonucleotide
  Target: SCN10A; (+) strand; PAM type: YTN; PAM sequence: TTG
ccagcttaaaacatgaccat

SEQ ID NO: 66064 - DNA, 20 bp, Artificial Sequence
  Description of Artificial Sequence: Synthetic oligonucleotide
  Target: SCN10A; (+) strand; PAM type: YTN; PAM sequence: CTT
aaaacatgaccatggcccca

SEQ ID NO: 66065 - DNA, 20 bp, Artificial Sequence
  Description of Artificial Sequence: Synthetic oligonucleotide
  Target: SCN10A; (+) strand; PAM type: YTN; PAM sequence: TTA
aaacatgaccatggccccac

SEQ ID NO: 66066 - DNA, 20 bp, Artificial Sequence
  Description of Artificial Sequence: Synthetic oligonucleotide
  Target: SCN10A; (+) strand; PAM type: YTN; PAM sequence: CTC
aaaaggatctcctatataaa

SEQ ID NO: 66067 - DNA, 20 bp, Artificial Sequence
  Description of Artificial Sequence: Synthetic oligonucleotide
  Target: SCN10A; (+) strand; PAM type: YTN; PAM sequence: CTC
ctatataaaattgataacag

SEQ ID NO: 66068 - DNA, 20 bp, Artificial Sequence
  Description of Artificial Sequence: Synthetic oligonucleotide
  Target: SCN10A; (+) strand; PAM type: YTN; PAM sequence: CTA
tataaaattgataacagaga

SEQ ID NO: 66069 - DNA, 20 bp, Artificial Sequence
  Description of Artificial Sequence: Synthetic oligonucleotide
  Target: SCN10A; (+) strand; PAM type: YTN; PAM sequence: TTG
ataacagagagaactttcct

SEQ ID NO: 66070 - DNA, 20 bp, Artificial Sequence
  Description of Artificial Sequence: Synthetic oligonucleotide
  Target: SCN10A; (+) strand; PAM type: YTN; PAM sequence: CTT
tcctcccttcatcctgttac

SEQ ID NO: 66071 - DNA, 20 bp, Artificial Sequence
  Description of Artificial Sequence: Synthetic oligonucleotide
  Target: SCN10A; (+) strand; PAM type: YTN; PAM sequence: TTT
cctcccttcatcctgttacg

SEQ ID NO: 66072 - DNA, 20 bp, Artificial Sequence
  Description of Artificial Sequence: Synthetic oligonucleotide
  Target: SCN10A; (+) strand; PAM type: YTN; PAM sequence: TTC
ctcccttcatcctgttacgc

SEQ ID NO: 66073 - DNA, 20 bp, Artificial Sequence
  Description of Artificial Sequence: Synthetic oligonucleotide
  Target: SCN10A; (+) strand; PAM type: YTN; PAM sequence: CTC
ccttcatcctgttacgctta

SEQ ID NO: 66074 - DNA, 20 bp, Artificial Sequence
  Description of Artificial Sequence: Synthetic oligonucleotide
  Target: SCN10A; (+) strand; PAM type: YTN; PAM sequence: CTT
catcctgttacgcttaaaga

SEQ ID NO: 66075 - DNA, 20 bp, Artificial Sequence
  Description of Artificial Sequence: Synthetic oligonucleotide
  Target: SCN10A; (+) strand; PAM type: YTN; PAM sequence: TTC
atcctgttacgcttaaagag

SEQ ID NO: 66076 - DNA, 20 bp, Artificial Sequence
  Description of Artificial Sequence: Synthetic oligonucleotide
  Target: SCN10A; (+) strand; PAM type: YTN; PAM sequence: CTG
ttacgcttaaagaggtcccc

SEQ ID NO: 66077 - DNA, 20 bp, Artificial Sequence
  Description of Artificial Sequence: Synthetic oligonucleotide
  Target: SCN10A; (+) strand; PAM type: YTN; PAM sequence: TTA
cgcttaaagaggtccccctg

SEQ ID NO: 66078 - DNA, 20 bp, Artificial Sequence
  Description of Artificial Sequence: Synthetic oligonucleotide
  Target: SCN10A; (+) strand; PAM type: YTN; PAM sequence: CTT
aaagaggtccccctgctcct

SEQ ID NO: 66079 - DNA, 20 bp, Artificial Sequence
  Description of Artificial Sequence: Synthetic oligonucleotide
  Target: SCN10A; (+) strand; PAM type: YTN; PAM sequence: TTA
aagaggtccccctgctcctg

SEQ ID NO: 66080 - DNA, 20 bp, Artificial Sequence
  Description of Artificial Sequence: Synthetic oligonucleotide
  Target: SCN10A; (+) strand; PAM type: YTN; PAM sequence: CTG
ctcctgttaacaccagtgtc

SEQ ID NO: 66081 - DNA, 20 bp, Artificial Sequence
  Description of Artificial Sequence: Synthetic oligonucleotide
  Target: SCN10A; (+) strand; PAM type: YTN; PAM sequence: CTC
ctgttaacaccagtgtctcc

SEQ ID NO: 66082 - DNA, 20 bp, Artificial Sequence
  Description of Artificial Sequence: Synthetic oligonucleotide
  Target: SCN10A; (+) strand; PAM type: YTN; PAM sequence: CTG
ttaacaccagtgtctccact

SEQ ID NO: 66083 - DNA, 20 bp, Artificial Sequence
  Description of Artificial Sequence: Synthetic oligonucleotide
  Target: SCN10A; (+) strand; PAM type: YTN; PAM sequence: TTA
acaccagtgtctccactgtg

SEQ ID NO: 66084 - DNA, 20 bp, Artificial Sequence
  Description of Artificial Sequence: Synthetic oligonucleotide
  Target: SCN10A; (+) strand; PAM type: YTN; PAM sequence: CTC
cactgtgcattctctcctgc

SEQ ID NO: 66085 - DNA, 20 bp, Artificial Sequence
  Description of Artificial Sequence: Synthetic oligonucleotide
  Target: SCN10A; (+) strand; PAM type: YTN; PAM sequence: CTG
tgcattctctcctgccactg

SEQ ID NO: 66086 - DNA, 20 bp, Artificial Sequence
  Description of Artificial Sequence: Synthetic oligonucleotide
  Target: SCN10A; (+) strand; PAM type: YTN; PAM sequence: TTC
tctcctgccactgcaggagt

SEQ ID NO: 66087 - DNA, 20 bp, Artificial Sequence
  Description of Artificial Sequence: Synthetic oligonucleotide
  Target: SCN10A; (+) strand; PAM type: YTN; PAM sequence: CTC
tcctgccactgcaggagtct

SEQ ID NO: 66088 - DNA, 20 bp, Artificial Sequence
  Description of Artificial Sequence: Synthetic oligonucleotide
  Target: SCN10A; (+) strand; PAM type: YTN; PAM sequence: CTC
ctgccactgcaggagtctgt

SEQ ID NO: 66089 - DNA, 20 bp, Artificial Sequence
  Description of Artificial Sequence: Synthetic oligonucleotide
  Target: SCN10A; (+) strand; PAM type: YTN; PAM sequence: CTG
ccactgcaggagtctgttga

SEQ ID NO: 66090 - DNA, 20 bp, Artificial Sequence
  Description of Artificial Sequence: Synthetic oligonucleotide
  Target: SCN10A; (+) strand; PAM type: YTN; PAM sequence: CTG
caggagtctgttgaatatac

SEQ ID NO: 66091 - DNA, 20 bp, Artificial Sequence
  Description of Artificial Sequence: Synthetic oligonucleotide
  Target: SCN10A; (+) strand; PAM type: YTN; PAM sequence: CTG
ttgaatataccctttcttcc

SEQ ID NO: 66092 - DNA, 20 bp, Artificial Sequence
  Description of Artificial Sequence: Synthetic oligonucleotide
  Target: SCN10A; (+) strand; PAM type: YTN; PAM sequence: TTG
aatataccctttcttccctt

SEQ ID NO: 66093 - DNA, 20 bp, Artificial Sequence
  Description of Artificial Sequence: Synthetic oligonucleotide
  Target: SCN10A; (+) strand; PAM type: YTN; PAM sequence: CTT
tcttcccttaatcttcagtc

SEQ ID NO: 66094 - DNA, 20 bp, Artificial Sequence
  Description of Artificial Sequence: Synthetic oligonucleotide
  Target: SCN10A; (+) strand; PAM type: YTN; PAM sequence: TTT
cttcccttaatcttcagtct

SEQ ID NO: 66095 - DNA, 20 bp, Artificial Sequence
  Description of Artificial Sequence: Synthetic oligonucleotide
  Target: SCN10A; (+) strand; PAM type: YTN; PAM sequence: TTC
ttcccttaatcttcagtctc

SEQ ID NO: 66096 - DNA, 20 bp, Artificial Sequence
  Description of Artificial Sequence: Synthetic oligonucleotide
  Target: SCN10A; (+) strand; PAM type: YTN; PAM sequence: CTT
cccttaatcttcagtctctc

SEQ ID NO: 66097 - DNA, 20 bp, Artificial Sequence
  Description of Artificial Sequence: Synthetic oligonucleotide
  Target: SCN10A; (+) strand; PAM type: YTN; PAM sequence: TTC
ccttaatcttcagtctctct

SEQ ID NO: 66098 - DNA, 20 bp, Artificial Sequence
  Description of Artificial Sequence: Synthetic oligonucleotide
  Target: SCN10A; (+) strand; PAM type: YTN; PAM sequence: CTT
aatcttcagtctctcttatt

SEQ ID NO: 66099 - DNA, 20 bp, Artificial Sequence
  Description of Artificial Sequence: Synthetic oligonucleotide
  Target: SCN10A; (+) strand; PAM type: YTN; PAM sequence: TTA
atcttcagtctctcttattc

SEQ ID NO: 66100 - DNA, 20 bp, Artificial Sequence
  Description of Artificial Sequence: Synthetic oligonucleotide
  Target: SCN10A; (+) strand; PAM type: YTN; PAM sequence: CTT
cagtctctcttattctccca

SEQ ID NO: 66101 - DNA, 20 bp, Artificial Sequence
  Description of Artificial Sequence: Synthetic oligonucleotide
  Target: SCN10A; (+) strand; PAM type: YTN; PAM sequence: TTC
agtctctcttattctcccag

SEQ ID NO: 66102 - DNA, 20 bp, Artificial Sequence
  Description of Artificial Sequence: Synthetic oligonucleotide
  Target: SCN10A; (+) strand; PAM type: YTN; PAM sequence: CTC
tcttattctcccagatcctt

SEQ ID NO: 66103 - DNA, 20 bp, Artificial Sequence
  Description of Artificial Sequence: Synthetic oligonucleotide
  Target: SCN10A; (+) strand; PAM type: YTN; PAM sequence: CTC
ttattctcccagatccttcc

SEQ ID NO: 66104 - DNA, 20 bp, Artificial Sequence
  Description of Artificial Sequence: Synthetic oligonucleotide
  Target: SCN10A; (+) strand; PAM type: YTN; PAM sequence: CTT
attctcccagatccttccca

SEQ ID NO: 66105 - DNA, 20 bp, Artificial Sequence
  Description of Artificial Sequence: Synthetic oligonucleotide
  Target: SCN10A; (+) strand; PAM type: YTN; PAM sequence: TTA
ttctcccagatccttcccat

SEQ ID NO: 66106 - DNA, 20 bp, Artificial Sequence
  Description of Artificial Sequence: Synthetic oligonucleotide
  Target: SCN10A; (+) strand; PAM type: YTN; PAM sequence: TTC
tcccagatccttcccattag

SEQ ID NO: 66107 - DNA, 20 bp, Artificial Sequence
  Description of Artificial Sequence: Synthetic oligonucleotide
  Target: SCN10A; (+) strand; PAM type: YTN; PAM sequence: CTC
ccagatccttcccattagca

SEQ ID NO: 66108 - DNA, 20 bp, Artificial Sequence
  Description of Artificial Sequence: Synthetic oligonucleotide
  Target: SCN10A; (+) strand; PAM type: YTN; PAM sequence: CTT
cccattagcatgcaaatatg

SEQ ID NO: 66109 - DNA, 20 bp, Artificial Sequence
  Description of Artificial Sequence: Synthetic oligonucleotide
  Target: SCN10A; (+) strand; PAM type: YTN; PAM sequence: TTC
ccattagcatgcaaatatgc

SEQ ID NO: 66110 - DNA, 20 bp, Artificial Sequence
  Description of Artificial Sequence: Synthetic oligonucleotide
  Target: SCN10A; (+) strand; PAM type: YTN; PAM sequence: TTA
gcatgcaaatatgctcaaaa

SEQ ID NO: 66111 - DNA, 20 bp, Artificial Sequence
  Description of Artificial Sequence: Synthetic oligonucleotide
  Target: SCN10A; (+) strand; PAM type: YTN; PAM sequence: CTC
aaaacaaacaaacaaacaaa

SEQ ID NO: 66112 - DNA, 20 bp, Artificial Sequence
  Description of Artificial Sequence: Synthetic oligonucleotide
  Target: SCN10A; (+) strand; PAM type: YTN; PAM sequence: CTC
ccccaaacacaaaaaccaaa

SEQ ID NO: 66113 - DNA, 20 bp, Artificial Sequence
  Description of Artificial Sequence: Synthetic oligonucleotide
  Target: SCN10A; (+) strand; PAM type: YTN; PAM sequence: CTT
ctttcaattctccctactcc

SEQ ID NO: 66114 - DNA, 20 bp, Artificial Sequence
  Description of Artificial Sequence: Synthetic oligonucleotide
  Target: SCN10A; (+) strand; PAM type: YTN; PAM sequence: TTC
tttcaattctccctactccc

SEQ ID NO: 66115 - DNA, 20 bp, Artificial Sequence
  Description of Artificial Sequence: Synthetic oligonucleotide
  Target: SCN10A; (+) strand; PAM type: YTN; PAM sequence: CTT
tcaattctccctactcccta

SEQ ID NO: 66116 - DNA, 20 bp, Artificial Sequence
  Description of Artificial Sequence: Synthetic oligonucleotide
  Target: SCN10A; (+) strand; PAM type: YTN; PAM sequence: TTT
caattctccctactccctag

SEQ ID NO: 66117 - DNA, 20 bp, Artificial Sequence
  Description of Artificial Sequence: Synthetic oligonucleotide
  Target: SCN10A; (+) strand; PAM type: YTN; PAM sequence: TTC
aattctccctactccctagt

SEQ ID NO: 66118 - DNA, 20 bp, Artificial Sequence
  Description of Artificial Sequence: Synthetic oligonucleotide
  Target: SCN10A; (+) strand; PAM type: YTN; PAM sequence: TTC
tccctactccctagtgccat

SEQ ID NO: 66119 - DNA, 20 bp, Artificial Sequence
  Description of Artificial Sequence: Synthetic oligonucleotide
  Target: SCN10A; (+) strand; PAM type: YTN; PAM sequence: CTC
cctactccctagtgccatct

SEQ ID NO: 66120 - DNA, 20 bp, Artificial Sequence
  Description of Artificial Sequence: Synthetic oligonucleotide
  Target: SCN10A; (+) strand; PAM type: YTN; PAM sequence: CTA
ctccctagtgccatcttact

SEQ ID NO: 66121 - DNA, 20 bp, Artificial Sequence
  Description of Artificial Sequence: Synthetic oligonucleotide
  Target: SCN10A; (+) strand; PAM type: YTN; PAM sequence: CTC
cctagtgccatcttactatc

SEQ ID NO: 66122 - DNA, 20 bp, Artificial Sequence
  Description of Artificial Sequence: Synthetic oligonucleotide
  Target: SCN10A; (+) strand; PAM type: YTN; PAM sequence: CTA
gtgccatcttactatctcct

SEQ ID NO: 66123 - DNA, 20 bp, Artificial Sequence
  Description of Artificial Sequence: Synthetic oligonucleotide
  Target: SCN10A; (+) strand; PAM type: YTN; PAM sequence: CTT
actatctccttttcctcaca

SEQ ID NO: 66124 - DNA, 20 bp, Artificial Sequence
  Description of Artificial Sequence: Synthetic oligonucleotide
  Target: SCN10A; (+) strand; PAM type: YTN; PAM sequence: TTA
ctatctccttttcctcacag

SEQ ID NO: 66125 - DNA, 20 bp, Artificial Sequence
  Description of Artificial Sequence: Synthetic oligonucleotide
  Target: SCN10A; (+) strand; PAM type: YTN; PAM sequence: CTA
tctccttttcctcacaggca

SEQ ID NO: 66126 - DNA, 20 bp, Artificial Sequence
  Description of Artificial Sequence: Synthetic oligonucleotide
  Target: SCN10A; (+) strand; PAM type: YTN; PAM sequence: CTC
cttttcctcacaggcaaact

SEQ ID NO: 66127 - DNA, 20 bp, Artificial Sequence
  Description of Artificial Sequence: Synthetic oligonucleotide
  Target: SCN10A; (+) strand; PAM type: YTN; PAM sequence: CTT
ttcctcacaggcaaacttct

SEQ ID NO: 66128 - DNA, 20 bp, Artificial Sequence
  Description of Artificial Sequence: Synthetic oligonucleotide
  Target: SCN10A; (+) strand; PAM type: YTN; PAM sequence: TTT
tcctcacaggcaaacttctt

SEQ ID NO: 66129 - DNA, 20 bp, Artificial Sequence
  Description of Artificial Sequence: Synthetic oligonucleotide
  Target: SCN10A; (+) strand; PAM type: YTN; PAM sequence: TTT
cctcacaggcaaacttcttg

SEQ ID NO: 66130 - DNA, 20 bp, Artificial Sequence
  Description of Artificial Sequence: Synthetic oligonucleotide
  Target: SCN10A; (+) strand; PAM type: YTN; PAM sequence: TTC
ctcacaggcaaacttcttga

SEQ ID NO: 66131 - DNA, 20 bp, Artificial Sequence
  Description of Artificial Sequence: Synthetic oligonucleotide
  Target: SCN10A; (+) strand; PAM type: YTN; PAM sequence: CTC
acaggcaaacttcttgaaaa

SEQ ID NO: 66132 - DNA, 20 bp, Artificial Sequence
  Description of Artificial Sequence: Synthetic oligonucleotide
  Target: SCN10A; (+) strand; PAM type: YTN; PAM sequence: CTT
cttgaaaaaattgtctgtac

SEQ ID NO: 66133 - DNA, 20 bp, Artificial Sequence
  Description of Artificial Sequence: Synthetic oligonucleotide
  Target: SCN10A; (+) strand; PAM type: YTN; PAM sequence: TTC
ttgaaaaaattgtctgtaca

SEQ ID NO: 66134 - DNA, 20 bp, Artificial Sequence
  Description of Artificial Sequence: Synthetic oligonucleotide
  Target: SCN10A; (+) strand; PAM type: YTN; PAM sequence: CTT
gaaaaaattgtctgtacacc

SEQ ID NO: 66135 - DNA, 20 bp, Artificial Sequence
  Description of Artificial Sequence: Synthetic oligonucleotide
  Target: SCN10A; (+) strand; PAM type: YTN; PAM sequence: TTG
aaaaaattgtctgtacacca

SEQ ID NO: 66136 - DNA, 20 bp, Artificial Sequence
  Description of Artificial Sequence: Synthetic oligonucleotide
  Target: SCN10A; (+) strand; PAM type: YTN; PAM sequence: TTG
tctgtacaccatatctccat

SEQ ID NO: 66137 - DNA, 20 bp, Artificial Sequence
  Description of Artificial Sequence: Synthetic oligonucleotide
  Target: SCN10A; (+) strand; PAM type: YTN; PAM sequence: CTG
tacaccatatctccatttct

SEQ ID NO: 66138 - DNA, 20 bp, Artificial Sequence
  Description of Artificial Sequence: Synthetic oligonucleotide
  Target: SCN10A; (+) strand; PAM type: YTN; PAM sequence: CTC
catttcttcacctctcaccc

SEQ ID NO: 66139 - DNA, 20 bp, Artificial Sequence
  Description of Artificial Sequence: Synthetic oligonucleotide
  Target: SCN10A; (+) strand; PAM type: YTN; PAM sequence: TTT
cttcacctctcacccgctct

SEQ ID NO: 66140 - DNA, 20 bp, Artificial Sequence
  Description of Artificial Sequence: Synthetic oligonucleotide
  Target: SCN10A; (+) strand; PAM type: YTN; PAM sequence: TTC
ttcacctctcacccgctctt

SEQ ID NO: 66141 - DNA, 20 bp, Artificial Sequence
  Description of Artificial Sequence: Synthetic oligonucleotide
  Target: SCN10A; (+) strand; PAM type: YTN; PAM sequence: CTT
cacctctcacccgctcttta

SEQ ID NO: 66142 - DNA, 20 bp, Artificial Sequence
  Description of Artificial Sequence: Synthetic oligonucleotide
  Target: SCN10A; (+) strand; PAM type: YTN; PAM sequence: TTC
acctctcacccgctctttaa

SEQ ID NO: 66143 - DNA, 20 bp, Artificial Sequence
  Description of Artificial Sequence: Synthetic oligonucleotide
  Target: SCN10A; (+) strand; PAM type: YTN; PAM sequence: CTC
tcacccgctctttaagcccc

SEQ ID NO: 66144 - DNA, 20 bp, Artificial Sequence
  Description of Artificial Sequence: Synthetic oligonucleotide
  Target: SCN10A; (+) strand; PAM type: YTN; PAM sequence: CTC
acccgctctttaagcccctt

SEQ ID NO: 66145 - DNA, 20 bp, Artificial Sequence
  Description of Artificial Sequence: Synthetic oligonucleotide
  Target: SCN10A; (+) strand; PAM type: YTN; PAM sequence: CTC
tttaagccccttcaatatga

SEQ ID NO: 66146 - DNA, 20 bp, Artificial Sequence
  Description of Artificial Sequence: Synthetic oligonucleotide
  Target: SCN10A; (+) strand; PAM type: YTN; PAM sequence: CTT
taagccccttcaatatgacc

SEQ ID NO: 66147 - DNA, 20 bp, Artificial Sequence
  Description of Artificial Sequence: Synthetic oligonucleotide
  Target: SCN10A; (+) strand; PAM type: YTN; PAM sequence: TTT
aagccccttcaatatgacct

SEQ ID NO: 66148 - DNA, 20 bp, Artificial Sequence
  Description of Artificial Sequence: Synthetic oligonucleotide
  Target: SCN10A; (+) strand; PAM type: YTN; PAM sequence: TTA
agccccttcaatatgacctc

SEQ ID NO: 66149 - DNA, 20 bp, Artificial Sequence
  Description of Artificial Sequence: Synthetic oligonucleotide
  Target: SCN10A; (+) strand; PAM type: YTN; PAM sequence: CTT
caatatgacctctgcctacc

SEQ ID NO: 66150 - DNA, 20 bp, Artificial Sequence
  Description of Artificial Sequence: Synthetic oligonucleotide
  Target: SCN10A; (+) strand; PAM type: YTN; PAM sequence: TTC
aatatgacctctgcctaccc

SEQ ID NO: 66151 - DNA, 20 bp, Artificial Sequence
  Description of Artificial Sequence: Synthetic oligonucleotide
  Target: SCN10A; (+) strand; PAM type: YTN; PAM sequence: CTC
tgcctacccttttactccat

SEQ ID NO: 66152 - DNA, 20 bp, Artificial Sequence
  Description of Artificial Sequence: Synthetic oligonucleotide
  Target: SCN10A; (+) strand; PAM type: YTN; PAM sequence: CTG
cctacccttttactccatta

SEQ ID NO: 66153 - DNA, 20 bp, Artificial Sequence
  Description of Artificial Sequence: Synthetic oligonucleotide
  Target: SCN10A; (+) strand; PAM type: YTN; PAM sequence: CTA
cccttttactccattaatcc

SEQ ID NO: 66154 - DNA, 20 bp, Artificial Sequence
  Description of Artificial Sequence: Synthetic oligonucleotide
  Target: SCN10A; (+) strand; PAM type: YTN; PAM sequence: CTT
ttactccattaatcctcttt

SEQ ID NO: 66155 - DNA, 20 bp, Artificial Sequence
  Description of Artificial Sequence: Synthetic oligonucleotide
  Target: SCN10A; (+) strand; PAM type: YTN; PAM sequence: TTT
tactccattaatcctctttt

SEQ ID NO: 66156 - DNA, 20 bp, Artificial Sequence
  Description of Artificial Sequence: Synthetic oligonucleotide
  Target: SCN10A; (+) strand; PAM type: YTN; PAM sequence: TTT
actccattaatcctcttttg

SEQ ID NO: 66157 - DNA, 20 bp, Artificial Sequence
  Description of Artificial Sequence: Synthetic oligonucleotide
  Target: SCN10A; (+) strand; PAM type: YTN; PAM sequence: TTA
ctccattaatcctcttttgc

SEQ ID NO: 66158 - DNA, 20 bp, Artificial Sequence
  Description of Artificial Sequence: Synthetic oligonucleotide
  Target: SCN10A; (+) strand; PAM type: YTN; PAM sequence: CTC
cattaatcctcttttgctta

SEQ ID NO: 66159 - DNA, 20 bp, Artificial Sequence
  Description of Artificial Sequence: Synthetic oligonucleotide
  Target: SCN10A; (+) strand; PAM type: YTN; PAM sequence: TTA
atcctcttttgcttagatca

SEQ ID NO: 66160 - DNA, 20 bp, Artificial Sequence
  Description of Artificial Sequence: Synthetic oligonucleotide
  Target: SCN10A; (+) strand; PAM type: YTN; PAM sequence: CTC
ttttgcttagatcaccaaag

SEQ ID NO: 66161 - DNA, 20 bp, Artificial Sequence
  Description of Artificial Sequence: Synthetic oligonucleotide
  Target: SCN10A; (+) strand; PAM type: YTN; PAM sequence: CTT
ttgcttagatcaccaaagac

SEQ ID NO: 66162 - DNA, 20 bp, Artificial Sequence
  Description of Artificial Sequence: Synthetic oligonucleotide
  Target: SCN10A; (+) strand; PAM type: YTN; PAM sequence: TTT
tgcttagatcaccaaagaca

SEQ ID NO: 66163 - DNA, 20 bp, Artificial Sequence
  Description of Artificial Sequence: Synthetic oligonucleotide
  Target: SCN10A; (+) strand; PAM type: YTN; PAM sequence: TTT
gcttagatcaccaaagacat

SEQ ID NO: 66164 - DNA, 20 bp, Artificial Sequence
  Description of Artificial Sequence: Synthetic oligonucleotide
  Target: SCN10A; (+) strand; PAM type: YTN; PAM sequence: TTG
cttagatcaccaaagacatc

SEQ ID NO: 66165 - DNA, 20 bp, Artificial Sequence
  Description of Artificial Sequence: Synthetic oligonucleotide
  Target: SCN10A; (+) strand; PAM type: YTN; PAM sequence: CTT
agatcaccaaagacatccat

SEQ ID NO: 66166 - DNA, 20 bp, Artificial Sequence
  Description of Artificial Sequence: Synthetic oligonucleotide
  Target: SCN10A; (+) strand; PAM type: YTN; PAM sequence: TTA
gatcaccaaagacatccatg

SEQ ID NO: 66167 - DNA, 20 bp, Artificial Sequence
  Description of Artificial Sequence: Synthetic oligonucleotide
  Target: SCN10A; (+) strand; PAM type: YTN; PAM sequence: CTA
aagcccctggaccttttcat

SEQ ID NO: 66168 - DNA, 20 bp, Artificial Sequence
  Description of Artificial Sequence: Synthetic oligonucleotide
  Target: SCN10A; (+) strand; PAM type: YTN; PAM sequence: CTG
gaccttttcatgtttcattt

SEQ ID NO: 66169 - DNA, 20 bp, Artificial Sequence
  Description of Artificial Sequence: Synthetic oligonucleotide
  Target: SCN10A; (+) strand; PAM type: YTN; PAM sequence: CTT
ttcatgtttcattttacctg

SEQ ID NO: 66170 - DNA, 20 bp, Artificial Sequence
  Description of Artificial Sequence: Synthetic oligonucleotide
  Target: SCN10A; (+) strand; PAM type: YTN; PAM sequence: TTT
tcatgtttcattttacctga

SEQ ID NO: 66171 - DNA, 20 bp, Artificial Sequence
  Description of Artificial Sequence: Synthetic oligonucleotide
  Target: SCN10A; (+) strand; PAM type: YTN; PAM sequence: TTT
catgtttcattttacctgac

SEQ ID NO: 66172 - DNA, 20 bp, Artificial Sequence
  Description of Artificial Sequence: Synthetic oligonucleotide
  Target: SCN10A; (+) strand; PAM type: YTN; PAM sequence: TTC
atgtttcattttacctgacc

SEQ ID NO: 66173 - DNA, 20 bp, Artificial Sequence
  Description of Artificial Sequence: Synthetic oligonucleotide
  Target: SCN10A; (+) strand; PAM type: YTN; PAM sequence: TTT
cattttacctgacctttcca

SEQ ID NO: 66174 - DNA, 20 bp, Artificial Sequence
  Description of Artificial Sequence: Synthetic oligonucleotide
  Target: SCN10A; (+) strand; PAM type: YTN; PAM sequence: TTC
attttacctgacctttccac

SEQ ID NO: 66175 - DNA, 20 bp, Artificial Sequence
  Description of Artificial Sequence: Synthetic oligonucleotide
  Target: SCN10A; (+) strand; PAM type: YTN; PAM sequence: TTT
tacctgacctttccacagca

SEQ ID NO: 66176 - DNA, 20 bp, Artificial Sequence
  Description of Artificial Sequence: Synthetic oligonucleotide
  Target: SCN10A; (+) strand; PAM type: YTN; PAM sequence: TTT
acctgacctttccacagcat

SEQ ID NO: 66177 - DNA, 20 bp, Artificial Sequence
  Description of Artificial Sequence: Synthetic oligonucleotide
  Target: SCN10A; (+) strand; PAM type: YTN; PAM sequence: TTA
cctgacctttccacagcatt

SEQ ID NO: 66178 - DNA, 20 bp, Artificial Sequence
  Description of Artificial Sequence: Synthetic oligonucleotide
  Target: SCN10A; (+) strand; PAM type: YTN; PAM sequence: CTG
acctttccacagcattgcct

SEQ ID NO: 66179 - DNA, 20 bp, Artificial Sequence
  Description of Artificial Sequence: Synthetic oligonucleotide
  Target: SCN10A; (+) strand; PAM type: YTN; PAM sequence: CTT
tccacagcattgcctctgtt

SEQ ID NO: 66180 - DNA, 20 bp, Artificial Sequence
  Description of Artificial Sequence: Synthetic oligonucleotide
  Target: SCN10A; (+) strand; PAM type: YTN; PAM sequence: TTT
ccacagcattgcctctgttg

SEQ ID NO: 66181 - DNA, 20 bp, Artificial Sequence
  Description of Artificial Sequence: Synthetic oligonucleotide
  Target: SCN10A; (+) strand; PAM type: YTN; PAM sequence: TTC
cacagcattgcctctgttgg

SEQ ID NO: 66182 - DNA, 20 bp, Artificial Sequence
  Description of Artificial Sequence: Synthetic oligonucleotide
  Target: SCN10A; (+) strand; PAM type: YTN; PAM sequence: TTG
cctctgttggcctttctatt

SEQ ID NO: 66183 - DNA, 20 bp, Artificial Sequence
  Description of Artificial Sequence: Synthetic oligonucleotide
  Target: SCN10A; (+) strand; PAM type: YTN; PAM sequence: CTC
tgttggcctttctattcttt

SEQ ID NO: 66184 - DNA, 20 bp, Artificial Sequence
  Description of Artificial Sequence: Synthetic oligonucleotide
  Target: SCN10A; (+) strand; PAM type: YTN; PAM sequence: CTG
ttggcctttctattctttct

SEQ ID NO: 66185 - DNA, 20 bp, Artificial Sequence
  Description of Artificial Sequence: Synthetic oligonucleotide
  Target: SCN10A; (+) strand; PAM type: YTN; PAM sequence: TTG
gcctttctattctttctgaa

SEQ ID NO: 66186 - DNA, 20 bp, Artificial Sequence
  Description of Artificial Sequence: Synthetic oligonucleotide
  Target: SCN10A; (+) strand; PAM type: YTN; PAM sequence: CTT
tctattctttctgaagaaat

SEQ ID NO: 66187 - DNA, 20 bp, Artificial Sequence
  Description of Artificial Sequence: Synthetic oligonucleotide
  Target: SCN10A; (+) strand; PAM type: YTN; PAM sequence: TTT
ctattctttctgaagaaatt

SEQ ID NO: 66188 - DNA, 20 bp, Artificial Sequence
  Description of Artificial Sequence: Synthetic oligonucleotide
  Target: SCN10A; (+) strand; PAM type: YTN; PAM sequence: TTC
tattctttctgaagaaattt

SEQ ID NO: 66189 - DNA, 20 bp, Artificial Sequence
  Description of Artificial Sequence: Synthetic oligonucleotide
  Target: SCN10A; (+) strand; PAM type: YTN; PAM sequence: CTA
ttctttctgaagaaattttt

SEQ ID NO: 66190 - DNA, 20 bp, Artificial Sequence
  Description of Artificial Sequence: Synthetic oligonucleotide
  Target: SCN10A; (+) strand; PAM type: YTN; PAM sequence: TTC
tttctgaagaaatttttact

SEQ ID NO: 66191 - DNA, 20 bp, Artificial Sequence
  Description of Artificial Sequence: Synthetic oligonucleotide
  Target: SCN10A; (+) strand; PAM type: YTN; PAM sequence: CTT
tctgaagaaatttttactct

SEQ ID NO: 66192 - DNA, 20 bp, Artificial Sequence
  Description of Artificial Sequence: Synthetic oligonucleotide
  Target: SCN10A; (+) strand; PAM type: YTN; PAM sequence: TTT
ctgaagaaatttttactctt

SEQ ID NO: 66193 - DNA, 20 bp, Artificial Sequence
  Description of Artificial Sequence: Synthetic oligonucleotide
  Target: SCN10A; (+) strand; PAM type: YTN; PAM sequence: TTC
tgaagaaatttttactcttg

SEQ ID NO: 66194 - DNA, 20 bp, Artificial Sequence
  Description of Artificial Sequence: Synthetic oligonucleotide
  Target: SCN10A; (+) strand; PAM type: YTN; PAM sequence: CTG
aagaaatttttactcttggc

SEQ ID NO: 66195 - DNA, 20 bp, Artificial Sequence
  Description of Artificial Sequence: Synthetic oligonucleotide
  Target: SCN10A; (+) strand; PAM type: YTN; PAM sequence: TTT
ttactcttggctctgcattg

SEQ ID NO: 66196 - DNA, 20 bp, Artificial Sequence
  Description of Artificial Sequence: Synthetic oligonucleotide
  Target: SCN10A; (+) strand; PAM type: YTN; PAM sequence: TTT
tactcttggctctgcattgt

SEQ ID NO: 66197 - DNA, 20 bp, Artificial Sequence
  Description of Artificial Sequence: Synthetic oligonucleotide
  Target: SCN10A; (+) strand; PAM type: YTN; PAM sequence: TTT
actcttggctctgcattgta

SEQ ID NO: 66198 - DNA, 20 bp, Artificial Sequence
  Description of Artificial Sequence: Synthetic oligonucleotide
  Target: SCN10A; (+) strand; PAM type: YTN; PAM sequence: TTA
ctcttggctctgcattgtat

SEQ ID NO: 66199 - DNA, 20 bp, Artificial Sequence
  Description of Artificial Sequence: Synthetic oligonucleotide
  Target: SCN10A; (+) strand; PAM type: YTN; PAM sequence: CTC
ttggctctgcattgtattct

SEQ ID NO: 66200 - DNA, 20 bp, Artificial Sequence
  Description of Artificial Sequence: Synthetic oligonucleotide
  Target: SCN10A; (+) strand; PAM type: YTN; PAM sequence: CTT
ggctctgcattgtattcttc

SEQ ID NO: 66201 - DNA, 20 bp, Artificial Sequence
  Description of Artificial Sequence: Synthetic oligonucleotide
  Target: SCN10A; (+) strand; PAM type: YTN; PAM sequence: TTG
gctctgcattgtattcttct

SEQ ID NO: 66202 - DNA, 20 bp, Artificial Sequence
  Description of Artificial Sequence: Synthetic oligonucleotide
  Target: SCN10A; (+) strand; PAM type: YTN; PAM sequence: CTC
tgcattgtattcttctagat

SEQ ID NO: 66203 - DNA, 20 bp, Artificial Sequence
  Description of Artificial Sequence: Synthetic oligonucleotide
  Target: SCN10A; (+) strand; PAM type: YTN; PAM sequence: CTG
cattgtattcttctagatct

SEQ ID NO: 66204 - DNA, 20 bp, Artificial Sequence
  Description of Artificial Sequence: Synthetic oligonucleotide
  Target: SCN10A; (+) strand; PAM type: YTN; PAM sequence: TTG
tattcttctagatcttttcc

SEQ ID NO: 66205 - DNA, 20 bp, Artificial Sequence
  Description of Artificial Sequence: Synthetic oligonucleotide
  Target: SCN10A; (+) strand; PAM type: YTN; PAM sequence: TTC
ttctagatcttttcctattt

SEQ ID NO: 66206 - DNA, 20 bp, Artificial Sequence
  Description of Artificial Sequence: Synthetic oligonucleotide
  Target: SCN10A; (+) strand; PAM type: YTN; PAM sequence: CTT
ctagatcttttcctatttct

SEQ ID NO: 66207 - DNA, 20 bp, Artificial Sequence
  Description of Artificial Sequence: Synthetic oligonucleotide
  Target: SCN10A; (+) strand; PAM type: YTN; PAM sequence: TTC
tagatcttttcctatttctg

SEQ ID NO: 66208 - DNA, 20 bp, Artificial Sequence
  Description of Artificial Sequence: Synthetic oligonucleotide
  Target: SCN10A; (+) strand; PAM type: YTN; PAM sequence: CTA
gatcttttcctatttctgta

SEQ ID NO: 66209 - DNA, 20 bp, Artificial Sequence
  Description of Artificial Sequence: Synthetic oligonucleotide
  Target: SCN10A; (+) strand; PAM type: YTN; PAM sequence: CTT
ttcctatttctgtaccttcc

SEQ ID NO: 66210 - DNA, 20 bp, Artificial Sequence
  Description of Artificial Sequence: Synthetic oligonucleotide
  Target: SCN10A; (+) strand; PAM type: YTN; PAM sequence: TTT
tcctatttctgtaccttcct

SEQ ID NO: 66211 - DNA, 20 bp, Artificial Sequence
  Description of Artificial Sequence: Synthetic oligonucleotide
  Target: SCN10A; (+) strand; PAM type: YTN; PAM sequence: TTT
cctatttctgtaccttcctt

SEQ ID NO: 66212 - DNA, 20 bp, Artificial Sequence
  Description of Artificial Sequence: Synthetic oligonucleotide
  Target: SCN10A; (+) strand; PAM type: YTN; PAM sequence: TTC
ctatttctgtaccttccttt

SEQ ID NO: 66213 - DNA, 20 bp, Artificial Sequence
  Description of Artificial Sequence: Synthetic oligonucleotide
  Target: SCN10A; (+) strand; PAM type: YTN; PAM sequence: CTA
tttctgtaccttccttttca

SEQ ID NO: 66214 - DNA, 20 bp, Artificial Sequence
  Description of Artificial Sequence: Synthetic oligonucleotide
  Target: SCN10A; (+) strand; PAM type: YTN; PAM sequence: TTT
ctgtaccttccttttcagtc

SEQ ID NO: 66215 - DNA, 20 bp, Artificial Sequence
  Description of Artificial Sequence: Synthetic oligonucleotide
  Target: SCN10A; (+) strand; PAM type: YTN; PAM sequence: TTC
tgtaccttccttttcagtct

SEQ ID NO: 66216 - DNA, 20 bp, Artificial Sequence
  Description of Artificial Sequence: Synthetic oligonucleotide
  Target: SCN10A; (+) strand; PAM type: YTN; PAM sequence: CTG
taccttccttttcagtctcc

SEQ ID NO: 66217 - DNA, 20 bp, Artificial Sequence
  Description of Artificial Sequence: Synthetic oligonucleotide
  Target: SCN10A; (+) strand; PAM type: YTN; PAM sequence: CTT
ccttttcagtctcctctgct

SEQ ID NO: 66218 - DNA, 20 bp, Artificial Sequence
  Description of Artificial Sequence: Synthetic oligonucleotide
  Target: SCN10A; (+) strand; PAM type: YTN; PAM sequence: TTC
cttttcagtctcctctgctg

SEQ ID NO: 66219 - DNA, 20 bp, Artificial Sequence
  Description of Artificial Sequence: Synthetic oligonucleotide
  Target: SCN10A; (+) strand; PAM type: YTN; PAM sequence: CTT
ttcagtctcctctgctgggt

SEQ ID NO: 66220 - DNA, 20 bp, Artificial Sequence
  Description of Artificial Sequence: Synthetic oligonucleotide
  Target: SCN10A; (+) strand; PAM type: YTN; PAM sequence: TTT
tcagtctcctctgctgggtc

SEQ ID NO: 66221 - DNA, 20 bp, Artificial Sequence
  Description of Artificial Sequence: Synthetic oligonucleotide
  Target: SCN10A; (+) strand; PAM type: YTN; PAM sequence: TTT
cagtctcctctgctgggtcc

SEQ ID NO: 66222 - DNA, 20 bp, Artificial Sequence
  Description of Artificial Sequence: Synthetic oligonucleotide
  Target: SCN10A; (+) strand; PAM type: YTN; PAM sequence: TTC
agtctcctctgctgggtcca

SEQ ID NO: 66223 - DNA, 20 bp, Artificial Sequence
  Description of Artificial Sequence: Synthetic oligonucleotide
  Target: SCN10A; (+) strand; PAM type: YTN; PAM sequence: CTC
ctctgctgggtccatctctt

SEQ ID NO: 66224 - DNA, 20 bp, Artificial Sequence
  Description of Artificial Sequence: Synthetic oligonucleotide
  Target: SCN10A; (+) strand; PAM type: YTN; PAM sequence: CTC
tgctgggtccatctcttctg

SEQ ID NO: 66225 - DNA, 20 bp, Artificial Sequence
  Description of Artificial Sequence: Synthetic oligonucleotide
  Target: SCN10A; (+) strand; PAM type: YTN; PAM sequence: CTG
ctgggtccatctcttctgct

SEQ ID NO: 66226 - DNA, 20 bp, Artificial Sequence
  Description of Artificial Sequence: Synthetic oligonucleotide
  Target: SCN10A; (+) strand; PAM type: YTN; PAM sequence: CTG
ggtccatctcttctgcttaa

SEQ ID NO: 66227 - DNA, 20 bp, Artificial Sequence
  Description of Artificial Sequence: Synthetic oligonucleotide
  Target: SCN10A; (+) strand; PAM type: YTN; PAM sequence: CTC
ttctgcttaactattaaaca

SEQ ID NO: 66228 - DNA, 20 bp, Artificial Sequence
  Description of Artificial Sequence: Synthetic oligonucleotide
  Target: SCN10A; (+) strand; PAM type: YTN; PAM sequence: CTT
ctgcttaactattaaacatt

SEQ ID NO: 66229 - DNA, 20 bp, Artificial Sequence
  Description of Artificial Sequence: Synthetic oligonucleotide
  Target: SCN10A; (+) strand; PAM type: YTN; PAM sequence: TTC
tgcttaactattaaacattt

SEQ ID NO: 66230 - DNA, 20 bp, Artificial Sequence
  Description of Artificial Sequence: Synthetic oligonucleotide
  Target: SCN10A; (+) strand; PAM type: YTN; PAM sequence: CTG
cttaactattaaacatttag

SEQ ID NO: 66231 - DNA, 20 bp, Artificial Sequence
  Description of Artificial Sequence: Synthetic oligonucleotide
  Target: SCN10A; (+) strand; PAM type: YTN; PAM sequence: CTT
aactattaaacatttagttt

SEQ ID NO: 66232 - DNA, 20 bp, Artificial Sequence
  Description of Artificial Sequence: Synthetic oligonucleotide
  Target: SCN10A; (+) strand; PAM type: YTN; PAM sequence: TTA
actattaaacatttagtttg

SEQ ID NO: 66233 - DNA, 20 bp, Artificial Sequence
  Description of Artificial Sequence: Synthetic oligonucleotide
  Target: SCN10A; (+) strand; PAM type: YTN; PAM sequence: CTA
ttaaacatttagtttgttag

SEQ ID NO: 66234 - DNA, 20 bp, Artificial Sequence
  Description of Artificial Sequence: Synthetic oligonucleotide
  Target: SCN10A; (+) strand; PAM type: YTN; PAM sequence: TTA
aacatttagtttgttagaac

SEQ ID NO: 66235 - DNA, 20 bp, Artificial Sequence
  Description of Artificial Sequence: Synthetic oligonucleotide
  Target: SCN10A; (+) strand; PAM type: YTN; PAM sequence: TTT
agtttgttagaactgtgtct

SEQ ID NO: 66236 - DNA, 20 bp, Artificial Sequence
  Description of Artificial Sequence: Synthetic oligonucleotide
  Target: SCN10A; (+) strand; PAM type: YTN; PAM sequence: TTA
gtttgttagaactgtgtctg

SEQ ID NO: 66237 - DNA, 20 bp, Artificial Sequence
  Description of Artificial Sequence: Synthetic oligonucleotide
  Target: SCN10A; (+) strand; PAM type: YTN; PAM sequence: TTT
gttagaactgtgtctgaggc

SEQ ID NO: 66238 - DNA, 20 bp, Artificial Sequence
  Description of Artificial Sequence: Synthetic oligonucleotide
  Target: SCN10A; (+) strand; PAM type: YTN; PAM sequence: TTG
ttagaactgtgtctgaggcc

SEQ ID NO: 66239 - DNA, 20 bp, Artificial Sequence
  Description of Artificial Sequence: Synthetic oligonucleotide
  Target: SCN10A; (+) strand; PAM type: YTN; PAM sequence: TTA
gaactgtgtctgaggccttc

SEQ ID NO: 66240 - DNA, 20 bp, Artificial Sequence
  Description of Artificial Sequence: Synthetic oligonucleotide
  Target: SCN10A; (+) strand; PAM type: YTN; PAM sequence: CTG
tgtctgaggccttcttctct

SEQ ID NO: 66241 - DNA, 20 bp, Artificial Sequence
  Description of Artificial Sequence: Synthetic oligonucleotide
  Target: SCN10A; (+) strand; PAM type: YTN; PAM sequence: CTG
aggccttcttctcttcttac

SEQ ID NO: 66242 - DNA, 20 bp, Artificial Sequence
  Description of Artificial Sequence: Synthetic oligonucleotide
  Target: SCN10A; (+) strand; PAM type: YTN; PAM sequence: CTT
cttctcttcttacttcaacc

SEQ ID NO: 66243 - DNA, 20 bp, Artificial Sequence
  Description of Artificial Sequence: Synthetic oligonucleotide
  Target: SCN10A; (+) strand; PAM type: YTN; PAM sequence: TTC
ttctcttcttacttcaaccc

SEQ ID NO: 66244 - DNA, 20 bp, Artificial Sequence
  Description of Artificial Sequence: Synthetic oligonucleotide
  Target: SCN10A; (+) strand; PAM type: YTN; PAM sequence: CTT
ctcttcttacttcaaccctt

SEQ ID NO: 66245 - DNA, 20 bp, Artificial Sequence
  Description of Artificial Sequence: Synthetic oligonucleotide
  Target: SCN10A; (+) strand; PAM type: YTN; PAM sequence: TTC
tcttcttacttcaacccttc

SEQ ID NO: 66246 - DNA, 20 bp, Artificial Sequence
  Description of Artificial Sequence: Synthetic oligonucleotide
  Target: SCN10A; (+) strand; PAM type: YTN; PAM sequence: CTC
ttcttacttcaacccttctg

SEQ ID NO: 66247 - DNA, 20 bp, Artificial Sequence
  Description of Artificial Sequence: Synthetic oligonucleotide
  Target: SCN10A; (+) strand; PAM type: YTN; PAM sequence: CTT
cttacttcaacccttctgtg

SEQ ID NO: 66248 - DNA, 20 bp, Artificial Sequence
  Description of Artificial Sequence: Synthetic oligonucleotide
  Target: SCN10A; (+) strand; PAM type: YTN; PAM sequence: TTC
ttacttcaacccttctgtgt

SEQ ID NO: 66249 - DNA, 20 bp, Artificial Sequence
  Description of Artificial Sequence: Synthetic oligonucleotide
  Target: SCN10A; (+) strand; PAM type: YTN; PAM sequence: CTT
acttcaacccttctgtgtta

SEQ ID NO: 66250 - DNA, 20 bp, Artificial Sequence
  Description of Artificial Sequence: Synthetic oligonucleotide
  Target: SCN10A; (+) strand; PAM type: YTN; PAM sequence: TTA
cttcaacccttctgtgttaa

SEQ ID NO: 66251 - DNA, 20 bp, Artificial Sequence
  Description of Artificial Sequence: Synthetic oligonucleotide
  Target: SCN10A; (+) strand; PAM type: YTN; PAM sequence: CTT
caacccttctgtgttaactc

SEQ ID NO: 66252 - DNA, 20 bp, Artificial Sequence
  Description of Artificial Sequence: Synthetic oligonucleotide
  Target: SCN10A; (+) strand; PAM type: YTN; PAM sequence: TTC
aacccttctgtgttaactca

SEQ ID NO: 66253 - DNA, 20 bp, Artificial Sequence
  Description of Artificial Sequence: Synthetic oligonucleotide
  Target: SCN10A; (+) strand; PAM type: YTN; PAM sequence: CTT
ctgtgttaactcatccagtt

SEQ ID NO: 66254 - DNA, 20 bp, Artificial Sequence
  Description of Artificial Sequence: Synthetic oligonucleotide
  Target: SCN10A; (+) strand; PAM type: YTN; PAM sequence: TTC
tgtgttaactcatccagttg

SEQ ID NO: 66255 - DNA, 20 bp, Artificial Sequence
  Description of Artificial Sequence: Synthetic oligonucleotide
  Target: SCN10A; (+) strand; PAM type: YTN; PAM sequence: CTG
tgttaactcatccagttgca

SEQ ID NO: 66256 - DNA, 20 bp, Artificial Sequence
  Description of Artificial Sequence: Synthetic oligonucleotide
  Target: SCN10A; (+) strand; PAM type: YTN; PAM sequence: TTA
actcatccagttgcatcttt

SEQ ID NO: 66257 - DNA, 20 bp, Artificial Sequence
  Description of Artificial Sequence: Synthetic oligonucleotide
  Target: SCN10A; (+) strand; PAM type: YTN; PAM sequence: CTC
atccagttgcatcttttcaa

SEQ ID NO: 66258 - DNA, 20 bp, Artificial Sequence
  Description of Artificial Sequence: Synthetic oligonucleotide
  Target: SCN10A; (+) strand; PAM type: YTN; PAM sequence: TTG
catcttttcaaaattaccac

SEQ ID NO: 66259 - DNA, 20 bp, Artificial Sequence
  Description of Artificial Sequence: Synthetic oligonucleotide
  Target: SCN10A; (+) strand; PAM type: YTN; PAM sequence: CTT
ttcaaaattaccacttacat

SEQ ID NO: 66260 - DNA, 20 bp, Artificial Sequence
  Description of Artificial Sequence: Synthetic oligonucleotide
  Target: SCN10A; (+) strand; PAM type: YTN; PAM sequence: TTT
tcaaaattaccacttacatt

SEQ ID NO: 66261 - DNA, 20 bp, Artificial Sequence
  Description of Artificial Sequence: Synthetic oligonucleotide
  Target: SCN10A; (+) strand; PAM type: YTN; PAM sequence: TTT
caaaattaccacttacattc

SEQ ID NO: 66262 - DNA, 20 bp, Artificial Sequence
  Description of Artificial Sequence: Synthetic oligonucleotide
  Target: SCN10A; (+) strand; PAM type: YTN; PAM sequence: TTC
aaaattaccacttacattca

SEQ ID NO: 66263 - DNA, 20 bp, Artificial Sequence
  Description of Artificial Sequence: Synthetic oligonucleotide
  Target: SCN10A; (+) strand; PAM type: YTN; PAM sequence: TTA
ccacttacattcaaactgct

SEQ ID NO: 66264 - DNA, 20 bp, Artificial Sequence
  Description of Artificial Sequence: Synthetic oligonucleotide
  Target: SCN10A; (+) strand; PAM type: YTN; PAM sequence: CTT
acattcaaactgctttcaaa

SEQ ID NO: 66265 - DNA, 20 bp, Artificial Sequence
  Description of Artificial Sequence: Synthetic oligonucleotide
  Target: SCN10A; (+) strand; PAM type: YTN; PAM sequence: TTA
cattcaaactgctttcaaat

SEQ ID NO: 66266 - DNA, 20 bp, Artificial Sequence
  Description of Artificial Sequence: Synthetic oligonucleotide
  Target: SCN10A; (+) strand; PAM type: YTN; PAM sequence: TTC
aaactgctttcaaatatata

SEQ ID NO: 66267 - DNA, 20 bp, Artificial Sequence
  Description of Artificial Sequence: Synthetic oligonucleotide
  Target: SCN10A; (+) strand; PAM type: YTN; PAM sequence: CTG
ctttcaaatatatatatata

SEQ ID NO: 66268 - DNA, 20 bp, Artificial Sequence
  Description of Artificial Sequence: Synthetic oligonucleotide
  Target: SCN10A; (+) strand; PAM type: YTN; PAM sequence: CTT
tcaaatatatatatatacat

SEQ ID NO: 66269 - DNA, 20 bp, Artificial Sequence
  Description of Artificial Sequence: Synthetic oligonucleotide
  Target: SCN10A; (+) strand; PAM type: YTN; PAM sequence: TTT
caaatatatatatatacata

SEQ ID NO: 66270 - DNA, 20 bp, Artificial Sequence
  Description of Artificial Sequence: Synthetic oligonucleotide
  Target: SCN10A; (+) strand; PAM type: YTN; PAM sequence: TTC
aaatatatatatatacatat

SEQ ID NO: 66271 - DNA, 20 bp, Artificial Sequence
  Description of Artificial Sequence: Synthetic oligonucleotide
  Target: SCN10A; (+) strand; PAM type: YTN; PAM sequence: CTT
tgtcatctaagttctagacc

SEQ ID NO: 66272 - DNA, 20 bp, Artificial Sequence
  Description of Artificial Sequence: Synthetic oligonucleotide
  Target: SCN10A; (+) strand; PAM type: YTN; PAM sequence: TTT
gtcatctaagttctagaccc

SEQ ID NO: 66273 - DNA, 20 bp, Artificial Sequence
  Description of Artificial Sequence: Synthetic oligonucleotide
  Target: SCN10A; (+) strand; PAM type: YTN; PAM sequence: TTG
tcatctaagttctagacccc

SEQ ID NO: 66274 - DNA, 20 bp, Artificial Sequence
  Description of Artificial Sequence: Synthetic oligonucleotide
  Target: SCN10A; (+) strand; PAM type: YTN; PAM sequence: CTA
agttctagacccctatatcc

SEQ ID NO: 66275 - DNA, 20 bp, Artificial Sequence
  Description of Artificial Sequence: Synthetic oligonucleotide
  Target: SCN10A; (+) strand; PAM type: YTN; PAM sequence: TTC
tagacccctatatcctaaag

SEQ ID NO: 66276 - DNA, 20 bp, Artificial Sequence
  Description of Artificial Sequence: Synthetic oligonucleotide
  Target: SCN10A; (+) strand; PAM type: YTN; PAM sequence: CTA
gacccctatatcctaaagtc

SEQ ID NO: 66277 - DNA, 20 bp, Artificial Sequence
  Description of Artificial Sequence: Synthetic oligonucleotide
  Target: SCN10A; (+) strand; PAM type: YTN; PAM sequence: CTA
tatcctaaagtcaacttcct

SEQ ID NO: 66278 - DNA, 20 bp, Artificial Sequence
  Description of Artificial Sequence: Synthetic oligonucleotide
  Target: SCN10A; (+) strand; PAM type: YTN; PAM sequence: CTA
aagtcaacttcctactggac

SEQ ID NO: 66279 - DNA, 20 bp, Artificial Sequence
  Description of Artificial Sequence: Synthetic oligonucleotide
  Target: SCN10A; (+) strand; PAM type: YTN; PAM sequence: CTT
cctactggacacccctacct

SEQ ID NO: 66280 - DNA, 20 bp, Artificial Sequence
  Description of Artificial Sequence: Synthetic oligonucleotide
  Target: SCN10A; (+) strand; PAM type: YTN; PAM sequence: TTC
ctactggacacccctaccta

SEQ ID NO: 66281 - DNA, 20 bp, Artificial Sequence
  Description of Artificial Sequence: Synthetic oligonucleotide
  Target: SCN10A; (+) strand; PAM type: YTN; PAM sequence: CTA
ctggacacccctacctagat

SEQ ID NO: 66282 - DNA, 20 bp, Artificial Sequence
  Description of Artificial Sequence: Synthetic oligonucleotide
  Target: SCN10A; (+) strand; PAM type: YTN; PAM sequence: CTG
gacacccctacctagatgct

SEQ ID NO: 66283 - DNA, 20 bp, Artificial Sequence
  Description of Artificial Sequence: Synthetic oligonucleotide
  Target: SCN10A; (+) strand; PAM type: YTN; PAM sequence: CTA
cctagatgctccaagggcac

SEQ ID NO: 66284 - DNA, 20 bp, Artificial Sequence
  Description of Artificial Sequence: Synthetic oligonucleotide
  Target: SCN10A; (+) strand; PAM type: YTN; PAM sequence: CTA
gatgctccaagggcacctga

SEQ ID NO: 66285 - DNA, 20 bp, Artificial Sequence
  Description of Artificial Sequence: Synthetic oligonucleotide
  Target: SCN10A; (+) strand; PAM type: YTN; PAM sequence: CTC
caagggcacctgaaacccaa

SEQ ID NO: 66286 - DNA, 20 bp, Artificial Sequence
  Description of Artificial Sequence: Synthetic oligonucleotide
  Target: SCN10A; (+) strand; PAM type: YTN; PAM sequence: CTG
aaacccaatatatcccagac

SEQ ID NO: 66287 - DNA, 20 bp, Artificial Sequence
  Description of Artificial Sequence: Synthetic oligonucleotide
  Target: SCN10A; (+) strand; PAM type: YTN; PAM sequence: CTC
aactcataatcttctttcat

SEQ ID NO: 66288 - DNA, 20 bp, Artificial Sequence
  Description of Artificial Sequence: Synthetic oligonucleotide
  Target: SCN10A; (+) strand; PAM type: YTN; PAM sequence: CTC
ataatcttctttcatctttc

SEQ ID NO: 66289 - DNA, 20 bp, Artificial Sequence
  Description of Artificial Sequence: Synthetic oligonucleotide
  Target: SCN10A; (+) strand; PAM type: YTN; PAM sequence: CTT
ctttcatctttccccattaa

SEQ ID NO: 66290 - DNA, 20 bp, Artificial Sequence
  Description of Artificial Sequence: Synthetic oligonucleotide
  Target: SCN10A; (+) strand; PAM type: YTN; PAM sequence: TTC
tttcatctttccccattaaa

SEQ ID NO: 66291 - DNA, 20 bp, Artificial Sequence
  Description of Artificial Sequence: Synthetic oligonucleotide
  Target: SCN10A; (+) strand; PAM type: YTN; PAM sequence: CTT
tcatctttccccattaaagc

SEQ ID NO: 66292 - DNA, 20 bp, Artificial Sequence
  Description of Artificial Sequence: Synthetic oligonucleotide
  Target: SCN10A; (+) strand; PAM type: YTN; PAM sequence: TTT
catctttccccattaaagcc

SEQ ID NO: 66293 - DNA, 20 bp, Artificial Sequence
  Description of Artificial Sequence: Synthetic oligonucleotide
  Target: SCN10A; (+) strand; PAM type: YTN; PAM sequence: TTC
atctttccccattaaagccc

SEQ ID NO: 66294 - DNA, 20 bp, Artificial Sequence
  Description of Artificial Sequence: Synthetic oligonucleotide
  Target: SCN10A; (+) strand; PAM type: YTN; PAM sequence: CTT
tccccattaaagcccccttc

SEQ ID NO: 66295 - DNA, 20 bp, Artificial Sequence
  Description of Artificial Sequence: Synthetic oligonucleotide
  Target: SCN10A; (+) strand; PAM type: YTN; PAM sequence: TTT
ccccattaaagcccccttct

SEQ ID NO: 66296 - DNA, 20 bp, Artificial Sequence
  Description of Artificial Sequence: Synthetic oligonucleotide
  Target: SCN10A; (+) strand; PAM type: YTN; PAM sequence: TTC
cccattaaagcccccttctt

SEQ ID NO: 66297 - DNA, 20 bp, Artificial Sequence
  Description of Artificial Sequence: Synthetic oligonucleotide
  Target: SCN10A; (+) strand; PAM type: YTN; PAM sequence: TTA
aagcccccttcttcccctaa

SEQ ID NO: 66298 - DNA, 20 bp, Artificial Sequence
  Description of Artificial Sequence: Synthetic oligonucleotide
  Target: SCN10A; (+) strand; PAM type: YTN; PAM sequence: CTT
cttcccctaaaatgctccct

SEQ ID NO: 66299 - DNA, 20 bp, Artificial Sequence
  Description of Artificial Sequence: Synthetic oligonucleotide
  Target: SCN10A; (+) strand; PAM type: YTN; PAM sequence: TTC
ttcccctaaaatgctccctt

SEQ ID NO: 66300 - DNA, 20 bp, Artificial Sequence
  Description of Artificial Sequence: Synthetic oligonucleotide
  Target: SCN10A; (+) strand; PAM type: YTN; PAM sequence: CTT
cccctaaaatgctcccttta

SEQ ID NO: 66301 - DNA, 20 bp, Artificial Sequence
  Description of Artificial Sequence: Synthetic oligonucleotide
  Target: SCN10A; (+) strand; PAM type: YTN; PAM sequence: TTC
ccctaaaatgctccctttat

SEQ ID NO: 66302 - DNA, 20 bp, Artificial Sequence
  Description of Artificial Sequence: Synthetic oligonucleotide
  Target: SCN10A; (+) strand; PAM type: YTN; PAM sequence: CTA
aaatgctccctttatgagtt

SEQ ID NO: 66303 - DNA, 20 bp, Artificial Sequence
  Description of Artificial Sequence: Synthetic oligonucleotide
  Target: SCN10A; (+) strand; PAM type: YTN; PAM sequence: CTC
cctttatgagttattgtatc

SEQ ID NO: 66304 - DNA, 20 bp, Artificial Sequence
  Description of Artificial Sequence: Synthetic oligonucleotide
  Target: SCN10A; (+) strand; PAM type: YTN; PAM sequence: CTT
tatgagttattgtatcagca

SEQ ID NO: 66305 - DNA, 20 bp, Artificial Sequence
  Description of Artificial Sequence: Synthetic oligonucleotide
  Target: SCN10A; (+) strand; PAM type: YTN; PAM sequence: TTT
atgagttattgtatcagcat

SEQ ID NO: 66306 - DNA, 20 bp, Artificial Sequence
  Description of Artificial Sequence: Synthetic oligonucleotide
  Target: SCN10A; (+) strand; PAM type: YTN; PAM sequence: TTA
tgagttattgtatcagcata

SEQ ID NO: 66307 - DNA, 20 bp, Artificial Sequence
  Description of Artificial Sequence: Synthetic oligonucleotide
  Target: SCN10A; (+) strand; PAM type: YTN; PAM sequence: TTA
ttgtatcagcatatcttaag

SEQ ID NO: 66308 - DNA, 20 bp, Artificial Sequence
  Description of Artificial Sequence: Synthetic oligonucleotide
  Target: SCN10A; (+) strand; PAM type: YTN; PAM sequence: TTG
tatcagcatatcttaaggca

SEQ ID NO: 66309 - DNA, 20 bp, Artificial Sequence
  Description of Artificial Sequence: Synthetic oligonucleotide
  Target: SCN10A; (+) strand; PAM type: YTN; PAM sequence: CTT
aaggcacttataccagaacc

SEQ ID NO: 66310 - DNA, 20 bp, Artificial Sequence
  Description of Artificial Sequence: Synthetic oligonucleotide
  Target: SCN10A; (+) strand; PAM type: YTN; PAM sequence: TTA
aggcacttataccagaacca

SEQ ID NO: 66311 - DNA, 20 bp, Artificial Sequence
  Description of Artificial Sequence: Synthetic oligonucleotide
  Target: SCN10A; (+) strand; PAM type: YTN; PAM sequence: CTT
ataccagaaccatatgcatc

SEQ ID NO: 66312 - DNA, 20 bp, Artificial Sequence
  Description of Artificial Sequence: Synthetic oligonucleotide
  Target: SCN10A; (+) strand; PAM type: YTN; PAM sequence: TTA
taccagaaccatatgcatca

SEQ ID NO: 66313 - DNA, 20 bp, Artificial Sequence
  Description of Artificial Sequence: Synthetic oligonucleotide
  Target: SCN10A; (+) strand; PAM type: YTN; PAM sequence: CTG
aatcttatgccccttagata

SEQ ID NO: 66314 - DNA, 20 bp, Artificial Sequence
  Description of Artificial Sequence: Synthetic oligonucleotide
  Target: SCN10A; (+) strand; PAM type: YTN; PAM sequence: CTT
atgccccttagatagctctc

SEQ ID NO: 66315 - DNA, 20 bp, Artificial Sequence
  Description of Artificial Sequence: Synthetic oligonucleotide
  Target: SCN10A; (+) strand; PAM type: YTN; PAM sequence: TTA
tgccccttagatagctctca

SEQ ID NO: 66316 - DNA, 20 bp, Artificial Sequence
  Description of Artificial Sequence: Synthetic oligonucleotide
  Target: SCN10A; (+) strand; PAM type: YTN; PAM sequence: CTT
agatagctctcatatccttc

SEQ ID NO: 66317 - DNA, 20 bp, Artificial Sequence
  Description of Artificial Sequence: Synthetic oligonucleotide
  Target: SCN10A; (+) strand; PAM type: YTN; PAM sequence: TTA
gatagctctcatatccttcc

SEQ ID NO: 66318 - DNA, 20 bp, Artificial Sequence
  Description of Artificial Sequence: Synthetic oligonucleotide
  Target: SCN10A; (+) strand; PAM type: YTN; PAM sequence: CTC
tcatatccttccatttccca

SEQ ID NO: 66319 - DNA, 20 bp, Artificial Sequence
  Description of Artificial Sequence: Synthetic oligonucleotide
  Target: SCN10A; (+) strand; PAM type: YTN; PAM sequence: CTC
atatccttccatttcccatc

SEQ ID NO: 66320 - DNA, 20 bp, Artificial Sequence
  Description of Artificial Sequence: Synthetic oligonucleotide
  Target: SCN10A; (+) strand; PAM type: YTN; PAM sequence: CTT
ccatttcccatcagccccac

SEQ ID NO: 66321 - DNA, 20 bp, Artificial Sequence
  Description of Artificial Sequence: Synthetic oligonucleotide
  Target: SCN10A; (+) strand; PAM type: YTN; PAM sequence: TTC
catttcccatcagccccact

SEQ ID NO: 66322 - DNA, 20 bp, Artificial Sequence
  Description of Artificial Sequence: Synthetic oligonucleotide
  Target: SCN10A; (+) strand; PAM type: YTN; PAM sequence: TTT
cccatcagccccactgtcac

SEQ ID NO: 66323 - DNA, 20 bp, Artificial Sequence
  Description of Artificial Sequence: Synthetic oligonucleotide
  Target: SCN10A; (+) strand; PAM type: YTN; PAM sequence: TTC
ccatcagccccactgtcact

SEQ ID NO: 66324 - DNA, 20 bp, Artificial Sequence
  Description of Artificial Sequence: Synthetic oligonucleotide
  Target: SCN10A; (+) strand; PAM type: YTN; PAM sequence: CTG
tcactaccccagagttcaag

SEQ ID NO: 66325 - DNA, 20 bp, Artificial Sequence
  Description of Artificial Sequence: Synthetic oligonucleotide
  Target: SCN10A; (+) strand; PAM type: YTN; PAM sequence: CTA
ccccagagttcaagcactgc

SEQ ID NO: 66326 - DNA, 20 bp, Artificial Sequence
  Description of Artificial Sequence: Synthetic oligonucleotide
  Target: SCN10A; (+) strand; PAM type: YTN; PAM sequence: TTC
aagcactgccatcttgtact

SEQ ID NO: 66327 - DNA, 20 bp, Artificial Sequence
  Description of Artificial Sequence: Synthetic oligonucleotide
  Target: SCN10A; (+) strand; PAM type: YTN; PAM sequence: CTG
ccatcttgtacttggcttcc

SEQ ID NO: 66328 - DNA, 20 bp, Artificial Sequence
  Description of Artificial Sequence: Synthetic oligonucleotide
  Target: SCN10A; (+) strand; PAM type: YTN; PAM sequence: CTT
gtacttggcttcctcctaac

SEQ ID NO: 66329 - DNA, 20 bp, Artificial Sequence
  Description of Artificial Sequence: Synthetic oligonucleotide
  Target: SCN10A; (+) strand; PAM type: YTN; PAM sequence: TTG
tacttggcttcctcctaact

SEQ ID NO: 66330 - DNA, 20 bp, Artificial Sequence
  Description of Artificial Sequence: Synthetic oligonucleotide
  Target: SCN10A; (+) strand; PAM type: YTN; PAM sequence: CTT
ggcttcctcctaactggttt

SEQ ID NO: 66331 - DNA, 20 bp, Artificial Sequence
  Description of Artificial Sequence: Synthetic oligonucleotide
  Target: SCN10A; (+) strand; PAM type: YTN; PAM sequence: TTG
gcttcctcctaactggtttc

SEQ ID NO: 66332 - DNA, 20 bp, Artificial Sequence
  Description of Artificial Sequence: Synthetic oligonucleotide
  Target: SCN10A; (+) strand; PAM type: YTN; PAM sequence: CTT
cctcctaactggtttccctg

SEQ ID NO: 66333 - DNA, 20 bp, Artificial Sequence
  Description of Artificial Sequence: Synthetic oligonucleotide
  Target: SCN10A; (+) strand; PAM type: YTN; PAM sequence: TTC
ctcctaactggtttccctga

SEQ ID NO: 66334 - DNA, 20 bp, Artificial Sequence
  Description of Artificial Sequence: Synthetic oligonucleotide
  Target: SCN10A; (+) strand; PAM type: YTN; PAM sequence: CTC
ctaactggtttccctgacaa

SEQ ID NO: 66335 - DNA, 20 bp, Artificial Sequence
  Description of Artificial Sequence: Synthetic oligonucleotide
  Target: SCN10A; (+) strand; PAM type: YTN; PAM sequence: CTA
actggtttccctgacaacat

SEQ ID NO: 66336 - DNA, 20 bp, Artificial Sequence
  Description of Artificial Sequence: Synthetic oligonucleotide
  Target: SCN10A; (+) strand; PAM type: YTN; PAM sequence: CTG
gtttccctgacaacatactt

SEQ ID NO: 66337 - DNA, 20 bp, Artificial Sequence
  Description of Artificial Sequence: Synthetic oligonucleotide
  Target: SCN10A; (+) strand; PAM type: YTN; PAM sequence: TTT
ccctgacaacatacttcccc

SEQ ID NO: 66338 - DNA, 20 bp, Artificial Sequence
  Description of Artificial Sequence: Synthetic oligonucleotide
  Target: SCN10A; (+) strand; PAM type: YTN; PAM sequence: TTC
cctgacaacatacttcccct

SEQ ID NO: 66339 - DNA, 20 bp, Artificial Sequence
  Description of Artificial Sequence: Synthetic oligonucleotide
  Target: SCN10A; (+) strand; PAM type: YTN; PAM sequence: CTG
acaacatacttcccctctta

SEQ ID NO: 66340 - DNA, 20 bp, Artificial Sequence
  Description of Artificial Sequence: Synthetic oligonucleotide
  Target: SCN10A; (+) strand; PAM type: YTN; PAM sequence: CTT
cccctcttatatctacaagt

SEQ ID NO: 66341 - DNA, 20 bp, Artificial Sequence
  Description of Artificial Sequence: Synthetic oligonucleotide
  Target: SCN10A; (+) strand; PAM type: YTN; PAM sequence: TTC
ccctcttatatctacaagta

SEQ ID NO: 66342 - DNA, 20 bp, Artificial Sequence
  Description of Artificial Sequence: Synthetic oligonucleotide
  Target: SCN10A; (+) strand; PAM type: YTN; PAM sequence: CTC
ttatatctacaagtatccag

SEQ ID NO: 66343 - DNA, 20 bp, Artificial Sequence
  Description of Artificial Sequence: Synthetic oligonucleotide
  Target: SCN10A; (+) strand; PAM type: YTN; PAM sequence: CTT
atatctacaagtatccagag

SEQ ID NO: 66344 - DNA, 20 bp, Artificial Sequence
  Description of Artificial Sequence: Synthetic oligonucleotide
  Target: SCN10A; (+) strand; PAM type: YTN; PAM sequence: TTA
tatctacaagtatccagagt

SEQ ID NO: 66345 - DNA, 20 bp, Artificial Sequence
  Description of Artificial Sequence: Synthetic oligonucleotide
  Target: SCN10A; (+) strand; PAM type: YTN; PAM sequence: CTA
caagtatccagagtaacttt

SEQ ID NO: 66346 - DNA, 20 bp, Artificial Sequence
  Description of Artificial Sequence: Synthetic oligonucleotide
  Target: SCN10A; (+) strand; PAM type: YTN; PAM sequence: CTT
ttataaaatgcaaatgtaac

SEQ ID NO: 66347 - DNA, 20 bp, Artificial Sequence
  Description of Artificial Sequence: Synthetic oligonucleotide
  Target: SCN10A; (+) strand; PAM type: YTN; PAM sequence: TTT
tataaaatgcaaatgtaact

SEQ ID NO: 66348 - DNA, 20 bp, Artificial Sequence
  Description of Artificial Sequence: Synthetic oligonucleotide
  Target: SCN10A; (+) strand; PAM type: YTN; PAM sequence: TTT
ataaaatgcaaatgtaactt

SEQ ID NO: 66349 - DNA, 20 bp, Artificial Sequence
  Description of Artificial Sequence: Synthetic oligonucleotide
  Target: SCN10A; (+) strand; PAM type: YTN; PAM sequence: TTA
taaaatgcaaatgtaacttc

SEQ ID NO: 66350 - DNA, 20 bp, Artificial Sequence
  Description of Artificial Sequence: Synthetic oligonucleotide
  Target: SCN10A; (+) strand; PAM type: YTN; PAM sequence: CTT
ccctgcctccaatcctttaa

SEQ ID NO: 66351 - DNA, 20 bp, Artificial Sequence
  Description of Artificial Sequence: Synthetic oligonucleotide
  Target: SCN10A; (+) strand; PAM type: YTN; PAM sequence: TTC
cctgcctccaatcctttaat

SEQ ID NO: 66352 - DNA, 20 bp, Artificial Sequence
  Description of Artificial Sequence: Synthetic oligonucleotide
  Target: SCN10A; (+) strand; PAM type: YTN; PAM sequence: CTG
cctccaatcctttaatggca

SEQ ID NO: 66353 - DNA, 20 bp, Artificial Sequence
  Description of Artificial Sequence: Synthetic oligonucleotide
  Target: SCN10A; (+) strand; PAM type: YTN; PAM sequence: CTC
caatcctttaatggcacctc

SEQ ID NO: 66354 - DNA, 20 bp, Artificial Sequence
  Description of Artificial Sequence: Synthetic oligonucleotide
  Target: SCN10A; (+) strand; PAM type: YTN; PAM sequence: CTT
taatggcacctcactcctct

SEQ ID NO: 66355 - DNA, 20 bp, Artificial Sequence
  Description of Artificial Sequence: Synthetic oligonucleotide
  Target: SCN10A; (+) strand; PAM type: YTN; PAM sequence: TTT
aatggcacctcactcctctt

SEQ ID NO: 66356 - DNA, 20 bp, Artificial Sequence
  Description of Artificial Sequence: Synthetic oligonucleotide
  Target: SCN10A; (+) strand; PAM type: YTN; PAM sequence: TTA
atggcacctcactcctctta

SEQ ID NO: 66357 - DNA, 20 bp, Artificial Sequence
  Description of Artificial Sequence: Synthetic oligonucleotide
  Target: SCN10A; (+) strand; PAM type: YTN; PAM sequence: CTC
actcctcttagcatgaagtc

SEQ ID NO: 66358 - DNA, 20 bp, Artificial Sequence
  Description of Artificial Sequence: Synthetic oligonucleotide
  Target: SCN10A; (+) strand; PAM type: YTN; PAM sequence: CTC
ctcttagcatgaagtcccat

SEQ ID NO: 66359 - DNA, 20 bp, Artificial Sequence
  Description of Artificial Sequence: Synthetic oligonucleotide
  Target: SCN10A; (+) strand; PAM type: YTN; PAM sequence: CTC
ttagcatgaagtcccatatc

SEQ ID NO: 66360 - DNA, 20 bp, Artificial Sequence
  Description of Artificial Sequence: Synthetic oligonucleotide
  Target: SCN10A; (+) strand; PAM type: YTN; PAM sequence: CTT
agcatgaagtcccatatcct

SEQ ID NO: 66361 - DNA, 20 bp, Artificial Sequence
  Description of Artificial Sequence: Synthetic oligonucleotide
  Target: SCN10A; (+) strand; PAM type: YTN; PAM sequence: TTA
gcatgaagtcccatatcctt

SEQ ID NO: 66362 - DNA, 20 bp, Artificial Sequence
  Description of Artificial Sequence: Synthetic oligonucleotide
  Target: SCN10A; (+) strand; PAM type: YTN; PAM sequence: CTT
aatgcagtctaggagtttct

SEQ ID NO: 66363 - DNA, 20 bp, Artificial Sequence
  Description of Artificial Sequence: Synthetic oligonucleotide
  Target: SCN10A; (+) strand; PAM type: YTN; PAM sequence: TTA
atgcagtctaggagtttctt

SEQ ID NO: 66364 - DNA, 20 bp, Artificial Sequence
  Description of Artificial Sequence: Synthetic oligonucleotide
  Target: SCN10A; (+) strand; PAM type: YTN; PAM sequence: CTA
ggagtttcttgggatctggc

SEQ ID NO: 66365 - DNA, 20 bp, Artificial Sequence
  Description of Artificial Sequence: Synthetic oligonucleotide
  Target: SCN10A; (+) strand; PAM type: YTN; PAM sequence: TTT
cttgggatctggccccaact

SEQ ID NO: 66366 - DNA, 20 bp, Artificial Sequence
  Description of Artificial Sequence: Synthetic oligonucleotide
  Target: SCN10A; (+) strand; PAM type: YTN; PAM sequence: TTC
ttgggatctggccccaactc

SEQ ID NO: 66367 - DNA, 20 bp, Artificial Sequence
  Description of Artificial Sequence: Synthetic oligonucleotide
  Target: SCN10A; (+) strand; PAM type: YTN; PAM sequence: CTT
gggatctggccccaactcat

SEQ ID NO: 66368 - DNA, 20 bp, Artificial Sequence
  Description of Artificial Sequence: Synthetic oligonucleotide
  Target: SCN10A; (+) strand; PAM type: YTN; PAM sequence: TTG
ggatctggccccaactcatc

SEQ ID NO: 66369 - DNA, 20 bp, Artificial Sequence
  Description of Artificial Sequence: Synthetic oligonucleotide
  Target: SCN10A; (+) strand; PAM type: YTN; PAM sequence: CTG
gccccaactcatccctctag

SEQ ID NO: 66370 - DNA, 20 bp, Artificial Sequence
  Description of Artificial Sequence: Synthetic oligonucleotide
  Target: SCN10A; (+) strand; PAM type: YTN; PAM sequence: CTC
atccctctagccttattttc

SEQ ID NO: 66371 - DNA, 20 bp, Artificial Sequence
  Description of Artificial Sequence: Synthetic oligonucleotide
  Target: SCN10A; (+) strand; PAM type: YTN; PAM sequence: CTC
tagccttattttcagttctc

SEQ ID NO: 66372 - DNA, 20 bp, Artificial Sequence
  Description of Artificial Sequence: Synthetic oligonucleotide
  Target: SCN10A; (+) strand; PAM type: YTN; PAM sequence: CTA
gccttattttcagttctcct

SEQ ID NO: 66373 - DNA, 20 bp, Artificial Sequence
  Description of Artificial Sequence: Synthetic oligonucleotide
  Target: SCN10A; (+) strand; PAM type: YTN; PAM sequence: CTT
attttcagttctcctggttc

SEQ ID NO: 66374 - DNA, 20 bp, Artificial Sequence
  Description of Artificial Sequence: Synthetic oligonucleotide
  Target: SCN10A; (+) strand; PAM type: YTN; PAM sequence: TTA
ttttcagttctcctggttct

SEQ ID NO: 66375 - DNA, 20 bp, Artificial Sequence
  Description of Artificial Sequence: Synthetic oligonucleotide
  Target: SCN10A; (+) strand; PAM type: YTN; PAM sequence: TTT
tcagttctcctggttctcta

SEQ ID NO: 66376 - DNA, 20 bp, Artificial Sequence
  Description of Artificial Sequence: Synthetic oligonucleotide
  Target: SCN10A; (+) strand; PAM type: YTN; PAM sequence: TTT
cagttctcctggttctctag

SEQ ID NO: 66377 - DNA, 20 bp, Artificial Sequence
  Description of Artificial Sequence: Synthetic oligonucleotide
  Target: SCN10A; (+) strand; PAM type: YTN; PAM sequence: TTC
agttctcctggttctctagg

SEQ ID NO: 66378 - DNA, 20 bp, Artificial Sequence
  Description of Artificial Sequence: Synthetic oligonucleotide
  Target: SCN10A; (+) strand; PAM type: YTN; PAM sequence: TTC
tcctggttctctaggttaca

SEQ ID NO: 66379 - DNA, 20 bp, Artificial Sequence
  Description of Artificial Sequence: Synthetic oligonucleotide
  Target: SCN10A; (+) strand; PAM type: YTN; PAM sequence: CTC
ctggttctctaggttacagc

SEQ ID NO: 66380 - DNA, 20 bp, Artificial Sequence
  Description of Artificial Sequence: Synthetic oligonucleotide
  Target: SCN10A; (+) strand; PAM type: YTN; PAM sequence: CTG
gttctctaggttacagctac

SEQ ID NO: 66381 - DNA, 20 bp, Artificial Sequence
  Description of Artificial Sequence: Synthetic oligonucleotide
  Target: SCN10A; (+) strand; PAM type: YTN; PAM sequence: TTC
tctaggttacagctacatta

SEQ ID NO: 66382 - DNA, 20 bp, Artificial Sequence
  Description of Artificial Sequence: Synthetic oligonucleotide
  Target: SCN10A; (+) strand; PAM type: YTN; PAM sequence: CTC
taggttacagctacattagg

SEQ ID NO: 66383 - DNA, 20 bp, Artificial Sequence
  Description of Artificial Sequence: Synthetic oligonucleotide
  Target: SCN10A; (+) strand; PAM type: YTN; PAM sequence: CTA
ggttacagctacattaggct

SEQ ID NO: 66384 - DNA, 20 bp, Artificial Sequence
  Description of Artificial Sequence: Synthetic oligonucleotide
  Target: SCN10A; (+) strand; PAM type: YTN; PAM sequence: TTA
cagctacattaggctttttc

SEQ ID NO: 66385 - DNA, 20 bp, Artificial Sequence
  Description of Artificial Sequence: Synthetic oligonucleotide
  Target: SCN10A; (+) strand; PAM type: YTN; PAM sequence: CTA
cattaggctttttcattcct

SEQ ID NO: 66386 - DNA, 20 bp, Artificial Sequence
  Description of Artificial Sequence: Synthetic oligonucleotide
  Target: SCN10A; (+) strand; PAM type: YTN; PAM sequence: TTA
ggctttttcattccttcaaa

SEQ ID NO: 66387 - DNA, 20 bp, Artificial Sequence
  Description of Artificial Sequence: Synthetic oligonucleotide
  Target: SCN10A; (+) strand; PAM type: YTN; PAM sequence: CTT
tttcattccttcaaatgtta

SEQ ID NO: 66388 - DNA, 20 bp, Artificial Sequence
  Description of Artificial Sequence: Synthetic oligonucleotide
  Target: SCN10A; (+) strand; PAM type: YTN; PAM sequence: TTT
ttcattccttcaaatgttat

SEQ ID NO: 66389 - DNA, 20 bp, Artificial Sequence
  Description of Artificial Sequence: Synthetic oligonucleotide
  Target: SCN10A; (+) strand; PAM type: YTN; PAM sequence: TTT
tcattccttcaaatgttatt

SEQ ID NO: 66390 - DNA, 20 bp, Artificial Sequence
  Description of Artificial Sequence: Synthetic oligonucleotide
  Target: SCN10A; (+) strand; PAM type: YTN; PAM sequence: TTT
cattccttcaaatgttattc

SEQ ID NO: 66391 - DNA, 20 bp, Artificial Sequence
  Description of Artificial Sequence: Synthetic oligonucleotide
  Target: SCN10A; (+) strand; PAM type: YTN; PAM sequence: TTC
attccttcaaatgttattct

SEQ ID NO: 66392 - DNA, 20 bp, Artificial Sequence
  Description of Artificial Sequence: Synthetic oligonucleotide
  Target: SCN10A; (+) strand; PAM type: YTN; PAM sequence: TTC
cttcaaatgttattctctct

SEQ ID NO: 66393 - DNA, 20 bp, Artificial Sequence
  Description of Artificial Sequence: Synthetic oligonucleotide
  Target: SCN10A; (+) strand; PAM type: YTN; PAM sequence: CTT
caaatgttattctctcttct

SEQ ID NO: 66394 - DNA, 20 bp, Artificial Sequence
  Description of Artificial Sequence: Synthetic oligonucleotide
  Target: SCN10A; (+) strand; PAM type: YTN; PAM sequence: TTC
aaatgttattctctcttctg

SEQ ID NO: 66395 - DNA, 20 bp, Artificial Sequence
  Description of Artificial Sequence: Synthetic oligonucleotide
  Target: SCN10A; (+) strand; PAM type: YTN; PAM sequence: TTA
ttctctcttctgctttgcag

SEQ ID NO: 66396 - DNA, 20 bp, Artificial Sequence
  Description of Artificial Sequence: Synthetic oligonucleotide
  Target: SCN10A; (+) strand; PAM type: YTN; PAM sequence: TTC
tctcttctgctttgcagtcc

SEQ ID NO: 66397 - DNA, 20 bp, Artificial Sequence
  Description of Artificial Sequence: Synthetic oligonucleotide
  Target: SCN10A; (+) strand; PAM type: YTN; PAM sequence: CTC
tcttctgctttgcagtcctt

SEQ ID NO: 66398 - DNA, 20 bp, Artificial Sequence
  Description of Artificial Sequence: Synthetic oligonucleotide
  Target: SCN10A; (+) strand; PAM type: YTN; PAM sequence: CTC
ttctgctttgcagtcctttc

SEQ ID NO: 66399 - DNA, 20 bp, Artificial Sequence
  Description of Artificial Sequence: Synthetic oligonucleotide
  Target: SCN10A; (+) strand; PAM type: YTN; PAM sequence: CTT
ctgctttgcagtcctttcag

SEQ ID NO: 66400 - DNA, 20 bp, Artificial Sequence
  Description of Artificial Sequence: Synthetic oligonucleotide
  Target: SCN10A; (+) strand; PAM type: YTN; PAM sequence: TTC
tgctttgcagtcctttcagc

SEQ ID NO: 66401 - DNA, 20 bp, Artificial Sequence
  Description of Artificial Sequence: Synthetic oligonucleotide
  Target: SCN10A; (+) strand; PAM type: YTN; PAM sequence: CTG
ctttgcagtcctttcagcct

SEQ ID NO: 66402 - DNA, 20 bp, Artificial Sequence
  Description of Artificial Sequence: Synthetic oligonucleotide
  Target: SCN10A; (+) strand; PAM type: YTN; PAM sequence: CTT
tgcagtcctttcagcctggg

SEQ ID NO: 66403 - DNA, 20 bp, Artificial Sequence
  Description of Artificial Sequence: Synthetic oligonucleotide
  Target: SCN10A; (+) strand; PAM type: YTN; PAM sequence: TTT
gcagtcctttcagcctggga

SEQ ID NO: 66404 - DNA, 20 bp, Artificial Sequence
  Description of Artificial Sequence: Synthetic oligonucleotide
  Target: SCN10A; (+) strand; PAM type: YTN; PAM sequence: TTG
cagtcctttcagcctgggat

SEQ ID NO: 66405 - DNA, 20 bp, Artificial Sequence
  Description of Artificial Sequence: Synthetic oligonucleotide
  Target: SCN10A; (+) strand; PAM type: YTN; PAM sequence: CTT
tcagcctgggataattccct

SEQ ID NO: 66406 - DNA, 20 bp, Artificial Sequence
  Description of Artificial Sequence: Synthetic oligonucleotide
  Target: SCN10A; (+) strand; PAM type: YTN; PAM sequence: TTT
cagcctgggataattccctg

SEQ ID NO: 66407 - DNA, 20 bp, Artificial Sequence
  Description of Artificial Sequence: Synthetic oligonucleotide
  Target: SCN10A; (+) strand; PAM type: YTN; PAM sequence: TTC
agcctgggataattccctgg

SEQ ID NO: 66408 - DNA, 20 bp, Artificial Sequence
  Description of Artificial Sequence: Synthetic oligonucleotide
  Target: SCN10A; (+) strand; PAM type: YTN; PAM sequence: CTG
ggataattccctggctccag

SEQ ID NO: 66409 - DNA, 20 bp, Artificial Sequence
  Description of Artificial Sequence: Synthetic oligonucleotide
  Target: SCN10A; (+) strand; PAM type: YTN; PAM sequence: TTC
cctggctccaggcaaatctt

SEQ ID NO: 66410 - DNA, 20 bp, Artificial Sequence
  Description of Artificial Sequence: Synthetic oligonucleotide
  Target: SCN10A; (+) strand; PAM type: YTN; PAM sequence: CTG
gctccaggcaaatcttacca

SEQ ID NO: 66411 - DNA, 20 bp, Artificial Sequence
  Description of Artificial Sequence: Synthetic oligonucleotide
  Target: SCN10A; (+) strand; PAM type: YTN; PAM sequence: CTC
caggcaaatcttaccatatt

SEQ ID NO: 66412 - DNA, 20 bp, Artificial Sequence
  Description of Artificial Sequence: Synthetic oligonucleotide
  Target: SCN10A; (+) strand; PAM type: YTN; PAM sequence: CTT
accatatttcacttagtatc

SEQ ID NO: 66413 - DNA, 20 bp, Artificial Sequence
  Description of Artificial Sequence: Synthetic oligonucleotide
  Target: SCN10A; (+) strand; PAM type: YTN; PAM sequence: TTA
ccatatttcacttagtatcc

SEQ ID NO: 66414 - DNA, 20 bp, Artificial Sequence
  Description of Artificial Sequence: Synthetic oligonucleotide
  Target: SCN10A; (+) strand; PAM type: YTN; PAM sequence: TTT
cacttagtatcctgcacttc

SEQ ID NO: 66415 - DNA, 20 bp, Artificial Sequence
  Description of Artificial Sequence: Synthetic oligonucleotide
  Target: SCN10A; (+) strand; PAM type: YTN; PAM sequence: TTC
acttagtatcctgcacttcc

SEQ ID NO: 66416 - DNA, 20 bp, Artificial Sequence
  Description of Artificial Sequence: Synthetic oligonucleotide
  Target: SCN10A; (+) strand; PAM type: YTN; PAM sequence: CTT
agtatcctgcacttcctctt

SEQ ID NO: 66417 - DNA, 20 bp, Artificial Sequence
  Description of Artificial Sequence: Synthetic oligonucleotide
  Target: SCN10A; (+) strand; PAM type: YTN; PAM sequence: TTA
gtatcctgcacttcctcttt

SEQ ID NO: 66418 - DNA, 20 bp, Artificial Sequence
  Description of Artificial Sequence: Synthetic oligonucleotide
  Target: SCN10A; (+) strand; PAM type: YTN; PAM sequence: CTG
cacttcctctttaaggcact

SEQ ID NO: 66419 - DNA, 20 bp, Artificial Sequence
  Description of Artificial Sequence: Synthetic oligonucleotide
  Target: SCN10A; (+) strand; PAM type: YTN; PAM sequence: CTT
cctctttaaggcactcacca

SEQ ID NO: 66420 - DNA, 20 bp, Artificial Sequence
  Description of Artificial Sequence: Synthetic oligonucleotide
  Target: SCN10A; (+) strand; PAM type: YTN; PAM sequence: TTC
ctctttaaggcactcaccac

SEQ ID NO: 66421 - DNA, 20 bp, Artificial Sequence
  Description of Artificial Sequence: Synthetic oligonucleotide
  Target: SCN10A; (+) strand; PAM type: YTN; PAM sequence: CTC
tttaaggcactcaccactcc

SEQ ID NO: 66422 - DNA, 20 bp, Artificial Sequence
  Description of Artificial Sequence: Synthetic oligonucleotide
  Target: SCN10A; (+) strand; PAM type: YTN; PAM sequence: CTT
taaggcactcaccactccag

SEQ ID NO: 66423 - DNA, 20 bp, Artificial Sequence
  Description of Artificial Sequence: Synthetic oligonucleotide
  Target: SCN10A; (+) strand; PAM type: YTN; PAM sequence: TTT
aaggcactcaccactccagt

SEQ ID NO: 66424 - DNA, 20 bp, Artificial Sequence
  Description of Artificial Sequence: Synthetic oligonucleotide
  Target: SCN10A; (+) strand; PAM type: YTN; PAM sequence: TTA
aggcactcaccactccagta

SEQ ID NO: 66425 - DNA, 20 bp, Artificial Sequence
  Description of Artificial Sequence: Synthetic oligonucleotide
  Target: SCN10A; (+) strand; PAM type: YTN; PAM sequence: CTC
accactccagtaagctcact

SEQ ID NO: 66426 - DNA, 20 bp, Artificial Sequence
  Description of Artificial Sequence: Synthetic oligonucleotide
  Target: SCN10A; (+) strand; PAM type: YTN; PAM sequence: CTC
cagtaagctcactgctgtga

SEQ ID NO: 66427 - DNA, 20 bp, Artificial Sequence
  Description of Artificial Sequence: Synthetic oligonucleotide
  Target: SCN10A; (+) strand; PAM type: YTN; PAM sequence: CTC
actgctgtgacccagcttct

SEQ ID NO: 66428 - DNA, 20 bp, Artificial Sequence
  Description of Artificial Sequence: Synthetic oligonucleotide
  Target: SCN10A; (+) strand; PAM type: YTN; PAM sequence: CTG
ctgtgacccagcttctggaa

SEQ ID NO: 66429 - DNA, 20 bp, Artificial Sequence
  Description of Artificial Sequence: Synthetic oligonucleotide
  Target: SCN10A; (+) strand; PAM type: YTN; PAM sequence: CTG
tgacccagcttctggaattc

SEQ ID NO: 66430 - DNA, 20 bp, Artificial Sequence
  Description of Artificial Sequence: Synthetic oligonucleotide
  Target: SCN10A; (+) strand; PAM type: YTN; PAM sequence: CTT
ctggaattctggcttggaca

SEQ ID NO: 66431 - DNA, 20 bp, Artificial Sequence
  Description of Artificial Sequence: Synthetic oligonucleotide
  Target: SCN10A; (+) strand; PAM type: YTN; PAM sequence: TTC
tggaattctggcttggacaa

SEQ ID NO: 66432 - DNA, 20 bp, Artificial Sequence
  Description of Artificial Sequence: Synthetic oligonucleotide
  Target: SCN10A; (+) strand; PAM type: YTN; PAM sequence: CTG
gaattctggcttggacaaca

SEQ ID NO: 66433 - DNA, 20 bp, Artificial Sequence
  Description of Artificial Sequence: Synthetic oligonucleotide
  Target: SCN10A; (+) strand; PAM type: YTN; PAM sequence: TTC
tggcttggacaacagtgaaa

SEQ ID NO: 66434 - DNA, 20 bp, Artificial Sequence
  Description of Artificial Sequence: Synthetic oligonucleotide
  Target: SCN10A; (+) strand; PAM type: YTN; PAM sequence: CTG
gcttggacaacagtgaaatc

SEQ ID NO: 66435 - DNA, 20 bp, Artificial Sequence
  Description of Artificial Sequence: Synthetic oligonucleotide
  Target: SCN10A; (+) strand; PAM type: YTN; PAM sequence: CTT
ggacaacagtgaaatctcag

SEQ ID NO: 66436 - DNA, 20 bp, Artificial Sequence
  Description of Artificial Sequence: Synthetic oligonucleotide
  Target: SCN10A; (+) strand; PAM type: YTN; PAM sequence: TTG
gacaacagtgaaatctcagc

SEQ ID NO: 66437 - DNA, 20 bp, Artificial Sequence
  Description of Artificial Sequence: Synthetic oligonucleotide
  Target: SCN10A; (+) strand; PAM type: YTN; PAM sequence: CTC
agcttgcatgccaagcatag

SEQ ID NO: 66438 - DNA, 20 bp, Artificial Sequence
  Description of Artificial Sequence: Synthetic oligonucleotide
  Target: SCN10A; (+) strand; PAM type: YTN; PAM sequence: CTT
gcatgccaagcatagaaggt

SEQ ID NO: 66439 - DNA, 20 bp, Artificial Sequence
  Description of Artificial Sequence: Synthetic oligonucleotide
  Target: SCN10A; (+) strand; PAM type: YTN; PAM sequence: TTG
catgccaagcatagaaggtt

SEQ ID NO: 66440 - DNA, 20 bp, Artificial Sequence
  Description of Artificial Sequence: Synthetic oligonucleotide
  Target: SCN10A; (+) strand; PAM type: YTN; PAM sequence: TTC
acatgctttgagttcagtga

SEQ ID NO: 66441 - DNA, 20 bp, Artificial Sequence
  Description of Artificial Sequence: Synthetic oligonucleotide
  Target: SCN10A; (+) strand; PAM type: YTN; PAM sequence: CTT
tgagttcagtgaattgtcaa

SEQ ID NO: 66442 - DNA, 20 bp, Artificial Sequence
  Description of Artificial Sequence: Synthetic oligonucleotide
  Target: SCN10A; (+) strand; PAM type: YTN; PAM sequence: TTT
gagttcagtgaattgtcaaa

SEQ ID NO: 66443 - DNA, 20 bp, Artificial Sequence
  Description of Artificial Sequence: Synthetic oligonucleotide
  Target: SCN10A; (+) strand; PAM type: YTN; PAM sequence: TTG
agttcagtgaattgtcaaac

SEQ ID NO: 66444 - DNA, 20 bp, Artificial Sequence
  Description of Artificial Sequence: Synthetic oligonucleotide
  Target: SCN10A; (+) strand; PAM type: YTN; PAM sequence: TTC
agtgaattgtcaaactcctg

SEQ ID NO: 66445 - DNA, 20 bp, Artificial Sequence
  Description of Artificial Sequence: Synthetic oligonucleotide
  Target: SCN10A; (+) strand; PAM type: YTN; PAM sequence: TTG
tcaaactcctgttggtttgg

SEQ ID NO: 66446 - DNA, 20 bp, Artificial Sequence
  Description of Artificial Sequence: Synthetic oligonucleotide
  Target: SCN10A; (+) strand; PAM type: YTN; PAM sequence: CTC
ctgttggtttgggccaaact

SEQ ID NO: 66447 - DNA, 20 bp, Artificial Sequence
  Description of Artificial Sequence: Synthetic oligonucleotide
  Target: SCN10A; (+) strand; PAM type: YTN; PAM sequence: CTG
ttggtttgggccaaactttc

SEQ ID NO: 66448 - DNA, 20 bp, Artificial Sequence
  Description of Artificial Sequence: Synthetic oligonucleotide
  Target: SCN10A; (+) strand; PAM type: YTN; PAM sequence: TTG
gtttgggccaaactttctta

SEQ ID NO: 66449 - DNA, 20 bp, Artificial Sequence
  Description of Artificial Sequence: Synthetic oligonucleotide
  Target: SCN10A; (+) strand; PAM type: YTN; PAM sequence: TTT
gggccaaactttcttaagca

SEQ ID NO: 66450 - DNA, 20 bp, Artificial Sequence
  Description of Artificial Sequence: Synthetic oligonucleotide
  Target: SCN10A; (+) strand; PAM type: YTN; PAM sequence: TTG
ggccaaactttcttaagcat

SEQ ID NO: 66451 - DNA, 20 bp, Artificial Sequence
  Description of Artificial Sequence: Synthetic oligonucleotide
  Target: SCN10A; (+) strand; PAM type: YTN; PAM sequence: CTT
tcttaagcataatccctctt

SEQ ID NO: 66452 - DNA, 20 bp, Artificial Sequence
  Description of Artificial Sequence: Synthetic oligonucleotide
  Target: SCN10A; (+) strand; PAM type: YTN; PAM sequence: TTT
cttaagcataatccctctta

SEQ ID NO: 66453 - DNA, 20 bp, Artificial Sequence
  Description of Artificial Sequence: Synthetic oligonucleotide
  Target: SCN10A; (+) strand; PAM type: YTN; PAM sequence: TTC
ttaagcataatccctcttaa

SEQ ID NO: 66454 - DNA, 20 bp, Artificial Sequence
  Description of Artificial Sequence: Synthetic oligonucleotide
  Target: SCN10A; (+) strand; PAM type: YTN; PAM sequence: CTT
aagcataatccctcttaaag

SEQ ID NO: 66455 - DNA, 20 bp, Artificial Sequence
  Description of Artificial Sequence: Synthetic oligonucleotide
  Target: SCN10A; (+) strand; PAM type: YTN; PAM sequence: TTA
agcataatccctcttaaaga

SEQ ID NO: 66456 - DNA, 20 bp, Artificial Sequence
  Description of Artificial Sequence: Synthetic oligonucleotide
  Target: SCN10A; (+) strand; PAM type: YTN; PAM sequence: CTC
ttaaagaggtggcctttata

SEQ ID NO: 66457 - DNA, 20 bp, Artificial Sequence
  Description of Artificial Sequence: Synthetic oligonucleotide
  Target: SCN10A; (+) strand; PAM type: YTN; PAM sequence: CTT
aaagaggtggcctttataaa

SEQ ID NO: 66458 - DNA, 20 bp, Artificial Sequence
  Description of Artificial Sequence: Synthetic oligonucleotide
  Target: SCN10A; (+) strand; PAM type: YTN; PAM sequence: TTA
aagaggtggcctttataaat

SEQ ID NO: 66459 - DNA, 20 bp, Artificial Sequence
  Description of Artificial Sequence: Synthetic oligonucleotide
  Target: SCN10A; (+) strand; PAM type: YTN; PAM sequence: CTT
tataaatcctattacgactc

SEQ ID NO: 66460 - DNA, 20 bp, Artificial Sequence
  Description of Artificial Sequence: Synthetic oligonucleotide
  Target: SCN10A; (+) strand; PAM type: YTN; PAM sequence: TTT
ataaatcctattacgactct

SEQ ID NO: 66461 - DNA, 20 bp, Artificial Sequence
  Description of Artificial Sequence: Synthetic oligonucleotide
  Target: SCN10A; (+) strand; PAM type: YTN; PAM sequence: TTA
taaatcctattacgactctg

SEQ ID NO: 66462 - DNA, 20 bp, Artificial Sequence
  Description of Artificial Sequence: Synthetic oligonucleotide
  Target: SCN10A; (+) strand; PAM type: YTN; PAM sequence: CTA
ttacgactctggcagcatga

SEQ ID NO: 66463 - DNA, 20 bp, Artificial Sequence
  Description of Artificial Sequence: Synthetic oligonucleotide
  Target: SCN10A; (+) strand; PAM type: YTN; PAM sequence: TTA
cgactctggcagcatgaagc

SEQ ID NO: 66464 - DNA, 20 bp, Artificial Sequence
  Description of Artificial Sequence: Synthetic oligonucleotide
  Target: SCN10A; (+) strand; PAM type: YTN; PAM sequence: CTC
tggcagcatgaagcatcctt

SEQ ID NO: 66465 - DNA, 20 bp, Artificial Sequence
  Description of Artificial Sequence: Synthetic oligonucleotide
  Target: SCN10A; (+) strand; PAM type: YTN; PAM sequence: CTG
gcagcatgaagcatccttca

SEQ ID NO: 66466 - DNA, 20 bp, Artificial Sequence
  Description of Artificial Sequence: Synthetic oligonucleotide
  Target: SCN10A; (+) strand; PAM type: YTN; PAM sequence: CTT
caggtgtctcatgtgtgtaa

SEQ ID NO: 66467 - DNA, 20 bp, Artificial Sequence
  Description of Artificial Sequence: Synthetic oligonucleotide
  Target: SCN10A; (+) strand; PAM type: YTN; PAM sequence: TTC
aggtgtctcatgtgtgtaat

SEQ ID NO: 66468 - DNA, 20 bp, Artificial Sequence
  Description of Artificial Sequence: Synthetic oligonucleotide
  Target: SCN10A; (+) strand; PAM type: YTN; PAM sequence: CTC
atgtgtgtaatgaatataac

SEQ ID NO: 66469 - DNA, 20 bp, Artificial Sequence
  Description of Artificial Sequence: Synthetic oligonucleotide
  Target: SCN10A; (+) strand; PAM type: YTN; PAM sequence: CTA
tgctcagaaaactttgacct

SEQ ID NO: 66470 - DNA, 20 bp, Artificial Sequence
  Description of Artificial Sequence: Synthetic oligonucleotide
  Target: SCN10A; (+) strand; PAM type: YTN; PAM sequence: CTC
agaaaactttgacctctttt

SEQ ID NO: 66471 - DNA, 20 bp, Artificial Sequence
  Description of Artificial Sequence: Synthetic oligonucleotide
  Target: SCN10A; (+) strand; PAM type: YTN; PAM sequence: CTT
tgacctcttttatttaacct

SEQ ID NO: 66472 - DNA, 20 bp, Artificial Sequence
  Description of Artificial Sequence: Synthetic oligonucleotide
  Target: SCN10A; (+) strand; PAM type: YTN; PAM sequence: TTT
gacctcttttatttaaccta

SEQ ID NO: 66473 - DNA, 20 bp, Artificial Sequence
  Description of Artificial Sequence: Synthetic oligonucleotide
  Target: SCN10A; (+) strand; PAM type: YTN; PAM sequence: TTG
acctcttttatttaacctaa

SEQ ID NO: 66474 - DNA, 20 bp, Artificial Sequence
  Description of Artificial Sequence: Synthetic oligonucleotide
  Target: SCN10A; (+) strand; PAM type: YTN; PAM sequence: CTC
ttttatttaacctaaggttt

SEQ ID NO: 66475 - DNA, 20 bp, Artificial Sequence
  Description of Artificial Sequence: Synthetic oligonucleotide
  Target: SCN10A; (+) strand; PAM type: YTN; PAM sequence: CTT
ttatttaacctaaggtttcc

SEQ ID NO: 66476 - DNA, 20 bp, Artificial Sequence
  Description of Artificial Sequence: Synthetic oligonucleotide
  Target: SCN10A; (+) strand; PAM type: YTN; PAM sequence: TTT
tatttaacctaaggtttcct

SEQ ID NO: 66477 - DNA, 20 bp, Artificial Sequence
  Description of Artificial Sequence: Synthetic oligonucleotide
  Target: SCN10A; (+) strand; PAM type: YTN; PAM sequence: TTT
atttaacctaaggtttcctc

SEQ ID NO: 66478 - DNA, 20 bp, Artificial Sequence
  Description of Artificial Sequence: Synthetic oligonucleotide
  Target: SCN10A; (+) strand; PAM type: YTN; PAM sequence: TTA
tttaacctaaggtttcctct

SEQ ID NO: 66479 - DNA, 20 bp, Artificial Sequence
  Description of Artificial Sequence: Synthetic oligonucleotide
  Target: SCN10A; (+) strand; PAM type: YTN; PAM sequence: TTT
aacctaaggtttcctctcct

SEQ ID NO: 66480 - DNA, 20 bp, Artificial Sequence
  Description of Artificial Sequence: Synthetic oligonucleotide
  Target: SCN10A; (+) strand; PAM type: YTN; PAM sequence: TTA
acctaaggtttcctctcctc

SEQ ID NO: 66481 - DNA, 20 bp, Artificial Sequence
  Description of Artificial Sequence: Synthetic oligonucleotide
  Target: SCN10A; (+) strand; PAM type: YTN; PAM sequence: CTA
aggtttcctctcctcagatt

SEQ ID NO: 66482 - DNA, 20 bp, Artificial Sequence
  Description of Artificial Sequence: Synthetic oligonucleotide
  Target: SCN10A; (+) strand; PAM type: YTN; PAM sequence: TTT
cctctcctcagattttcttt

SEQ ID NO: 66483 - DNA, 20 bp, Artificial Sequence
  Description of Artificial Sequence: Synthetic oligonucleotide
  Target: SCN10A; (+) strand; PAM type: YTN; PAM sequence: TTC
ctctcctcagattttcttta

SEQ ID NO: 66484 - DNA, 20 bp, Artificial Sequence
  Description of Artificial Sequence: Synthetic oligonucleotide
  Target: SCN10A; (+) strand; PAM type: YTN; PAM sequence: CTC
tcctcagattttctttaaaa

SEQ ID NO: 66485 - DNA, 20 bp, Artificial Sequence
  Description of Artificial Sequence: Synthetic oligonucleotide
  Target: SCN10A; (+) strand; PAM type: YTN; PAM sequence: CTC
ctcagattttctttaaaaca

SEQ ID NO: 66486 - DNA, 20 bp, Artificial Sequence
  Description of Artificial Sequence: Synthetic oligonucleotide
  Target: SCN10A; (+) strand; PAM type: YTN; PAM sequence: CTC
agattttctttaaaacatca

SEQ ID NO: 66487 - DNA, 20 bp, Artificial Sequence
  Description of Artificial Sequence: Synthetic oligonucleotide
  Target: SCN10A; (+) strand; PAM type: YTN; PAM sequence: TTT
tctttaaaacatcattgttt

SEQ ID NO: 66488 - DNA, 20 bp, Artificial Sequence
  Description of Artificial Sequence: Synthetic oligonucleotide
  Target: SCN10A; (+) strand; PAM type: YTN; PAM sequence: TTT
ctttaaaacatcattgtttc

SEQ ID NO: 66489 - DNA, 20 bp, Artificial Sequence
  Description of Artificial Sequence: Synthetic oligonucleotide
  Target: SCN10A; (+) strand; PAM type: YTN; PAM sequence: TTC
tttaaaacatcattgtttct

SEQ ID NO: 66490 - DNA, 20 bp, Artificial Sequence
  Description of Artificial Sequence: Synthetic oligonucleotide
  Target: SCN10A; (+) strand; PAM type: YTN; PAM sequence: CTT
taaaacatcattgtttctct

SEQ ID NO: 66491 - DNA, 20 bp, Artificial Sequence
  Description of Artificial Sequence: Synthetic oligonucleotide
  Target: SCN10A; (+) strand; PAM type: YTN; PAM sequence: TTT
aaaacatcattgtttctctg

SEQ ID NO: 66492 - DNA, 20 bp, Artificial Sequence
  Description of Artificial Sequence: Synthetic oligonucleotide
  Target: SCN10A; (+) strand; PAM type: YTN; PAM sequence: TTA
aaacatcattgtttctctgg

SEQ ID NO: 66493 - DNA, 20 bp, Artificial Sequence
  Description of Artificial Sequence: Synthetic oligonucleotide
  Target: SCN10A; (+) strand; PAM type: YTN; PAM sequence: TTG
tttctctggcctttcttact

SEQ ID NO: 66494 - DNA, 20 bp, Artificial Sequence
  Description of Artificial Sequence: Synthetic oligonucleotide
  Target: SCN10A; (+) strand; PAM type: YTN; PAM sequence: TTT
ctctggcctttcttactcta

SEQ ID NO: 66495 - DNA, 20 bp, Artificial Sequence
  Description of Artificial Sequence: Synthetic oligonucleotide
  Target: SCN10A; (+) strand; PAM type: YTN; PAM sequence: TTC
tctggcctttcttactctac

SEQ ID NO: 66496 - DNA, 20 bp, Artificial Sequence
  Description of Artificial Sequence: Synthetic oligonucleotide
  Target: SCN10A; (+) strand; PAM type: YTN; PAM sequence: CTC
tggcctttcttactctactg

SEQ ID NO: 66497 - DNA, 20 bp, Artificial Sequence
  Description of Artificial Sequence: Synthetic oligonucleotide
  Target: SCN10A; (+) strand; PAM type: YTN; PAM sequence: CTG
gcctttcttactctactgtc

SEQ ID NO: 66498 - DNA, 20 bp, Artificial Sequence
  Description of Artificial Sequence: Synthetic oligonucleotide
  Target: SCN10A; (+) strand; PAM type: YTN; PAM sequence: CTT
tcttactctactgtcacagc

SEQ ID NO: 66499 - DNA, 20 bp, Artificial Sequence
  Description of Artificial Sequence: Synthetic oligonucleotide
  Target: SCN10A; (+) strand; PAM type: YTN; PAM sequence: TTT
cttactctactgtcacagca

SEQ ID NO: 66500 - DNA, 20 bp, Artificial Sequence
  Description of Artificial Sequence: Synthetic oligonucleotide
  Target: SCN10A; (+) strand; PAM type: YTN; PAM sequence: TTC
ttactctactgtcacagcat

SEQ ID NO: 66501 - DNA, 20 bp, Artificial Sequence
  Description of Artificial Sequence: Synthetic oligonucleotide
  Target: SCN10A; (+) strand; PAM type: YTN; PAM sequence: CTT
actctactgtcacagcatct

SEQ ID NO: 66502 - DNA, 20 bp, Artificial Sequence
  Description of Artificial Sequence: Synthetic oligonucleotide
  Target: SCN10A; (+) strand; PAM type: YTN; PAM sequence: TTA
ctctactgtcacagcatctt

SEQ ID NO: 66503 - DNA, 20 bp, Artificial Sequence
  Description of Artificial Sequence: Synthetic oligonucleotide
  Target: SCN10A; (+) strand; PAM type: YTN; PAM sequence: CTC
tactgtcacagcatcttcct

SEQ ID NO: 66504 - DNA, 20 bp, Artificial Sequence
  Description of Artificial Sequence: Synthetic oligonucleotide
  Target: SCN10A; (+) strand; PAM type: YTN; PAM sequence: CTA
ctgtcacagcatcttccttg

SEQ ID NO: 66505 - DNA, 20 bp, Artificial Sequence
  Description of Artificial Sequence: Synthetic oligonucleotide
  Target: SCN10A; (+) strand; PAM type: YTN; PAM sequence: CTG
tcacagcatcttccttgagg

SEQ ID NO: 66506 - DNA, 20 bp, Artificial Sequence
  Description of Artificial Sequence: Synthetic oligonucleotide
  Target: SCN10A; (+) strand; PAM type: YTN; PAM sequence: CTT
ccttgaggggaagtctaccc

SEQ ID NO: 66507 - DNA, 20 bp, Artificial Sequence
  Description of Artificial Sequence: Synthetic oligonucleotide
  Target: SCN10A; (+) strand; PAM type: YTN; PAM sequence: TTC
cttgaggggaagtctaccct

SEQ ID NO: 66508 - DNA, 20 bp, Artificial Sequence
  Description of Artificial Sequence: Synthetic oligonucleotide
  Target: SCN10A; (+) strand; PAM type: YTN; PAM sequence: CTT
gaggggaagtctaccctacc

SEQ ID NO: 66509 - DNA, 20 bp, Artificial Sequence
  Description of Artificial Sequence: Synthetic oligonucleotide
  Target: SCN10A; (+) strand; PAM type: YTN; PAM sequence: TTG
aggggaagtctaccctaccc

SEQ ID NO: 66510 - DNA, 20 bp, Artificial Sequence
  Description of Artificial Sequence: Synthetic oligonucleotide
  Target: SCN10A; (+) strand; PAM type: YTN; PAM sequence: CTA
ccctaccccaacatatttgc

SEQ ID NO: 66511 - DNA, 20 bp, Artificial Sequence
  Description of Artificial Sequence: Synthetic oligonucleotide
  Target: SCN10A; (+) strand; PAM type: YTN; PAM sequence: CTA
ccccaacatatttgcctatt

SEQ ID NO: 66512 - DNA, 20 bp, Artificial Sequence
  Description of Artificial Sequence: Synthetic oligonucleotide
  Target: SCN10A; (+) strand; PAM type: YTN; PAM sequence: TTT
gcctattacttattttcttc

SEQ ID NO: 66513 - DNA, 20 bp, Artificial Sequence
  Description of Artificial Sequence: Synthetic oligonucleotide
  Target: SCN10A; (+) strand; PAM type: YTN; PAM sequence: TTG
cctattacttattttcttcc

SEQ ID NO: 66514 - DNA, 20 bp, Artificial Sequence
  Description of Artificial Sequence: Synthetic oligonucleotide
  Target: SCN10A; (+) strand; PAM type: YTN; PAM sequence: CTA
ttacttattttcttcctttt

SEQ ID NO: 66515 - DNA, 20 bp, Artificial Sequence
  Description of Artificial Sequence: Synthetic oligonucleotide
  Target: SCN10A; (+) strand; PAM type: YTN; PAM sequence: TTA
cttattttcttcctttttat

SEQ ID NO: 66516 - DNA, 20 bp, Artificial Sequence
  Description of Artificial Sequence: Synthetic oligonucleotide
  Target: SCN10A; (+) strand; PAM type: YTN; PAM sequence: CTT
attttcttcctttttatcag

SEQ ID NO: 66517 - DNA, 20 bp, Artificial Sequence
  Description of Artificial Sequence: Synthetic oligonucleotide
  Target: SCN10A; (+) strand; PAM type: YTN; PAM sequence: TTA
ttttcttcctttttatcagt

SEQ ID NO: 66518 - DNA, 20 bp, Artificial Sequence
  Description of Artificial Sequence: Synthetic oligonucleotide
  Target: SCN10A; (+) strand; PAM type: YTN; PAM sequence: TTT
tcttcctttttatcagttca

SEQ ID NO: 66519 - DNA, 20 bp, Artificial Sequence
  Description of Artificial Sequence: Synthetic oligonucleotide
  Target: SCN10A; (+) strand; PAM type: YTN; PAM sequence: TTT
cttcctttttatcagttcac

SEQ ID NO: 66520 - DNA, 20 bp, Artificial Sequence
  Description of Artificial Sequence: Synthetic oligonucleotide
  Target: SCN10A; (+) strand; PAM type: YTN; PAM sequence: TTC
ttcctttttatcagttcaca

SEQ ID NO: 66521 - DNA, 20 bp, Artificial Sequence
  Description of Artificial Sequence: Synthetic oligonucleotide
  Target: SCN10A; (+) strand; PAM type: YTN; PAM sequence: CTT
cctttttatcagttcacact

SEQ ID NO: 66522 - DNA, 20 bp, Artificial Sequence
  Description of Artificial Sequence: Synthetic oligonucleotide
  Target: SCN10A; (+) strand; PAM type: YTN; PAM sequence: TTC
ctttttatcagttcacactg

SEQ ID NO: 66523 - DNA, 20 bp, Artificial Sequence
  Description of Artificial Sequence: Synthetic oligonucleotide
  Target: SCN10A; (+) strand; PAM type: YTN; PAM sequence: CTT
tttatcagttcacactgtta

SEQ ID NO: 66524 - DNA, 20 bp, Artificial Sequence
  Description of Artificial Sequence: Synthetic oligonucleotide
  Target: SCN10A; (+) strand; PAM type: YTN; PAM sequence: TTT
ttatcagttcacactgttat

SEQ ID NO: 66525 - DNA, 20 bp, Artificial Sequence
  Description of Artificial Sequence: Synthetic oligonucleotide
  Target: SCN10A; (+) strand; PAM type: YTN; PAM sequence: TTT
tatcagttcacactgttata

SEQ ID NO: 66526 - DNA, 20 bp, Artificial Sequence
  Description of Artificial Sequence: Synthetic oligonucleotide
  Target: SCN10A; (+) strand; PAM type: YTN; PAM sequence: TTT
atcagttcacactgttataa

SEQ ID NO: 66527 - DNA, 20 bp, Artificial Sequence
  Description of Artificial Sequence: Synthetic oligonucleotide
  Target: SCN10A; (+) strand; PAM type: YTN; PAM sequence: TTA
tcagttcacactgttataaa

SEQ ID NO: 66528 - DNA, 20 bp, Artificial Sequence
  Description of Artificial Sequence: Synthetic oligonucleotide
  Target: SCN10A; (+) strand; PAM type: YTN; PAM sequence: TTC
acactgttataaattagcat

SEQ ID NO: 66529 - DNA, 20 bp, Artificial Sequence
  Description of Artificial Sequence: Synthetic oligonucleotide
  Target: SCN10A; (+) strand; PAM type: YTN; PAM sequence: CTG
ttataaattagcatcactcc

SEQ ID NO: 66530 - DNA, 20 bp, Artificial Sequence
  Description of Artificial Sequence: Synthetic oligonucleotide
  Target: SCN10A; (+) strand; PAM type: YTN; PAM sequence: TTA
taaattagcatcactcccgc

SEQ ID NO: 66531 - DNA, 20 bp, Artificial Sequence
  Description of Artificial Sequence: Synthetic oligonucleotide
  Target: SCN10A; (+) strand; PAM type: YTN; PAM sequence: TTA
gcatcactcccgccgccaac

SEQ ID NO: 66532 - DNA, 20 bp, Artificial Sequence
  Description of Artificial Sequence: Synthetic oligonucleotide
  Target: SCN10A; (+) strand; PAM type: YTN; PAM sequence: CTC
ccgccgccaaccacccaaat

SEQ ID NO: 66533 - DNA, 20 bp, Artificial Sequence
  Description of Artificial Sequence: Synthetic oligonucleotide
  Target: SCN10A; (+) strand; PAM type: YTN; PAM sequence: CTT
tgtgcatgcacttgtcttct

SEQ ID NO: 66534 - DNA, 20 bp, Artificial Sequence
  Description of Artificial Sequence: Synthetic oligonucleotide
  Target: SCN10A; (+) strand; PAM type: YTN; PAM sequence: TTT
gtgcatgcacttgtcttctg

SEQ ID NO: 66535 - DNA, 20 bp, Artificial Sequence
  Description of Artificial Sequence: Synthetic oligonucleotide
  Target: SCN10A; (+) strand; PAM type: YTN; PAM sequence: TTG
tgcatgcacttgtcttctgg

SEQ ID NO: 66536 - DNA, 20 bp, Artificial Sequence
  Description of Artificial Sequence: Synthetic oligonucleotide
  Target: SCN10A; (+) strand; PAM type: YTN; PAM sequence: CTT
gtcttctgggtaatggaggt

SEQ ID NO: 66537 - DNA, 20 bp, Artificial Sequence
  Description of Artificial Sequence: Synthetic oligonucleotide
  Target: SCN10A; (+) strand; PAM type: YTN; PAM sequence: TTG
tcttctgggtaatggaggtc

SEQ ID NO: 66538 - DNA, 20 bp, Artificial Sequence
  Description of Artificial Sequence: Synthetic oligonucleotide
  Target: SCN10A; (+) strand; PAM type: YTN; PAM sequence: CTT
ctgggtaatggaggtcaggc

SEQ ID NO: 66539 - DNA, 20 bp, Artificial Sequence
  Description of Artificial Sequence: Synthetic oligonucleotide
  Target: SCN10A; (+) strand; PAM type: YTN; PAM sequence: TTC
tgggtaatggaggtcaggct

SEQ ID NO: 66540 - DNA, 20 bp, Artificial Sequence
  Description of Artificial Sequence: Synthetic oligonucleotide
  Target: SCN10A; (+) strand; PAM type: YTN; PAM sequence: CTG
ggtaatggaggtcaggctgt

SEQ ID NO: 66541 - DNA, 20 bp, Artificial Sequence
  Description of Artificial Sequence: Synthetic oligonucleotide
  Target: SCN10A; (+) strand; PAM type: YTN; PAM sequence: CTG
tgagcaaaacagacacatct

SEQ ID NO: 66542 - DNA, 20 bp, Artificial Sequence
  Description of Artificial Sequence: Synthetic oligonucleotide
  Target: SCN10A; (+) strand; PAM type: YTN; PAM sequence: CTC
cgccctcatagattttacaa

SEQ ID NO: 66543 - DNA, 20 bp, Artificial Sequence
  Description of Artificial Sequence: Synthetic oligonucleotide
  Target: SCN10A; (+) strand; PAM type: YTN; PAM sequence: CTC
atagattttacaacctagta

SEQ ID NO: 66544 - DNA, 20 bp, Artificial Sequence
  Description of Artificial Sequence: Synthetic oligonucleotide
  Target: SCN10A; (+) strand; PAM type: YTN; PAM sequence: TTT
tacaacctagtaaatcataa

SEQ ID NO: 66545 - DNA, 20 bp, Artificial Sequence
  Description of Artificial Sequence: Synthetic oligonucleotide
  Target: SCN10A; (+) strand; PAM type: YTN; PAM sequence: TTT
acaacctagtaaatcataat

SEQ ID NO: 66546 - DNA, 20 bp, Artificial Sequence
  Description of Artificial Sequence: Synthetic oligonucleotide
  Target: SCN10A; (+) strand; PAM type: YTN; PAM sequence: TTA
caacctagtaaatcataata

SEQ ID NO: 66547 - DNA, 20 bp, Artificial Sequence
  Description of Artificial Sequence: Synthetic oligonucleotide
  Target: SCN10A; (+) strand; PAM type: YTN; PAM sequence: CTA
gtaaatcataatagccaaat

SEQ ID NO: 66548 - DNA, 20 bp, Artificial Sequence
  Description of Artificial Sequence: Synthetic oligonucleotide
  Target: SCN10A; (+) strand; PAM type: YTN; PAM sequence: TTT
actacatgccagtcgtggtt

SEQ ID NO: 66549 - DNA, 20 bp, Artificial Sequence
  Description of Artificial Sequence: Synthetic oligonucleotide
  Target: SCN10A; (+) strand; PAM type: YTN; PAM sequence: TTA
ctacatgccagtcgtggttc

SEQ ID NO: 66550 - DNA, 20 bp, Artificial Sequence
  Description of Artificial Sequence: Synthetic oligonucleotide
  Target: SCN10A; (+) strand; PAM type: YTN; PAM sequence: CTA
catgccagtcgtggttctaa

SEQ ID NO: 66551 - DNA, 20 bp, Artificial Sequence
  Description of Artificial Sequence: Synthetic oligonucleotide
  Target: SCN10A; (+) strand; PAM type: YTN; PAM sequence: TTC
taagcattttgcttgacctg

SEQ ID NO: 66552 - DNA, 20 bp, Artificial Sequence
  Description of Artificial Sequence: Synthetic oligonucleotide
  Target: SCN10A; (+) strand; PAM type: YTN; PAM sequence: CTA
agcattttgcttgacctgac

SEQ ID NO: 66553 - DNA, 20 bp, Artificial Sequence
  Description of Artificial Sequence: Synthetic oligonucleotide
  Target: SCN10A; (+) strand; PAM type: YTN; PAM sequence: TTT
tgcttgacctgactcattta

SEQ ID NO: 66554 - DNA, 20 bp, Artificial Sequence
  Description of Artificial Sequence: Synthetic oligonucleotide
  Target: SCN10A; (+) strand; PAM type: YTN; PAM sequence: TTT
gcttgacctgactcatttaa

SEQ ID NO: 66555 - DNA, 20 bp, Artificial Sequence
  Description of Artificial Sequence: Synthetic oligonucleotide
  Target: SCN10A; (+) strand; PAM type: YTN; PAM sequence: TTG
cttgacctgactcatttaat

SEQ ID NO: 66556 - DNA, 20 bp, Artificial Sequence
  Description of Artificial Sequence: Synthetic oligonucleotide
  Target: SCN10A; (+) strand; PAM type: YTN; PAM sequence: CTT
gacctgactcatttaatcct

SEQ ID NO: 66557 - DNA, 20 bp, Artificial Sequence
  Description of Artificial Sequence: Synthetic oligonucleotide
  Target: SCN10A; (+) strand; PAM type: YTN; PAM sequence: TTG
acctgactcatttaatcctc

SEQ ID NO: 66558 - DNA, 20 bp, Artificial Sequence
  Description of Artificial Sequence: Synthetic oligonucleotide
  Target: SCN10A; (+) strand; PAM type: YTN; PAM sequence: CTG
actcatttaatcctcacaaa

SEQ ID NO: 66559 - DNA, 20 bp, Artificial Sequence
  Description of Artificial Sequence: Synthetic oligonucleotide
  Target: SCN10A; (+) strand; PAM type: YTN; PAM sequence: CTC
atttaatcctcacaaaactc

SEQ ID NO: 66560 - DNA, 20 bp, Artificial Sequence
  Description of Artificial Sequence: Synthetic oligonucleotide
  Target: SCN10A; (+) strand; PAM type: YTN; PAM sequence: TTT
aatcctcacaaaactctaca

SEQ ID NO: 66561 - DNA, 20 bp, Artificial Sequence
  Description of Artificial Sequence: Synthetic oligonucleotide
  Target: SCN10A; (+) strand; PAM type: YTN; PAM sequence: TTA
atcctcacaaaactctacaa

SEQ ID NO: 66562 - DNA, 20 bp, Artificial Sequence
  Description of Artificial Sequence: Synthetic oligonucleotide
  Target: SCN10A; (+) strand; PAM type: YTN; PAM sequence: CTC
acaaaactctacaagataag

SEQ ID NO: 66563 - DNA, 20 bp, Artificial Sequence
  Description of Artificial Sequence: Synthetic oligonucleotide
  Target: SCN10A; (+) strand; PAM type: YTN; PAM sequence: CTC
tacaagataagtatattctc

SEQ ID NO: 66564 - DNA, 20 bp, Artificial Sequence
  Description of Artificial Sequence: Synthetic oligonucleotide
  Target: SCN10A; (+) strand; PAM type: YTN; PAM sequence: CTA
caagataagtatattctcac

SEQ ID NO: 66565 - DNA, 20 bp, Artificial Sequence
  Description of Artificial Sequence: Synthetic oligonucleotide
  Target: SCN10A; (+) strand; PAM type: YTN; PAM sequence: TTC
tcactactttacaggctaaa

SEQ ID NO: 66566 - DNA, 20 bp, Artificial Sequence
  Description of Artificial Sequence: Synthetic oligonucleotide
  Target: SCN10A; (+) strand; PAM type: YTN; PAM sequence: CTC
actactttacaggctaaaaa

SEQ ID NO: 66567 - DNA, 20 bp, Artificial Sequence
  Description of Artificial Sequence: Synthetic oligonucleotide
  Target: SCN10A; (+) strand; PAM type: YTN; PAM sequence: CTA
ctttacaggctaaaaatctg

SEQ ID NO: 66568 - DNA, 20 bp, Artificial Sequence
  Description of Artificial Sequence: Synthetic oligonucleotide
  Target: SCN10A; (+) strand; PAM type: YTN; PAM sequence: CTT
tacaggctaaaaatctgagg

SEQ ID NO: 66569 - DNA, 20 bp, Artificial Sequence
  Description of Artificial Sequence: Synthetic oligonucleotide
  Target: SCN10A; (+) strand; PAM type: YTN; PAM sequence: TTT
acaggctaaaaatctgaggc

SEQ ID NO: 66570 - DNA, 20 bp, Artificial Sequence
  Description of Artificial Sequence: Synthetic oligonucleotide
  Target: SCN10A; (+) strand; PAM type: YTN; PAM sequence: TTA
caggctaaaaatctgaggca

SEQ ID NO: 66571 - DNA, 20 bp, Artificial Sequence
  Description of Artificial Sequence: Synthetic oligonucleotide
  Target: SCN10A; (+) strand; PAM type: YTN; PAM sequence: CTA
aaaatctgaggcacagaaaa

SEQ ID NO: 66572 - DNA, 20 bp, Artificial Sequence
  Description of Artificial Sequence: Synthetic oligonucleotide
  Target: SCN10A; (+) strand; PAM type: YTN; PAM sequence: CTG
aggcacagaaaagttactga

SEQ ID NO: 66573 - DNA, 20 bp, Artificial Sequence
  Description of Artificial Sequence: Synthetic oligonucleotide
  Target: SCN10A; (+) strand; PAM type: YTN; PAM sequence: TTA
ctgaagctccaaggtcacac

SEQ ID NO: 66574 - DNA, 20 bp, Artificial Sequence
  Description of Artificial Sequence: Synthetic oligonucleotide
  Target: SCN10A; (+) strand; PAM type: YTN; PAM sequence: CTG
aagctccaaggtcacactgt

SEQ ID NO: 66575 - DNA, 20 bp, Artificial Sequence
  Description of Artificial Sequence: Synthetic oligonucleotide
  Target: SCN10A; (+) strand; PAM type: YTN; PAM sequence: CTC
caaggtcacactgtgtacca

SEQ ID NO: 66576 - DNA, 20 bp, Artificial Sequence
  Description of Artificial Sequence: Synthetic oligonucleotide
  Target: SCN10A; (+) strand; PAM type: YTN; PAM sequence: CTG
tgtaccataagtggaagagc

SEQ ID NO: 66577 - DNA, 20 bp, Artificial Sequence
  Description of Artificial Sequence: Synthetic oligonucleotide
  Target: SCN10A; (+) strand; PAM type: YTN; PAM sequence: CTA
ggatgcaaacccaggcagcc

SEQ ID NO: 66578 - DNA, 20 bp, Artificial Sequence
  Description of Artificial Sequence: Synthetic oligonucleotide
  Target: SCN10A; (+) strand; PAM type: YTN; PAM sequence: TTC
cagagcagtgttctaactac

SEQ ID NO: 66579 - DNA, 20 bp, Artificial Sequence
  Description of Artificial Sequence: Synthetic oligonucleotide
  Target: SCN10A; (+) strand; PAM type: YTN; PAM sequence: TTC
taactactaccctctgttgc

SEQ ID NO: 66580 - DNA, 20 bp, Artificial Sequence
  Description of Artificial Sequence: Synthetic oligonucleotide
  Target: SCN10A; (+) strand; PAM type: YTN; PAM sequence: CTA
actactaccctctgttgcct

SEQ ID NO: 66581 - DNA, 20 bp, Artificial Sequence
  Description of Artificial Sequence: Synthetic oligonucleotide
  Target: SCN10A; (+) strand; PAM type: YTN; PAM sequence: CTA
ctaccctctgttgcctctca

SEQ ID NO: 66582 - DNA, 20 bp, Artificial Sequence
  Description of Artificial Sequence: Synthetic oligonucleotide
  Target: SCN10A; (+) strand; PAM type: YTN; PAM sequence: CTA
ccctctgttgcctctcattc

SEQ ID NO: 66583 - DNA, 20 bp, Artificial Sequence
  Description of Artificial Sequence: Synthetic oligonucleotide
  Target: SCN10A; (+) strand; PAM type: YTN; PAM sequence: CTC
tgttgcctctcattcatccc

SEQ ID NO: 66584 - DNA, 20 bp, Artificial Sequence
  Description of Artificial Sequence: Synthetic oligonucleotide
  Target: SCN10A; (+) strand; PAM type: YTN; PAM sequence: CTG
ttgcctctcattcatcccat

SEQ ID NO: 66585 - DNA, 20 bp, Artificial Sequence
  Description of Artificial Sequence: Synthetic oligonucleotide
  Target: SCN10A; (+) strand; PAM type: YTN; PAM sequence: TTG
cctctcattcatcccatgac

SEQ ID NO: 66586 - DNA, 20 bp, Artificial Sequence
  Description of Artificial Sequence: Synthetic oligonucleotide
  Target: SCN10A; (+) strand; PAM type: YTN; PAM sequence: CTC
tcattcatcccatgaccttc

SEQ ID NO: 66587 - DNA, 20 bp, Artificial Sequence
  Description of Artificial Sequence: Synthetic oligonucleotide
  Target: SCN10A; (+) strand; PAM type: YTN; PAM sequence: CTC
attcatcccatgaccttctt

SEQ ID NO: 66588 - DNA, 20 bp, Artificial Sequence
  Description of Artificial Sequence: Synthetic oligonucleotide
  Target: SCN10A; (+) strand; PAM type: YTN; PAM sequence: TTC
atcccatgaccttcttttgt

SEQ ID NO: 66589 - DNA, 20 bp, Artificial Sequence
  Description of Artificial Sequence: Synthetic oligonucleotide
  Target: SCN10A; (+) strand; PAM type: YTN; PAM sequence: CTT
cttttgtcttacctacactg

SEQ ID NO: 66590 - DNA, 20 bp, Artificial Sequence
  Description of Artificial Sequence: Synthetic oligonucleotide
  Target: SCN10A; (+) strand; PAM type: YTN; PAM sequence: TTC
ttttgtcttacctacactgg

SEQ ID NO: 66591 - DNA, 20 bp, Artificial Sequence
  Description of Artificial Sequence: Synthetic oligonucleotide
  Target: SCN10A; (+) strand; PAM type: YTN; PAM sequence: CTT
ttgtcttacctacactggga

SEQ ID NO: 66592 - DNA, 20 bp, Artificial Sequence
  Description of Artificial Sequence: Synthetic oligonucleotide
  Target: SCN10A; (+) strand; PAM type: YTN; PAM sequence: TTT
tgtcttacctacactgggat

SEQ ID NO: 66593 - DNA, 20 bp, Artificial Sequence
  Description of Artificial Sequence: Synthetic oligonucleotide
  Target: SCN10A; (+) strand; PAM type: YTN; PAM sequence: TTT
gtcttacctacactgggatg

SEQ ID NO: 66594 - DNA, 20 bp, Artificial Sequence
  Description of Artificial Sequence: Synthetic oligonucleotide
  Target: SCN10A; (+) strand; PAM type: YTN; PAM sequence: TTG
tcttacctacactgggatgt

SEQ ID NO: 66595 - DNA, 20 bp, Artificial Sequence
  Description of Artificial Sequence: Synthetic oligonucleotide
  Target: SCN10A; (+) strand; PAM type: YTN; PAM sequence: CTT
acctacactgggatgtgttt

SEQ ID NO: 66596 - DNA, 20 bp, Artificial Sequence
  Description of Artificial Sequence: Synthetic oligonucleotide
  Target: SCN10A; (+) strand; PAM type: YTN; PAM sequence: TTA
cctacactgggatgtgtttg

SEQ ID NO: 66597 - DNA, 20 bp, Artificial Sequence
  Description of Artificial Sequence: Synthetic oligonucleotide
  Target: SCN10A; (+) strand; PAM type: YTN; PAM sequence: CTA
cactgggatgtgtttgggac

SEQ ID NO: 66598 - DNA, 20 bp, Artificial Sequence
  Description of Artificial Sequence: Synthetic oligonucleotide
  Target: SCN10A; (+) strand; PAM type: YTN; PAM sequence: CTG
ggatgtgtttgggacatgca

SEQ ID NO: 66599 - DNA, 20 bp, Artificial Sequence
  Description of Artificial Sequence: Synthetic oligonucleotide
  Target: SCN10A; (+) strand; PAM type: YTN; PAM sequence: TTT
gggacatgcattttgcttgt

SEQ ID NO: 66600 - DNA, 20 bp, Artificial Sequence
  Description of Artificial Sequence: Synthetic oligonucleotide
  Target: SCN10A; (+) strand; PAM type: YTN; PAM sequence: TTG
ggacatgcattttgcttgtt

SEQ ID NO: 66601 - DNA, 20 bp, Artificial Sequence
  Description of Artificial Sequence: Synthetic oligonucleotide
  Target: SCN10A; (+) strand; PAM type: YTN; PAM sequence: TTT
tgcttgttgctatctcattc

SEQ ID NO: 66602 - DNA, 20 bp, Artificial Sequence
  Description of Artificial Sequence: Synthetic oligonucleotide
  Target: SCN10A; (+) strand; PAM type: YTN; PAM sequence: TTT
gcttgttgctatctcattct

SEQ ID NO: 66603 - DNA, 20 bp, Artificial Sequence
  Description of Artificial Sequence: Synthetic oligonucleotide
  Target: SCN10A; (+) strand; PAM type: YTN; PAM sequence: TTG
cttgttgctatctcattctt

SEQ ID NO: 66604 - DNA, 20 bp, Artificial Sequence
  Description of Artificial Sequence: Synthetic oligonucleotide
  Target: SCN10A; (+) strand; PAM type: YTN; PAM sequence: CTT
gttgctatctcattcttgca

SEQ ID NO: 66605 - DNA, 20 bp, Artificial Sequence
  Description of Artificial Sequence: Synthetic oligonucleotide
  Target: SCN10A; (+) strand; PAM type: YTN; PAM sequence: TTG
ttgctatctcattcttgcag

SEQ ID NO: 66606 - DNA, 20 bp, Artificial Sequence
  Description of Artificial Sequence: Synthetic oligonucleotide
  Target: SCN10A; (+) strand; PAM type: YTN; PAM sequence: TTG
ctatctcattcttgcagaat

SEQ ID NO: 66607 - DNA, 20 bp, Artificial Sequence
  Description of Artificial Sequence: Synthetic oligonucleotide
  Target: SCN10A; (+) strand; PAM type: YTN; PAM sequence: CTA
tctcattcttgcagaatgca

SEQ ID NO: 66608 - DNA, 20 bp, Artificial Sequence
  Description of Artificial Sequence: Synthetic oligonucleotide
  Target: SCN10A; (+) strand; PAM type: YTN; PAM sequence: CTC
attcttgcagaatgcattgt

SEQ ID NO: 66609 - DNA, 20 bp, Artificial Sequence
  Description of Artificial Sequence: Synthetic oligonucleotide
  Target: SCN10A; (+) strand; PAM type: YTN; PAM sequence: TTC
ttgcagaatgcattgtactt

SEQ ID NO: 66610 - DNA, 20 bp, Artificial Sequence
  Description of Artificial Sequence: Synthetic oligonucleotide
  Target: SCN10A; (+) strand; PAM type: YTN; PAM sequence: CTT
gcagaatgcattgtacttgc

SEQ ID NO: 66611 - DNA, 20 bp, Artificial Sequence
  Description of Artificial Sequence: Synthetic oligonucleotide
  Target: SCN10A; (+) strand; PAM type: YTN; PAM sequence: TTG
cagaatgcattgtacttgct

SEQ ID NO: 66612 - DNA, 20 bp, Artificial Sequence
  Description of Artificial Sequence: Synthetic oligonucleotide
  Target: SCN10A; (+) strand; PAM type: YTN; PAM sequence: TTG
tacttgctatttgtgtctgc

SEQ ID NO: 66613 - DNA, 20 bp, Artificial Sequence
  Description of Artificial Sequence: Synthetic oligonucleotide
  Target: SCN10A; (+) strand; PAM type: YTN; PAM sequence: CTT
gctatttgtgtctgcgaact

SEQ ID NO: 66614 - DNA, 20 bp, Artificial Sequence
  Description of Artificial Sequence: Synthetic oligonucleotide
  Target: SCN10A; (+) strand; PAM type: YTN; PAM sequence: TTG
ctatttgtgtctgcgaactt

SEQ ID NO: 66615 - DNA, 20 bp, Artificial Sequence
  Description of Artificial Sequence: Synthetic oligonucleotide
  Target: SCN10A; (+) strand; PAM type: YTN; PAM sequence: CTA
tttgtgtctgcgaactttct

SEQ ID NO: 66616 - DNA, 20 bp, Artificial Sequence
  Description of Artificial Sequence: Synthetic oligonucleotide
  Target: SCN10A; (+) strand; PAM type: YTN; PAM sequence: TTT
gtgtctgcgaactttctcct

SEQ ID NO: 66617 - DNA, 20 bp, Artificial Sequence
  Description of Artificial Sequence: Synthetic oligonucleotide
  Target: SCN10A; (+) strand; PAM type: YTN; PAM sequence: TTG
tgtctgcgaactttctcctc

SEQ ID NO: 66618 - DNA, 20 bp, Artificial Sequence
  Description of Artificial Sequence: Synthetic oligonucleotide
  Target: SCN10A; (+) strand; PAM type: YTN; PAM sequence: CTG
cgaactttctcctcagcttc

SEQ ID NO: 66619 - DNA, 20 bp, Artificial Sequence
  Description of Artificial Sequence: Synthetic oligonucleotide
  Target: SCN10A; (+) strand; PAM type: YTN; PAM sequence: CTT
tctcctcagcttcttacata

SEQ ID NO: 66620 - DNA, 20 bp, Artificial Sequence
  Description of Artificial Sequence: Synthetic oligonucleotide
  Target: SCN10A; (+) strand; PAM type: YTN; PAM sequence: TTT
ctcctcagcttcttacatag

SEQ ID NO: 66621 - DNA, 20 bp, Artificial Sequence
  Description of Artificial Sequence: Synthetic oligonucleotide
  Target: SCN10A; (+) strand; PAM type: YTN; PAM sequence: TTC
tcctcagcttcttacatagc

SEQ ID NO: 66622 - DNA, 20 bp, Artificial Sequence
  Description of Artificial Sequence: Synthetic oligonucleotide
  Target: SCN10A; (+) strand; PAM type: YTN; PAM sequence: CTC
ctcagcttcttacatagctg

SEQ ID NO: 66623 - DNA, 20 bp, Artificial Sequence
  Description of Artificial Sequence: Synthetic oligonucleotide
  Target: SCN10A; (+) strand; PAM type: YTN; PAM sequence: CTC
agcttcttacatagctgatt

SEQ ID NO: 66624 - DNA, 20 bp, Artificial Sequence
  Description of Artificial Sequence: Synthetic oligonucleotide
  Target: SCN10A; (+) strand; PAM type: YTN; PAM sequence: CTT
cttacatagctgattccttt

SEQ ID NO: 66625 - DNA, 20 bp, Artificial Sequence
  Description of Artificial Sequence: Synthetic oligonucleotide
  Target: SCN10A; (+) strand; PAM type: YTN; PAM sequence: TTC
ttacatagctgattccttta

SEQ ID NO: 66626 - DNA, 20 bp, Artificial Sequence
  Description of Artificial Sequence: Synthetic oligonucleotide
  Target: SCN10A; (+) strand; PAM type: YTN; PAM sequence: CTT
acatagctgattcctttatt

SEQ ID NO: 66627 - DNA, 20 bp, Artificial Sequence
  Description of Artificial Sequence: Synthetic oligonucleotide
  Target: SCN10A; (+) strand; PAM type: YTN; PAM sequence: TTA
catagctgattcctttattt

SEQ ID NO: 66628 - DNA, 20 bp, Artificial Sequence
  Description of Artificial Sequence: Synthetic oligonucleotide
  Target: SCN10A; (+) strand; PAM type: YTN; PAM sequence: CTG
attcctttatttaattcaaa

SEQ ID NO: 66629 - DNA, 20 bp, Artificial Sequence
  Description of Artificial Sequence: Synthetic oligonucleotide
  Target: SCN10A; (+) strand; PAM type: YTN; PAM sequence: TTC
ctttatttaattcaaatttc

SEQ ID NO: 66630 - DNA, 20 bp, Artificial Sequence
  Description of Artificial Sequence: Synthetic oligonucleotide
  Target: SCN10A; (+) strand; PAM type: YTN; PAM sequence: CTT
tatttaattcaaatttctgt

SEQ ID NO: 66631 - DNA, 20 bp, Artificial Sequence
  Description of Artificial Sequence: Synthetic oligonucleotide
  Target: SCN10A; (+) strand; PAM type: YTN; PAM sequence: TTT
atttaattcaaatttctgtt

SEQ ID NO: 66632 - DNA, 20 bp, Artificial Sequence
  Description of Artificial Sequence: Synthetic oligonucleotide
  Target: SCN10A; (+) strand; PAM type: YTN; PAM sequence: TTA
tttaattcaaatttctgttc

SEQ ID NO: 66633 - DNA, 20 bp, Artificial Sequence
  Description of Artificial Sequence: Synthetic oligonucleotide
  Target: SCN10A; (+) strand; PAM type: YTN; PAM sequence: TTT
aattcaaatttctgttcttc

SEQ ID NO: 66634 - DNA, 20 bp, Artificial Sequence
  Description of Artificial Sequence: Synthetic oligonucleotide
  Target: SCN10A; (+) strand; PAM type: YTN; PAM sequence: TTA
attcaaatttctgttcttct

SEQ ID NO: 66635 - DNA, 20 bp, Artificial Sequence
  Description of Artificial Sequence: Synthetic oligonucleotide
  Target: SCN10A; (+) strand; PAM type: YTN; PAM sequence: TTC
aaatttctgttcttcttgga

SEQ ID NO: 66636 - DNA, 20 bp, Artificial Sequence
  Description of Artificial Sequence: Synthetic oligonucleotide
  Target: SCN10A; (+) strand; PAM type: YTN; PAM sequence: TTT
ctgttcttcttggagagaat

SEQ ID NO: 66637 - DNA, 20 bp, Artificial Sequence
  Description of Artificial Sequence: Synthetic oligonucleotide
  Target: SCN10A; (+) strand; PAM type: YTN; PAM sequence: TTC
tgttcttcttggagagaatt

SEQ ID NO: 66638 - DNA, 20 bp, Artificial Sequence
  Description of Artificial Sequence: Synthetic oligonucleotide
  Target: SCN10A; (+) strand; PAM type: YTN; PAM sequence: CTG
ttcttcttggagagaatttt

SEQ ID NO: 66639 - DNA, 20 bp, Artificial Sequence
  Description of Artificial Sequence: Synthetic oligonucleotide
  Target: SCN10A; (+) strand; PAM type: YTN; PAM sequence: TTC
ttcttggagagaattttcca

SEQ ID NO: 66640 - DNA, 20 bp, Artificial Sequence
  Description of Artificial Sequence: Synthetic oligonucleotide
  Target: SCN10A; (+) strand; PAM type: YTN; PAM sequence: CTT
cttggagagaattttccatc

SEQ ID NO: 66641 - DNA, 20 bp, Artificial Sequence
  Description of Artificial Sequence: Synthetic oligonucleotide
  Target: SCN10A; (+) strand; PAM type: YTN; PAM sequence: TTC
ttggagagaattttccatct

SEQ ID NO: 66642 - DNA, 20 bp, Artificial Sequence
  Description of Artificial Sequence: Synthetic oligonucleotide
  Target: SCN10A; (+) strand; PAM type: YTN; PAM sequence: CTT
ggagagaattttccatctcc

SEQ ID NO: 66643 - DNA, 20 bp, Artificial Sequence
  Description of Artificial Sequence: Synthetic oligonucleotide
  Target: SCN10A; (+) strand; PAM type: YTN; PAM sequence: TTG
gagagaattttccatctcct

SEQ ID NO: 66644 - DNA, 20 bp, Artificial Sequence
  Description of Artificial Sequence: Synthetic oligonucleotide
  Target: SCN10A; (+) strand; PAM type: YTN; PAM sequence: TTT
tccatctcctttcctacttt

SEQ ID NO: 66645 - DNA, 20 bp, Artificial Sequence
  Description of Artificial Sequence: Synthetic oligonucleotide
  Target: SCN10A; (+) strand; PAM type: YTN; PAM sequence: TTT
ccatctcctttcctacttta

SEQ ID NO: 66646 - DNA, 20 bp, Artificial Sequence
  Description of Artificial Sequence: Synthetic oligonucleotide
  Target: SCN10A; (+) strand; PAM type: YTN; PAM sequence: TTC
catctcctttcctactttat

SEQ ID NO: 66647 - DNA, 20 bp, Artificial Sequence
  Description of Artificial Sequence: Synthetic oligonucleotide
  Target: SCN10A; (+) strand; PAM type: YTN; PAM sequence: CTC
ctttcctactttattttttc

SEQ ID NO: 66648 - DNA, 20 bp, Artificial Sequence
  Description of Artificial Sequence: Synthetic oligonucleotide
  Target: SCN10A; (+) strand; PAM type: YTN; PAM sequence: CTT
tcctactttattttttctcc

SEQ ID NO: 66649 - DNA, 20 bp, Artificial Sequence
  Description of Artificial Sequence: Synthetic oligonucleotide
  Target: SCN10A; (+) strand; PAM type: YTN; PAM sequence: TTT
cctactttattttttctcct

SEQ ID NO: 66650 - DNA, 20 bp, Artificial Sequence
  Description of Artificial Sequence: Synthetic oligonucleotide
  Target: SCN10A; (+) strand; PAM type: YTN; PAM sequence: TTC
ctactttattttttctccta

SEQ ID NO: 66651 - DNA, 20 bp, Artificial Sequence
  Description of Artificial Sequence: Synthetic oligonucleotide
  Target: SCN10A; (+) strand; PAM type: YTN; PAM sequence: CTA
ctttattttttctcctactt

SEQ ID NO: 66652 - DNA, 20 bp, Artificial Sequence
  Description of Artificial Sequence: Synthetic oligonucleotide
  Target: SCN10A; (+) strand; PAM type: YTN; PAM sequence: CTT
tattttttctcctacttctt

SEQ ID NO: 66653 - DNA, 20 bp, Artificial Sequence
  Description of Artificial Sequence: Synthetic oligonucleotide
  Target: SCN10A; (+) strand; PAM type: YTN; PAM sequence: TTT
attttttctcctacttctta

SEQ ID NO: 66654 - DNA, 20 bp, Artificial Sequence
  Description of Artificial Sequence: Synthetic oligonucleotide
  Target: SCN10A; (+) strand; PAM type: YTN; PAM sequence: TTA
ttttttctcctacttcttat

SEQ ID NO: 66655 - DNA, 20 bp, Artificial Sequence
  Description of Artificial Sequence: Synthetic oligonucleotide
  Target: SCN10A; (+) strand; PAM type: YTN; PAM sequence: TTT
tttctcctacttcttatatc

SEQ ID NO: 66656 - DNA, 20 bp, Artificial Sequence
  Description of Artificial Sequence: Synthetic oligonucleotide
  Target: SCN10A; (+) strand; PAM type: YTN; PAM sequence: TTT
ttctcctacttcttatatct

SEQ ID NO: 66657 - DNA, 20 bp, Artificial Sequence
  Description of Artificial Sequence: Synthetic oligonucleotide
  Target: SCN10A; (+) strand; PAM type: YTN; PAM sequence: TTT
tctcctacttcttatatctg

SEQ ID NO: 66658 - DNA, 20 bp, Artificial Sequence
  Description of Artificial Sequence: Synthetic oligonucleotide
  Target: SCN10A; (+) strand; PAM type: YTN; PAM sequence: TTT
ctcctacttcttatatctga

SEQ ID NO: 66659 - DNA, 20 bp, Artificial Sequence
  Description of Artificial Sequence: Synthetic oligonucleotide
  Target: SCN10A; (+) strand; PAM type: YTN; PAM sequence: TTC
tcctacttcttatatctgaa

SEQ ID NO: 66660 - DNA, 20 bp, Artificial Sequence
  Description of Artificial Sequence: Synthetic oligonucleotide
  Target: SCN10A; (+) strand; PAM type: YTN; PAM sequence: CTC
ctacttcttatatctgaata

SEQ ID NO: 66661 - DNA, 20 bp, Artificial Sequence
  Description of Artificial Sequence: Synthetic oligonucleotide
  Target: SCN10A; (+) strand; PAM type: YTN; PAM sequence: CTA
cttcttatatctgaatatct

SEQ ID NO: 66662 - DNA, 20 bp, Artificial Sequence
  Description of Artificial Sequence: Synthetic oligonucleotide
  Target: SCN10A; (+) strand; PAM type: YTN; PAM sequence: CTT
cttatatctgaatatctatt

SEQ ID NO: 66663 - DNA, 20 bp, Artificial Sequence
  Description of Artificial Sequence: Synthetic oligonucleotide
  Target: SCN10A; (+) strand; PAM type: YTN; PAM sequence: TTC
ttatatctgaatatctattc

SEQ ID NO: 66664 - DNA, 20 bp, Artificial Sequence
  Description of Artificial Sequence: Synthetic oligonucleotide
  Target: SCN10A; (+) strand; PAM type: YTN; PAM sequence: CTT
atatctgaatatctattcat

SEQ ID NO: 66665 - DNA, 20 bp, Artificial Sequence
  Description of Artificial Sequence: Synthetic oligonucleotide
  Target: SCN10A; (+) strand; PAM type: YTN; PAM sequence: TTA
tatctgaatatctattcatc

SEQ ID NO: 66666 - DNA, 20 bp, Artificial Sequence
  Description of Artificial Sequence: Synthetic oligonucleotide
  Target: SCN10A; (+) strand; PAM type: YTN; PAM sequence: CTG
aatatctattcatctttcat

SEQ ID NO: 66667 - DNA, 20 bp, Artificial Sequence
  Description of Artificial Sequence: Synthetic oligonucleotide
  Target: SCN10A; (+) strand; PAM type: YTN; PAM sequence: CTA
ttcatctttcatgtcccctt

SEQ ID NO: 66668 - DNA, 20 bp, Artificial Sequence
  Description of Artificial Sequence: Synthetic oligonucleotide
  Target: SCN10A; (+) strand; PAM type: YTN; PAM sequence: TTC
atctttcatgtccccttccc

SEQ ID NO: 66669 - DNA, 20 bp, Artificial Sequence
  Description of Artificial Sequence: Synthetic oligonucleotide
  Target: SCN10A; (+) strand; PAM type: YTN; PAM sequence: CTT
tcatgtccccttccctgcta

SEQ ID NO: 66670 - DNA, 20 bp, Artificial Sequence
  Description of Artificial Sequence: Synthetic oligonucleotide
  Target: SCN10A; (+) strand; PAM type: YTN; PAM sequence: TTT
catgtccccttccctgctag

SEQ ID NO: 66671 - DNA, 20 bp, Artificial Sequence
  Description of Artificial Sequence: Synthetic oligonucleotide
  Target: SCN10A; (+) strand; PAM type: YTN; PAM sequence: TTC
atgtccccttccctgctagg

SEQ ID NO: 66672 - DNA, 20 bp, Artificial Sequence
  Description of Artificial Sequence: Synthetic oligonucleotide
  Target: SCN10A; (+) strand; PAM type: YTN; PAM sequence: CTT
ccctgctaggatgtagattc

SEQ ID NO: 66673 - DNA, 20 bp, Artificial Sequence
  Description of Artificial Sequence: Synthetic oligonucleotide
  Target: SCN10A; (+) strand; PAM type: YTN; PAM sequence: TTC
cctgctaggatgtagattcc

SEQ ID NO: 66674 - DNA, 20 bp, Artificial Sequence
  Description of Artificial Sequence: Synthetic oligonucleotide
  Target: SCN10A; (+) strand; PAM type: YTN; PAM sequence: CTG
ctaggatgtagattccatga

SEQ ID NO: 66675 - DNA, 20 bp, Artificial Sequence
  Description of Artificial Sequence: Synthetic oligonucleotide
  Target: SCN10A; (+) strand; PAM type: YTN; PAM sequence: CTA
ggatgtagattccatgagcg

SEQ ID NO: 66676 - DNA, 20 bp, Artificial Sequence
  Description of Artificial Sequence: Synthetic oligonucleotide
  Target: SCN10A; (+) strand; PAM type: YTN; PAM sequence: TTC
catgagcgcaagcttatatc

SEQ ID NO: 66677 - DNA, 20 bp, Artificial Sequence
  Description of Artificial Sequence: Synthetic oligonucleotide
  Target: SCN10A; (+) strand; PAM type: YTN; PAM sequence: CTT
atatcagttcaccactgaat

SEQ ID NO: 66678 - DNA, 20 bp, Artificial Sequence
  Description of Artificial Sequence: Synthetic oligonucleotide
  Target: SCN10A; (+) strand; PAM type: YTN; PAM sequence: TTA
tatcagttcaccactgaatc

SEQ ID NO: 66679 - DNA, 20 bp, Artificial Sequence
  Description of Artificial Sequence: Synthetic oligonucleotide
  Target: SCN10A; (+) strand; PAM type: YTN; PAM sequence: TTC
accactgaatcccagcacct

SEQ ID NO: 66680 - DNA, 20 bp, Artificial Sequence
  Description of Artificial Sequence: Synthetic oligonucleotide
  Target: SCN10A; (+) strand; PAM type: YTN; PAM sequence: CTG
aatcccagcacctgaagcaa

SEQ ID NO: 66681 - DNA, 20 bp, Artificial Sequence
  Description of Artificial Sequence: Synthetic oligonucleotide
  Target: SCN10A; (+) strand; PAM type: YTN; PAM sequence: CTG
aagcaatgccacacacacaa

SEQ ID NO: 66682 - DNA, 20 bp, Artificial Sequence
  Description of Artificial Sequence: Synthetic oligonucleotide
  Target: SCN10A; (+) strand; PAM type: YTN; PAM sequence: CTC
aacaaatgcttgttgataag

SEQ ID NO: 66683 - DNA, 20 bp, Artificial Sequence
  Description of Artificial Sequence: Synthetic oligonucleotide
  Target: SCN10A; (+) strand; PAM type: YTN; PAM sequence: CTT
gttgataagagaataaatga

SEQ ID NO: 66684 - DNA, 20 bp, Artificial Sequence
  Description of Artificial Sequence: Synthetic oligonucleotide
  Target: SCN10A; (+) strand; PAM type: YTN; PAM sequence: TTG
ttgataagagaataaatgaa

SEQ ID NO: 66685 - DNA, 20 bp, Artificial Sequence
  Description of Artificial Sequence: Synthetic oligonucleotide
  Target: SCN10A; (+) strand; PAM type: YTN; PAM sequence: TTG
ataagagaataaatgaaaga

SEQ ID NO: 66686 - DNA, 20 bp, Artificial Sequence
  Description of Artificial Sequence: Synthetic oligonucleotide
  Target: SCN10A; (+) strand; PAM type: YTN; PAM sequence: CTT
aacagttttcgagaataaat

SEQ ID NO: 66687 - DNA, 20 bp, Artificial Sequence
  Description of Artificial Sequence: Synthetic oligonucleotide
  Target: SCN10A; (+) strand; PAM type: YTN; PAM sequence: TTA
acagttttcgagaataaatg

SEQ ID NO: 66688 - DNA, 20 bp, Artificial Sequence
  Description of Artificial Sequence: Synthetic oligonucleotide
  Target: SCN10A; (+) strand; PAM type: YTN; PAM sequence: TTT
tcgagaataaatgaaaaaaa

SEQ ID NO: 66689 - DNA, 20 bp, Artificial Sequence
  Description of Artificial Sequence: Synthetic oligonucleotide
  Target: SCN10A; (+) strand; PAM type: YTN; PAM sequence: TTT
cgagaataaatgaaaaaaac

SEQ ID NO: 66690 - DNA, 20 bp, Artificial Sequence
  Description of Artificial Sequence: Synthetic oligonucleotide
  Target: SCN10A; (+) strand; PAM type: YTN; PAM sequence: TTC
gagaataaatgaaaaaaaca

SEQ ID NO: 66691 - DNA, 20 bp, Artificial Sequence
  Description of Artificial Sequence: Synthetic oligonucleotide
  Target: SCN10A; (+) strand; PAM type: YTN; PAM sequence: CTG
tttgtattcaatgtttgctg

SEQ ID NO: 66692 - DNA, 20 bp, Artificial Sequence
  Description of Artificial Sequence: Synthetic oligonucleotide
  Target: SCN10A; (+) strand; PAM type: YTN; PAM sequence: TTT
gtattcaatgtttgctgttt

SEQ ID NO: 66693 - DNA, 20 bp, Artificial Sequence
  Description of Artificial Sequence: Synthetic oligonucleotide
  Target: SCN10A; (+) strand; PAM type: YTN; PAM sequence: TTG
tattcaatgtttgctgtttg

SEQ ID NO: 66694 - DNA, 20 bp, Artificial Sequence
  Description of Artificial Sequence: Synthetic oligonucleotide
  Target: SCN10A; (+) strand; PAM type: YTN; PAM sequence: TTC
aatgtttgctgtttgatgac

SEQ ID NO: 66695 - DNA, 20 bp, Artificial Sequence
  Description of Artificial Sequence: Synthetic oligonucleotide
  Target: SCN10A; (+) strand; PAM type: YTN; PAM sequence: TTT
gctgtttgatgactaatagc

SEQ ID NO: 66696 - DNA, 20 bp, Artificial Sequence
  Description of Artificial Sequence: Synthetic oligonucleotide
  Target: SCN10A; (+) strand; PAM type: YTN; PAM sequence: TTG
ctgtttgatgactaatagca

SEQ ID NO: 66697 - DNA, 20 bp, Artificial Sequence
  Description of Artificial Sequence: Synthetic oligonucleotide
  Target: SCN10A; (+) strand; PAM type: YTN; PAM sequence: CTG
tttgatgactaatagcaaaa

SEQ ID NO: 66698 - DNA, 20 bp, Artificial Sequence
  Description of Artificial Sequence: Synthetic oligonucleotide
  Target: SCN10A; (+) strand; PAM type: YTN; PAM sequence: TTT
gatgactaatagcaaaacaa

SEQ ID NO: 66699 - DNA, 20 bp, Artificial Sequence
  Description of Artificial Sequence: Synthetic oligonucleotide
  Target: SCN10A; (+) strand; PAM type: YTN; PAM sequence: TTG
atgactaatagcaaaacaaa

SEQ ID NO: 66700 - DNA, 20 bp, Artificial Sequence
  Description of Artificial Sequence: Synthetic oligonucleotide
  Target: SCN10A; (+) strand; PAM type: YTN; PAM sequence: CTA
atagcaaaacaaaaaccaaa

SEQ ID NO: 66701 - DNA, 20 bp, Artificial Sequence
  Description of Artificial Sequence: Synthetic oligonucleotide
  Target: SCN10A; (+) strand; PAM type: YTN; PAM sequence: CTA
tctggccaagaaagaaattg

SEQ ID NO: 66702 - DNA, 20 bp, Artificial Sequence
  Description of Artificial Sequence: Synthetic oligonucleotide
  Target: SCN10A; (+) strand; PAM type: YTN; PAM sequence: CTG
gccaagaaagaaattgtggg

SEQ ID NO: 66703 - DNA, 20 bp, Artificial Sequence
  Description of Artificial Sequence: Synthetic oligonucleotide
  Target: SCN10A; (+) strand; PAM type: YTN; PAM sequence: TTG
tgggaatagcagcttggtca

SEQ ID NO: 66704 - DNA, 20 bp, Artificial Sequence
  Description of Artificial Sequence: Synthetic oligonucleotide
  Target: SCN10A; (+) strand; PAM type: YTN; PAM sequence: CTT
ggtcaaattctatgccatga

SEQ ID NO: 66705 - DNA, 20 bp, Artificial Sequence
  Description of Artificial Sequence: Synthetic oligonucleotide
  Target: SCN10A; (+) strand; PAM type: YTN; PAM sequence: TTG
gtcaaattctatgccatgaa

SEQ ID NO: 66706 - DNA, 20 bp, Artificial Sequence
  Description of Artificial Sequence: Synthetic oligonucleotide
  Target: SCN10A; (+) strand; PAM type: YTN; PAM sequence: TTC
tatgccatgaaaaatgttag

SEQ ID NO: 66707 - DNA, 20 bp, Artificial Sequence
  Description of Artificial Sequence: Synthetic oligonucleotide
  Target: SCN10A; (+) strand; PAM type: YTN; PAM sequence: CTA
tgccatgaaaaatgttagaa

SEQ ID NO: 66708 - DNA, 20 bp, Artificial Sequence
  Description of Artificial Sequence: Synthetic oligonucleotide
  Target: SCN10A; (+) strand; PAM type: YTN; PAM sequence: TTA
gaagtacagactctattaca

SEQ ID NO: 66709 - DNA, 20 bp, Artificial Sequence
  Description of Artificial Sequence: Synthetic oligonucleotide
  Target: SCN10A; (+) strand; PAM type: YTN; PAM sequence: CTC
tattacaatgaacagtgata

SEQ ID NO: 66710 - DNA, 20 bp, Artificial Sequence
  Description of Artificial Sequence: Synthetic oligonucleotide
  Target: SCN10A; (+) strand; PAM type: YTN; PAM sequence: CTA
ttacaatgaacagtgatatt

SEQ ID NO: 66711 - DNA, 20 bp, Artificial Sequence
  Description of Artificial Sequence: Synthetic oligonucleotide
  Target: SCN10A; (+) strand; PAM type: YTN; PAM sequence: TTA
caatgaacagtgatattaaa

SEQ ID NO: 66712 - DNA, 20 bp, Artificial Sequence
  Description of Artificial Sequence: Synthetic oligonucleotide
  Target: SCN10A; (+) strand; PAM type: YTN; PAM sequence: TTA
aataattatcaatgagaaaa

SEQ ID NO: 66713 - DNA, 20 bp, Artificial Sequence
  Description of Artificial Sequence: Synthetic oligonucleotide
  Target: SCN10A; (+) strand; PAM type: YTN; PAM sequence: TTA
tcaatgagaaaaaataatag

SEQ ID NO: 66714 - DNA, 20 bp, Artificial Sequence
  Description of Artificial Sequence: Synthetic oligonucleotide
  Target: SCN10A; (+) strand; PAM type: YTN; PAM sequence: CTG
tacacgttgttgttgagaaa

SEQ ID NO: 66715 - DNA, 20 bp, Artificial Sequence
  Description of Artificial Sequence: Synthetic oligonucleotide
  Target: SCN10A; (+) strand; PAM type: YTN; PAM sequence: TTG
ttgttgagaaatgagtacac

SEQ ID NO: 66716 - DNA, 20 bp, Artificial Sequence
  Description of Artificial Sequence: Synthetic oligonucleotide
  Target: SCN10A; (+) strand; PAM type: YTN; PAM sequence: TTG
ttgagaaatgagtacacatt

SEQ ID NO: 66717 - DNA, 20 bp, Artificial Sequence
  Description of Artificial Sequence: Synthetic oligonucleotide
  Target: SCN10A; (+) strand; PAM type: YTN; PAM sequence: TTG
agaaatgagtacacatttct

SEQ ID NO: 66718 - DNA, 20 bp, Artificial Sequence
  Description of Artificial Sequence: Synthetic oligonucleotide
  Target: SCN10A; (+) strand; PAM type: YTN; PAM sequence: TTT
ctcaaagcacaaactcaggt

SEQ ID NO: 66719 - DNA, 20 bp, Artificial Sequence
  Description of Artificial Sequence: Synthetic oligonucleotide
  Target: SCN10A; (+) strand; PAM type: YTN; PAM sequence: TTC
tcaaagcacaaactcaggta

SEQ ID NO: 66720 - DNA, 20 bp, Artificial Sequence
  Description of Artificial Sequence: Synthetic oligonucleotide
  Target: SCN10A; (+) strand; PAM type: YTN; PAM sequence: CTC
aaagcacaaactcaggtatg

SEQ ID NO: 66721 - DNA, 20 bp, Artificial Sequence
  Description of Artificial Sequence: Synthetic oligonucleotide
  Target: SCN10A; (+) strand; PAM type: YTN; PAM sequence: CTC
aggtatgcaagaaatgtaac

SEQ ID NO: 66722 - DNA, 20 bp, Artificial Sequence
  Description of Artificial Sequence: Synthetic oligonucleotide
  Target: SCN10A; (+) strand; PAM type: YTN; PAM sequence: CTT
agttgaattcaatttatgct

SEQ ID NO: 66723 - DNA, 20 bp, Artificial Sequence
  Description of Artificial Sequence: Synthetic oligonucleotide
  Target: SCN10A; (+) strand; PAM type: YTN; PAM sequence: TTA
gttgaattcaatttatgctt

SEQ ID NO: 66724 - DNA, 20 bp, Artificial Sequence
  Description of Artificial Sequence: Synthetic oligonucleotide
  Target: SCN10A; (+) strand; PAM type: YTN; PAM sequence: TTG
aattcaatttatgcttcaag

SEQ ID NO: 66725 - DNA, 20 bp, Artificial Sequence
  Description of Artificial Sequence: Synthetic oligonucleotide
  Target: SCN10A; (+) strand; PAM type: YTN; PAM sequence: TTC
aatttatgcttcaagtcctc

SEQ ID NO: 66726 - DNA, 20 bp, Artificial Sequence
  Description of Artificial Sequence: Synthetic oligonucleotide
  Target: SCN10A; (+) strand; PAM type: YTN; PAM sequence: TTT
atgcttcaagtcctcaccat

SEQ ID NO: 66727 - DNA, 20 bp, Artificial Sequence
  Description of Artificial Sequence: Synthetic oligonucleotide
  Target: SCN10A; (+) strand; PAM type: YTN; PAM sequence: TTA
tgcttcaagtcctcaccatg

SEQ ID NO: 66728 - DNA, 20 bp, Artificial Sequence
  Description of Artificial Sequence: Synthetic oligonucleotide
  Target: SCN10A; (+) strand; PAM type: YTN; PAM sequence: CTT
caagtcctcaccatgggaac

SEQ ID NO: 66729 - DNA, 20 bp, Artificial Sequence
  Description of Artificial Sequence: Synthetic oligonucleotide
  Target: SCN10A; (+) strand; PAM type: YTN; PAM sequence: TTC
aagtcctcaccatgggaact

SEQ ID NO: 66730 - DNA, 20 bp, Artificial Sequence
  Description of Artificial Sequence: Synthetic oligonucleotide
  Target: SCN10A; (+) strand; PAM type: YTN; PAM sequence: CTC
accatgggaactgtctcttg

SEQ ID NO: 66731 - DNA, 20 bp, Artificial Sequence
  Description of Artificial Sequence: Synthetic oligonucleotide
  Target: SCN10A; (+) strand; PAM type: YTN; PAM sequence: CTG
tctcttgttaagtcaatgtt

SEQ ID NO: 66732 - DNA, 20 bp, Artificial Sequence
  Description of Artificial Sequence: Synthetic oligonucleotide
  Target: SCN10A; (+) strand; PAM type: YTN; PAM sequence: CTC
ttgttaagtcaatgttgggt

SEQ ID NO: 66733 - DNA, 20 bp, Artificial Sequence
  Description of Artificial Sequence: Synthetic oligonucleotide
  Target: SCN10A; (+) strand; PAM type: YTN; PAM sequence: CTT
gttaagtcaatgttgggtac

SEQ ID NO: 66734 - DNA, 20 bp, Artificial Sequence
  Description of Artificial Sequence: Synthetic oligonucleotide
  Target: SCN10A; (+) strand; PAM type: YTN; PAM sequence: TTG
ttaagtcaatgttgggtact

SEQ ID NO: 66735 - DNA, 20 bp, Artificial Sequence
  Description of Artificial Sequence: Synthetic oligonucleotide
  Target: SCN10A; (+) strand; PAM type: YTN; PAM sequence: TTA
agtcaatgttgggtactatt

SEQ ID NO: 66736 - DNA, 20 bp, Artificial Sequence
  Description of Artificial Sequence: Synthetic oligonucleotide
  Target: SCN10A; (+) strand; PAM type: YTN; PAM sequence: TTG
ggtactatttcaatatctga

SEQ ID NO: 66737 - DNA, 20 bp, Artificial Sequence
  Description of Artificial Sequence: Synthetic oligonucleotide
  Target: SCN10A; (+) strand; PAM type: YTN; PAM sequence: CTA
tttcaatatctgagtctgtg

SEQ ID NO: 66738 - DNA, 20 bp, Artificial Sequence
  Description of Artificial Sequence: Synthetic oligonucleotide
  Target: SCN10A; (+) strand; PAM type: YTN; PAM sequence: TTT
caatatctgagtctgtgtct

SEQ ID NO: 66739 - DNA, 20 bp, Artificial Sequence
  Description of Artificial Sequence: Synthetic oligonucleotide
  Target: SCN10A; (+) strand; PAM type: YTN; PAM sequence: TTC
aatatctgagtctgtgtctg

SEQ ID NO: 66740 - DNA, 20 bp, Artificial Sequence
  Description of Artificial Sequence: Synthetic oligonucleotide
  Target: SCN10A; (+) strand; PAM type: YTN; PAM sequence: CTG
agtctgtgtctgagttttgt

SEQ ID NO: 66741 - DNA, 20 bp, Artificial Sequence
  Description of Artificial Sequence: Synthetic oligonucleotide
  Target: SCN10A; (+) strand; PAM type: YTN; PAM sequence: CTG
tgtctgagttttgtagggct

SEQ ID NO: 66742 - DNA, 20 bp, Artificial Sequence
  Description of Artificial Sequence: Synthetic oligonucleotide
  Target: SCN10A; (+) strand; PAM type: YTN; PAM sequence: CTG
agttttgtagggctcaaacc

SEQ ID NO: 66743 - DNA, 20 bp, Artificial Sequence
  Description of Artificial Sequence: Synthetic oligonucleotide
  Target: SCN10A; (+) strand; PAM type: YTN; PAM sequence: TTT
tgtagggctcaaacctggag

SEQ ID NO: 66744 - DNA, 20 bp, Artificial Sequence
  Description of Artificial Sequence: Synthetic oligonucleotide
  Target: SCN10A; (+) strand; PAM type: YTN; PAM sequence: TTT
gtagggctcaaacctggagg

SEQ ID NO: 66745 - DNA, 20 bp, Artificial Sequence
  Description of Artificial Sequence: Synthetic oligonucleotide
  Target: SCN10A; (+) strand; PAM type: YTN; PAM sequence: TTG
tagggctcaaacctggagga

SEQ ID NO: 66746 - DNA, 20 bp, Artificial Sequence
  Description of Artificial Sequence: Synthetic oligonucleotide
  Target: SCN10A; (+) strand; PAM type: YTN; PAM sequence: CTC
aaacctggaggagagttgag

SEQ ID NO: 66747 - DNA, 20 bp, Artificial Sequence
  Description of Artificial Sequence: Synthetic oligonucleotide
  Target: SCN10A; (+) strand; PAM type: YTN; PAM sequence: CTG
gaggagagttgagctggtcc

SEQ ID NO: 66748 - DNA, 20 bp, Artificial Sequence
  Description of Artificial Sequence: Synthetic oligonucleotide
  Target: SCN10A; (+) strand; PAM type: YTN; PAM sequence: TTG
agctggtcctttgtcattgc

SEQ ID NO: 66749 - DNA, 20 bp, Artificial Sequence
  Description of Artificial Sequence: Synthetic oligonucleotide
  Target: SCN10A; (+) strand; PAM type: YTN; PAM sequence: CTG
gtcctttgtcattgctaagc

SEQ ID NO: 66750 - DNA, 20 bp, Artificial Sequence
  Description of Artificial Sequence: Synthetic oligonucleotide
  Target: SCN10A; (+) strand; PAM type: YTN; PAM sequence: CTT
tgtcattgctaagcgtattt

SEQ ID NO: 66751 - DNA, 20 bp, Artificial Sequence
  Description of Artificial Sequence: Synthetic oligonucleotide
  Target: SCN10A; (+) strand; PAM type: YTN; PAM sequence: TTT
gtcattgctaagcgtatttt

SEQ ID NO: 66752 - DNA, 20 bp, Artificial Sequence
  Description of Artificial Sequence: Synthetic oligonucleotide
  Target: SCN10A; (+) strand; PAM type: YTN; PAM sequence: TTG
tcattgctaagcgtattttg

SEQ ID NO: 66753 - DNA, 20 bp, Artificial Sequence
  Description of Artificial Sequence: Synthetic oligonucleotide
  Target: SCN10A; (+) strand; PAM type: YTN; PAM sequence: TTG
ctaagcgtattttgcctgag

SEQ ID NO: 66754 - DNA, 20 bp, Artificial Sequence
  Description of Artificial Sequence: Synthetic oligonucleotide
  Target: SCN10A; (+) strand; PAM type: YTN; PAM sequence: CTA
agcgtattttgcctgagttg

SEQ ID NO: 66755 - DNA, 20 bp, Artificial Sequence
  Description of Artificial Sequence: Synthetic oligonucleotide
  Target: SCN10A; (+) strand; PAM type: YTN; PAM sequence: TTT
tgcctgagttgtagctccca

SEQ ID NO: 66756 - DNA, 20 bp, Artificial Sequence
  Description of Artificial Sequence: Synthetic oligonucleotide
  Target: SCN10A; (+) strand; PAM type: YTN; PAM sequence: TTT
gcctgagttgtagctcccat

SEQ ID NO: 66757 - DNA, 20 bp, Artificial Sequence
  Description of Artificial Sequence: Synthetic oligonucleotide
  Target: SCN10A; (+) strand; PAM type: YTN; PAM sequence: TTG
cctgagttgtagctcccatc

SEQ ID NO: 66758 - DNA, 20 bp, Artificial Sequence
  Description of Artificial Sequence: Synthetic oligonucleotide
  Target: SCN10A; (+) strand; PAM type: YTN; PAM sequence: CTG
agttgtagctcccatctggt

SEQ ID NO: 66759 - DNA, 20 bp, Artificial Sequence
  Description of Artificial Sequence: Synthetic oligonucleotide
  Target: SCN10A; (+) strand; PAM type: YTN; PAM sequence: TTG
tagctcccatctggtccctg

SEQ ID NO: 66760 - DNA, 20 bp, Artificial Sequence
  Description of Artificial Sequence: Synthetic oligonucleotide
  Target: SCN10A; (+) strand; PAM type: YTN; PAM sequence: CTC
ccatctggtccctggtggga

SEQ ID NO: 66761 - DNA, 20 bp, Artificial Sequence
  Description of Artificial Sequence: Synthetic oligonucleotide
  Target: SCN10A; (+) strand; PAM type: YTN; PAM sequence: CTG
gtccctggtgggagagtcca

SEQ ID NO: 66762 - DNA, 20 bp, Artificial Sequence
  Description of Artificial Sequence: Synthetic oligonucleotide
  Target: SCN10A; (+) strand; PAM type: YTN; PAM sequence: CTG
gtgggagagtccatgaagat

SEQ ID NO: 66763 - DNA, 20 bp, Artificial Sequence
  Description of Artificial Sequence: Synthetic oligonucleotide
  Target: SCN10A; (+) strand; PAM type: YTN; PAM sequence: CTC
ttctctctctagtttccctc

SEQ ID NO: 66764 - DNA, 20 bp, Artificial Sequence
  Description of Artificial Sequence: Synthetic oligonucleotide
  Target: SCN10A; (+) strand; PAM type: YTN; PAM sequence: CTT
ctctctctagtttccctcta

SEQ ID NO: 66765 - DNA, 20 bp, Artificial Sequence
  Description of Artificial Sequence: Synthetic oligonucleotide
  Target: SCN10A; (+) strand; PAM type: YTN; PAM sequence: TTC
tctctctagtttccctctat

SEQ ID NO: 66766 - DNA, 20 bp, Artificial Sequence
  Description of Artificial Sequence: Synthetic oligonucleotide
  Target: SCN10A; (+) strand; PAM type: YTN; PAM sequence: CTC
tctctagtttccctctatgg

SEQ ID NO: 66767 - DNA, 20 bp, Artificial Sequence
  Description of Artificial Sequence: Synthetic oligonucleotide
  Target: SCN10A; (+) strand; PAM type: YTN; PAM sequence: CTC
tctagtttccctctatgggt

SEQ ID NO: 66768 - DNA, 20 bp, Artificial Sequence
  Description of Artificial Sequence: Synthetic oligonucleotide
  Target: SCN10A; (+) strand; PAM type: YTN; PAM sequence: CTC
tagtttccctctatgggtct

SEQ ID NO: 66769 - DNA, 20 bp, Artificial Sequence
  Description of Artificial Sequence: Synthetic oligonucleotide
  Target: SCN10A; (+) strand; PAM type: YTN; PAM sequence: CTA
gtttccctctatgggtctca

SEQ ID NO: 66770 - DNA, 20 bp, Artificial Sequence
  Description of Artificial Sequence: Synthetic oligonucleotide
  Target: SCN10A; (+) strand; PAM type: YTN; PAM sequence: TTT
ccctctatgggtctcactca

SEQ ID NO: 66771 - DNA, 20 bp, Artificial Sequence
  Description of Artificial Sequence: Synthetic oligonucleotide
  Target: SCN10A; (+) strand; PAM type: YTN; PAM sequence: TTC
cctctatgggtctcactcat

SEQ ID NO: 66772 - DNA, 20 bp, Artificial Sequence
  Description of Artificial Sequence: Synthetic oligonucleotide
  Target: SCN10A; (+) strand; PAM type: YTN; PAM sequence: CTC
tatgggtctcactcatcttt

SEQ ID NO: 66773 - DNA, 20 bp, Artificial Sequence
  Description of Artificial Sequence: Synthetic oligonucleotide
  Target: SCN10A; (+) strand; PAM type: YTN; PAM sequence: CTA
tgggtctcactcatcttttt

SEQ ID NO: 66774 - DNA, 20 bp, Artificial Sequence
  Description of Artificial Sequence: Synthetic oligonucleotide
  Target: SCN10A; (+) strand; PAM type: YTN; PAM sequence: CTC
actcatctttttccatagcc

SEQ ID NO: 66775 - DNA, 20 bp, Artificial Sequence
  Description of Artificial Sequence: Synthetic oligonucleotide
  Target: SCN10A; (+) strand; PAM type: YTN; PAM sequence: CTC
atctttttccatagccttca

SEQ ID NO: 66776 - DNA, 20 bp, Artificial Sequence
  Description of Artificial Sequence: Synthetic oligonucleotide
  Target: SCN10A; (+) strand; PAM type: YTN; PAM sequence: CTT
tttccatagccttcactggg

SEQ ID NO: 66777 - DNA, 20 bp, Artificial Sequence
  Description of Artificial Sequence: Synthetic oligonucleotide
  Target: SCN10A; (+) strand; PAM type: YTN; PAM sequence: TTT
ttccatagccttcactgggg

SEQ ID NO: 66778 - DNA, 20 bp, Artificial Sequence
  Description of Artificial Sequence: Synthetic oligonucleotide
  Target: SCN10A; (+) strand; PAM type: YTN; PAM sequence: TTT
tccatagccttcactggggg

SEQ ID NO: 66779 - DNA, 20 bp, Artificial Sequence
  Description of Artificial Sequence: Synthetic oligonucleotide
  Target: SCN10A; (+) strand; PAM type: YTN; PAM sequence: TTT
ccatagccttcactgggggc

SEQ ID NO: 66780 - DNA, 20 bp, Artificial Sequence
  Description of Artificial Sequence: Synthetic oligonucleotide
  Target: SCN10A; (+) strand; PAM type: YTN; PAM sequence: TTC
catagccttcactgggggct

SEQ ID NO: 66781 - DNA, 20 bp, Artificial Sequence
  Description of Artificial Sequence: Synthetic oligonucleotide
  Target: SCN10A; (+) strand; PAM type: YTN; PAM sequence: CTT
cactgggggctaagtcatca

SEQ ID NO: 66782 - DNA, 20 bp, Artificial Sequence
  Description of Artificial Sequence: Synthetic oligonucleotide
  Target: SCN10A; (+) strand; PAM type: YTN; PAM sequence: TTC
actgggggctaagtcatcac

SEQ ID NO: 66783 - DNA, 20 bp, Artificial Sequence
  Description of Artificial Sequence: Synthetic oligonucleotide
  Target: SCN10A; (+) strand; PAM type: YTN; PAM sequence: CTG
ggggctaagtcatcacccag

SEQ ID NO: 66784 - DNA, 20 bp, Artificial Sequence
  Description of Artificial Sequence: Synthetic oligonucleotide
  Target: SCN10A; (+) strand; PAM type: YTN; PAM sequence: CTA
agtcatcacccagctcctct

SEQ ID NO: 66785 - DNA, 20 bp, Artificial Sequence
  Description of Artificial Sequence: Synthetic oligonucleotide
  Target: SCN10A; (+) strand; PAM type: YTN; PAM sequence: CTC
ctctctgccattctggagcc

SEQ ID NO: 66786 - DNA, 20 bp, Artificial Sequence
  Description of Artificial Sequence: Synthetic oligonucleotide
  Target: SCN10A; (+) strand; PAM type: YTN; PAM sequence: CTC
tctgccattctggagccaca

SEQ ID NO: 66787 - DNA, 20 bp, Artificial Sequence
  Description of Artificial Sequence: Synthetic oligonucleotide
  Target: SCN10A; (+) strand; PAM type: YTN; PAM sequence: CTC
tgccattctggagccacagg

SEQ ID NO: 66788 - DNA, 20 bp, Artificial Sequence
  Description of Artificial Sequence: Synthetic oligonucleotide
  Target: SCN10A; (+) strand; PAM type: YTN; PAM sequence: CTG
ccattctggagccacagggc

SEQ ID NO: 66789 - DNA, 20 bp, Artificial Sequence
  Description of Artificial Sequence: Synthetic oligonucleotide
  Target: SCN10A; (+) strand; PAM type: YTN; PAM sequence: TTC
tggagccacagggctctctc

SEQ ID NO: 66790 - DNA, 20 bp, Artificial Sequence
  Description of Artificial Sequence: Synthetic oligonucleotide
  Target: SCN10A; (+) strand; PAM type: YTN; PAM sequence: CTG
gagccacagggctctctctg

SEQ ID NO: 66791 - DNA, 20 bp, Artificial Sequence
  Description of Artificial Sequence: Synthetic oligonucleotide
  Target: SCN10A; (+) strand; PAM type: YTN; PAM sequence: CTC
tctctgaggctgcttcaggc

SEQ ID NO: 66792 - DNA, 20 bp, Artificial Sequence
  Description of Artificial Sequence: Synthetic oligonucleotide
  Target: SCN10A; (+) strand; PAM type: YTN; PAM sequence: CTC
tctgaggctgcttcaggcct

SEQ ID NO: 66793 - DNA, 20 bp, Artificial Sequence
  Description of Artificial Sequence: Synthetic oligonucleotide
  Target: SCN10A; (+) strand; PAM type: YTN; PAM sequence: CTC
tgaggctgcttcaggccttc

SEQ ID NO: 66794 - DNA, 20 bp, Artificial Sequence
  Description of Artificial Sequence: Synthetic oligonucleotide
  Target: SCN10A; (+) strand; PAM type: YTN; PAM sequence: CTG
aggctgcttcaggccttctc

SEQ ID NO: 66795 - DNA, 20 bp, Artificial Sequence
  Description of Artificial Sequence: Synthetic oligonucleotide
  Target: SCN10A; (+) strand; PAM type: YTN; PAM sequence: CTG
cttcaggccttctctaacct

SEQ ID NO: 66796 - DNA, 20 bp, Artificial Sequence
  Description of Artificial Sequence: Synthetic oligonucleotide
  Target: SCN10A; (+) strand; PAM type: YTN; PAM sequence: CTT
caggccttctctaacctaag

SEQ ID NO: 66797 - DNA, 20 bp, Artificial Sequence
  Description of Artificial Sequence: Synthetic oligonucleotide
  Target: SCN10A; (+) strand; PAM type: YTN; PAM sequence: TTC
aggccttctctaacctaagg

SEQ ID NO: 66798 - DNA, 20 bp, Artificial Sequence
  Description of Artificial Sequence: Synthetic oligonucleotide
  Target: SCN10A; (+) strand; PAM type: YTN; PAM sequence: CTT
ctctaacctaaggttgacct

SEQ ID NO: 66799 - DNA, 20 bp, Artificial Sequence
  Description of Artificial Sequence: Synthetic oligonucleotide
  Target: SCN10A; (+) strand; PAM type: YTN; PAM sequence: TTC
tctaacctaaggttgaccta

SEQ ID NO: 66800 - DNA, 20 bp, Artificial Sequence
  Description of Artificial Sequence: Synthetic oligonucleotide
  Target: SCN10A; (+) strand; PAM type: YTN; PAM sequence: CTC
taacctaaggttgacctaag

SEQ ID NO: 66801 - DNA, 20 bp, Artificial Sequence
  Description of Artificial Sequence: Synthetic oligonucleotide
  Target: SCN10A; (+) strand; PAM type: YTN; PAM sequence: CTA
acctaaggttgacctaagct

SEQ ID NO: 66802 - DNA, 20 bp, Artificial Sequence
  Description of Artificial Sequence: Synthetic oligonucleotide
  Target: SCN10A; (+) strand; PAM type: YTN; PAM sequence: CTA
aggttgacctaagctaaggt

SEQ ID NO: 66803 - DNA, 20 bp, Artificial Sequence
  Description of Artificial Sequence: Synthetic oligonucleotide
  Target: SCN10A; (+) strand; PAM type: YTN; PAM sequence: TTG
acctaagctaaggttgcctt

SEQ ID NO: 66804 - DNA, 20 bp, Artificial Sequence
  Description of Artificial Sequence: Synthetic oligonucleotide
  Target: SCN10A; (+) strand; PAM type: YTN; PAM sequence: CTA
agctaaggttgcctttcccc

SEQ ID NO: 66805 - DNA, 20 bp, Artificial Sequence
  Description of Artificial Sequence: Synthetic oligonucleotide
  Target: SCN10A; (+) strand; PAM type: YTN; PAM sequence: CTA
aggttgcctttccccagatt

SEQ ID NO: 66806 - DNA, 20 bp, Artificial Sequence
  Description of Artificial Sequence: Synthetic oligonucleotide
  Target: SCN10A; (+) strand; PAM type: YTN; PAM sequence: TTG
cctttccccagattttctta

SEQ ID NO: 66807 - DNA, 20 bp, Artificial Sequence
  Description of Artificial Sequence: Synthetic oligonucleotide
  Target: SCN10A; (+) strand; PAM type: YTN; PAM sequence: CTT
tccccagattttcttaaaaa

SEQ ID NO: 66808 - DNA, 20 bp, Artificial Sequence
  Description of Artificial Sequence: Synthetic oligonucleotide
  Target: SCN10A; (+) strand; PAM type: YTN; PAM sequence: TTT
ccccagattttcttaaaaac

SEQ ID NO: 66809 - DNA, 20 bp, Artificial Sequence
  Description of Artificial Sequence: Synthetic oligonucleotide
  Target: SCN10A; (+) strand; PAM type: YTN; PAM sequence: TTC
cccagattttcttaaaaacg

SEQ ID NO: 66810 - DNA, 20 bp, Artificial Sequence
  Description of Artificial Sequence: Synthetic oligonucleotide
  Target: SCN10A; (+) strand; PAM type: YTN; PAM sequence: TTT
tcttaaaaacgtctttgttt

SEQ ID NO: 66811 - DNA, 20 bp, Artificial Sequence
  Description of Artificial Sequence: Synthetic oligonucleotide
  Target: SCN10A; (+) strand; PAM type: YTN; PAM sequence: TTT
cttaaaaacgtctttgtttc

SEQ ID NO: 66812 - DNA, 20 bp, Artificial Sequence
  Description of Artificial Sequence: Synthetic oligonucleotide
  Target: SCN10A; (+) strand; PAM type: YTN; PAM sequence: TTC
ttaaaaacgtctttgtttct

SEQ ID NO: 66813 - DNA, 20 bp, Artificial Sequence
  Description of Artificial Sequence: Synthetic oligonucleotide
  Target: SCN10A; (+) strand; PAM type: YTN; PAM sequence: CTT
aaaaacgtctttgtttctcc

SEQ ID NO: 66814 - DNA, 20 bp, Artificial Sequence
  Description of Artificial Sequence: Synthetic oligonucleotide
  Target: SCN10A; (+) strand; PAM type: YTN; PAM sequence: TTA
aaaacgtctttgtttctcct

SEQ ID NO: 66815 - DNA, 20 bp, Artificial Sequence
  Description of Artificial Sequence: Synthetic oligonucleotide
  Target: SCN10A; (+) strand; PAM type: YTN; PAM sequence: CTT
tgtttctcctgcctttctta

SEQ ID NO: 66816 - DNA, 20 bp, Artificial Sequence
  Description of Artificial Sequence: Synthetic oligonucleotide
  Target: SCN10A; (+) strand; PAM type: YTN; PAM sequence: TTT
gtttctcctgcctttcttac

SEQ ID NO: 66817 - DNA, 20 bp, Artificial Sequence
  Description of Artificial Sequence: Synthetic oligonucleotide
  Target: SCN10A; (+) strand; PAM type: YTN; PAM sequence: TTG
tttctcctgcctttcttact

SEQ ID NO: 66818 - DNA, 20 bp, Artificial Sequence
  Description of Artificial Sequence: Synthetic oligonucleotide
  Target: SCN10A; (+) strand; PAM type: YTN; PAM sequence: TTT
ctcctgcctttcttactcta

SEQ ID NO: 66819 - DNA, 20 bp, Artificial Sequence
  Description of Artificial Sequence: Synthetic oligonucleotide
  Target: SCN10A; (+) strand; PAM type: YTN; PAM sequence: TTC
tcctgcctttcttactctac

SEQ ID NO: 66820 - DNA, 20 bp, Artificial Sequence
  Description of Artificial Sequence: Synthetic oligonucleotide
  Target: SCN10A; (+) strand; PAM type: YTN; PAM sequence: CTC
ctgcctttcttactctactc

SEQ ID NO: 66821 - DNA, 20 bp, Artificial Sequence
  Description of Artificial Sequence: Synthetic oligonucleotide
  Target: SCN10A; (+) strand; PAM type: YTN; PAM sequence: CTG
cctttcttactctactctca

SEQ ID NO: 66822 - DNA, 20 bp, Artificial Sequence
  Description of Artificial Sequence: Synthetic oligonucleotide
  Target: SCN10A; (+) strand; PAM type: YTN; PAM sequence: CTT
tcttactctactctcacagt

SEQ ID NO: 66823 - DNA, 20 bp, Artificial Sequence
  Description of Artificial Sequence: Synthetic oligonucleotide
  Target: SCN10A; (+) strand; PAM type: YTN; PAM sequence: TTT
cttactctactctcacagta

SEQ ID NO: 66824 - DNA, 20 bp, Artificial Sequence
  Description of Artificial Sequence: Synthetic oligonucleotide
  Target: SCN10A; (+) strand; PAM type: YTN; PAM sequence: TTC
ttactctactctcacagtat

SEQ ID NO: 66825 - DNA, 20 bp, Artificial Sequence
  Description of Artificial Sequence: Synthetic oligonucleotide
  Target: SCN10A; (+) strand; PAM type: YTN; PAM sequence: CTT
actctactctcacagtatct

SEQ ID NO: 66826 - DNA, 20 bp, Artificial Sequence
  Description of Artificial Sequence: Synthetic oligonucleotide
  Target: SCN10A; (+) strand; PAM type: YTN; PAM sequence: TTA
ctctactctcacagtatctt

SEQ ID NO: 66827 - DNA, 20 bp, Artificial Sequence
  Description of Artificial Sequence: Synthetic oligonucleotide
  Target: SCN10A; (+) strand; PAM type: YTN; PAM sequence: CTC
tactctcacagtatcttcct

SEQ ID NO: 66828 - DNA, 20 bp, Artificial Sequence
  Description of Artificial Sequence: Synthetic oligonucleotide
  Target: SCN10A; (+) strand; PAM type: YTN; PAM sequence: CTA
ctctcacagtatcttccttg

SEQ ID NO: 66829 - DNA, 20 bp, Artificial Sequence
  Description of Artificial Sequence: Synthetic oligonucleotide
  Target: SCN10A; (+) strand; PAM type: YTN; PAM sequence: CTC
tcacagtatcttccttgagc

SEQ ID NO: 66830 - DNA, 20 bp, Artificial Sequence
  Description of Artificial Sequence: Synthetic oligonucleotide
  Target: SCN10A; (+) strand; PAM type: YTN; PAM sequence: CTC
acagtatcttccttgagcgg

SEQ ID NO: 66831 - DNA, 20 bp, Artificial Sequence
  Description of Artificial Sequence: Synthetic oligonucleotide
  Target: SCN10A; (+) strand; PAM type: YTN; PAM sequence: CTT
ccttgagcggaagtctatcc

SEQ ID NO: 66832 - DNA, 20 bp, Artificial Sequence
  Description of Artificial Sequence: Synthetic oligonucleotide
  Target: SCN10A; (+) strand; PAM type: YTN; PAM sequence: TTC
cttgagcggaagtctatcct

SEQ ID NO: 66833 - DNA, 20 bp, Artificial Sequence
  Description of Artificial Sequence: Synthetic oligonucleotide
  Target: SCN10A; (+) strand; PAM type: YTN; PAM sequence: CTT
gagcggaagtctatcctacc

SEQ ID NO: 66834 - DNA, 20 bp, Artificial Sequence
  Description of Artificial Sequence: Synthetic oligonucleotide
  Target: SCN10A; (+) strand; PAM type: YTN; PAM sequence: TTG
agcggaagtctatcctaccc

SEQ ID NO: 66835 - DNA, 20 bp, Artificial Sequence
  Description of Artificial Sequence: Synthetic oligonucleotide
  Target: SCN10A; (+) strand; PAM type: YTN; PAM sequence: CTA
tcctaccccaagatacctga

SEQ ID NO: 66836 - DNA, 20 bp, Artificial Sequence
  Description of Artificial Sequence: Synthetic oligonucleotide
  Target: SCN10A; (+) strand; PAM type: YTN; PAM sequence: CTA
ccccaagatacctgactatt

SEQ ID NO: 66837 - DNA, 20 bp, Artificial Sequence
  Description of Artificial Sequence: Synthetic oligonucleotide
  Target: SCN10A; (+) strand; PAM type: YTN; PAM sequence: CTG
actattccttattttcttcc

SEQ ID NO: 66838 - DNA, 20 bp, Artificial Sequence
  Description of Artificial Sequence: Synthetic oligonucleotide
  Target: SCN10A; (+) strand; PAM type: YTN; PAM sequence: CTA
ttccttattttcttcctttt

SEQ ID NO: 66839 - DNA, 20 bp, Artificial Sequence
  Description of Artificial Sequence: Synthetic oligonucleotide
  Target: SCN10A; (+) strand; PAM type: YTN; PAM sequence: TTC
cttattttcttcctttttat

SEQ ID NO: 66840 - DNA, 20 bp, Artificial Sequence
  Description of Artificial Sequence: Synthetic oligonucleotide
  Target: SCN10A; (+) strand; PAM type: YTN; PAM sequence: CTT
attttcttcctttttatcag

SEQ ID NO: 66841 - DNA, 20 bp, Artificial Sequence
  Description of Artificial Sequence: Synthetic oligonucleotide
  Target: SCN10A; (+) strand; PAM type: YTN; PAM sequence: TTA
ttttcttcctttttatcagt

SEQ ID NO: 66842 - DNA, 20 bp, Artificial Sequence
  Description of Artificial Sequence: Synthetic oligonucleotide
  Target: SCN10A; (+) strand; PAM type: YTN; PAM sequence: TTT
tcttcctttttatcagttta

SEQ ID NO: 66843 - DNA, 20 bp, Artificial Sequence
  Description of Artificial Sequence: Synthetic oligonucleotide
  Target: SCN10A; (+) strand; PAM type: YTN; PAM sequence: TTT
cttcctttttatcagtttac

SEQ ID NO: 66844 - DNA, 20 bp, Artificial Sequence
  Description of Artificial Sequence: Synthetic oligonucleotide
  Target: SCN10A; (+) strand; PAM type: YTN; PAM sequence: TTC
ttcctttttatcagtttaca

SEQ ID NO: 66845 - DNA, 20 bp, Artificial Sequence
  Description of Artificial Sequence: Synthetic oligonucleotide
  Target: SCN10A; (+) strand; PAM type: YTN; PAM sequence: CTT
cctttttatcagtttacacc

SEQ ID NO: 66846 - DNA, 20 bp, Artificial Sequence
  Description of Artificial Sequence: Synthetic oligonucleotide
  Target: SCN10A; (+) strand; PAM type: YTN; PAM sequence: TTC
ctttttatcagtttacacca

SEQ ID NO: 66847 - DNA, 20 bp, Artificial Sequence
  Description of Artificial Sequence: Synthetic oligonucleotide
  Target: SCN10A; (+) strand; PAM type: YTN; PAM sequence: CTT
tttatcagtttacaccacta

SEQ ID NO: 66848 - DNA, 20 bp, Artificial Sequence
  Description of Artificial Sequence: Synthetic oligonucleotide
  Target: SCN10A; (+) strand; PAM type: YTN; PAM sequence: TTT
ttatcagtttacaccactat

SEQ ID NO: 66849 - DNA, 20 bp, Artificial Sequence
  Description of Artificial Sequence: Synthetic oligonucleotide
  Target: SCN10A; (+) strand; PAM type: YTN; PAM sequence: TTT
tatcagtttacaccactata

SEQ ID NO: 66850 - DNA, 20 bp, Artificial Sequence
  Description of Artificial Sequence: Synthetic oligonucleotide
  Target: SCN10A; (+) strand; PAM type: YTN; PAM sequence: TTT
atcagtttacaccactataa

SEQ ID NO: 66851 - DNA, 20 bp, Artificial Sequence
  Description of Artificial Sequence: Synthetic oligonucleotide
  Target: SCN10A; (+) strand; PAM type: YTN; PAM sequence: TTA
tcagtttacaccactataaa

SEQ ID NO: 66852 - DNA, 20 bp, Artificial Sequence
  Description of Artificial Sequence: Synthetic oligonucleotide
  Target: SCN10A; (+) strand; PAM type: YTN; PAM sequence: TTT
acaccactataaagtagcat

SEQ ID NO: 66853 - DNA, 20 bp, Artificial Sequence
  Description of Artificial Sequence: Synthetic oligonucleotide
  Target: SCN10A; (+) strand; PAM type: YTN; PAM sequence: TTA
caccactataaagtagcatc

SEQ ID NO: 66854 - DNA, 20 bp, Artificial Sequence
  Description of Artificial Sequence: Synthetic oligonucleotide
  Target: SCN10A; (+) strand; PAM type: YTN; PAM sequence: CTA
taaagtagcatcacccccca

SEQ ID NO: 66855 - DNA, 20 bp, Artificial Sequence
  Description of Artificial Sequence: Synthetic oligonucleotide
  Target: SCN10A; (+) strand; PAM type: YTN; PAM sequence: CTT
tgttaatgcactgctcttct

SEQ ID NO: 66856 - DNA, 20 bp, Artificial Sequence
  Description of Artificial Sequence: Synthetic oligonucleotide
  Target: SCN10A; (+) strand; PAM type: YTN; PAM sequence: TTT
gttaatgcactgctcttcta

SEQ ID NO: 66857 - DNA, 20 bp, Artificial Sequence
  Description of Artificial Sequence: Synthetic oligonucleotide
  Target: SCN10A; (+) strand; PAM type: YTN; PAM sequence: TTG
ttaatgcactgctcttctag

SEQ ID NO: 66858 - DNA, 20 bp, Artificial Sequence
  Description of Artificial Sequence: Synthetic oligonucleotide
  Target: SCN10A; (+) strand; PAM type: YTN; PAM sequence: TTA
atgcactgctcttctaggta

SEQ ID NO: 66859 - DNA, 20 bp, Artificial Sequence
  Description of Artificial Sequence: Synthetic oligonucleotide
  Target: SCN10A; (+) strand; PAM type: YTN; PAM sequence: CTG
ctcttctaggtaatggagat

SEQ ID NO: 66860 - DNA, 20 bp, Artificial Sequence
  Description of Artificial Sequence: Synthetic oligonucleotide
  Target: SCN10A; (+) strand; PAM type: YTN; PAM sequence: CTC
ttctaggtaatggagatcca

SEQ ID NO: 66861 - DNA, 20 bp, Artificial Sequence
  Description of Artificial Sequence: Synthetic oligonucleotide
  Target: SCN10A; (+) strand; PAM type: YTN; PAM sequence: CTT
ctaggtaatggagatccagc

SEQ ID NO: 66862 - DNA, 20 bp, Artificial Sequence
  Description of Artificial Sequence: Synthetic oligonucleotide
  Target: SCN10A; (+) strand; PAM type: YTN; PAM sequence: TTC
taggtaatggagatccagct

SEQ ID NO: 66863 - DNA, 20 bp, Artificial Sequence
  Description of Artificial Sequence: Synthetic oligonucleotide
  Target: SCN10A; (+) strand; PAM type: YTN; PAM sequence: CTA
ggtaatggagatccagctgt

SEQ ID NO: 66864 - DNA, 20 bp, Artificial Sequence
  Description of Artificial Sequence: Synthetic oligonucleotide
  Target: SCN10A; (+) strand; PAM type: YTN; PAM sequence: CTG
tgagcaaaacagatacatct

SEQ ID NO: 66865 - DNA, 20 bp, Artificial Sequence
  Description of Artificial Sequence: Synthetic oligonucleotide
  Target: SCN10A; (+) strand; PAM type: YTN; PAM sequence: CTC
tgcatatctggtaaattact

SEQ ID NO: 66866 - DNA, 20 bp, Artificial Sequence
  Description of Artificial Sequence: Synthetic oligonucleotide
  Target: SCN10A; (+) strand; PAM type: YTN; PAM sequence: CTG
catatctggtaaattactgg

SEQ ID NO: 66867 - DNA, 20 bp, Artificial Sequence
  Description of Artificial Sequence: Synthetic oligonucleotide
  Target: SCN10A; (+) strand; PAM type: YTN; PAM sequence: CTG
gtaaattactggctagttct

SEQ ID NO: 66868 - DNA, 20 bp, Artificial Sequence
  Description of Artificial Sequence: Synthetic oligonucleotide
  Target: SCN10A; (+) strand; PAM type: YTN; PAM sequence: TTA
ctggctagttctactctaca

SEQ ID NO: 66869 - DNA, 20 bp, Artificial Sequence
  Description of Artificial Sequence: Synthetic oligonucleotide
  Target: SCN10A; (+) strand; PAM type: YTN; PAM sequence: CTG
gctagttctactctacagtt

SEQ ID NO: 66870 - DNA, 20 bp, Artificial Sequence
  Description of Artificial Sequence: Synthetic oligonucleotide
  Target: SCN10A; (+) strand; PAM type: YTN; PAM sequence: CTA
gttctactctacagtttctg

SEQ ID NO: 66871 - DNA, 20 bp, Artificial Sequence
  Description of Artificial Sequence: Synthetic oligonucleotide
  Target: SCN10A; (+) strand; PAM type: YTN; PAM sequence: TTC
tactctacagtttctgtgca

SEQ ID NO: 66872 - DNA, 20 bp, Artificial Sequence
  Description of Artificial Sequence: Synthetic oligonucleotide
  Target: SCN10A; (+) strand; PAM type: YTN; PAM sequence: CTA
ctctacagtttctgtgcatg

SEQ ID NO: 66873 - DNA, 20 bp, Artificial Sequence
  Description of Artificial Sequence: Synthetic oligonucleotide
  Target: SCN10A; (+) strand; PAM type: YTN; PAM sequence: CTC
tacagtttctgtgcatgtga

SEQ ID NO: 66874 - DNA, 20 bp, Artificial Sequence
  Description of Artificial Sequence: Synthetic oligonucleotide
  Target: SCN10A; (+) strand; PAM type: YTN; PAM sequence: CTA
cagtttctgtgcatgtgaat

SEQ ID NO: 66875 - DNA, 20 bp, Artificial Sequence
  Description of Artificial Sequence: Synthetic oligonucleotide
  Target: SCN10A; (+) strand; PAM type: YTN; PAM sequence: TTT
ctgtgcatgtgaatctctct

SEQ ID NO: 66876 - DNA, 20 bp, Artificial Sequence
  Description of Artificial Sequence: Synthetic oligonucleotide
  Target: SCN10A; (+) strand; PAM type: YTN; PAM sequence: TTC
tgtgcatgtgaatctctctc

SEQ ID NO: 66877 - DNA, 20 bp, Artificial Sequence
  Description of Artificial Sequence: Synthetic oligonucleotide
  Target: SCN10A; (+) strand; PAM type: YTN; PAM sequence: CTG
tgcatgtgaatctctctcta

SEQ ID NO: 66878 - DNA, 20 bp, Artificial Sequence
  Description of Artificial Sequence: Synthetic oligonucleotide
  Target: SCN10A; (+) strand; PAM type: YTN; PAM sequence: CTC
tctctaaggcttgccacctc

SEQ ID NO: 66879 - DNA, 20 bp, Artificial Sequence
  Description of Artificial Sequence: Synthetic oligonucleotide
  Target: SCN10A; (+) strand; PAM type: YTN; PAM sequence: CTC
tctaaggcttgccacctctg

SEQ ID NO: 66880 - DNA, 20 bp, Artificial Sequence
  Description of Artificial Sequence: Synthetic oligonucleotide
  Target: SCN10A; (+) strand; PAM type: YTN; PAM sequence: CTC
taaggcttgccacctctggc

SEQ ID NO: 66881 - DNA, 20 bp, Artificial Sequence
  Description of Artificial Sequence: Synthetic oligonucleotide
  Target: SCN10A; (+) strand; PAM type: YTN; PAM sequence: CTA
aggcttgccacctctggctt

SEQ ID NO: 66882 - DNA, 20 bp, Artificial Sequence
  Description of Artificial Sequence: Synthetic oligonucleotide
  Target: SCN10A; (+) strand; PAM type: YTN; PAM sequence: CTT
gccacctctggctttaccta

SEQ ID NO: 66883 - DNA, 20 bp, Artificial Sequence
  Description of Artificial Sequence: Synthetic oligonucleotide
  Target: SCN10A; (+) strand; PAM type: YTN; PAM sequence: TTG
ccacctctggctttacctag

SEQ ID NO: 66884 - DNA, 20 bp, Artificial Sequence
  Description of Artificial Sequence: Synthetic oligonucleotide
  Target: SCN10A; (+) strand; PAM type: YTN; PAM sequence: CTC
tggctttacctagaaagtag

SEQ ID NO: 66885 - DNA, 20 bp, Artificial Sequence
  Description of Artificial Sequence: Synthetic oligonucleotide
  Target: SCN10A; (+) strand; PAM type: YTN; PAM sequence: CTG
gctttacctagaaagtaggg

SEQ ID NO: 66886 - DNA, 20 bp, Artificial Sequence
  Description of Artificial Sequence: Synthetic oligonucleotide
  Target: SCN10A; (+) strand; PAM type: YTN; PAM sequence: CTT
tacctagaaagtagggcaca

SEQ ID NO: 66887 - DNA, 20 bp, Artificial Sequence
  Description of Artificial Sequence: Synthetic oligonucleotide
  Target: SCN10A; (+) strand; PAM type: YTN; PAM sequence: TTT
acctagaaagtagggcacac

SEQ ID NO: 66888 - DNA, 20 bp, Artificial Sequence
  Description of Artificial Sequence: Synthetic oligonucleotide
  Target: SCN10A; (+) strand; PAM type: YTN; PAM sequence: TTA
cctagaaagtagggcacaca

SEQ ID NO: 66889 - DNA, 20 bp, Artificial Sequence
  Description of Artificial Sequence: Synthetic oligonucleotide
  Target: SCN10A; (+) strand; PAM type: YTN; PAM sequence: CTA
gaaagtagggcacacattgg

SEQ ID NO: 66890 - DNA, 20 bp, Artificial Sequence
  Description of Artificial Sequence: Synthetic oligonucleotide
  Target: SCN10A; (+) strand; PAM type: YTN; PAM sequence: TTG
gctctgttttgaaatccctc

SEQ ID NO: 66891 - DNA, 20 bp, Artificial Sequence
  Description of Artificial Sequence: Synthetic oligonucleotide
  Target: SCN10A; (+) strand; PAM type: YTN; PAM sequence: CTC
tgttttgaaatccctcaaac

SEQ ID NO: 66892 - DNA, 20 bp, Artificial Sequence
  Description of Artificial Sequence: Synthetic oligonucleotide
  Target: SCN10A; (+) strand; PAM type: YTN; PAM sequence: CTG
ttttgaaatccctcaaacat

SEQ ID NO: 66893 - DNA, 20 bp, Artificial Sequence
  Description of Artificial Sequence: Synthetic oligonucleotide
  Target: SCN10A; (+) strand; PAM type: YTN; PAM sequence: TTT
tgaaatccctcaaacatttt

SEQ ID NO: 66894 - DNA, 20 bp, Artificial Sequence
  Description of Artificial Sequence: Synthetic oligonucleotide
  Target: SCN10A; (+) strand; PAM type: YTN; PAM sequence: TTT
gaaatccctcaaacattttt

SEQ ID NO: 66895 - DNA, 20 bp, Artificial Sequence
  Description of Artificial Sequence: Synthetic oligonucleotide
  Target: SCN10A; (+) strand; PAM type: YTN; PAM sequence: TTG
aaatccctcaaacatttttt

SEQ ID NO: 66896 - DNA, 20 bp, Artificial Sequence
  Description of Artificial Sequence: Synthetic oligonucleotide
  Target: SCN10A; (+) strand; PAM type: YTN; PAM sequence: CTC
aaacatttttttggtttcta

SEQ ID NO: 66897 - DNA, 20 bp, Artificial Sequence
  Description of Artificial Sequence: Synthetic oligonucleotide
  Target: SCN10A; (+) strand; PAM type: YTN; PAM sequence: TTT
ttttggtttctattgctcac

SEQ ID NO: 66898 - DNA, 20 bp, Artificial Sequence
  Description of Artificial Sequence: Synthetic oligonucleotide
  Target: SCN10A; (+) strand; PAM type: YTN; PAM sequence: TTT
tttggtttctattgctcacc

SEQ ID NO: 66899 - DNA, 20 bp, Artificial Sequence
  Description of Artificial Sequence: Synthetic oligonucleotide
  Target: SCN10A; (+) strand; PAM type: YTN; PAM sequence: TTT
ttggtttctattgctcacca

SEQ ID NO: 66900 - DNA, 20 bp, Artificial Sequence
  Description of Artificial Sequence: Synthetic oligonucleotide
  Target: SCN10A; (+) strand; PAM type: YTN; PAM sequence: TTT
tggtttctattgctcaccac

SEQ ID NO: 66901 - DNA, 20 bp, Artificial Sequence
  Description of Artificial Sequence: Synthetic oligonucleotide
  Target: SCN10A; (+) strand; PAM type: YTN; PAM sequence: TTT
ggtttctattgctcaccact

SEQ ID NO: 66902 - DNA, 20 bp, Artificial Sequence
  Description of Artificial Sequence: Synthetic oligonucleotide
  Target: SCN10A; (+) strand; PAM type: YTN; PAM sequence: TTG
gtttctattgctcaccactt

SEQ ID NO: 66903 - DNA, 20 bp, Artificial Sequence
  Description of Artificial Sequence: Synthetic oligonucleotide
  Target: SCN10A; (+) strand; PAM type: YTN; PAM sequence: TTT
ctattgctcaccacttcttc

SEQ ID NO: 66904 - DNA, 20 bp, Artificial Sequence
  Description of Artificial Sequence: Synthetic oligonucleotide
  Target: SCN10A; (+) strand; PAM type: YTN; PAM sequence: TTC
tattgctcaccacttcttcc

SEQ ID NO: 66905 - DNA, 20 bp, Artificial Sequence
  Description of Artificial Sequence: Synthetic oligonucleotide
  Target: SCN10A; (+) strand; PAM type: YTN; PAM sequence: CTA
ttgctcaccacttcttcccc

SEQ ID NO: 66906 - DNA, 20 bp, Artificial Sequence
  Description of Artificial Sequence: Synthetic oligonucleotide
  Target: SCN10A; (+) strand; PAM type: YTN; PAM sequence: TTG
ctcaccacttcttcccctca

SEQ ID NO: 66907 - DNA, 20 bp, Artificial Sequence
  Description of Artificial Sequence: Synthetic oligonucleotide
  Target: SCN10A; (+) strand; PAM type: YTN; PAM sequence: CTC
accacttcttcccctcaaat

SEQ ID NO: 66908 - DNA, 20 bp, Artificial Sequence
  Description of Artificial Sequence: Synthetic oligonucleotide
  Target: SCN10A; (+) strand; PAM type: YTN; PAM sequence: CTT
cttcccctcaaattaggatt

SEQ ID NO: 66909 - DNA, 20 bp, Artificial Sequence
  Description of Artificial Sequence: Synthetic oligonucleotide
  Target: SCN10A; (+) strand; PAM type: YTN; PAM sequence: TTC
ttcccctcaaattaggattc

SEQ ID NO: 66910 - DNA, 20 bp, Artificial Sequence
  Description of Artificial Sequence: Synthetic oligonucleotide
  Target: SCN10A; (+) strand; PAM type: YTN; PAM sequence: CTT
cccctcaaattaggattcag

SEQ ID NO: 66911 - DNA, 20 bp, Artificial Sequence
  Description of Artificial Sequence: Synthetic oligonucleotide
  Target: SCN10A; (+) strand; PAM type: YTN; PAM sequence: TTC
ccctcaaattaggattcagc

SEQ ID NO: 66912 - DNA, 20 bp, Artificial Sequence
  Description of Artificial Sequence: Synthetic oligonucleotide
  Target: SCN10A; (+) strand; PAM type: YTN; PAM sequence: CTC
aaattaggattcagcctagg

SEQ ID NO: 66913 - DNA, 20 bp, Artificial Sequence
  Description of Artificial Sequence: Synthetic oligonucleotide
  Target: SCN10A; (+) strand; PAM type: YTN; PAM sequence: TTA
ggattcagcctagggctggg

SEQ ID NO: 66914 - DNA, 20 bp, Artificial Sequence
  Description of Artificial Sequence: Synthetic oligonucleotide
  Target: SCN10A; (+) strand; PAM type: YTN; PAM sequence: TTC
agcctagggctgggaggaaa

SEQ ID NO: 66915 - DNA, 20 bp, Artificial Sequence
  Description of Artificial Sequence: Synthetic oligonucleotide
  Target: SCN10A; (+) strand; PAM type: YTN; PAM sequence: CTA
gggctgggaggaaaacacac

SEQ ID NO: 66916 - DNA, 20 bp, Artificial Sequence
  Description of Artificial Sequence: Synthetic oligonucleotide
  Target: SCN10A; (+) strand; PAM type: YTN; PAM sequence: CTG
ggaggaaaacacacaggact

SEQ ID NO: 66917 - DNA, 20 bp, Artificial Sequence
  Description of Artificial Sequence: Synthetic oligonucleotide
  Target: SCN10A; (+) strand; PAM type: YTN; PAM sequence: CTC
cttctcaggggcacaccagc

SEQ ID NO: 66918 - DNA, 20 bp, Artificial Sequence
  Description of Artificial Sequence: Synthetic oligonucleotide
  Target: SCN10A; (+) strand; PAM type: YTN; PAM sequence: CTT
ctcaggggcacaccagcact

SEQ ID NO: 66919 - DNA, 20 bp, Artificial Sequence
  Description of Artificial Sequence: Synthetic oligonucleotide
  Target: SCN10A; (+) strand; PAM type: YTN; PAM sequence: TTC
tcaggggcacaccagcactc

SEQ ID NO: 66920 - DNA, 20 bp, Artificial Sequence
  Description of Artificial Sequence: Synthetic oligonucleotide
  Target: SCN10A; (+) strand; PAM type: YTN; PAM sequence: CTC
aggggcacaccagcactcaa

SEQ ID NO: 66921 - DNA, 20 bp, Artificial Sequence
  Description of Artificial Sequence: Synthetic oligonucleotide
  Target: SCN10A; (+) strand; PAM type: YTN; PAM sequence: CTC
aagctcccttacaactcctc

SEQ ID NO: 66922 - DNA, 20 bp, Artificial Sequence
  Description of Artificial Sequence: Synthetic oligonucleotide
  Target: SCN10A; (+) strand; PAM type: YTN; PAM sequence: CTC
ccttacaactcctccagcct

SEQ ID NO: 66923 - DNA, 20 bp, Artificial Sequence
  Description of Artificial Sequence: Synthetic oligonucleotide
  Target: SCN10A; (+) strand; PAM type: YTN; PAM sequence: CTT
acaactcctccagcctaggt

SEQ ID NO: 66924 - DNA, 20 bp, Artificial Sequence
  Description of Artificial Sequence: Synthetic oligonucleotide
  Target: SCN10A; (+) strand; PAM type: YTN; PAM sequence: TTA
caactcctccagcctaggtc

SEQ ID NO: 66925 - DNA, 20 bp, Artificial Sequence
  Description of Artificial Sequence: Synthetic oligonucleotide
  Target: SCN10A; (+) strand; PAM type: YTN; PAM sequence: CTC
ctccagcctaggtcagttta

SEQ ID NO: 66926 - DNA, 20 bp, Artificial Sequence
  Description of Artificial Sequence: Synthetic oligonucleotide
  Target: SCN10A; (+) strand; PAM type: YTN; PAM sequence: CTC
cagcctaggtcagtttaatt

SEQ ID NO: 66927 - DNA, 20 bp, Artificial Sequence
  Description of Artificial Sequence: Synthetic oligonucleotide
  Target: SCN10A; (+) strand; PAM type: YTN; PAM sequence: CTA
ggtcagtttaatttgtctag

SEQ ID NO: 66928 - DNA, 20 bp, Artificial Sequence
  Description of Artificial Sequence: Synthetic oligonucleotide
  Target: SCN10A; (+) strand; PAM type: YTN; PAM sequence: TTT
aatttgtctaggggagtaag

SEQ ID NO: 66929 - DNA, 20 bp, Artificial Sequence
  Description of Artificial Sequence: Synthetic oligonucleotide
  Target: SCN10A; (+) strand; PAM type: YTN; PAM sequence: TTA
atttgtctaggggagtaaga

SEQ ID NO: 66930 - DNA, 20 bp, Artificial Sequence
  Description of Artificial Sequence: Synthetic oligonucleotide
  Target: SCN10A; (+) strand; PAM type: YTN; PAM sequence: TTT
gtctaggggagtaagataac

SEQ ID NO: 66931 - DNA, 20 bp, Artificial Sequence
  Description of Artificial Sequence: Synthetic oligonucleotide
  Target: SCN10A; (+) strand; PAM type: YTN; PAM sequence: TTG
tctaggggagtaagataact

SEQ ID NO: 66932 - DNA, 20 bp, Artificial Sequence
  Description of Artificial Sequence: Synthetic oligonucleotide
  Target: SCN10A; (+) strand; PAM type: YTN; PAM sequence: CTA
ggggagtaagataactggaa

SEQ ID NO: 66933 - DNA, 20 bp, Artificial Sequence
  Description of Artificial Sequence: Synthetic oligonucleotide
  Target: SCN10A; (+) strand; PAM type: YTN; PAM sequence: CTG
gaaatgatgaaggttgcatt

SEQ ID NO: 66934 - DNA, 20 bp, Artificial Sequence
  Description of Artificial Sequence: Synthetic oligonucleotide
  Target: SCN10A; (+) strand; PAM type: YTN; PAM sequence: TTG
cattctccataccctaaggc

SEQ ID NO: 66935 - DNA, 20 bp, Artificial Sequence
  Description of Artificial Sequence: Synthetic oligonucleotide
  Target: SCN10A; (+) strand; PAM type: YTN; PAM sequence: TTC
tccataccctaaggcaaaaa

SEQ ID NO: 66936 - DNA, 20 bp, Artificial Sequence
  Description of Artificial Sequence: Synthetic oligonucleotide
  Target: SCN10A; (+) strand; PAM type: YTN; PAM sequence: CTC
cataccctaaggcaaaaaaa

SEQ ID NO: 66937 - DNA, 20 bp, Artificial Sequence
  Description of Artificial Sequence: Synthetic oligonucleotide
  Target: SCN10A; (+) strand; PAM type: YTN; PAM sequence: CTA
aggcaaaaaaaggctggatt

SEQ ID NO: 66938 - DNA, 20 bp, Artificial Sequence
  Description of Artificial Sequence: Synthetic oligonucleotide
  Target: SCN10A; (+) strand; PAM type: YTN; PAM sequence: CTG
gattagaacagacctcctgc

SEQ ID NO: 66939 - DNA, 20 bp, Artificial Sequence
  Description of Artificial Sequence: Synthetic oligonucleotide
  Target: SCN10A; (+) strand; PAM type: YTN; PAM sequence: TTA
gaacagacctcctgctcaag

SEQ ID NO: 66940 - DNA, 20 bp, Artificial Sequence
  Description of Artificial Sequence: Synthetic oligonucleotide
  Target: SCN10A; (+) strand; PAM type: YTN; PAM sequence: CTC
ctgctcaaggttagagggat

SEQ ID NO: 66941 - DNA, 20 bp, Artificial Sequence
  Description of Artificial Sequence: Synthetic oligonucleotide
  Target: SCN10A; (+) strand; PAM type: YTN; PAM sequence: CTG
ctcaaggttagagggatgca

SEQ ID NO: 66942 - DNA, 20 bp, Artificial Sequence
  Description of Artificial Sequence: Synthetic oligonucleotide
  Target: SCN10A; (+) strand; PAM type: YTN; PAM sequence: CTC
aaggttagagggatgcaatc

SEQ ID NO: 66943 - DNA, 20 bp, Artificial Sequence
  Description of Artificial Sequence: Synthetic oligonucleotide
  Target: SCN10A; (+) strand; PAM type: YTN; PAM sequence: TTA
gagggatgcaatcacgctct

SEQ ID NO: 66944 - DNA, 20 bp, Artificial Sequence
  Description of Artificial Sequence: Synthetic oligonucleotide
  Target: SCN10A; (+) strand; PAM type: YTN; PAM sequence: CTC
tatggcaaagtgtgtggata

SEQ ID NO: 66945 - DNA, 20 bp, Artificial Sequence
  Description of Artificial Sequence: Synthetic oligonucleotide
  Target: SCN10A; (+) strand; PAM type: YTN; PAM sequence: CTA
tggcaaagtgtgtggatagg

SEQ ID NO: 66946 - DNA, 20 bp, Artificial Sequence
  Description of Artificial Sequence: Synthetic oligonucleotide
  Target: SCN10A; (+) strand; PAM type: YTN; PAM sequence: TTG
ccactctcttcctctaccct

SEQ ID NO: 66947 - DNA, 20 bp, Artificial Sequence
  Description of Artificial Sequence: Synthetic oligonucleotide
  Target: SCN10A; (+) strand; PAM type: YTN; PAM sequence: CTC
tcttcctctaccctttggct

SEQ ID NO: 66948 - DNA, 20 bp, Artificial Sequence
  Description of Artificial Sequence: Synthetic oligonucleotide
  Target: SCN10A; (+) strand; PAM type: YTN; PAM sequence: CTC
ttcctctaccctttggcttg

SEQ ID NO: 66949 - DNA, 20 bp, Artificial Sequence
  Description of Artificial Sequence: Synthetic oligonucleotide
  Target: SCN10A; (+) strand; PAM type: YTN; PAM sequence: CTT
cctctaccctttggcttgga

SEQ ID NO: 66950 - DNA, 20 bp, Artificial Sequence
  Description of Artificial Sequence: Synthetic oligonucleotide
  Target: SCN10A; (+) strand; PAM type: YTN; PAM sequence: TTC
ctctaccctttggcttggaa

SEQ ID NO: 66951 - DNA, 20 bp, Artificial Sequence
  Description of Artificial Sequence: Synthetic oligonucleotide
  Target: SCN10A; (+) strand; PAM type: YTN; PAM sequence: CTC
taccctttggcttggaactt

SEQ ID NO: 66952 - DNA, 20 bp, Artificial Sequence
  Description of Artificial Sequence: Synthetic oligonucleotide
  Target: SCN10A; (+) strand; PAM type: YTN; PAM sequence: CTA
ccctttggcttggaacttag

SEQ ID NO: 66953 - DNA, 20 bp, Artificial Sequence
  Description of Artificial Sequence: Synthetic oligonucleotide
  Target: SCN10A; (+) strand; PAM type: YTN; PAM sequence: CTT
tggcttggaacttagataca

SEQ ID NO: 66954 - DNA, 20 bp, Artificial Sequence
  Description of Artificial Sequence: Synthetic oligonucleotide
  Target: SCN10A; (+) strand; PAM type: YTN; PAM sequence: TTT
ggcttggaacttagatacat

SEQ ID NO: 66955 - DNA, 20 bp, Artificial Sequence
  Description of Artificial Sequence: Synthetic oligonucleotide
  Target: SCN10A; (+) strand; PAM type: YTN; PAM sequence: TTG
gcttggaacttagatacatt

SEQ ID NO: 66956 - DNA, 20 bp, Artificial Sequence
  Description of Artificial Sequence: Synthetic oligonucleotide
  Target: SCN10A; (+) strand; PAM type: YTN; PAM sequence: CTT
ggaacttagatacattgctg

SEQ ID NO: 66957 - DNA, 20 bp, Artificial Sequence
  Description of Artificial Sequence: Synthetic oligonucleotide
  Target: SCN10A; (+) strand; PAM type: YTN; PAM sequence: TTG
gaacttagatacattgctgg

SEQ ID NO: 66958 - DNA, 20 bp, Artificial Sequence
  Description of Artificial Sequence: Synthetic oligonucleotide
  Target: SCN10A; (+) strand; PAM type: YTN; PAM sequence: CTT
agatacattgctggggagac

SEQ ID NO: 66959 - DNA, 20 bp, Artificial Sequence
  Description of Artificial Sequence: Synthetic oligonucleotide
  Target: SCN10A; (+) strand; PAM type: YTN; PAM sequence: TTA
gatacattgctggggagact

SEQ ID NO: 66960 - DNA, 20 bp, Artificial Sequence
  Description of Artificial Sequence: Synthetic oligonucleotide
  Target: SCN10A; (+) strand; PAM type: YTN; PAM sequence: TTG
ctggggagactgagtggatt

SEQ ID NO: 66961 - DNA, 20 bp, Artificial Sequence
  Description of Artificial Sequence: Synthetic oligonucleotide
  Target: SCN10A; (+) strand; PAM type: YTN; PAM sequence: CTG
gggagactgagtggattccc

SEQ ID NO: 66962 - DNA, 20 bp, Artificial Sequence
  Description of Artificial Sequence: Synthetic oligonucleotide
  Target: SCN10A; (+) strand; PAM type: YTN; PAM sequence: CTG
agtggattcccacttgattg

SEQ ID NO: 66963 - DNA, 20 bp, Artificial Sequence
  Description of Artificial Sequence: Synthetic oligonucleotide
  Target: SCN10A; (+) strand; PAM type: YTN; PAM sequence: TTC
ccacttgattggtagaattc

SEQ ID NO: 66964 - DNA, 20 bp, Artificial Sequence
  Description of Artificial Sequence: Synthetic oligonucleotide
  Target: SCN10A; (+) strand; PAM type: YTN; PAM sequence: CTT
gattggtagaattctaaatt

SEQ ID NO: 66965 - DNA, 20 bp, Artificial Sequence
  Description of Artificial Sequence: Synthetic oligonucleotide
  Target: SCN10A; (+) strand; PAM type: YTN; PAM sequence: TTG
attggtagaattctaaatta

SEQ ID NO: 66966 - DNA, 20 bp, Artificial Sequence
  Description of Artificial Sequence: Synthetic oligonucleotide
  Target: SCN10A; (+) strand; PAM type: YTN; PAM sequence: TTG
gtagaattctaaattaacaa

SEQ ID NO: 66967 - DNA, 20 bp, Artificial Sequence
  Description of Artificial Sequence: Synthetic oligonucleotide
  Target: SCN10A; (+) strand; PAM type: YTN; PAM sequence: TTC
taaattaacaaggacttagt

SEQ ID NO: 66968 - DNA, 20 bp, Artificial Sequence
  Description of Artificial Sequence: Synthetic oligonucleotide
  Target: SCN10A; (+) strand; PAM type: YTN; PAM sequence: CTA
aattaacaaggacttagtta

SEQ ID NO: 66969 - DNA, 20 bp, Artificial Sequence
  Description of Artificial Sequence: Synthetic oligonucleotide
  Target: SCN10A; (+) strand; PAM type: YTN; PAM sequence: TTA
acaaggacttagttaaattg

SEQ ID NO: 66970 - DNA, 20 bp, Artificial Sequence
  Description of Artificial Sequence: Synthetic oligonucleotide
  Target: SCN10A; (+) strand; PAM type: YTN; PAM sequence: CTT
agttaaattgactgattaat

SEQ ID NO: 66971 - DNA, 20 bp, Artificial Sequence
  Description of Artificial Sequence: Synthetic oligonucleotide
  Target: SCN10A; (+) strand; PAM type: YTN; PAM sequence: TTA
gttaaattgactgattaatg

SEQ ID NO: 66972 - DNA, 20 bp, Artificial Sequence
  Description of Artificial Sequence: Synthetic oligonucleotide
  Target: SCN10A; (+) strand; PAM type: YTN; PAM sequence: TTA
aattgactgattaatggact

SEQ ID NO: 66973 - DNA, 20 bp, Artificial Sequence
  Description of Artificial Sequence: Synthetic oligonucleotide
  Target: SCN10A; (+) strand; PAM type: YTN; PAM sequence: TTG
actgattaatggacttaaat

SEQ ID NO: 66974 - DNA, 20 bp, Artificial Sequence
  Description of Artificial Sequence: Synthetic oligonucleotide
  Target: SCN10A; (+) strand; PAM type: YTN; PAM sequence: CTG
attaatggacttaaattgtc

SEQ ID NO: 66975 - DNA, 20 bp, Artificial Sequence
  Description of Artificial Sequence: Synthetic oligonucleotide
  Target: SCN10A; (+) strand; PAM type: YTN; PAM sequence: TTA
atggacttaaattgtctacc

SEQ ID NO: 66976 - DNA, 20 bp, Artificial Sequence
  Description of Artificial Sequence: Synthetic oligonucleotide
  Target: SCN10A; (+) strand; PAM type: YTN; PAM sequence: CTT
aaattgtctaccaatattca

SEQ ID NO: 66977 - DNA, 20 bp, Artificial Sequence
  Description of Artificial Sequence: Synthetic oligonucleotide
  Target: SCN10A; (+) strand; PAM type: YTN; PAM sequence: TTA
aattgtctaccaatattcag

SEQ ID NO: 66978 - DNA, 20 bp, Artificial Sequence
  Description of Artificial Sequence: Synthetic oligonucleotide
  Target: SCN10A; (+) strand; PAM type: YTN; PAM sequence: TTG
tctaccaatattcagcataa

SEQ ID NO: 66979 - DNA, 20 bp, Artificial Sequence
  Description of Artificial Sequence: Synthetic oligonucleotide
  Target: SCN10A; (+) strand; PAM type: YTN; PAM sequence: CTA
ccaatattcagcataatgtg

SEQ ID NO: 66980 - DNA, 20 bp, Artificial Sequence
  Description of Artificial Sequence: Synthetic oligonucleotide
  Target: SCN10A; (+) strand; PAM type: YTN; PAM sequence: TTC
agcataatgtgggcttgaac

SEQ ID NO: 66981 - DNA, 20 bp, Artificial Sequence
  Description of Artificial Sequence: Synthetic oligonucleotide
  Target: SCN10A; (+) strand; PAM type: YTN; PAM sequence: CTT
gaacaagaaattaaattaca

SEQ ID NO: 66982 - DNA, 20 bp, Artificial Sequence
  Description of Artificial Sequence: Synthetic oligonucleotide
  Target: SCN10A; (+) strand; PAM type: YTN; PAM sequence: TTG
aacaagaaattaaattacaa

SEQ ID NO: 66983 - DNA, 20 bp, Artificial Sequence
  Description of Artificial Sequence: Synthetic oligonucleotide
  Target: SCN10A; (+) strand; PAM type: YTN; PAM sequence: TTA
aattacaactgtgtaagtta

SEQ ID NO: 66984 - DNA, 20 bp, Artificial Sequence
  Description of Artificial Sequence: Synthetic oligonucleotide
  Target: SCN10A; (+) strand; PAM type: YTN; PAM sequence: TTA
caactgtgtaagttacaacc

SEQ ID NO: 66985 - DNA, 20 bp, Artificial Sequence
  Description of Artificial Sequence: Synthetic oligonucleotide
  Target: SCN10A; (+) strand; PAM type: YTN; PAM sequence: CTG
tgtaagttacaaccatgaaa

SEQ ID NO: 66986 - DNA, 20 bp, Artificial Sequence
  Description of Artificial Sequence: Synthetic oligonucleotide
  Target: SCN10A; (+) strand; PAM type: YTN; PAM sequence: TTA
caaccatgaaaaatataatt

SEQ ID NO: 66987 - DNA, 20 bp, Artificial Sequence
  Description of Artificial Sequence: Synthetic oligonucleotide
  Target: SCN10A; (+) strand; PAM type: YTN; PAM sequence: TTA
tgaaaccatgaaaaggataa

SEQ ID NO: 66988 - DNA, 20 bp, Artificial Sequence
  Description of Artificial Sequence: Synthetic oligonucleotide
  Target: SCN10A; (+) strand; PAM type: YTN; PAM sequence: TTT
tgccatgttggaaaattaag

SEQ ID NO: 66989 - DNA, 20 bp, Artificial Sequence
  Description of Artificial Sequence: Synthetic oligonucleotide
  Target: SCN10A; (+) strand; PAM type: YTN; PAM sequence: TTT
gccatgttggaaaattaagg

SEQ ID NO: 66990 - DNA, 20 bp, Artificial Sequence
  Description of Artificial Sequence: Synthetic oligonucleotide
  Target: SCN10A; (+) strand; PAM type: YTN; PAM sequence: TTG
ccatgttggaaaattaagga

SEQ ID NO: 66991 - DNA, 20 bp, Artificial Sequence
  Description of Artificial Sequence: Synthetic oligonucleotide
  Target: SCN10A; (+) strand; PAM type: YTN; PAM sequence: TTG
gaaaattaaggatggttaaa

SEQ ID NO: 66992 - DNA, 20 bp, Artificial Sequence
  Description of Artificial Sequence: Synthetic oligonucleotide
  Target: SCN10A; (+) strand; PAM type: YTN; PAM sequence: TTA
aggatggttaaatttcttgt

SEQ ID NO: 66993 - DNA, 20 bp, Artificial Sequence
  Description of Artificial Sequence: Synthetic oligonucleotide
  Target: SCN10A; (+) strand; PAM type: YTN; PAM sequence: TTA
aatttcttgtacaccggaga

SEQ ID NO: 66994 - DNA, 20 bp, Artificial Sequence
  Description of Artificial Sequence: Synthetic oligonucleotide
  Target: SCN10A; (+) strand; PAM type: YTN; PAM sequence: TTT
cttgtacaccggagagctgg

SEQ ID NO: 66995 - DNA, 20 bp, Artificial Sequence
  Description of Artificial Sequence: Synthetic oligonucleotide
  Target: SCN10A; (+) strand; PAM type: YTN; PAM sequence: TTC
ttgtacaccggagagctggc

SEQ ID NO: 66996 - DNA, 20 bp, Artificial Sequence
  Description of Artificial Sequence: Synthetic oligonucleotide
  Target: SCN10A; (+) strand; PAM type: YTN; PAM sequence: CTT
gtacaccggagagctggcct

SEQ ID NO: 66997 - DNA, 20 bp, Artificial Sequence
  Description of Artificial Sequence: Synthetic oligonucleotide
  Target: SCN10A; (+) strand; PAM type: YTN; PAM sequence: TTG
tacaccggagagctggcctg

SEQ ID NO: 66998 - DNA, 20 bp, Artificial Sequence
  Description of Artificial Sequence: Synthetic oligonucleotide
  Target: SCN10A; (+) strand; PAM type: YTN; PAM sequence: CTG
gcctgaaattctctgatgcc

SEQ ID NO: 66999 - DNA, 20 bp, Artificial Sequence
  Description of Artificial Sequence: Synthetic oligonucleotide
  Target: SCN10A; (+) strand; PAM type: YTN; PAM sequence: CTG
aaattctctgatgcctgcca

SEQ ID NO: 67000 - DNA, 20 bp, Artificial Sequence
  Description of Artificial Sequence: Synthetic oligonucleotide
  Target: SCN10A; (+) strand; PAM type: YTN; PAM sequence: TTC
tctgatgcctgccagatcac

SEQ ID NO: 67001 - DNA, 20 bp, Artificial Sequence
  Description of Artificial Sequence: Synthetic oligonucleotide
  Target: SCN10A; (+) strand; PAM type: YTN; PAM sequence: CTC
tgatgcctgccagatcactt

SEQ ID NO: 67002 - DNA, 20 bp, Artificial Sequence
  Description of Artificial Sequence: Synthetic oligonucleotide
  Target: SCN10A; (+) strand; PAM type: YTN; PAM sequence: CTG
atgcctgccagatcactttt

SEQ ID NO: 67003 - DNA, 20 bp, Artificial Sequence
  Description of Artificial Sequence: Synthetic oligonucleotide
  Target: SCN10A; (+) strand; PAM type: YTN; PAM sequence: CTG
ccagatcacttttaaaaatc

SEQ ID NO: 67004 - DNA, 20 bp, Artificial Sequence
  Description of Artificial Sequence: Synthetic oligonucleotide
  Target: SCN10A; (+) strand; PAM type: YTN; PAM sequence: CTT
ttaaaaatctagttttgtga

SEQ ID NO: 67005 - DNA, 20 bp, Artificial Sequence
  Description of Artificial Sequence: Synthetic oligonucleotide
  Target: SCN10A; (+) strand; PAM type: YTN; PAM sequence: TTT
taaaaatctagttttgtgat

SEQ ID NO: 67006 - DNA, 20 bp, Artificial Sequence
  Description of Artificial Sequence: Synthetic oligonucleotide
  Target: SCN10A; (+) strand; PAM type: YTN; PAM sequence: TTT
aaaaatctagttttgtgatg

SEQ ID NO: 67007 - DNA, 20 bp, Artificial Sequence
  Description of Artificial Sequence: Synthetic oligonucleotide
  Target: SCN10A; (+) strand; PAM type: YTN; PAM sequence: TTA
aaaatctagttttgtgatgc

SEQ ID NO: 67008 - DNA, 20 bp, Artificial Sequence
  Description of Artificial Sequence: Synthetic oligonucleotide
  Target: SCN10A; (+) strand; PAM type: YTN; PAM sequence: CTA
gttttgtgatgcatgcaaag

SEQ ID NO: 67009 - DNA, 20 bp, Artificial Sequence
  Description of Artificial Sequence: Synthetic oligonucleotide
  Target: SCN10A; (+) strand; PAM type: YTN; PAM sequence: TTT
tgtgatgcatgcaaagcaga

SEQ ID NO: 67010 - DNA, 20 bp, Artificial Sequence
  Description of Artificial Sequence: Synthetic oligonucleotide
  Target: SCN10A; (+) strand; PAM type: YTN; PAM sequence: TTT
gtgatgcatgcaaagcagat

SEQ ID NO: 67011 - DNA, 20 bp, Artificial Sequence
  Description of Artificial Sequence: Synthetic oligonucleotide
  Target: SCN10A; (+) strand; PAM type: YTN; PAM sequence: TTG
tgatgcatgcaaagcagatg

SEQ ID NO: 67012 - DNA, 20 bp, Artificial Sequence
  Description of Artificial Sequence: Synthetic oligonucleotide
  Target: SCN10A; (+) strand; PAM type: YTN; PAM sequence: CTA
atttgaacaagagatgagct

SEQ ID NO: 67013 - DNA, 20 bp, Artificial Sequence
  Description of Artificial Sequence: Synthetic oligonucleotide
  Target: SCN10A; (+) strand; PAM type: YTN; PAM sequence: TTT
gaacaagagatgagctagga

SEQ ID NO: 67014 - DNA, 20 bp, Artificial Sequence
  Description of Artificial Sequence: Synthetic oligonucleotide
  Target: SCN10A; (+) strand; PAM type: YTN; PAM sequence: TTG
aacaagagatgagctaggat

SEQ ID NO: 67015 - DNA, 20 bp, Artificial Sequence
  Description of Artificial Sequence: Synthetic oligonucleotide
  Target: SCN10A; (+) strand; PAM type: YTN; PAM sequence: CTA
ggatattttattcatcaaat

SEQ ID NO: 67016 - DNA, 20 bp, Artificial Sequence
  Description of Artificial Sequence: Synthetic oligonucleotide
  Target: SCN10A; (+) strand; PAM type: YTN; PAM sequence: TTT
tattcatcaaattattttgt

SEQ ID NO: 67017 - DNA, 20 bp, Artificial Sequence
  Description of Artificial Sequence: Synthetic oligonucleotide
  Target: SCN10A; (+) strand; PAM type: YTN; PAM sequence: TTT
attcatcaaattattttgtt

SEQ ID NO: 67018 - DNA, 20 bp, Artificial Sequence
  Description of Artificial Sequence: Synthetic oligonucleotide
  Target: SCN10A; (+) strand; PAM type: YTN; PAM sequence: TTA
ttcatcaaattattttgttt

SEQ ID NO: 67019 - DNA, 20 bp, Artificial Sequence
  Description of Artificial Sequence: Synthetic oligonucleotide
  Target: SCN10A; (+) strand; PAM type: YTN; PAM sequence: TTC
atcaaattattttgtttttg

SEQ ID NO: 67020 - DNA, 20 bp, Artificial Sequence
  Description of Artificial Sequence: Synthetic oligonucleotide
  Target: SCN10A; (+) strand; PAM type: YTN; PAM sequence: TTA
ttttgtttttgaaaaattat

SEQ ID NO: 67021 - DNA, 20 bp, Artificial Sequence
  Description of Artificial Sequence: Synthetic oligonucleotide
  Target: SCN10A; (+) strand; PAM type: YTN; PAM sequence: TTT
tgtttttgaaaaattatgca

SEQ ID NO: 67022 - DNA, 20 bp, Artificial Sequence
  Description of Artificial Sequence: Synthetic oligonucleotide
  Target: SCN10A; (+) strand; PAM type: YTN; PAM sequence: TTT
gtttttgaaaaattatgcat

SEQ ID NO: 67023 - DNA, 20 bp, Artificial Sequence
  Description of Artificial Sequence: Synthetic oligonucleotide
  Target: SCN10A; (+) strand; PAM type: YTN; PAM sequence: TTG
tttttgaaaaattatgcatc

SEQ ID NO: 67024 - DNA, 20 bp, Artificial Sequence
  Description of Artificial Sequence: Synthetic oligonucleotide
  Target: SCN10A; (+) strand; PAM type: YTN; PAM sequence: TTT
ttgaaaaattatgcatctaa

SEQ ID NO: 67025 - DNA, 20 bp, Artificial Sequence
  Description of Artificial Sequence: Synthetic oligonucleotide
  Target: SCN10A; (+) strand; PAM type: YTN; PAM sequence: TTT
tgaaaaattatgcatctaaa

SEQ ID NO: 67026 - DNA, 20 bp, Artificial Sequence
  Description of Artificial Sequence: Synthetic oligonucleotide
  Target: SCN10A; (+) strand; PAM type: YTN; PAM sequence: TTT
gaaaaattatgcatctaaaa

SEQ ID NO: 67027 - DNA, 20 bp, Artificial Sequence
  Description of Artificial Sequence: Synthetic oligonucleotide
  Target: SCN10A; (+) strand; PAM type: YTN; PAM sequence: TTG
aaaaattatgcatctaaaaa

SEQ ID NO: 67028 - DNA, 20 bp, Artificial Sequence
  Description of Artificial Sequence: Synthetic oligonucleotide
  Target: SCN10A; (+) strand; PAM type: YTN; PAM sequence: TTA
tgcatctaaaaaaccacatt

SEQ ID NO: 67029 - DNA, 20 bp, Artificial Sequence
  Description of Artificial Sequence: Synthetic oligonucleotide
  Target: SCN10A; (+) strand; PAM type: YTN; PAM sequence: CTA
aaaaaccacattgataaaag

SEQ ID NO: 67030 - DNA, 20 bp, Artificial Sequence
  Description of Artificial Sequence: Synthetic oligonucleotide
  Target: SCN10A; (+) strand; PAM type: YTN; PAM sequence: TTG
ataaaagatggtggggccta

SEQ ID NO: 67031 - DNA, 20 bp, Artificial Sequence
  Description of Artificial Sequence: Synthetic oligonucleotide
  Target: SCN10A; (+) strand; PAM type: YTN; PAM sequence: CTA
agacataagaatgaggagta

SEQ ID NO: 67032 - DNA, 20 bp, Artificial Sequence
  Description of Artificial Sequence: Synthetic oligonucleotide
  Target: SCN10A; (+) strand; PAM type: YTN; PAM sequence: TTA
ggaattccagtacacagaga

SEQ ID NO: 67033 - DNA, 20 bp, Artificial Sequence
  Description of Artificial Sequence: Synthetic oligonucleotide
  Target: SCN10A; (+) strand; PAM type: YTN; PAM sequence: TTC
cagtacacagagatggacgc

SEQ ID NO: 67034 - DNA, 20 bp, Artificial Sequence
  Description of Artificial Sequence: Synthetic oligonucleotide
  Target: SCN10A; (+) strand; PAM type: YTN; PAM sequence: CTT
tgacacgagttagagacatt

SEQ ID NO: 67035 - DNA, 20 bp, Artificial Sequence
  Description of Artificial Sequence: Synthetic oligonucleotide
  Target: SCN10A; (+) strand; PAM type: YTN; PAM sequence: TTT
gacacgagttagagacattg

SEQ ID NO: 67036 - DNA, 20 bp, Artificial Sequence
  Description of Artificial Sequence: Synthetic oligonucleotide
  Target: SCN10A; (+) strand; PAM type: YTN; PAM sequence: TTG
acacgagttagagacattgc

SEQ ID NO: 67037 - DNA, 20 bp, Artificial Sequence
  Description of Artificial Sequence: Synthetic oligonucleotide
  Target: SCN10A; (+) strand; PAM type: YTN; PAM sequence: TTA
gagacattgcttctgctgct

SEQ ID NO: 67038 - DNA, 20 bp, Artificial Sequence
  Description of Artificial Sequence: Synthetic oligonucleotide
  Target: SCN10A; (+) strand; PAM type: YTN; PAM sequence: TTG
cttctgctgctcacatggga

SEQ ID NO: 67039 - DNA, 20 bp, Artificial Sequence
  Description of Artificial Sequence: Synthetic oligonucleotide
  Target: SCN10A; (+) strand; PAM type: YTN; PAM sequence: CTT
ctgctgctcacatgggaatt

SEQ ID NO: 67040 - DNA, 20 bp, Artificial Sequence
  Description of Artificial Sequence: Synthetic oligonucleotide
  Target: SCN10A; (+) strand; PAM type: YTN; PAM sequence: TTC
tgctgctcacatgggaattc

SEQ ID NO: 67041 - DNA, 20 bp, Artificial Sequence
  Description of Artificial Sequence: Synthetic oligonucleotide
  Target: SCN10A; (+) strand; PAM type: YTN; PAM sequence: CTG
ctgctcacatgggaattcat

SEQ ID NO: 67042 - DNA, 20 bp, Artificial Sequence
  Description of Artificial Sequence: Synthetic oligonucleotide
  Target: SCN10A; (+) strand; PAM type: YTN; PAM sequence: CTG
ctcacatgggaattcatcat

SEQ ID NO: 67043 - DNA, 20 bp, Artificial Sequence
  Description of Artificial Sequence: Synthetic oligonucleotide
  Target: SCN10A; (+) strand; PAM type: YTN; PAM sequence: CTC
acatgggaattcatcatgac

SEQ ID NO: 67044 - DNA, 20 bp, Artificial Sequence
  Description of Artificial Sequence: Synthetic oligonucleotide
  Target: SCN10A; (+) strand; PAM type: YTN; PAM sequence: TTC
atcatgacacagtggatgaa

SEQ ID NO: 67045 - DNA, 20 bp, Artificial Sequence
  Description of Artificial Sequence: Synthetic oligonucleotide
  Target: SCN10A; (+) strand; PAM type: YTN; PAM sequence: CTT
accctcaaggacggaggtta

SEQ ID NO: 67046 - DNA, 20 bp, Artificial Sequence
  Description of Artificial Sequence: Synthetic oligonucleotide
  Target: SCN10A; (+) strand; PAM type: YTN; PAM sequence: TTA
ccctcaaggacggaggttat

SEQ ID NO: 67047 - DNA, 20 bp, Artificial Sequence
  Description of Artificial Sequence: Synthetic oligonucleotide
  Target: SCN10A; (+) strand; PAM type: YTN; PAM sequence: CTC
aaggacggaggttatgatac

SEQ ID NO: 67048 - DNA, 20 bp, Artificial Sequence
  Description of Artificial Sequence: Synthetic oligonucleotide
  Target: SCN10A; (+) strand; PAM type: YTN; PAM sequence: TTA
tgatactgacaacactcatt

SEQ ID NO: 67049 - DNA, 20 bp, Artificial Sequence
  Description of Artificial Sequence: Synthetic oligonucleotide
  Target: SCN10A; (+) strand; PAM type: YTN; PAM sequence: CTG
acaacactcattgccctttg

SEQ ID NO: 67050 - DNA, 20 bp, Artificial Sequence
  Description of Artificial Sequence: Synthetic oligonucleotide
  Target: SCN10A; (+) strand; PAM type: YTN; PAM sequence: CTC
attgccctttgggcccggaa

SEQ ID NO: 67051 - DNA, 20 bp, Artificial Sequence
  Description of Artificial Sequence: Synthetic oligonucleotide
  Target: SCN10A; (+) strand; PAM type: YTN; PAM sequence: TTG
ccctttgggcccggaaaggt

SEQ ID NO: 67052 - DNA, 20 bp, Artificial Sequence
  Description of Artificial Sequence: Synthetic oligonucleotide
  Target: SCN10A; (+) strand; PAM type: YTN; PAM sequence: CTT
tgggcccggaaaggttcatc

SEQ ID NO: 67053 - DNA, 20 bp, Artificial Sequence
  Description of Artificial Sequence: Synthetic oligonucleotide
  Target: SCN10A; (+) strand; PAM type: YTN; PAM sequence: TTT
gggcccggaaaggttcatct

SEQ ID NO: 67054 - DNA, 20 bp, Artificial Sequence
  Description of Artificial Sequence: Synthetic oligonucleotide
  Target: SCN10A; (+) strand; PAM type: YTN; PAM sequence: TTG
ggcccggaaaggttcatcta

SEQ ID NO: 67055 - DNA, 20 bp, Artificial Sequence
  Description of Artificial Sequence: Synthetic oligonucleotide
  Target: SCN10A; (+) strand; PAM type: YTN; PAM sequence: TTC
atctaagtattctgctgaca

SEQ ID NO: 67056 - DNA, 20 bp, Artificial Sequence
  Description of Artificial Sequence: Synthetic oligonucleotide
  Target: SCN10A; (+) strand; PAM type: YTN; PAM sequence: CTA
agtattctgctgacaagaaa

SEQ ID NO: 67057 - DNA, 20 bp, Artificial Sequence
  Description of Artificial Sequence: Synthetic oligonucleotide
  Target: SCN10A; (+) strand; PAM type: YTN; PAM sequence: TTC
tgctgacaagaaagtcttct

SEQ ID NO: 67058 - DNA, 20 bp, Artificial Sequence
  Description of Artificial Sequence: Synthetic oligonucleotide
  Target: SCN10A; (+) strand; PAM type: YTN; PAM sequence: CTG
ctgacaagaaagtcttcttt

SEQ ID NO: 67059 - DNA, 20 bp, Artificial Sequence
  Description of Artificial Sequence: Synthetic oligonucleotide
  Target: SCN10A; (+) strand; PAM type: YTN; PAM sequence: CTG
acaagaaagtcttcttttgt

SEQ ID NO: 67060 - DNA, 20 bp, Artificial Sequence
  Description of Artificial Sequence: Synthetic oligonucleotide
  Target: SCN10A; (+) strand; PAM type: YTN; PAM sequence: CTT
cttttgtcctgcatcgaatg

SEQ ID NO: 67061 - DNA, 20 bp, Artificial Sequence
  Description of Artificial Sequence: Synthetic oligonucleotide
  Target: SCN10A; (+) strand; PAM type: YTN; PAM sequence: TTC
ttttgtcctgcatcgaatgc

SEQ ID NO: 67062 - DNA, 20 bp, Artificial Sequence
  Description of Artificial Sequence: Synthetic oligonucleotide
  Target: SCN10A; (+) strand; PAM type: YTN; PAM sequence: CTT
ttgtcctgcatcgaatgcct

SEQ ID NO: 67063 - DNA, 20 bp, Artificial Sequence
  Description of Artificial Sequence: Synthetic oligonucleotide
  Target: SCN10A; (+) strand; PAM type: YTN; PAM sequence: TTT
tgtcctgcatcgaatgcctg

SEQ ID NO: 67064 - DNA, 20 bp, Artificial Sequence
  Description of Artificial Sequence: Synthetic oligonucleotide
  Target: SCN10A; (+) strand; PAM type: YTN; PAM sequence: TTT
gtcctgcatcgaatgcctgt

SEQ ID NO: 67065 - DNA, 20 bp, Artificial Sequence
  Description of Artificial Sequence: Synthetic oligonucleotide
  Target: SCN10A; (+) strand; PAM type: YTN; PAM sequence: TTG
tcctgcatcgaatgcctgtt

SEQ ID NO: 67066 - DNA, 20 bp, Artificial Sequence
  Description of Artificial Sequence: Synthetic oligonucleotide
  Target: SCN10A; (+) strand; PAM type: YTN; PAM sequence: CTG
catcgaatgcctgttgagac

SEQ ID NO: 67067 - DNA, 20 bp, Artificial Sequence
  Description of Artificial Sequence: Synthetic oligonucleotide
  Target: SCN10A; (+) strand; PAM type: YTN; PAM sequence: CTG
ttgagacacaaacagagtca

SEQ ID NO: 67068 - DNA, 20 bp, Artificial Sequence
  Description of Artificial Sequence: Synthetic oligonucleotide
  Target: SCN10A; (+) strand; PAM type: YTN; PAM sequence: TTG
agacacaaacagagtcagga

SEQ ID NO: 67069 - DNA, 20 bp, Artificial Sequence
  Description of Artificial Sequence: Synthetic oligonucleotide
  Target: SCN10A; (+) strand; PAM type: YTN; PAM sequence: CTC
ctttaacctgacatcttcat

SEQ ID NO: 67070 - DNA, 20 bp, Artificial Sequence
  Description of Artificial Sequence: Synthetic oligonucleotide
  Target: SCN10A; (+) strand; PAM type: YTN; PAM sequence: CTT
taacctgacatcttcatggc

SEQ ID NO: 67071 - DNA, 20 bp, Artificial Sequence
  Description of Artificial Sequence: Synthetic oligonucleotide
  Target: SCN10A; (+) strand; PAM type: YTN; PAM sequence: TTT
aacctgacatcttcatggca

SEQ ID NO: 67072 - DNA, 20 bp, Artificial Sequence
  Description of Artificial Sequence: Synthetic oligonucleotide
  Target: SCN10A; (+) strand; PAM type: YTN; PAM sequence: TTA
acctgacatcttcatggcaa

SEQ ID NO: 67073 - DNA, 20 bp, Artificial Sequence
  Description of Artificial Sequence: Synthetic oligonucleotide
  Target: SCN10A; (+) strand; PAM type: YTN; PAM sequence: CTG
acatcttcatggcaaagttg

SEQ ID NO: 67074 - DNA, 20 bp, Artificial Sequence
  Description of Artificial Sequence: Synthetic oligonucleotide
  Target: SCN10A; (+) strand; PAM type: YTN; PAM sequence: CTT
catggcaaagttggatcatt

SEQ ID NO: 67075 - DNA, 20 bp, Artificial Sequence
  Description of Artificial Sequence: Synthetic oligonucleotide
  Target: SCN10A; (+) strand; PAM type: YTN; PAM sequence: TTC
atggcaaagttggatcattc

SEQ ID NO: 67076 - DNA, 20 bp, Artificial Sequence
  Description of Artificial Sequence: Synthetic oligonucleotide
  Target: SCN10A; (+) strand; PAM type: YTN; PAM sequence: TTG
gatcattcagcctcttattg

SEQ ID NO: 67077 - DNA, 20 bp, Artificial Sequence
  Description of Artificial Sequence: Synthetic oligonucleotide
  Target: SCN10A; (+) strand; PAM type: YTN; PAM sequence: TTC
agcctcttattggccaatct

SEQ ID NO: 67078 - DNA, 20 bp, Artificial Sequence
  Description of Artificial Sequence: Synthetic oligonucleotide
  Target: SCN10A; (+) strand; PAM type: YTN; PAM sequence: CTC
ttattggccaatctcatata

SEQ ID NO: 67079 - DNA, 20 bp, Artificial Sequence
  Description of Artificial Sequence: Synthetic oligonucleotide
  Target: SCN10A; (+) strand; PAM type: YTN; PAM sequence: CTT
attggccaatctcatatata

SEQ ID NO: 67080 - DNA, 20 bp, Artificial Sequence
  Description of Artificial Sequence: Synthetic oligonucleotide
  Target: SCN10A; (+) strand; PAM type: YTN; PAM sequence: TTA
ttggccaatctcatatatag

SEQ ID NO: 67081 - DNA, 20 bp, Artificial Sequence
  Description of Artificial Sequence: Synthetic oligonucleotide
  Target: SCN10A; (+) strand; PAM type: YTN; PAM sequence: TTG
gccaatctcatatatagtca

SEQ ID NO: 67082 - DNA, 20 bp, Artificial Sequence
  Description of Artificial Sequence: Synthetic oligonucleotide
  Target: SCN10A; (+) strand; PAM type: YTN; PAM sequence: CTC
atatatagtcatatgtcact

SEQ ID NO: 67083 - DNA, 20 bp, Artificial Sequence
  Description of Artificial Sequence: Synthetic oligonucleotide
  Target: SCN10A; (+) strand; PAM type: YTN; PAM sequence: CTT
acagatagagatatgttctg

SEQ ID NO: 67084 - DNA, 20 bp, Artificial Sequence
  Description of Artificial Sequence: Synthetic oligonucleotide
  Target: SCN10A; (+) strand; PAM type: YTN; PAM sequence: TTA
cagatagagatatgttctga

SEQ ID NO: 67085 - DNA, 20 bp, Artificial Sequence
  Description of Artificial Sequence: Synthetic oligonucleotide
  Target: SCN10A; (+) strand; PAM type: YTN; PAM sequence: TTC
tgacaaatacatcattaggt

SEQ ID NO: 67086 - DNA, 20 bp, Artificial Sequence
  Description of Artificial Sequence: Synthetic oligonucleotide
  Target: SCN10A; (+) strand; PAM type: YTN; PAM sequence: CTG
acaaatacatcattaggtga

SEQ ID NO: 67087 - DNA, 20 bp, Artificial Sequence
  Description of Artificial Sequence: Synthetic oligonucleotide
  Target: SCN10A; (+) strand; PAM type: YTN; PAM sequence: TTA
ggtgatttcatcattctgtg

SEQ ID NO: 67088 - DNA, 20 bp, Artificial Sequence
  Description of Artificial Sequence: Synthetic oligonucleotide
  Target: SCN10A; (+) strand; PAM type: YTN; PAM sequence: TTT
catcattctgtgaatatcct

SEQ ID NO: 67089 - DNA, 20 bp, Artificial Sequence
  Description of Artificial Sequence: Synthetic oligonucleotide
  Target: SCN10A; (+) strand; PAM type: YTN; PAM sequence: TTC
atcattctgtgaatatccta

SEQ ID NO: 67090 - DNA, 20 bp, Artificial Sequence
  Description of Artificial Sequence: Synthetic oligonucleotide
  Target: SCN10A; (+) strand; PAM type: YTN; PAM sequence: TTC
tgtgaatatcctacattgta

SEQ ID NO: 67091 - DNA, 20 bp, Artificial Sequence
  Description of Artificial Sequence: Synthetic oligonucleotide
  Target: SCN10A; (+) strand; PAM type: YTN; PAM sequence: CTG
tgaatatcctacattgtatt

SEQ ID NO: 67092 - DNA, 20 bp, Artificial Sequence
  Description of Artificial Sequence: Synthetic oligonucleotide
  Target: SCN10A; (+) strand; PAM type: YTN; PAM sequence: CTA
cattgtatttacacaaacaa

SEQ ID NO: 67093 - DNA, 20 bp, Artificial Sequence
  Description of Artificial Sequence: Synthetic oligonucleotide
  Target: SCN10A; (+) strand; PAM type: YTN; PAM sequence: TTG
tatttacacaaacaaatgct

SEQ ID NO: 67094 - DNA, 20 bp, Artificial Sequence
  Description of Artificial Sequence: Synthetic oligonucleotide
  Target: SCN10A; (+) strand; PAM type: YTN; PAM sequence: TTT
acacaaacaaatgctatagc

SEQ ID NO: 67095 - DNA, 20 bp, Artificial Sequence
  Description of Artificial Sequence: Synthetic oligonucleotide
  Target: SCN10A; (+) strand; PAM type: YTN; PAM sequence: TTA
cacaaacaaatgctatagcc

SEQ ID NO: 67096 - DNA, 20 bp, Artificial Sequence
  Description of Artificial Sequence: Synthetic oligonucleotide
  Target: SCN10A; (+) strand; PAM type: YTN; PAM sequence: CTA
tagccttctatacatctagg

SEQ ID NO: 67097 - DNA, 20 bp, Artificial Sequence
  Description of Artificial Sequence: Synthetic oligonucleotide
  Target: SCN10A; (+) strand; PAM type: YTN; PAM sequence: CTT
ctatacatctaggctaaata

SEQ ID NO: 67098 - DNA, 20 bp, Artificial Sequence
  Description of Artificial Sequence: Synthetic oligonucleotide
  Target: SCN10A; (+) strand; PAM type: YTN; PAM sequence: TTC
tatacatctaggctaaatag

SEQ ID NO: 67099 - DNA, 20 bp, Artificial Sequence
  Description of Artificial Sequence: Synthetic oligonucleotide
  Target: SCN10A; (+) strand; PAM type: YTN; PAM sequence: CTA
tacatctaggctaaatagtg

SEQ ID NO: 67100 - DNA, 20 bp, Artificial Sequence
  Description of Artificial Sequence: Synthetic oligonucleotide
  Target: SCN10A; (+) strand; PAM type: YTN; PAM sequence: CTA
ggctaaatagtgtggcctat

SEQ ID NO: 67101 - DNA, 20 bp, Artificial Sequence
  Description of Artificial Sequence: Synthetic oligonucleotide
  Target: SCN10A; (+) strand; PAM type: YTN; PAM sequence: CTA
aatagtgtggcctattgctc

SEQ ID NO: 67102 - DNA, 20 bp, Artificial Sequence
  Description of Artificial Sequence: Synthetic oligonucleotide
  Target: SCN10A; (+) strand; PAM type: YTN; PAM sequence: CTA
ttgctcctaggctacaaatc

SEQ ID NO: 67103 - DNA, 20 bp, Artificial Sequence
  Description of Artificial Sequence: Synthetic oligonucleotide
  Target: SCN10A; (+) strand; PAM type: YTN; PAM sequence: TTG
ctcctaggctacaaatctgt

SEQ ID NO: 67104 - DNA, 20 bp, Artificial Sequence
  Description of Artificial Sequence: Synthetic oligonucleotide
  Target: SCN10A; (+) strand; PAM type: YTN; PAM sequence: CTC
ctaggctacaaatctgtaca

SEQ ID NO: 67105 - DNA, 20 bp, Artificial Sequence
  Description of Artificial Sequence: Synthetic oligonucleotide
  Target: SCN10A; (+) strand; PAM type: YTN; PAM sequence: CTA
ggctacaaatctgtacagca

SEQ ID NO: 67106 - DNA, 20 bp, Artificial Sequence
  Description of Artificial Sequence: Synthetic oligonucleotide
  Target: SCN10A; (+) strand; PAM type: YTN; PAM sequence: CTA
caaatctgtacagcatgtta

SEQ ID NO: 67107 - DNA, 20 bp, Artificial Sequence
  Description of Artificial Sequence: Synthetic oligonucleotide
  Target: SCN10A; (+) strand; PAM type: YTN; PAM sequence: CTG
tacagcatgttattgctgaa

SEQ ID NO: 67108 - DNA, 20 bp, Artificial Sequence
  Description of Artificial Sequence: Synthetic oligonucleotide
  Target: SCN10A; (+) strand; PAM type: YTN; PAM sequence: TTA
ttgctgaatactgtaagtat

SEQ ID NO: 67109 - DNA, 20 bp, Artificial Sequence
  Description of Artificial Sequence: Synthetic oligonucleotide
  Target: SCN10A; (+) strand; PAM type: YTN; PAM sequence: TTG
ctgaatactgtaagtataaa

SEQ ID NO: 67110 - DNA, 20 bp, Artificial Sequence
  Description of Artificial Sequence: Synthetic oligonucleotide
  Target: SCN10A; (+) strand; PAM type: YTN; PAM sequence: CTG
aatactgtaagtataaacag

SEQ ID NO: 67111 - DNA, 20 bp, Artificial Sequence
  Description of Artificial Sequence: Synthetic oligonucleotide
  Target: SCN10A; (+) strand; PAM type: YTN; PAM sequence: CTG
taagtataaacagttaataa

SEQ ID NO: 67112 - DNA, 20 bp, Artificial Sequence
  Description of Artificial Sequence: Synthetic oligonucleotide
  Target: SCN10A; (+) strand; PAM type: YTN; PAM sequence: TTA
ataaacataaagaaagttta

SEQ ID NO: 67113 - DNA, 20 bp, Artificial Sequence
  Description of Artificial Sequence: Synthetic oligonucleotide
  Target: SCN10A; (+) strand; PAM type: YTN; PAM sequence: TTT
ataaagcttccaaccatgag

SEQ ID NO: 67114 - DNA, 20 bp, Artificial Sequence
  Description of Artificial Sequence: Synthetic oligonucleotide
  Target: SCN10A; (+) strand; PAM type: YTN; PAM sequence: TTA
taaagcttccaaccatgagg

SEQ ID NO: 67115 - DNA, 20 bp, Artificial Sequence
  Description of Artificial Sequence: Synthetic oligonucleotide
  Target: SCN10A; (+) strand; PAM type: YTN; PAM sequence: CTT
ccaaccatgaggactaagca

SEQ ID NO: 67116 - DNA, 20 bp, Artificial Sequence
  Description of Artificial Sequence: Synthetic oligonucleotide
  Target: SCN10A; (+) strand; PAM type: YTN; PAM sequence: TTC
caaccatgaggactaagcaa

SEQ ID NO: 67117 - DNA, 20 bp, Artificial Sequence
  Description of Artificial Sequence: Synthetic oligonucleotide
  Target: SCN10A; (+) strand; PAM type: YTN; PAM sequence: CTA
agcaaatgatactagtagtc

SEQ ID NO: 67118 - DNA, 20 bp, Artificial Sequence
  Description of Artificial Sequence: Synthetic oligonucleotide
  Target: SCN10A; (+) strand; PAM type: YTN; PAM sequence: CTA
gtagtcactatttattgtta

SEQ ID NO: 67119 - DNA, 20 bp, Artificial Sequence
  Description of Artificial Sequence: Synthetic oligonucleotide
  Target: SCN10A; (+) strand; PAM type: YTN; PAM sequence: CTA
tttattgttatctgtcagac

SEQ ID NO: 67120 - DNA, 20 bp, Artificial Sequence
  Description of Artificial Sequence: Synthetic oligonucleotide
  Target: SCN10A; (+) strand; PAM type: YTN; PAM sequence: TTT
attgttatctgtcagacatg

SEQ ID NO: 67121 - DNA, 20 bp, Artificial Sequence
  Description of Artificial Sequence: Synthetic oligonucleotide
  Target: SCN10A; (+) strand; PAM type: YTN; PAM sequence: TTA
ttgttatctgtcagacatgt

SEQ ID NO: 67122 - DNA, 20 bp, Artificial Sequence
  Description of Artificial Sequence: Synthetic oligonucleotide
  Target: SCN10A; (+) strand; PAM type: YTN; PAM sequence: TTG
ttatctgtcagacatgtata

SEQ ID NO: 67123 - DNA, 20 bp, Artificial Sequence
  Description of Artificial Sequence: Synthetic oligonucleotide
  Target: SCN10A; (+) strand; PAM type: YTN; PAM sequence: TTA
tctgtcagacatgtataaaa

SEQ ID NO: 67124 - DNA, 20 bp, Artificial Sequence
  Description of Artificial Sequence: Synthetic oligonucleotide
  Target: SCN10A; (+) strand; PAM type: YTN; PAM sequence: CTG
tcagacatgtataaaaatgt

SEQ ID NO: 67125 - DNA, 20 bp, Artificial Sequence
  Description of Artificial Sequence: Synthetic oligonucleotide
  Target: SCN10A; (+) strand; PAM type: YTN; PAM sequence: CTT
tgttatttcatttaaccctc

SEQ ID NO: 67126 - DNA, 20 bp, Artificial Sequence
  Description of Artificial Sequence: Synthetic oligonucleotide
  Target: SCN10A; (+) strand; PAM type: YTN; PAM sequence: TTT
gttatttcatttaaccctcc

SEQ ID NO: 67127 - DNA, 20 bp, Artificial Sequence
  Description of Artificial Sequence: Synthetic oligonucleotide
  Target: SCN10A; (+) strand; PAM type: YTN; PAM sequence: TTG
ttatttcatttaaccctcca

SEQ ID NO: 67128 - DNA, 20 bp, Artificial Sequence
  Description of Artificial Sequence: Synthetic oligonucleotide
  Target: SCN10A; (+) strand; PAM type: YTN; PAM sequence: TTA
tttcatttaaccctccagct

SEQ ID NO: 67129 - DNA, 20 bp, Artificial Sequence
  Description of Artificial Sequence: Synthetic oligonucleotide
  Target: SCN10A; (+) strand; PAM type: YTN; PAM sequence: TTT
catttaaccctccagctatt

SEQ ID NO: 67130 - DNA, 20 bp, Artificial Sequence
  Description of Artificial Sequence: Synthetic oligonucleotide
  Target: SCN10A; (+) strand; PAM type: YTN; PAM sequence: TTC
atttaaccctccagctattt

SEQ ID NO: 67131 - DNA, 20 bp, Artificial Sequence
  Description of Artificial Sequence: Synthetic oligonucleotide
  Target: SCN10A; (+) strand; PAM type: YTN; PAM sequence: TTT
aaccctccagctatttagaa

SEQ ID NO: 67132 - DNA, 20 bp, Artificial Sequence
  Description of Artificial Sequence: Synthetic oligonucleotide
  Target: SCN10A; (+) strand; PAM type: YTN; PAM sequence: TTA
accctccagctatttagaaa

SEQ ID NO: 67133 - DNA, 20 bp, Artificial Sequence
  Description of Artificial Sequence: Synthetic oligonucleotide
  Target: SCN10A; (+) strand; PAM type: YTN; PAM sequence: CTC
cagctatttagaaacctttt

SEQ ID NO: 67134 - DNA, 20 bp, Artificial Sequence
  Description of Artificial Sequence: Synthetic oligonucleotide
  Target: SCN10A; (+) strand; PAM type: YTN; PAM sequence: CTA
tttagaaacctttttacaag

SEQ ID NO: 67135 - DNA, 20 bp, Artificial Sequence
  Description of Artificial Sequence: Synthetic oligonucleotide
  Target: SCN10A; (+) strand; PAM type: YTN; PAM sequence: TTT
agaaacctttttacaagggg

SEQ ID NO: 67136 - DNA, 20 bp, Artificial Sequence
  Description of Artificial Sequence: Synthetic oligonucleotide
  Target: SCN10A; (+) strand; PAM type: YTN; PAM sequence: TTA
gaaacctttttacaagggga

SEQ ID NO: 67137 - DNA, 20 bp, Artificial Sequence
  Description of Artificial Sequence: Synthetic oligonucleotide
  Target: SCN10A; (+) strand; PAM type: YTN; PAM sequence: CTT
tttacaaggggagataagga

SEQ ID NO: 67138 - DNA, 20 bp, Artificial Sequence
  Description of Artificial Sequence: Synthetic oligonucleotide
  Target: SCN10A; (+) strand; PAM type: YTN; PAM sequence: TTT
ttacaaggggagataaggag

SEQ ID NO: 67139 - DNA, 20 bp, Artificial Sequence
  Description of Artificial Sequence: Synthetic oligonucleotide
  Target: SCN10A; (+) strand; PAM type: YTN; PAM sequence: TTT
tacaaggggagataaggagg

SEQ ID NO: 67140 - DNA, 20 bp, Artificial Sequence
  Description of Artificial Sequence: Synthetic oligonucleotide
  Target: SCN10A; (+) strand; PAM type: YTN; PAM sequence: TTT
acaaggggagataaggaggc

SEQ ID NO: 67141 - DNA, 20 bp, Artificial Sequence
  Description of Artificial Sequence: Synthetic oligonucleotide
  Target: SCN10A; (+) strand; PAM type: YTN; PAM sequence: TTA
caaggggagataaggaggct

SEQ ID NO: 67142 - DNA, 20 bp, Artificial Sequence
  Description of Artificial Sequence: Synthetic oligonucleotide
  Target: SCN10A; (+) strand; PAM type: YTN; PAM sequence: CTT
ggataatttaaaggacttgc

SEQ ID NO: 67143 - DNA, 20 bp, Artificial Sequence
  Description of Artificial Sequence: Synthetic oligonucleotide
  Target: SCN10A; (+) strand; PAM type: YTN; PAM sequence: TTG
gataatttaaaggacttgct

SEQ ID NO: 67144 - DNA, 20 bp, Artificial Sequence
  Description of Artificial Sequence: Synthetic oligonucleotide
  Target: SCN10A; (+) strand; PAM type: YTN; PAM sequence: TTT
aaaggacttgctaaatgtga

SEQ ID NO: 67145 - DNA, 20 bp, Artificial Sequence
  Description of Artificial Sequence: Synthetic oligonucleotide
  Target: SCN10A; (+) strand; PAM type: YTN; PAM sequence: TTA
aaggacttgctaaatgtgac

SEQ ID NO: 67146 - DNA, 20 bp, Artificial Sequence
  Description of Artificial Sequence: Synthetic oligonucleotide
  Target: SCN10A; (+) strand; PAM type: YTN; PAM sequence: CTT
gctaaatgtgactcaggtgg

SEQ ID NO: 67147 - DNA, 20 bp, Artificial Sequence
  Description of Artificial Sequence: Synthetic oligonucleotide
  Target: SCN10A; (+) strand; PAM type: YTN; PAM sequence: TTG
ctaaatgtgactcaggtggt

SEQ ID NO: 67148 - DNA, 20 bp, Artificial Sequence
  Description of Artificial Sequence: Synthetic oligonucleotide
  Target: SCN10A; (+) strand; PAM type: YTN; PAM sequence: CTA
aatgtgactcaggtggtaac

SEQ ID NO: 67149 - DNA, 20 bp, Artificial Sequence
  Description of Artificial Sequence: Synthetic oligonucleotide
  Target: SCN10A; (+) strand; PAM type: YTN; PAM sequence: CTC
aggtggtaactggcacagtt

SEQ ID NO: 67150 - DNA, 20 bp, Artificial Sequence
  Description of Artificial Sequence: Synthetic oligonucleotide
  Target: SCN10A; (+) strand; PAM type: YTN; PAM sequence: CTG
gcacagttgggactaaaata

SEQ ID NO: 67151 - DNA, 20 bp, Artificial Sequence
  Description of Artificial Sequence: Synthetic oligonucleotide
  Target: SCN10A; (+) strand; PAM type: YTN; PAM sequence: TTG
ggactaaaatataggtccat

SEQ ID NO: 67152 - DNA, 20 bp, Artificial Sequence
  Description of Artificial Sequence: Synthetic oligonucleotide
  Target: SCN10A; (+) strand; PAM type: YTN; PAM sequence: CTA
aaatataggtccatactaaa

SEQ ID NO: 67153 - DNA, 20 bp, Artificial Sequence
  Description of Artificial Sequence: Synthetic oligonucleotide
  Target: SCN10A; (+) strand; PAM type: YTN; PAM sequence: CTA
aacagaagggcctaaagagt

SEQ ID NO: 67154 - DNA, 20 bp, Artificial Sequence
  Description of Artificial Sequence: Synthetic oligonucleotide
  Target: SCN10A; (+) strand; PAM type: YTN; PAM sequence: CTA
aagagtcaatctttcactag

SEQ ID NO: 67155 - DNA, 20 bp, Artificial Sequence
  Description of Artificial Sequence: Synthetic oligonucleotide
  Target: SCN10A; (+) strand; PAM type: YTN; PAM sequence: CTT
tcactagcctggtaatttaa

SEQ ID NO: 67156 - DNA, 20 bp, Artificial Sequence
  Description of Artificial Sequence: Synthetic oligonucleotide
  Target: SCN10A; (+) strand; PAM type: YTN; PAM sequence: TTT
cactagcctggtaatttaac

SEQ ID NO: 67157 - DNA, 20 bp, Artificial Sequence
  Description of Artificial Sequence: Synthetic oligonucleotide
  Target: SCN10A; (+) strand; PAM type: YTN; PAM sequence: TTC
actagcctggtaatttaact

SEQ ID NO: 67158 - DNA, 20 bp, Artificial Sequence
  Description of Artificial Sequence: Synthetic oligonucleotide
  Target: SCN10A; (+) strand; PAM type: YTN; PAM sequence: CTA
gcctggtaatttaactagaa

SEQ ID NO: 67159 - DNA, 20 bp, Artificial Sequence
  Description of Artificial Sequence: Synthetic oligonucleotide
  Target: SCN10A; (+) strand; PAM type: YTN; PAM sequence: CTG
gtaatttaactagaatgaat

SEQ ID NO: 67160 - DNA, 20 bp, Artificial Sequence
  Description of Artificial Sequence: Synthetic oligonucleotide
  Target: SCN10A; (+) strand; PAM type: YTN; PAM sequence: TTT
aactagaatgaatcaaggtc

SEQ ID NO: 67161 - DNA, 20 bp, Artificial Sequence
  Description of Artificial Sequence: Synthetic oligonucleotide
  Target: SCN10A; (+) strand; PAM type: YTN; PAM sequence: TTA
actagaatgaatcaaggtca

SEQ ID NO: 67162 - DNA, 20 bp, Artificial Sequence
  Description of Artificial Sequence: Synthetic oligonucleotide
  Target: SCN10A; (+) strand; PAM type: YTN; PAM sequence: CTA
gaatgaatcaaggtcagaat

SEQ ID NO: 67163 - DNA, 20 bp, Artificial Sequence
  Description of Artificial Sequence: Synthetic oligonucleotide
  Target: SCN10A; (+) strand; PAM type: YTN; PAM sequence: CTA
gacacatgataatctcagga

SEQ ID NO: 67164 - DNA, 20 bp, Artificial Sequence
  Description of Artificial Sequence: Synthetic oligonucleotide
  Target: SCN10A; (+) strand; PAM type: YTN; PAM sequence: CTC
aggaacagagaaaggagggt

SEQ ID NO: 67165 - DNA, 20 bp, Artificial Sequence
  Description of Artificial Sequence: Synthetic oligonucleotide
  Target: SCN10A; (+) strand; PAM type: YTN; PAM sequence: CTT
cagtgaggcattttctagag

SEQ ID NO: 67166 - DNA, 20 bp, Artificial Sequence
  Description of Artificial Sequence: Synthetic oligonucleotide
  Target: SCN10A; (+) strand; PAM type: YTN; PAM sequence: TTC
agtgaggcattttctagagt

SEQ ID NO: 67167 - DNA, 20 bp, Artificial Sequence
  Description of Artificial Sequence: Synthetic oligonucleotide
  Target: SCN10A; (+) strand; PAM type: YTN; PAM sequence: TTT
tctagagtgctaatgcactc

SEQ ID NO: 67168 - DNA, 20 bp, Artificial Sequence
  Description of Artificial Sequence: Synthetic oligonucleotide
  Target: SCN10A; (+) strand; PAM type: YTN; PAM sequence: TTT
ctagagtgctaatgcactcc

SEQ ID NO: 67169 - DNA, 20 bp, Artificial Sequence
  Description of Artificial Sequence: Synthetic oligonucleotide
  Target: SCN10A; (+) strand; PAM type: YTN; PAM sequence: TTC
tagagtgctaatgcactccc

SEQ ID NO: 67170 - DNA, 20 bp, Artificial Sequence
  Description of Artificial Sequence: Synthetic oligonucleotide
  Target: SCN10A; (+) strand; PAM type: YTN; PAM sequence: CTA
gagtgctaatgcactcccag

SEQ ID NO: 67171 - DNA, 20 bp, Artificial Sequence
  Description of Artificial Sequence: Synthetic oligonucleotide
  Target: SCN10A; (+) strand; PAM type: YTN; PAM sequence: CTA
atgcactcccagcgagccct

SEQ ID NO: 67172 - DNA, 20 bp, Artificial Sequence
  Description of Artificial Sequence: Synthetic oligonucleotide
  Target: SCN10A; (+) strand; PAM type: YTN; PAM sequence: CTC
ccagcgagccctgcaggatg

SEQ ID NO: 67173 - DNA, 20 bp, Artificial Sequence
  Description of Artificial Sequence: Synthetic oligonucleotide
  Target: SCN10A; (+) strand; PAM type: YTN; PAM sequence: CTG
caggatgcctttgactttaa

SEQ ID NO: 67174 - DNA, 20 bp, Artificial Sequence
  Description of Artificial Sequence: Synthetic oligonucleotide
  Target: SCN10A; (+) strand; PAM type: YTN; PAM sequence: CTT
tgactttaaggctctgtttt

SEQ ID NO: 67175 - DNA, 20 bp, Artificial Sequence
  Description of Artificial Sequence: Synthetic oligonucleotide
  Target: SCN10A; (+) strand; PAM type: YTN; PAM sequence: TTT
gactttaaggctctgttttg

SEQ ID NO: 67176 - DNA, 20 bp, Artificial Sequence
  Description of Artificial Sequence: Synthetic oligonucleotide
  Target: SCN10A; (+) strand; PAM type: YTN; PAM sequence: TTG
actttaaggctctgttttgg

SEQ ID NO: 67177 - DNA, 20 bp, Artificial Sequence
  Description of Artificial Sequence: Synthetic oligonucleotide
  Target: SCN10A; (+) strand; PAM type: YTN; PAM sequence: CTT
taaggctctgttttggtgat

SEQ ID NO: 67178 - DNA, 20 bp, Artificial Sequence
  Description of Artificial Sequence: Synthetic oligonucleotide
  Target: SCN10A; (+) strand; PAM type: YTN; PAM sequence: TTT
aaggctctgttttggtgatt

SEQ ID NO: 67179 - DNA, 20 bp, Artificial Sequence
  Description of Artificial Sequence: Synthetic oligonucleotide
  Target: SCN10A; (+) strand; PAM type: YTN; PAM sequence: TTA
aggctctgttttggtgattc

SEQ ID NO: 67180 - DNA, 20 bp, Artificial Sequence
  Description of Artificial Sequence: Synthetic oligonucleotide
  Target: SCN10A; (+) strand; PAM type: YTN; PAM sequence: CTC
tgttttggtgattccatttg

SEQ ID NO: 67181 - DNA, 20 bp, Artificial Sequence
  Description of Artificial Sequence: Synthetic oligonucleotide
  Target: SCN10A; (+) strand; PAM type: YTN; PAM sequence: CTG
ttttggtgattccatttgcc

SEQ ID NO: 67182 - DNA, 20 bp, Artificial Sequence
  Description of Artificial Sequence: Synthetic oligonucleotide
  Target: SCN10A; (+) strand; PAM type: YTN; PAM sequence: TTT
tggtgattccatttgccctg

SEQ ID NO: 67183 - DNA, 20 bp, Artificial Sequence
  Description of Artificial Sequence: Synthetic oligonucleotide
  Target: SCN10A; (+) strand; PAM type: YTN; PAM sequence: TTT
ggtgattccatttgccctgg

SEQ ID NO: 67184 - DNA, 20 bp, Artificial Sequence
  Description of Artificial Sequence: Synthetic oligonucleotide
  Target: SCN10A; (+) strand; PAM type: YTN; PAM sequence: TTG
gtgattccatttgccctgga

SEQ ID NO: 67185 - DNA, 20 bp, Artificial Sequence
  Description of Artificial Sequence: Synthetic oligonucleotide
  Target: SCN10A; (+) strand; PAM type: YTN; PAM sequence: TTC
catttgccctggagacctac

SEQ ID NO: 67186 - DNA, 20 bp, Artificial Sequence
  Description of Artificial Sequence: Synthetic oligonucleotide
  Target: SCN10A; (+) strand; PAM type: YTN; PAM sequence: TTT
gccctggagacctactctct

SEQ ID NO: 67187 - DNA, 20 bp, Artificial Sequence
  Description of Artificial Sequence: Synthetic oligonucleotide
  Target: SCN10A; (+) strand; PAM type: YTN; PAM sequence: TTG
ccctggagacctactctcta

SEQ ID NO: 67188 - DNA, 20 bp, Artificial Sequence
  Description of Artificial Sequence: Synthetic oligonucleotide
  Target: SCN10A; (+) strand; PAM type: YTN; PAM sequence: CTG
gagacctactctctaccttc

SEQ ID NO: 67189 - DNA, 20 bp, Artificial Sequence
  Description of Artificial Sequence: Synthetic oligonucleotide
  Target: SCN10A; (+) strand; PAM type: YTN; PAM sequence: CTA
ctctctaccttctccactgt

SEQ ID NO: 67190 - DNA, 20 bp, Artificial Sequence
  Description of Artificial Sequence: Synthetic oligonucleotide
  Target: SCN10A; (+) strand; PAM type: YTN; PAM sequence: CTC
tctaccttctccactgtctc

SEQ ID NO: 67191 - DNA, 20 bp, Artificial Sequence
  Description of Artificial Sequence: Synthetic oligonucleotide
  Target: SCN10A; (+) strand; PAM type: YTN; PAM sequence: CTC
taccttctccactgtctctg

SEQ ID NO: 67192 - DNA, 20 bp, Artificial Sequence
  Description of Artificial Sequence: Synthetic oligonucleotide
  Target: SCN10A; (+) strand; PAM type: YTN; PAM sequence: CTA
ccttctccactgtctctgtt

SEQ ID NO: 67193 - DNA, 20 bp, Artificial Sequence
  Description of Artificial Sequence: Synthetic oligonucleotide
  Target: SCN10A; (+) strand; PAM type: YTN; PAM sequence: CTT
ctccactgtctctgttcctg

SEQ ID NO: 67194 - DNA, 20 bp, Artificial Sequence
  Description of Artificial Sequence: Synthetic oligonucleotide
  Target: SCN10A; (+) strand; PAM type: YTN; PAM sequence: TTC
tccactgtctctgttcctgg

SEQ ID NO: 67195 - DNA, 20 bp, Artificial Sequence
  Description of Artificial Sequence: Synthetic oligonucleotide
  Target: SCN10A; (+) strand; PAM type: YTN; PAM sequence: CTC
cactgtctctgttcctgggg

SEQ ID NO: 67196 - DNA, 20 bp, Artificial Sequence
  Description of Artificial Sequence: Synthetic oligonucleotide
  Target: SCN10A; (+) strand; PAM type: YTN; PAM sequence: CTG
tctctgttcctggggaggga

SEQ ID NO: 67197 - DNA, 20 bp, Artificial Sequence
  Description of Artificial Sequence: Synthetic oligonucleotide
  Target: SCN10A; (+) strand; PAM type: YTN; PAM sequence: CTC
tgttcctggggagggagacc

SEQ ID NO: 67198 - DNA, 20 bp, Artificial Sequence
  Description of Artificial Sequence: Synthetic oligonucleotide
  Target: SCN10A; (+) strand; PAM type: YTN; PAM sequence: CTG
ttcctggggagggagacctg

SEQ ID NO: 67199 - DNA, 20 bp, Artificial Sequence
  Description of Artificial Sequence: Synthetic oligonucleotide
  Target: SCN10A; (+) strand; PAM type: YTN; PAM sequence: TTC
ctggggagggagacctgtac

SEQ ID NO: 67200 - DNA, 20 bp, Artificial Sequence
  Description of Artificial Sequence: Synthetic oligonucleotide
  Target: SCN10A; (+) strand; PAM type: YTN; PAM sequence: CTG
gggagggagacctgtacaaa

SEQ ID NO: 67201 - DNA, 20 bp, Artificial Sequence
  Description of Artificial Sequence: Synthetic oligonucleotide
  Target: SCN10A; (+) strand; PAM type: YTN; PAM sequence: CTG
tacaaaatgtgttatcctta

SEQ ID NO: 67202 - DNA, 20 bp, Artificial Sequence
  Description of Artificial Sequence: Synthetic oligonucleotide
  Target: SCN10A; (+) strand; PAM type: YTN; PAM sequence: TTA
tccttaccctctggttctgg

SEQ ID NO: 67203 - DNA, 20 bp, Artificial Sequence
  Description of Artificial Sequence: Synthetic oligonucleotide
  Target: SCN10A; (+) strand; PAM type: YTN; PAM sequence: CTT
accctctggttctggccagg

SEQ ID NO: 67204 - DNA, 20 bp, Artificial Sequence
  Description of Artificial Sequence: Synthetic oligonucleotide
  Target: SCN10A; (+) strand; PAM type: YTN; PAM sequence: TTA
ccctctggttctggccaggt

SEQ ID NO: 67205 - DNA, 20 bp, Artificial Sequence
  Description of Artificial Sequence: Synthetic oligonucleotide
  Target: SCN10A; (+) strand; PAM type: YTN; PAM sequence: CTC
tggttctggccaggtttggt

SEQ ID NO: 67206 - DNA, 20 bp, Artificial Sequence
  Description of Artificial Sequence: Synthetic oligonucleotide
  Target: SCN10A; (+) strand; PAM type: YTN; PAM sequence: CTG
gttctggccaggtttggtta

SEQ ID NO: 67207 - DNA, 20 bp, Artificial Sequence
  Description of Artificial Sequence: Synthetic oligonucleotide
  Target: SCN10A; (+) strand; PAM type: YTN; PAM sequence: TTC
tggccaggtttggttaatgg

SEQ ID NO: 67208 - DNA, 20 bp, Artificial Sequence
  Description of Artificial Sequence: Synthetic oligonucleotide
  Target: SCN10A; (+) strand; PAM type: YTN; PAM sequence: CTG
gccaggtttggttaatggga

SEQ ID NO: 67209 - DNA, 20 bp, Artificial Sequence
  Description of Artificial Sequence: Synthetic oligonucleotide
  Target: SCN10A; (+) strand; PAM type: YTN; PAM sequence: TTT
ggttaatgggagacataggc

SEQ ID NO: 67210 - DNA, 20 bp, Artificial Sequence
  Description of Artificial Sequence: Synthetic oligonucleotide
  Target: SCN10A; (+) strand; PAM type: YTN; PAM sequence: TTG
gttaatgggagacataggca

SEQ ID NO: 67211 - DNA, 20 bp, Artificial Sequence
  Description of Artificial Sequence: Synthetic oligonucleotide
  Target: SCN10A; (+) strand; PAM type: YTN; PAM sequence: TTA
atgggagacataggcaggac

SEQ ID NO: 67212 - DNA, 20 bp, Artificial Sequence
  Description of Artificial Sequence: Synthetic oligonucleotide
  Target: SCN10A; (+) strand; PAM type: YTN; PAM sequence: TTC
aaggatagaaggagagacaa

SEQ ID NO: 67213 - DNA, 20 bp, Artificial Sequence
  Description of Artificial Sequence: Synthetic oligonucleotide
  Target: SCN10A; (+) strand; PAM type: YTN; PAM sequence: TTT
tcccctggcttcttctctcc

SEQ ID NO: 67214 - DNA, 20 bp, Artificial Sequence
  Description of Artificial Sequence: Synthetic oligonucleotide
  Target: SCN10A; (+) strand; PAM type: YTN; PAM sequence: TTT
cccctggcttcttctctcct

SEQ ID NO: 67215 - DNA, 20 bp, Artificial Sequence
  Description of Artificial Sequence: Synthetic oligonucleotide
  Target: SCN10A; (+) strand; PAM type: YTN; PAM sequence: TTC
ccctggcttcttctctcctg

SEQ ID NO: 67216 - DNA, 20 bp, Artificial Sequence
  Description of Artificial Sequence: Synthetic oligonucleotide
  Target: SCN10A; (+) strand; PAM type: YTN; PAM sequence: CTG
gcttcttctctcctgtgcta

SEQ ID NO: 67217 - DNA, 20 bp, Artificial Sequence
  Description of Artificial Sequence: Synthetic oligonucleotide
  Target: SCN10A; (+) strand; PAM type: YTN; PAM sequence: CTT
cttctctcctgtgctatggc

SEQ ID NO: 67218 - DNA, 20 bp, Artificial Sequence
  Description of Artificial Sequence: Synthetic oligonucleotide
  Target: SCN10A; (+) strand; PAM type: YTN; PAM sequence: TTC
ttctctcctgtgctatggct

SEQ ID NO: 67219 - DNA, 20 bp, Artificial Sequence
  Description of Artificial Sequence: Synthetic oligonucleotide
  Target: SCN10A; (+) strand; PAM type: YTN; PAM sequence: CTT
ctctcctgtgctatggctga

SEQ ID NO: 67220 - DNA, 20 bp, Artificial Sequence
  Description of Artificial Sequence: Synthetic oligonucleotide
  Target: SCN10A; (+) strand; PAM type: YTN; PAM sequence: TTC
tctcctgtgctatggctgag

SEQ ID NO: 67221 - DNA, 20 bp, Artificial Sequence
  Description of Artificial Sequence: Synthetic oligonucleotide
  Target: SCN10A; (+) strand; PAM type: YTN; PAM sequence: CTC
tcctgtgctatggctgagta

SEQ ID NO: 67222 - DNA, 20 bp, Artificial Sequence
  Description of Artificial Sequence: Synthetic oligonucleotide
  Target: SCN10A; (+) strand; PAM type: YTN; PAM sequence: CTC
ctgtgctatggctgagtagc

SEQ ID NO: 67223 - DNA, 20 bp, Artificial Sequence
  Description of Artificial Sequence: Synthetic oligonucleotide
  Target: SCN10A; (+) strand; PAM type: YTN; PAM sequence: CTG
tgctatggctgagtagcaga

SEQ ID NO: 67224 - DNA, 20 bp, Artificial Sequence
  Description of Artificial Sequence: Synthetic oligonucleotide
  Target: SCN10A; (+) strand; PAM type: YTN; PAM sequence: CTA
tggctgagtagcagagctgt

SEQ ID NO: 67225 - DNA, 20 bp, Artificial Sequence
  Description of Artificial Sequence: Synthetic oligonucleotide
  Target: SCN10A; (+) strand; PAM type: YTN; PAM sequence: CTG
agtagcagagctgtgatcct

SEQ ID NO: 67226 - DNA, 20 bp, Artificial Sequence
  Description of Artificial Sequence: Synthetic oligonucleotide
  Target: SCN10A; (+) strand; PAM type: YTN; PAM sequence: CTG
tgatcctctactaagatcac

SEQ ID NO: 67227 - DNA, 20 bp, Artificial Sequence
  Description of Artificial Sequence: Synthetic oligonucleotide
  Target: SCN10A; (+) strand; PAM type: YTN; PAM sequence: CTC
tactaagatcacaagttctg

SEQ ID NO: 67228 - DNA, 20 bp, Artificial Sequence
  Description of Artificial Sequence: Synthetic oligonucleotide
  Target: SCN10A; (+) strand; PAM type: YTN; PAM sequence: CTA
ctaagatcacaagttctgcc

SEQ ID NO: 67229 - DNA, 20 bp, Artificial Sequence
  Description of Artificial Sequence: Synthetic oligonucleotide
  Target: SCN10A; (+) strand; PAM type: YTN; PAM sequence: CTA
agatcacaagttctgccagg

SEQ ID NO: 67230 - DNA, 20 bp, Artificial Sequence
  Description of Artificial Sequence: Synthetic oligonucleotide
  Target: SCN10A; (+) strand; PAM type: YTN; PAM sequence: TTC
tgccaggcagcctctctgac

SEQ ID NO: 67231 - DNA, 20 bp, Artificial Sequence
  Description of Artificial Sequence: Synthetic oligonucleotide
  Target: SCN10A; (+) strand; PAM type: YTN; PAM sequence: CTG
ccaggcagcctctctgacac

SEQ ID NO: 67232 - DNA, 20 bp, Artificial Sequence
  Description of Artificial Sequence: Synthetic oligonucleotide
  Target: SCN10A; (+) strand; PAM type: YTN; PAM sequence: CTC
tctgacacatgagggcagct

SEQ ID NO: 67233 - DNA, 20 bp, Artificial Sequence
  Description of Artificial Sequence: Synthetic oligonucleotide
  Target: SCN10A; (+) strand; PAM type: YTN; PAM sequence: CTC
tgacacatgagggcagctgc

SEQ ID NO: 67234 - DNA, 20 bp, Artificial Sequence
  Description of Artificial Sequence: Synthetic oligonucleotide
  Target: SCN10A; (+) strand; PAM type: YTN; PAM sequence: CTG
acacatgagggcagctgctg

SEQ ID NO: 67235 - DNA, 20 bp, Artificial Sequence
  Description of Artificial Sequence: Synthetic oligonucleotide
  Target: SCN10A; (+) strand; PAM type: YTN; PAM sequence: CTG
ctgctgtagtctaattctgg

SEQ ID NO: 67236 - DNA, 20 bp, Artificial Sequence
  Description of Artificial Sequence: Synthetic oligonucleotide
  Target: SCN10A; (+) strand; PAM type: YTN; PAM sequence: CTG
ctgtagtctaattctggtcc

SEQ ID NO: 67237 - DNA, 20 bp, Artificial Sequence
  Description of Artificial Sequence: Synthetic oligonucleotide
  Target: SCN10A; (+) strand; PAM type: YTN; PAM sequence: CTG
tagtctaattctggtccttt

SEQ ID NO: 67238 - DNA, 20 bp, Artificial Sequence
  Description of Artificial Sequence: Synthetic oligonucleotide
  Target: SCN10A; (+) strand; PAM type: YTN; PAM sequence: CTA
attctggtcctttccttcat

SEQ ID NO: 67239 - DNA, 20 bp, Artificial Sequence
  Description of Artificial Sequence: Synthetic oligonucleotide
  Target: SCN10A; (+) strand; PAM type: YTN; PAM sequence: TTC
tggtcctttccttcatccct

SEQ ID NO: 67240 - DNA, 20 bp, Artificial Sequence
  Description of Artificial Sequence: Synthetic oligonucleotide
  Target: SCN10A; (+) strand; PAM type: YTN; PAM sequence: CTG
gtcctttccttcatcccttc

SEQ ID NO: 67241 - DNA, 20 bp, Artificial Sequence
  Description of Artificial Sequence: Synthetic oligonucleotide
  Target: SCN10A; (+) strand; PAM type: YTN; PAM sequence: CTT
tccttcatcccttcagccta

SEQ ID NO: 67242 - DNA, 20 bp, Artificial Sequence
  Description of Artificial Sequence: Synthetic oligonucleotide
  Target: SCN10A; (+) strand; PAM type: YTN; PAM sequence: TTT
ccttcatcccttcagcctag

SEQ ID NO: 67243 - DNA, 20 bp, Artificial Sequence
  Description of Artificial Sequence: Synthetic oligonucleotide
  Target: SCN10A; (+) strand; PAM type: YTN; PAM sequence: TTC
cttcatcccttcagcctagg

SEQ ID NO: 67244 - DNA, 20 bp, Artificial Sequence
  Description of Artificial Sequence: Synthetic oligonucleotide
  Target: SCN10A; (+) strand; PAM type: YTN; PAM sequence: CTT
catcccttcagcctaggcat

SEQ ID NO: 67245 - DNA, 20 bp, Artificial Sequence
  Description of Artificial Sequence: Synthetic oligonucleotide
  Target: SCN10A; (+) strand; PAM type: YTN; PAM sequence: TTC
atcccttcagcctaggcatg

SEQ ID NO: 67246 - DNA, 20 bp, Artificial Sequence
  Description of Artificial Sequence: Synthetic oligonucleotide
  Target: SCN10A; (+) strand; PAM type: YTN; PAM sequence: CTT
cagcctaggcatgtaacagc

SEQ ID NO: 67247 - DNA, 20 bp, Artificial Sequence
  Description of Artificial Sequence: Synthetic oligonucleotide
  Target: SCN10A; (+) strand; PAM type: YTN; PAM sequence: TTC
agcctaggcatgtaacagct

SEQ ID NO: 67248 - DNA, 20 bp, Artificial Sequence
  Description of Artificial Sequence: Synthetic oligonucleotide
  Target: SCN10A; (+) strand; PAM type: YTN; PAM sequence: CTA
ggcatgtaacagcttccccc

SEQ ID NO: 67249 - DNA, 20 bp, Artificial Sequence
  Description of Artificial Sequence: Synthetic oligonucleotide
  Target: SCN10A; (+) strand; PAM type: YTN; PAM sequence: CTT
ccccctgttactagtttcta

SEQ ID NO: 67250 - DNA, 20 bp, Artificial Sequence
  Description of Artificial Sequence: Synthetic oligonucleotide
  Target: SCN10A; (+) strand; PAM type: YTN; PAM sequence: TTC
cccctgttactagtttctag

SEQ ID NO: 67251 - DNA, 20 bp, Artificial Sequence
  Description of Artificial Sequence: Synthetic oligonucleotide
  Target: SCN10A; (+) strand; PAM type: YTN; PAM sequence: CTG
ttactagtttctaggtgcct

SEQ ID NO: 67252 - DNA, 20 bp, Artificial Sequence
  Description of Artificial Sequence: Synthetic oligonucleotide
  Target: SCN10A; (+) strand; PAM type: YTN; PAM sequence: TTA
ctagtttctaggtgcctcac

SEQ ID NO: 67253 - DNA, 20 bp, Artificial Sequence
  Description of Artificial Sequence: Synthetic oligonucleotide
  Target: SCN10A; (+) strand; PAM type: YTN; PAM sequence: CTA
gtttctaggtgcctcactgt

SEQ ID NO: 67254 - DNA, 20 bp, Artificial Sequence
  Description of Artificial Sequence: Synthetic oligonucleotide
  Target: SCN10A; (+) strand; PAM type: YTN; PAM sequence: TTT
ctaggtgcctcactgtccct

SEQ ID NO: 67255 - DNA, 20 bp, Artificial Sequence
  Description of Artificial Sequence: Synthetic oligonucleotide
  Target: SCN10A; (+) strand; PAM type: YTN; PAM sequence: TTC
taggtgcctcactgtccctt

SEQ ID NO: 67256 - DNA, 20 bp, Artificial Sequence
  Description of Artificial Sequence: Synthetic oligonucleotide
  Target: SCN10A; (+) strand; PAM type: YTN; PAM sequence: CTA
ggtgcctcactgtcccttat

SEQ ID NO: 67257 - DNA, 20 bp, Artificial Sequence
  Description of Artificial Sequence: Synthetic oligonucleotide
  Target: SCN10A; (+) strand; PAM type: YTN; PAM sequence: CTC
actgtcccttattcattccc

SEQ ID NO: 67258 - DNA, 20 bp, Artificial Sequence
  Description of Artificial Sequence: Synthetic oligonucleotide
  Target: SCN10A; (+) strand; PAM type: YTN; PAM sequence: CTG
tcccttattcattccctaag

SEQ ID NO: 67259 - DNA, 20 bp, Artificial Sequence
  Description of Artificial Sequence: Synthetic oligonucleotide
  Target: SCN10A; (+) strand; PAM type: YTN; PAM sequence: CTT
attcattccctaagcccagc

SEQ ID NO: 67260 - DNA, 20 bp, Artificial Sequence
  Description of Artificial Sequence: Synthetic oligonucleotide
  Target: SCN10A; (+) strand; PAM type: YTN; PAM sequence: TTA
ttcattccctaagcccagcc

SEQ ID NO: 67261 - DNA, 20 bp, Artificial Sequence
  Description of Artificial Sequence: Synthetic oligonucleotide
  Target: SCN10A; (+) strand; PAM type: YTN; PAM sequence: TTC
attccctaagcccagcccac

SEQ ID NO: 67262 - DNA, 20 bp, Artificial Sequence
  Description of Artificial Sequence: Synthetic oligonucleotide
  Target: SCN10A; (+) strand; PAM type: YTN; PAM sequence: TTC
cctaagcccagcccacacct

SEQ ID NO: 67263 - DNA, 20 bp, Artificial Sequence
  Description of Artificial Sequence: Synthetic oligonucleotide
  Target: SCN10A; (+) strand; PAM type: YTN; PAM sequence: CTA
agcccagcccacacctctgt

SEQ ID NO: 67264 - DNA, 20 bp, Artificial Sequence
  Description of Artificial Sequence: Synthetic oligonucleotide
  Target: SCN10A; (+) strand; PAM type: YTN; PAM sequence: CTC
tgtaaatactttactaaact

SEQ ID NO: 67265 - DNA, 20 bp, Artificial Sequence
  Description of Artificial Sequence: Synthetic oligonucleotide
  Target: SCN10A; (+) strand; PAM type: YTN; PAM sequence: CTG
taaatactttactaaactct

SEQ ID NO: 67266 - DNA, 20 bp, Artificial Sequence
  Description of Artificial Sequence: Synthetic oligonucleotide
  Target: SCN10A; (+) strand; PAM type: YTN; PAM sequence: CTT
tactaaactctctctattag

SEQ ID NO: 67267 - DNA, 20 bp, Artificial Sequence
  Description of Artificial Sequence: Synthetic oligonucleotide
  Target: SCN10A; (+) strand; PAM type: YTN; PAM sequence: TTT
actaaactctctctattagc

SEQ ID NO: 67268 - DNA, 20 bp, Artificial Sequence
  Description of Artificial Sequence: Synthetic oligonucleotide
  Target: SCN10A; (+) strand; PAM type: YTN; PAM sequence: TTA
ctaaactctctctattagcc

SEQ ID NO: 67269 - DNA, 20 bp, Artificial Sequence
  Description of Artificial Sequence: Synthetic oligonucleotide
  Target: SCN10A; (+) strand; PAM type: YTN; PAM sequence: CTA
aactctctctattagcccat

SEQ ID NO: 67270 - DNA, 20 bp, Artificial Sequence
  Description of Artificial Sequence: Synthetic oligonucleotide
  Target: SCN10A; (+) strand; PAM type: YTN; PAM sequence: CTC
tctctattagcccatcggag

SEQ ID NO: 67271 - DNA, 20 bp, Artificial Sequence
  Description of Artificial Sequence: Synthetic oligonucleotide
  Target: SCN10A; (+) strand; PAM type: YTN; PAM sequence: CTC
tctattagcccatcggagtg

SEQ ID NO: 67272 - DNA, 20 bp, Artificial Sequence
  Description of Artificial Sequence: Synthetic oligonucleotide
  Target: SCN10A; (+) strand; PAM type: YTN; PAM sequence: CTC
tattagcccatcggagtggt

SEQ ID NO: 67273 - DNA, 20 bp, Artificial Sequence
  Description of Artificial Sequence: Synthetic oligonucleotide
  Target: SCN10A; (+) strand; PAM type: YTN; PAM sequence: CTA
ttagcccatcggagtggtcc

SEQ ID NO: 67274 - DNA, 20 bp, Artificial Sequence
  Description of Artificial Sequence: Synthetic oligonucleotide
  Target: SCN10A; (+) strand; PAM type: YTN; PAM sequence: TTA
gcccatcggagtggtccatc

SEQ ID NO: 67275 - DNA, 20 bp, Artificial Sequence
  Description of Artificial Sequence: Synthetic oligonucleotide
  Target: SCN10A; (+) strand; PAM type: YTN; PAM sequence: CTG
tttcttgctgggaccctgaa

SEQ ID NO: 67276 - DNA, 20 bp, Artificial Sequence
  Description of Artificial Sequence: Synthetic oligonucleotide
  Target: SCN10A; (+) strand; PAM type: YTN; PAM sequence: TTT
cttgctgggaccctgaatca

SEQ ID NO: 67277 - DNA, 20 bp, Artificial Sequence
  Description of Artificial Sequence: Synthetic oligonucleotide
  Target: SCN10A; (+) strand; PAM type: YTN; PAM sequence: TTC
ttgctgggaccctgaatcac

SEQ ID NO: 67278 - DNA, 20 bp, Artificial Sequence
  Description of Artificial Sequence: Synthetic oligonucleotide
  Target: SCN10A; (+) strand; PAM type: YTN; PAM sequence: CTT
gctgggaccctgaatcacat

SEQ ID NO: 67279 - DNA, 20 bp, Artificial Sequence
  Description of Artificial Sequence: Synthetic oligonucleotide
  Target: SCN10A; (+) strand; PAM type: YTN; PAM sequence: TTG
ctgggaccctgaatcacatg

SEQ ID NO: 67280 - DNA, 20 bp, Artificial Sequence
  Description of Artificial Sequence: Synthetic oligonucleotide
  Target: SCN10A; (+) strand; PAM type: YTN; PAM sequence: CTG
ggaccctgaatcacatgaca

SEQ ID NO: 67281 - DNA, 20 bp, Artificial Sequence
  Description of Artificial Sequence: Synthetic oligonucleotide
  Target: SCN10A; (+) strand; PAM type: YTN; PAM sequence: CTG
aatcacatgacattgagtca

SEQ ID NO: 67282 - DNA, 20 bp, Artificial Sequence
  Description of Artificial Sequence: Synthetic oligonucleotide
  Target: SCN10A; (+) strand; PAM type: YTN; PAM sequence: TTG
agtcagagactgagctaagg

SEQ ID NO: 67283 - DNA, 20 bp, Artificial Sequence
  Description of Artificial Sequence: Synthetic oligonucleotide
  Target: SCN10A; (+) strand; PAM type: YTN; PAM sequence: CTG
agctaaggcaactctaagac

SEQ ID NO: 67284 - DNA, 20 bp, Artificial Sequence
  Description of Artificial Sequence: Synthetic oligonucleotide
  Target: SCN10A; (+) strand; PAM type: YTN; PAM sequence: CTA
aggcaactctaagacttatc

SEQ ID NO: 67285 - DNA, 20 bp, Artificial Sequence
  Description of Artificial Sequence: Synthetic oligonucleotide
  Target: SCN10A; (+) strand; PAM type: YTN; PAM sequence: CTC
taagacttatctgtatcagt

SEQ ID NO: 67286 - DNA, 20 bp, Artificial Sequence
  Description of Artificial Sequence: Synthetic oligonucleotide
  Target: SCN10A; (+) strand; PAM type: YTN; PAM sequence: CTA
agacttatctgtatcagtgg

SEQ ID NO: 67287 - DNA, 20 bp, Artificial Sequence
  Description of Artificial Sequence: Synthetic oligonucleotide
  Target: SCN10A; (+) strand; PAM type: YTN; PAM sequence: CTT
atctgtatcagtggaaccat

SEQ ID NO: 67288 - DNA, 20 bp, Artificial Sequence
  Description of Artificial Sequence: Synthetic oligonucleotide
  Target: SCN10A; (+) strand; PAM type: YTN; PAM sequence: TTA
tctgtatcagtggaaccatt

SEQ ID NO: 67289 - DNA, 20 bp, Artificial Sequence
  Description of Artificial Sequence: Synthetic oligonucleotide
  Target: SCN10A; (+) strand; PAM type: YTN; PAM sequence: CTG
tatcagtggaaccatttatt

SEQ ID NO: 67290 - DNA, 20 bp, Artificial Sequence
  Description of Artificial Sequence: Synthetic oligonucleotide
  Target: SCN10A; (+) strand; PAM type: YTN; PAM sequence: TTT
attggtctctttacaattct

SEQ ID NO: 67291 - DNA, 20 bp, Artificial Sequence
  Description of Artificial Sequence: Synthetic oligonucleotide
  Target: SCN10A; (+) strand; PAM type: YTN; PAM sequence: TTA
ttggtctctttacaattctg

SEQ ID NO: 67292 - DNA, 20 bp, Artificial Sequence
  Description of Artificial Sequence: Synthetic oligonucleotide
  Target: SCN10A; (+) strand; PAM type: YTN; PAM sequence: TTG
gtctctttacaattctgtct

SEQ ID NO: 67293 - DNA, 20 bp, Artificial Sequence
  Description of Artificial Sequence: Synthetic oligonucleotide
  Target: SCN10A; (+) strand; PAM type: YTN; PAM sequence: CTC
tttacaattctgtctgcaat

SEQ ID NO: 67294 - DNA, 20 bp, Artificial Sequence
  Description of Artificial Sequence: Synthetic oligonucleotide
  Target: SCN10A; (+) strand; PAM type: YTN; PAM sequence: CTT
tacaattctgtctgcaattg

SEQ ID NO: 67295 - DNA, 20 bp, Artificial Sequence
  Description of Artificial Sequence: Synthetic oligonucleotide
  Target: SCN10A; (+) strand; PAM type: YTN; PAM sequence: TTT
acaattctgtctgcaattgc

SEQ ID NO: 67296 - DNA, 20 bp, Artificial Sequence
  Description of Artificial Sequence: Synthetic oligonucleotide
  Target: SCN10A; (+) strand; PAM type: YTN; PAM sequence: TTA
caattctgtctgcaattgcg

SEQ ID NO: 67297 - DNA, 20 bp, Artificial Sequence
  Description of Artificial Sequence: Synthetic oligonucleotide
  Target: SCN10A; (+) strand; PAM type: YTN; PAM sequence: TTC
tgtctgcaattgcgctgtat

SEQ ID NO: 67298 - DNA, 20 bp, Artificial Sequence
  Description of Artificial Sequence: Synthetic oligonucleotide
  Target: SCN10A; (+) strand; PAM type: YTN; PAM sequence: CTG
tctgcaattgcgctgtatcc

SEQ ID NO: 67299 - DNA, 20 bp, Artificial Sequence
  Description of Artificial Sequence: Synthetic oligonucleotide
  Target: SCN10A; (+) strand; PAM type: YTN; PAM sequence: CTG
caattgcgctgtatccctgg

SEQ ID NO: 67300 - DNA, 20 bp, Artificial Sequence
  Description of Artificial Sequence: Synthetic oligonucleotide
  Target: SCN10A; (+) strand; PAM type: YTN; PAM sequence: TTG
cgctgtatccctggctagcc

SEQ ID NO: 67301 - DNA, 20 bp, Artificial Sequence
  Description of Artificial Sequence: Synthetic oligonucleotide
  Target: SCN10A; (+) strand; PAM type: YTN; PAM sequence: CTG
tatccctggctagccagaga

SEQ ID NO: 67302 - DNA, 20 bp, Artificial Sequence
  Description of Artificial Sequence: Synthetic oligonucleotide
  Target: SCN10A; (+) strand; PAM type: YTN; PAM sequence: CTG
gctagccagagagggcaaat

SEQ ID NO: 67303 - DNA, 20 bp, Artificial Sequence
  Description of Artificial Sequence: Synthetic oligonucleotide
  Target: SCN10A; (+) strand; PAM type: YTN; PAM sequence: CTA
gccagagagggcaaatgaaa

SEQ ID NO: 67304 - DNA, 20 bp, Artificial Sequence
  Description of Artificial Sequence: Synthetic oligonucleotide
  Target: SCN10A; (+) strand; PAM type: YTN; PAM sequence: CTA
gaaacatcattgctgaaact

SEQ ID NO: 67305 - DNA, 20 bp, Artificial Sequence
  Description of Artificial Sequence: Synthetic oligonucleotide
  Target: SCN10A; (+) strand; PAM type: YTN; PAM sequence: TTG
ctgaaactggaggggagagc

SEQ ID NO: 67306 - DNA, 20 bp, Artificial Sequence
  Description of Artificial Sequence: Synthetic oligonucleotide
  Target: SCN10A; (+) strand; PAM type: YTN; PAM sequence: CTG
aaactggaggggagagctca

SEQ ID NO: 67307 - DNA, 20 bp, Artificial Sequence
  Description of Artificial Sequence: Synthetic oligonucleotide
  Target: SCN10A; (+) strand; PAM type: YTN; PAM sequence: CTG
gaggggagagctcacattaa

SEQ ID NO: 67308 - DNA, 20 bp, Artificial Sequence
  Description of Artificial Sequence: Synthetic oligonucleotide
  Target: SCN10A; (+) strand; PAM type: YTN; PAM sequence: CTC
acattaactcacagctccca

SEQ ID NO: 67309 - DNA, 20 bp, Artificial Sequence
  Description of Artificial Sequence: Synthetic oligonucleotide
  Target: SCN10A; (+) strand; PAM type: YTN; PAM sequence: TTA
actcacagctcccaatccaa

SEQ ID NO: 67310 - DNA, 20 bp, Artificial Sequence
  Description of Artificial Sequence: Synthetic oligonucleotide
  Target: SCN10A; (+) strand; PAM type: YTN; PAM sequence: CTC
acagctcccaatccaatgag

SEQ ID NO: 67311 - DNA, 20 bp, Artificial Sequence
  Description of Artificial Sequence: Synthetic oligonucleotide
  Target: SCN10A; (+) strand; PAM type: YTN; PAM sequence: CTC
ccaatccaatgaggaatccc

SEQ ID NO: 67312 - DNA, 20 bp, Artificial Sequence
  Description of Artificial Sequence: Synthetic oligonucleotide
  Target: SCN10A; (+) strand; PAM type: YTN; PAM sequence: CTG
acttgccattacactctgcg

SEQ ID NO: 67313 - DNA, 20 bp, Artificial Sequence
  Description of Artificial Sequence: Synthetic oligonucleotide
  Target: SCN10A; (+) strand; PAM type: YTN; PAM sequence: CTT
gccattacactctgcgatta

SEQ ID NO: 67314 - DNA, 20 bp, Artificial Sequence
  Description of Artificial Sequence: Synthetic oligonucleotide
  Target: SCN10A; (+) strand; PAM type: YTN; PAM sequence: TTG
ccattacactctgcgattat

SEQ ID NO: 67315 - DNA, 20 bp, Artificial Sequence
  Description of Artificial Sequence: Synthetic oligonucleotide
  Target: SCN10A; (+) strand; PAM type: YTN; PAM sequence: TTA
cactctgcgattattctatt

SEQ ID NO: 67316 - DNA, 20 bp, Artificial Sequence
  Description of Artificial Sequence: Synthetic oligonucleotide
  Target: SCN10A; (+) strand; PAM type: YTN; PAM sequence: CTC
tgcgattattctattaaaga

SEQ ID NO: 67317 - DNA, 20 bp, Artificial Sequence
  Description of Artificial Sequence: Synthetic oligonucleotide
  Target: SCN10A; (+) strand; PAM type: YTN; PAM sequence: CTG
cgattattctattaaagagt

SEQ ID NO: 67318 - DNA, 20 bp, Artificial Sequence
  Description of Artificial Sequence: Synthetic oligonucleotide
  Target: SCN10A; (+) strand; PAM type: YTN; PAM sequence: TTA
ttctattaaagagtgctggc

SEQ ID NO: 67319 - DNA, 20 bp, Artificial Sequence
  Description of Artificial Sequence: Synthetic oligonucleotide
  Target: SCN10A; (+) strand; PAM type: YTN; PAM sequence: TTC
tattaaagagtgctggccag

SEQ ID NO: 67320 - DNA, 20 bp, Artificial Sequence
  Description of Artificial Sequence: Synthetic oligonucleotide
  Target: SCN10A; (+) strand; PAM type: YTN; PAM sequence: CTA
ttaaagagtgctggccagtt

SEQ ID NO: 67321 - DNA, 20 bp, Artificial Sequence
  Description of Artificial Sequence: Synthetic oligonucleotide
  Target: SCN10A; (+) strand; PAM type: YTN; PAM sequence: TTA
aagagtgctggccagttagt

SEQ ID NO: 67322 - DNA, 20 bp, Artificial Sequence
  Description of Artificial Sequence: Synthetic oligonucleotide
  Target: SCN10A; (+) strand; PAM type: YTN; PAM sequence: CTG
gccagttagtcactgttgcc

SEQ ID NO: 67323 - DNA, 20 bp, Artificial Sequence
  Description of Artificial Sequence: Synthetic oligonucleotide
  Target: SCN10A; (+) strand; PAM type: YTN; PAM sequence: TTA
gtcactgttgcctaatttgc

SEQ ID NO: 67324 - DNA, 20 bp, Artificial Sequence
  Description of Artificial Sequence: Synthetic oligonucleotide
  Target: SCN10A; (+) strand; PAM type: YTN; PAM sequence: CTG
ttgcctaatttgctcatttt

SEQ ID NO: 67325 - DNA, 20 bp, Artificial Sequence
  Description of Artificial Sequence: Synthetic oligonucleotide
  Target: SCN10A; (+) strand; PAM type: YTN; PAM sequence: TTG
cctaatttgctcattttggc

SEQ ID NO: 67326 - DNA, 20 bp, Artificial Sequence
  Description of Artificial Sequence: Synthetic oligonucleotide
  Target: SCN10A; (+) strand; PAM type: YTN; PAM sequence: CTA
atttgctcattttggcaaat

SEQ ID NO: 67327 - DNA, 20 bp, Artificial Sequence
  Description of Artificial Sequence: Synthetic oligonucleotide
  Target: SCN10A; (+) strand; PAM type: YTN; PAM sequence: TTT
gctcattttggcaaattatt

SEQ ID NO: 67328 - DNA, 20 bp, Artificial Sequence
  Description of Artificial Sequence: Synthetic oligonucleotide
  Target: SCN10A; (+) strand; PAM type: YTN; PAM sequence: TTG
ctcattttggcaaattattt

SEQ ID NO: 67329 - DNA, 20 bp, Artificial Sequence
  Description of Artificial Sequence: Synthetic oligonucleotide
  Target: SCN10A; (+) strand; PAM type: YTN; PAM sequence: CTC
attttggcaaattatttctt

SEQ ID NO: 67330 - DNA, 20 bp, Artificial Sequence
  Description of Artificial Sequence: Synthetic oligonucleotide
  Target: SCN10A; (+) strand; PAM type: YTN; PAM sequence: TTT
tggcaaattatttcttctgt

SEQ ID NO: 67331 - DNA, 20 bp, Artificial Sequence
  Description of Artificial Sequence: Synthetic oligonucleotide
  Target: SCN10A; (+) strand; PAM type: YTN; PAM sequence: TTT
ggcaaattatttcttctgtg

SEQ ID NO: 67332 - DNA, 20 bp, Artificial Sequence
  Description of Artificial Sequence: Synthetic oligonucleotide
  Target: SCN10A; (+) strand; PAM type: YTN; PAM sequence: TTG
gcaaattatttcttctgtga

SEQ ID NO: 67333 - DNA, 20 bp, Artificial Sequence
  Description of Artificial Sequence: Synthetic oligonucleotide
  Target: SCN10A; (+) strand; PAM type: YTN; PAM sequence: TTA
tttcttctgtgagtaaagca

SEQ ID NO: 67334 - DNA, 20 bp, Artificial Sequence
  Description of Artificial Sequence: Synthetic oligonucleotide
  Target: SCN10A; (+) strand; PAM type: YTN; PAM sequence: TTT
cttctgtgagtaaagcaagg

SEQ ID NO: 67335 - DNA, 20 bp, Artificial Sequence
  Description of Artificial Sequence: Synthetic oligonucleotide
  Target: SCN10A; (+) strand; PAM type: YTN; PAM sequence: TTC
ttctgtgagtaaagcaagga

SEQ ID NO: 67336 - DNA, 20 bp, Artificial Sequence
  Description of Artificial Sequence: Synthetic oligonucleotide
  Target: SCN10A; (+) strand; PAM type: YTN; PAM sequence: CTT
ctgtgagtaaagcaaggaat

SEQ ID NO: 67337 - DNA, 20 bp, Artificial Sequence
  Description of Artificial Sequence: Synthetic oligonucleotide
  Target: SCN10A; (+) strand; PAM type: YTN; PAM sequence: TTC
tgtgagtaaagcaaggaata

SEQ ID NO: 67338 - DNA, 20 bp, Artificial Sequence
  Description of Artificial Sequence: Synthetic oligonucleotide
  Target: SCN10A; (+) strand; PAM type: YTN; PAM sequence: CTG
tgagtaaagcaaggaatact

SEQ ID NO: 67339 - DNA, 20 bp, Artificial Sequence
  Description of Artificial Sequence: Synthetic oligonucleotide
  Target: SCN10A; (+) strand; PAM type: YTN; PAM sequence: CTG
tgcttctattcagatctgtc

SEQ ID NO: 67340 - DNA, 20 bp, Artificial Sequence
  Description of Artificial Sequence: Synthetic oligonucleotide
  Target: SCN10A; (+) strand; PAM type: YTN; PAM sequence: CTT
ctattcagatctgtcctaag

SEQ ID NO: 67341 - DNA, 20 bp, Artificial Sequence
  Description of Artificial Sequence: Synthetic oligonucleotide
  Target: SCN10A; (+) strand; PAM type: YTN; PAM sequence: TTC
tattcagatctgtcctaaga

SEQ ID NO: 67342 - DNA, 20 bp, Artificial Sequence
  Description of Artificial Sequence: Synthetic oligonucleotide
  Target: SCN10A; (+) strand; PAM type: YTN; PAM sequence: CTA
ttcagatctgtcctaagaaa

SEQ ID NO: 67343 - DNA, 20 bp, Artificial Sequence
  Description of Artificial Sequence: Synthetic oligonucleotide
  Target: SCN10A; (+) strand; PAM type: YTN; PAM sequence: TTC
agatctgtcctaagaaactt

SEQ ID NO: 67344 - DNA, 20 bp, Artificial Sequence
  Description of Artificial Sequence: Synthetic oligonucleotide
  Target: SCN10A; (+) strand; PAM type: YTN; PAM sequence: CTG
tcctaagaaacttcctgaat

SEQ ID NO: 67345 - DNA, 20 bp, Artificial Sequence
  Description of Artificial Sequence: Synthetic oligonucleotide
  Target: SCN10A; (+) strand; PAM type: YTN; PAM sequence: CTA
agaaacttcctgaatttctc

SEQ ID NO: 67346 - DNA, 20 bp, Artificial Sequence
  Description of Artificial Sequence: Synthetic oligonucleotide
  Target: SCN10A; (+) strand; PAM type: YTN; PAM sequence: CTT
cctgaatttctctgggtgcc

SEQ ID NO: 67347 - DNA, 20 bp, Artificial Sequence
  Description of Artificial Sequence: Synthetic oligonucleotide
  Target: SCN10A; (+) strand; PAM type: YTN; PAM sequence: TTC
ctgaatttctctgggtgcca

SEQ ID NO: 67348 - DNA, 20 bp, Artificial Sequence
  Description of Artificial Sequence: Synthetic oligonucleotide
  Target: SCN10A; (+) strand; PAM type: YTN; PAM sequence: CTG
aatttctctgggtgccattt

SEQ ID NO: 67349 - DNA, 20 bp, Artificial Sequence
  Description of Artificial Sequence: Synthetic oligonucleotide
  Target: SCN10A; (+) strand; PAM type: YTN; PAM sequence: TTT
ctctgggtgccatttgccca

SEQ ID NO: 67350 - DNA, 20 bp, Artificial Sequence
  Description of Artificial Sequence: Synthetic oligonucleotide
  Target: SCN10A; (+) strand; PAM type: YTN; PAM sequence: TTC
tctgggtgccatttgcccag

SEQ ID NO: 67351 - DNA, 20 bp, Artificial Sequence
  Description of Artificial Sequence: Synthetic oligonucleotide
  Target: SCN10A; (+) strand; PAM type: YTN; PAM sequence: CTC
tgggtgccatttgcccagcc

SEQ ID NO: 67352 - DNA, 20 bp, Artificial Sequence
  Description of Artificial Sequence: Synthetic oligonucleotide
  Target: SCN10A; (+) strand; PAM type: YTN; PAM sequence: CTG
ggtgccatttgcccagccta

SEQ ID NO: 67353 - DNA, 20 bp, Artificial Sequence
  Description of Artificial Sequence: Synthetic oligonucleotide
  Target: SCN10A; (+) strand; PAM type: YTN; PAM sequence: TTT
gcccagcctagaagagtttg

SEQ ID NO: 67354 - DNA, 20 bp, Artificial Sequence
  Description of Artificial Sequence: Synthetic oligonucleotide
  Target: SCN10A; (+) strand; PAM type: YTN; PAM sequence: TTG
cccagcctagaagagtttgc

SEQ ID NO: 67355 - DNA, 20 bp, Artificial Sequence
  Description of Artificial Sequence: Synthetic oligonucleotide
  Target: SCN10A; (+) strand; PAM type: YTN; PAM sequence: CTA
gaagagtttgcatagagcca

SEQ ID NO: 67356 - DNA, 20 bp, Artificial Sequence
  Description of Artificial Sequence: Synthetic oligonucleotide
  Target: SCN10A; (+) strand; PAM type: YTN; PAM sequence: TTT
gcatagagccataagcagga

SEQ ID NO: 67357 - DNA, 20 bp, Artificial Sequence
  Description of Artificial Sequence: Synthetic oligonucleotide
  Target: SCN10A; (+) strand; PAM type: YTN; PAM sequence: TTG
catagagccataagcaggaa

SEQ ID NO: 67358 - DNA, 20 bp, Artificial Sequence
  Description of Artificial Sequence: Synthetic oligonucleotide
  Target: SCN10A; (+) strand; PAM type: YTN; PAM sequence: CTT
cagtttttctcatacctgtc

SEQ ID NO: 67359 - DNA, 20 bp, Artificial Sequence
  Description of Artificial Sequence: Synthetic oligonucleotide
  Target: SCN10A; (+) strand; PAM type: YTN; PAM sequence: TTC
agtttttctcatacctgtcc

SEQ ID NO: 67360 - DNA, 20 bp, Artificial Sequence
  Description of Artificial Sequence: Synthetic oligonucleotide
  Target: SCN10A; (+) strand; PAM type: YTN; PAM sequence: TTT
ttctcatacctgtccaacaa

SEQ ID NO: 67361 - DNA, 20 bp, Artificial Sequence
  Description of Artificial Sequence: Synthetic oligonucleotide
  Target: SCN10A; (+) strand; PAM type: YTN; PAM sequence: TTT
tctcatacctgtccaacaag

SEQ ID NO: 67362 - DNA, 20 bp, Artificial Sequence
  Description of Artificial Sequence: Synthetic oligonucleotide
  Target: SCN10A; (+) strand; PAM type: YTN; PAM sequence: TTT
ctcatacctgtccaacaaga

SEQ ID NO: 67363 - DNA, 20 bp, Artificial Sequence
  Description of Artificial Sequence: Synthetic oligonucleotide
  Target: SCN10A; (+) strand; PAM type: YTN; PAM sequence: TTC
tcatacctgtccaacaagaa

SEQ ID NO: 67364 - DNA, 20 bp, Artificial Sequence
  Description of Artificial Sequence: Synthetic oligonucleotide
  Target: SCN10A; (+) strand; PAM type: YTN; PAM sequence: CTC
atacctgtccaacaagaaag

SEQ ID NO: 67365 - DNA, 20 bp, Artificial Sequence
  Description of Artificial Sequence: Synthetic oligonucleotide
  Target: SCN10A; (+) strand; PAM type: YTN; PAM sequence: CTG
tccaacaagaaagcaggcct

SEQ ID NO: 67366 - DNA, 20 bp, Artificial Sequence
  Description of Artificial Sequence: Synthetic oligonucleotide
  Target: SCN10A; (+) strand; PAM type: YTN; PAM sequence: CTA
tcactgaggcagtgatgttg

SEQ ID NO: 67367 - DNA, 20 bp, Artificial Sequence
  Description of Artificial Sequence: Synthetic oligonucleotide
  Target: SCN10A; (+) strand; PAM type: YTN; PAM sequence: CTG
aggcagtgatgttgagtggg

SEQ ID NO: 67368 - DNA, 20 bp, Artificial Sequence
  Description of Artificial Sequence: Synthetic oligonucleotide
  Target: SCN10A; (+) strand; PAM type: YTN; PAM sequence: TTG
agtggggacagagaagcact

SEQ ID NO: 67369 - DNA, 20 bp, Artificial Sequence
  Description of Artificial Sequence: Synthetic oligonucleotide
  Target: SCN10A; (+) strand; PAM type: YTN; PAM sequence: CTG
ataagaaatatggggtcaaa

SEQ ID NO: 67370 - DNA, 20 bp, Artificial Sequence
  Description of Artificial Sequence: Synthetic oligonucleotide
  Target: SCN10A; (+) strand; PAM type: YTN; PAM sequence: TTT
gcatcactactgcagaataa

SEQ ID NO: 67371 - DNA, 20 bp, Artificial Sequence
  Description of Artificial Sequence: Synthetic oligonucleotide
  Target: SCN10A; (+) strand; PAM type: YTN; PAM sequence: TTG
catcactactgcagaataaa

SEQ ID NO: 67372 - DNA, 20 bp, Artificial Sequence
  Description of Artificial Sequence: Synthetic oligonucleotide
  Target: SCN10A; (+) strand; PAM type: YTN; PAM sequence: CTA
ctgcagaataaaccaggaaa

SEQ ID NO: 67373 - DNA, 20 bp, Artificial Sequence
  Description of Artificial Sequence: Synthetic oligonucleotide
  Target: SCN10A; (+) strand; PAM type: YTN; PAM sequence: CTG
cagaataaaccaggaaacct

SEQ ID NO: 67374 - DNA, 20 bp, Artificial Sequence
  Description of Artificial Sequence: Synthetic oligonucleotide
  Target: SCN10A; (+) strand; PAM type: YTN; PAM sequence: CTG
tttgacctcaggccaactca

SEQ ID NO: 67375 - DNA, 20 bp, Artificial Sequence
  Description of Artificial Sequence: Synthetic oligonucleotide
  Target: SCN10A; (+) strand; PAM type: YTN; PAM sequence: TTT
gacctcaggccaactcaatc

SEQ ID NO: 67376 - DNA, 20 bp, Artificial Sequence
  Description of Artificial Sequence: Synthetic oligonucleotide
  Target: SCN10A; (+) strand; PAM type: YTN; PAM sequence: TTG
acctcaggccaactcaatct

SEQ ID NO: 67377 - DNA, 20 bp, Artificial Sequence
  Description of Artificial Sequence: Synthetic oligonucleotide
  Target: SCN10A; (+) strand; PAM type: YTN; PAM sequence: CTC
aggccaactcaatctctctc

SEQ ID NO: 67378 - DNA, 20 bp, Artificial Sequence
  Description of Artificial Sequence: Synthetic oligonucleotide
  Target: SCN10A; (+) strand; PAM type: YTN; PAM sequence: CTC
aatctctctctctctctggg

SEQ ID NO: 67379 - DNA, 20 bp, Artificial Sequence
  Description of Artificial Sequence: Synthetic oligonucleotide
  Target: SCN10A; (+) strand; PAM type: YTN; PAM sequence: CTC
tctctctctctgggtctcat

SEQ ID NO: 67380 - DNA, 20 bp, Artificial Sequence
  Description of Artificial Sequence: Synthetic oligonucleotide
  Target: SCN10A; (+) strand; PAM type: YTN; PAM sequence: CTC
tctctctctgggtctcatct

SEQ ID NO: 67381 - DNA, 20 bp, Artificial Sequence
  Description of Artificial Sequence: Synthetic oligonucleotide
  Target: SCN10A; (+) strand; PAM type: YTN; PAM sequence: CTC
tctctctgggtctcatcttc

SEQ ID NO: 67382 - DNA, 20 bp, Artificial Sequence
  Description of Artificial Sequence: Synthetic oligonucleotide
  Target: SCN10A; (+) strand; PAM type: YTN; PAM sequence: CTC
tctctgggtctcatcttcta

SEQ ID NO: 67383 - DNA, 20 bp, Artificial Sequence
  Description of Artificial Sequence: Synthetic oligonucleotide
  Target: SCN10A; (+) strand; PAM type: YTN; PAM sequence: CTC
tctgggtctcatcttctatg

SEQ ID NO: 67384 - DNA, 20 bp, Artificial Sequence
  Description of Artificial Sequence: Synthetic oligonucleotide
  Target: SCN10A; (+) strand; PAM type: YTN; PAM sequence: CTC
tgggtctcatcttctatgtc

SEQ ID NO: 67385 - DNA, 20 bp, Artificial Sequence
  Description of Artificial Sequence: Synthetic oligonucleotide
  Target: SCN10A; (+) strand; PAM type: YTN; PAM sequence: CTG
ggtctcatcttctatgtctg

SEQ ID NO: 67386 - DNA, 20 bp, Artificial Sequence
  Description of Artificial Sequence: Synthetic oligonucleotide
  Target: SCN10A; (+) strand; PAM type: YTN; PAM sequence: CTC
atcttctatgtctgtaaaaa

SEQ ID NO: 67387 - DNA, 20 bp, Artificial Sequence
  Description of Artificial Sequence: Synthetic oligonucleotide
  Target: SCN10A; (+) strand; PAM type: YTN; PAM sequence: CTT
ctatgtctgtaaaaaaggag

SEQ ID NO: 67388 - DNA, 20 bp, Artificial Sequence
  Description of Artificial Sequence: Synthetic oligonucleotide
  Target: SCN10A; (+) strand; PAM type: YTN; PAM sequence: TTC
tatgtctgtaaaaaaggagt

SEQ ID NO: 67389 - DNA, 20 bp, Artificial Sequence
  Description of Artificial Sequence: Synthetic oligonucleotide
  Target: SCN10A; (+) strand; PAM type: YTN; PAM sequence: CTA
tgtctgtaaaaaaggagtag

SEQ ID NO: 67390 - DNA, 20 bp, Artificial Sequence
  Description of Artificial Sequence: Synthetic oligonucleotide
  Target: SCN10A; (+) strand; PAM type: YTN; PAM sequence: CTG
taaaaaaggagtagaatggg

SEQ ID NO: 67391 - DNA, 20 bp, Artificial Sequence
  Description of Artificial Sequence: Synthetic oligonucleotide
  Target: SCN10A; (+) strand; PAM type: YTN; PAM sequence: TTG
gacaggatgatggctaaaga

SEQ ID NO: 67392 - DNA, 20 bp, Artificial Sequence
  Description of Artificial Sequence: Synthetic oligonucleotide
  Target: SCN10A; (+) strand; PAM type: YTN; PAM sequence: CTA
aagatcccttccattggtga

SEQ ID NO: 67393 - DNA, 20 bp, Artificial Sequence
  Description of Artificial Sequence: Synthetic oligonucleotide
  Target: SCN10A; (+) strand; PAM type: YTN; PAM sequence: CTT
ccattggtgatactcaggct

SEQ ID NO: 67394 - DNA, 20 bp, Artificial Sequence
  Description of Artificial Sequence: Synthetic oligonucleotide
  Target: SCN10A; (+) strand; PAM type: YTN; PAM sequence: TTC
cattggtgatactcaggctt

SEQ ID NO: 67395 - DNA, 20 bp, Artificial Sequence
  Description of Artificial Sequence: Synthetic oligonucleotide
  Target: SCN10A; (+) strand; PAM type: YTN; PAM sequence: TTG
gtgatactcaggcttcttgg

SEQ ID NO: 67396 - DNA, 20 bp, Artificial Sequence
  Description of Artificial Sequence: Synthetic oligonucleotide
  Target: SCN10A; (+) strand; PAM type: YTN; PAM sequence: CTC
aggcttcttggctcaaggct

SEQ ID NO: 67397 - DNA, 20 bp, Artificial Sequence
  Description of Artificial Sequence: Synthetic oligonucleotide
  Target: SCN10A; (+) strand; PAM type: YTN; PAM sequence: CTT
cttggctcaaggcttctagg

SEQ ID NO: 67398 - DNA, 20 bp, Artificial Sequence
  Description of Artificial Sequence: Synthetic oligonucleotide
  Target: SCN10A; (+) strand; PAM type: YTN; PAM sequence: TTC
ttggctcaaggcttctaggt

SEQ ID NO: 67399 - DNA, 20 bp, Artificial Sequence
  Description of Artificial Sequence: Synthetic oligonucleotide
  Target: SCN10A; (+) strand; PAM type: YTN; PAM sequence: CTT
ggctcaaggcttctaggtgg

SEQ ID NO: 67400 - DNA, 20 bp, Artificial Sequence
  Description of Artificial Sequence: Synthetic oligonucleotide
  Target: SCN10A; (+) strand; PAM type: YTN; PAM sequence: TTG
gctcaaggcttctaggtgga

SEQ ID NO: 67401 - DNA, 20 bp, Artificial Sequence
  Description of Artificial Sequence: Synthetic oligonucleotide
  Target: SCN10A; (+) strand; PAM type: YTN; PAM sequence: CTC
aaggcttctaggtggaagac

SEQ ID NO: 67402 - DNA, 20 bp, Artificial Sequence
  Description of Artificial Sequence: Synthetic oligonucleotide
  Target: SCN10A; (+) strand; PAM type: YTN; PAM sequence: CTT
ctaggtggaagacagcctga

SEQ ID NO: 67403 - DNA, 20 bp, Artificial Sequence
  Description of Artificial Sequence: Synthetic oligonucleotide
  Target: SCN10A; (+) strand; PAM type: YTN; PAM sequence: TTC
taggtggaagacagcctgag

SEQ ID NO: 67404 - DNA, 20 bp, Artificial Sequence
  Description of Artificial Sequence: Synthetic oligonucleotide
  Target: SCN10A; (+) strand; PAM type: YTN; PAM sequence: CTA
ggtggaagacagcctgaggg

SEQ ID NO: 67405 - DNA, 20 bp, Artificial Sequence
  Description of Artificial Sequence: Synthetic oligonucleotide
  Target: SCN10A; (+) strand; PAM type: YTN; PAM sequence: CTG
agggagtctgaagcattcac

SEQ ID NO: 67406 - DNA, 20 bp, Artificial Sequence
  Description of Artificial Sequence: Synthetic oligonucleotide
  Target: SCN10A; (+) strand; PAM type: YTN; PAM sequence: CTG
aagcattcacaaactcaccg

SEQ ID NO: 67407 - DNA, 20 bp, Artificial Sequence
  Description of Artificial Sequence: Synthetic oligonucleotide
  Target: SCN10A; (+) strand; PAM type: YTN; PAM sequence: TTC
acaaactcaccgagacatcg

SEQ ID NO: 67408 - DNA, 20 bp, Artificial Sequence
  Description of Artificial Sequence: Synthetic oligonucleotide
  Target: SCN10A; (+) strand; PAM type: YTN; PAM sequence: CTC
accgagacatcgacagctcc

SEQ ID NO: 67409 - DNA, 20 bp, Artificial Sequence
  Description of Artificial Sequence: Synthetic oligonucleotide
  Target: SCN10A; (+) strand; PAM type: YTN; PAM sequence: CTC
caggggcaagctcactagtg

SEQ ID NO: 67410 - DNA, 20 bp, Artificial Sequence
  Description of Artificial Sequence: Synthetic oligonucleotide
  Target: SCN10A; (+) strand; PAM type: YTN; PAM sequence: CTC
actagtgggcggcggttggt

SEQ ID NO: 67411 - DNA, 20 bp, Artificial Sequence
  Description of Artificial Sequence: Synthetic oligonucleotide
  Target: SCN10A; (+) strand; PAM type: YTN; PAM sequence: CTA
gtgggcggcggttggtgttc

SEQ ID NO: 67412 - DNA, 20 bp, Artificial Sequence
  Description of Artificial Sequence: Synthetic oligonucleotide
  Target: SCN10A; (+) strand; PAM type: YTN; PAM sequence: TTG
gtgttcatcttctccatgcc

SEQ ID NO: 67413 - DNA, 20 bp, Artificial Sequence
  Description of Artificial Sequence: Synthetic oligonucleotide
  Target: SCN10A; (+) strand; PAM type: YTN; PAM sequence: TTC
atcttctccatgcctggagt

SEQ ID NO: 67414 - DNA, 20 bp, Artificial Sequence
  Description of Artificial Sequence: Synthetic oligonucleotide
  Target: SCN10A; (+) strand; PAM type: YTN; PAM sequence: CTT
ctccatgcctggagtcaggg

SEQ ID NO: 67415 - DNA, 20 bp, Artificial Sequence
  Description of Artificial Sequence: Synthetic oligonucleotide
  Target: SCN10A; (+) strand; PAM type: YTN; PAM sequence: TTC
tccatgcctggagtcagggt

SEQ ID NO: 67416 - DNA, 20 bp, Artificial Sequence
  Description of Artificial Sequence: Synthetic oligonucleotide
  Target: SCN10A; (+) strand; PAM type: YTN; PAM sequence: CTC
catgcctggagtcagggttg

SEQ ID NO: 67417 - DNA, 20 bp, Artificial Sequence
  Description of Artificial Sequence: Synthetic oligonucleotide
  Target: SCN10A; (+) strand; PAM type: YTN; PAM sequence: CTG
gagtcagggttgctgggttg

SEQ ID NO: 67418 - DNA, 20 bp, Artificial Sequence
  Description of Artificial Sequence: Synthetic oligonucleotide
  Target: SCN10A; (+) strand; PAM type: YTN; PAM sequence: TTG
ctgggttgaggaagagggct

SEQ ID NO: 67419 - DNA, 20 bp, Artificial Sequence
  Description of Artificial Sequence: Synthetic oligonucleotide
  Target: SCN10A; (+) strand; PAM type: YTN; PAM sequence: CTG
ggttgaggaagagggcttct

SEQ ID NO: 67420 - DNA, 20 bp, Artificial Sequence
  Description of Artificial Sequence: Synthetic oligonucleotide
  Target: SCN10A; (+) strand; PAM type: YTN; PAM sequence: TTG
aggaagagggcttctaggga

SEQ ID NO: 67421 - DNA, 20 bp, Artificial Sequence
  Description of Artificial Sequence: Synthetic oligonucleotide
  Target: SCN10A; (+) strand; PAM type: YTN; PAM sequence: CTT
ctagggagggggccttgctg

SEQ ID NO: 67422 - DNA, 20 bp, Artificial Sequence
  Description of Artificial Sequence: Synthetic oligonucleotide
  Target: SCN10A; (+) strand; PAM type: YTN; PAM sequence: TTC
tagggagggggccttgctgg

SEQ ID NO: 67423 - DNA, 20 bp, Artificial Sequence
  Description of Artificial Sequence: Synthetic oligonucleotide
  Target: SCN10A; (+) strand; PAM type: YTN; PAM sequence: CTA
gggagggggccttgctggcc

SEQ ID NO: 67424 - DNA, 20 bp, Artificial Sequence
  Description of Artificial Sequence: Synthetic oligonucleotide
  Target: SCN10A; (+) strand; PAM type: YTN; PAM sequence: CTT
gctggccagcacccccaccc

SEQ ID NO: 67425 - DNA, 20 bp, Artificial Sequence
  Description of Artificial Sequence: Synthetic oligonucleotide
  Target: SCN10A; (+) strand; PAM type: YTN; PAM sequence: TTG
ctggccagcacccccaccca

SEQ ID NO: 67426 - DNA, 20 bp, Artificial Sequence
  Description of Artificial Sequence: Synthetic oligonucleotide
  Target: SCN10A; (+) strand; PAM type: YTN; PAM sequence: CTG
gccagcacccccacccagca

SEQ ID NO: 67427 - DNA, 20 bp, Artificial Sequence
  Description of Artificial Sequence: Synthetic oligonucleotide
  Target: SCN10A; (+) strand; PAM type: YTN; PAM sequence: CTT
tcgtggtctccaggaaagac

SEQ ID NO: 67428 - DNA, 20 bp, Artificial Sequence
  Description of Artificial Sequence: Synthetic oligonucleotide
  Target: SCN10A; (+) strand; PAM type: YTN; PAM sequence: TTT
cgtggtctccaggaaagact

SEQ ID NO: 67429 - DNA, 20 bp, Artificial Sequence
  Description of Artificial Sequence: Synthetic oligonucleotide
  Target: SCN10A; (+) strand; PAM type: YTN; PAM sequence: TTC
gtggtctccaggaaagactc

SEQ ID NO: 67430 - DNA, 20 bp, Artificial Sequence
  Description of Artificial Sequence: Synthetic oligonucleotide
  Target: SCN10A; (+) strand; PAM type: YTN; PAM sequence: CTC
caggaaagactccatcatct

SEQ ID NO: 67431 - DNA, 20 bp, Artificial Sequence
  Description of Artificial Sequence: Synthetic oligonucleotide
  Target: SCN10A; (+) strand; PAM type: YTN; PAM sequence: CTC
catcatctgtgactccctca

SEQ ID NO: 67432 - DNA, 20 bp, Artificial Sequence
  Description of Artificial Sequence: Synthetic oligonucleotide
  Target: SCN10A; (+) strand; PAM type: YTN; PAM sequence: CTG
tgactccctcagggagtgag

SEQ ID NO: 67433 - DNA, 20 bp, Artificial Sequence
  Description of Artificial Sequence: Synthetic oligonucleotide
  Target: SCN10A; (+) strand; PAM type: YTN; PAM sequence: CTC
cctcagggagtgagatatct

SEQ ID NO: 67434 - DNA, 20 bp, Artificial Sequence
  Description of Artificial Sequence: Synthetic oligonucleotide
  Target: SCN10A; (+) strand; PAM type: YTN; PAM sequence: CTC
agggagtgagatatctcggc

SEQ ID NO: 67435 - DNA, 20 bp, Artificial Sequence
  Description of Artificial Sequence: Synthetic oligonucleotide
  Target: SCN10A; (+) strand; PAM type: YTN; PAM sequence: CTC
ggccaggggaccggaaatgg

SEQ ID NO: 67436 - DNA, 20 bp, Artificial Sequence
  Description of Artificial Sequence: Synthetic oligonucleotide
  Target: SCN10A; (+) strand; PAM type: YTN; PAM sequence: CTG
ccatgactagcccggcgttt

SEQ ID NO: 67437 - DNA, 20 bp, Artificial Sequence
  Description of Artificial Sequence: Synthetic oligonucleotide
  Target: SCN10A; (+) strand; PAM type: YTN; PAM sequence: CTA
gcccggcgttttccagaggc

SEQ ID NO: 67438 - DNA, 20 bp, Artificial Sequence
  Description of Artificial Sequence: Synthetic oligonucleotide
  Target: SCN10A; (+) strand; PAM type: YTN; PAM sequence: TTT
tccagaggcgaggcctagaa

SEQ ID NO: 67439 - DNA, 20 bp, Artificial Sequence
  Description of Artificial Sequence: Synthetic oligonucleotide
  Target: SCN10A; (+) strand; PAM type: YTN; PAM sequence: TTT
ccagaggcgaggcctagaaa

SEQ ID NO: 67440 - DNA, 20 bp, Artificial Sequence
  Description of Artificial Sequence: Synthetic oligonucleotide
  Target: SCN10A; (+) strand; PAM type: YTN; PAM sequence: TTC
cagaggcgaggcctagaaaa

SEQ ID NO: 67441 - DNA, 20 bp, Artificial Sequence
  Description of Artificial Sequence: Synthetic oligonucleotide
  Target: SCN10A; (+) strand; PAM type: YTN; PAM sequence: CTA
gaaaagactgggcattgccc

SEQ ID NO: 67442 - DNA, 20 bp, Artificial Sequence
  Description of Artificial Sequence: Synthetic oligonucleotide
  Target: SCN10A; (+) strand; PAM type: YTN; PAM sequence: CTG
ggcattgccccaaaggagca

SEQ ID NO: 67443 - DNA, 20 bp, Artificial Sequence
  Description of Artificial Sequence: Synthetic oligonucleotide
  Target: SCN10A; (+) strand; PAM type: YTN; PAM sequence: TTG
ccccaaaggagcaagaaggc

SEQ ID NO: 67444 - DNA, 20 bp, Artificial Sequence
  Description of Artificial Sequence: Synthetic oligonucleotide
  Target: SCN10A; (+) strand; PAM type: YTN; PAM sequence: CTG
gaaactggtcctctgggaaa

SEQ ID NO: 67445 - DNA, 20 bp, Artificial Sequence
  Description of Artificial Sequence: Synthetic oligonucleotide
  Target: SCN10A; (+) strand; PAM type: YTN; PAM sequence: CTG
gtcctctgggaaatctagag

SEQ ID NO: 67446 - DNA, 20 bp, Artificial Sequence
  Description of Artificial Sequence: Synthetic oligonucleotide
  Target: SCN10A; (+) strand; PAM type: YTN; PAM sequence: CTC
tgggaaatctagagcccaac

SEQ ID NO: 67447 - DNA, 20 bp, Artificial Sequence
  Description of Artificial Sequence: Synthetic oligonucleotide
  Target: SCN10A; (+) strand; PAM type: YTN; PAM sequence: CTG
ggaaatctagagcccaacac

SEQ ID NO: 67448 - DNA, 20 bp, Artificial Sequence
  Description of Artificial Sequence: Synthetic oligonucleotide
  Target: SCN10A; (+) strand; PAM type: YTN; PAM sequence: CTA
gagcccaacacttccctcta

SEQ ID NO: 67449 - DNA, 20 bp, Artificial Sequence
  Description of Artificial Sequence: Synthetic oligonucleotide
  Target: SCN10A; (+) strand; PAM type: YTN; PAM sequence: CTT
ccctctacctactcccattt

SEQ ID NO: 67450 - DNA, 20 bp, Artificial Sequence
  Description of Artificial Sequence: Synthetic oligonucleotide
  Target: SCN10A; (+) strand; PAM type: YTN; PAM sequence: TTC
cctctacctactcccatttc

SEQ ID NO: 67451 - DNA, 20 bp, Artificial Sequence
  Description of Artificial Sequence: Synthetic oligonucleotide
  Target: SCN10A; (+) strand; PAM type: YTN; PAM sequence: CTC
tacctactcccatttccctg

SEQ ID NO: 67452 - DNA, 20 bp, Artificial Sequence
  Description of Artificial Sequence: Synthetic oligonucleotide
  Target: SCN10A; (+) strand; PAM type: YTN; PAM sequence: CTA
cctactcccatttccctgcc

SEQ ID NO: 67453 - DNA, 20 bp, Artificial Sequence
  Description of Artificial Sequence: Synthetic oligonucleotide
  Target: SCN10A; (+) strand; PAM type: YTN; PAM sequence: CTA
ctcccatttccctgcccctg

SEQ ID NO: 67454 - DNA, 20 bp, Artificial Sequence
  Description of Artificial Sequence: Synthetic oligonucleotide
  Target: SCN10A; (+) strand; PAM type: YTN; PAM sequence: CTC
ccatttccctgcccctgtct

SEQ ID NO: 67455 - DNA, 20 bp, Artificial Sequence
  Description of Artificial Sequence: Synthetic oligonucleotide
  Target: SCN10A; (+) strand; PAM type: YTN; PAM sequence: TTT
ccctgcccctgtctttatga

SEQ ID NO: 67456 - DNA, 20 bp, Artificial Sequence
  Description of Artificial Sequence: Synthetic oligonucleotide
  Target: SCN10A; (+) strand; PAM type: YTN; PAM sequence: TTC
cctgcccctgtctttatgac

SEQ ID NO: 67457 - DNA, 20 bp, Artificial Sequence
  Description of Artificial Sequence: Synthetic oligonucleotide
  Target: SCN10A; (+) strand; PAM type: YTN; PAM sequence: CTG
cccctgtctttatgaccttt

SEQ ID NO: 67458 - DNA, 20 bp, Artificial Sequence
  Description of Artificial Sequence: Synthetic oligonucleotide
  Target: SCN10A; (+) strand; PAM type: YTN; PAM sequence: CTG
tctttatgacctttcagtca

SEQ ID NO: 67459 - DNA, 20 bp, Artificial Sequence
  Description of Artificial Sequence: Synthetic oligonucleotide
  Target: SCN10A; (+) strand; PAM type: YTN; PAM sequence: CTT
tatgacctttcagtcactaa

SEQ ID NO: 67460 - DNA, 20 bp, Artificial Sequence
  Description of Artificial Sequence: Synthetic oligonucleotide
  Target: SCN10A; (+) strand; PAM type: YTN; PAM sequence: TTT
atgacctttcagtcactaag

SEQ ID NO: 67461 - DNA, 20 bp, Artificial Sequence
  Description of Artificial Sequence: Synthetic oligonucleotide
  Target: SCN10A; (+) strand; PAM type: YTN; PAM sequence: TTA
tgacctttcagtcactaagt

SEQ ID NO: 67462 - DNA, 20 bp, Artificial Sequence
  Description of Artificial Sequence: Synthetic oligonucleotide
  Target: SCN10A; (+) strand; PAM type: YTN; PAM sequence: CTT
tcagtcactaagtaaaggca

SEQ ID NO: 67463 - DNA, 20 bp, Artificial Sequence
  Description of Artificial Sequence: Synthetic oligonucleotide
  Target: SCN10A; (+) strand; PAM type: YTN; PAM sequence: TTT
cagtcactaagtaaaggcac

SEQ ID NO: 67464 - DNA, 20 bp, Artificial Sequence
  Description of Artificial Sequence: Synthetic oligonucleotide
  Target: SCN10A; (+) strand; PAM type: YTN; PAM sequence: TTC
agtcactaagtaaaggcaca

SEQ ID NO: 67465 - DNA, 20 bp, Artificial Sequence
  Description of Artificial Sequence: Synthetic oligonucleotide
  Target: SCN10A; (+) strand; PAM type: YTN; PAM sequence: CTA
agtaaaggcacaaatctaag

SEQ ID NO: 67466 - DNA, 20 bp, Artificial Sequence
  Description of Artificial Sequence: Synthetic oligonucleotide
  Target: SCN10A; (+) strand; PAM type: YTN; PAM sequence: CTA
aggggtattctaggtatgca

SEQ ID NO: 67467 - DNA, 20 bp, Artificial Sequence
  Description of Artificial Sequence: Synthetic oligonucleotide
  Target: SCN10A; (+) strand; PAM type: YTN; PAM sequence: TTC
taggtatgcatggtggggaa

SEQ ID NO: 67468 - DNA, 20 bp, Artificial Sequence
  Description of Artificial Sequence: Synthetic oligonucleotide
  Target: SCN10A; (+) strand; PAM type: YTN; PAM sequence: CTA
ggtatgcatggtggggaaaa

SEQ ID NO: 67469 - DNA, 20 bp, Artificial Sequence
  Description of Artificial Sequence: Synthetic oligonucleotide
  Target: SCN10A; (+) strand; PAM type: YTN; PAM sequence: CTC
tagatagactccgggaaaga

SEQ ID NO: 67470 - DNA, 20 bp, Artificial Sequence
  Description of Artificial Sequence: Synthetic oligonucleotide
  Target: SCN10A; (+) strand; PAM type: YTN; PAM sequence: CTA
gatagactccgggaaagacc

SEQ ID NO: 67471 - DNA, 20 bp, Artificial Sequence
  Description of Artificial Sequence: Synthetic oligonucleotide
  Target: SCN10A; (+) strand; PAM type: YTN; PAM sequence: CTC
cgggaaagaccaggagagag

SEQ ID NO: 67472 - DNA, 20 bp, Artificial Sequence
  Description of Artificial Sequence: Synthetic oligonucleotide
  Target: SCN10A; (+) strand; PAM type: YTN; PAM sequence: TTA
cagcgtgctgatgctcagca

SEQ ID NO: 67473 - DNA, 20 bp, Artificial Sequence
  Description of Artificial Sequence: Synthetic oligonucleotide
  Target: SCN10A; (+) strand; PAM type: YTN; PAM sequence: CTG
atgctcagcaaataggttat

SEQ ID NO: 67474 - DNA, 20 bp, Artificial Sequence
  Description of Artificial Sequence: Synthetic oligonucleotide
  Target: SCN10A; (+) strand; PAM type: YTN; PAM sequence: CTC
agcaaataggttatcatggt

SEQ ID NO: 67475 - DNA, 20 bp, Artificial Sequence
  Description of Artificial Sequence: Synthetic oligonucleotide
  Target: SCN10A; (+) strand; PAM type: YTN; PAM sequence: TTA
tcatggtcaggaacatgtca

SEQ ID NO: 67476 - DNA, 20 bp, Artificial Sequence
  Description of Artificial Sequence: Synthetic oligonucleotide
  Target: SCN10A; (+) strand; PAM type: YTN; PAM sequence: CTT
gtcacctggatagttcagtt

SEQ ID NO: 67477 - DNA, 20 bp, Artificial Sequence
  Description of Artificial Sequence: Synthetic oligonucleotide
  Target: SCN10A; (+) strand; PAM type: YTN; PAM sequence: TTG
tcacctggatagttcagttg

SEQ ID NO: 67478 - DNA, 20 bp, Artificial Sequence
  Description of Artificial Sequence: Synthetic oligonucleotide
  Target: SCN10A; (+) strand; PAM type: YTN; PAM sequence: CTG
gatagttcagttgattgcca

SEQ ID NO: 67479 - DNA, 20 bp, Artificial Sequence
  Description of Artificial Sequence: Synthetic oligonucleotide
  Target: SCN10A; (+) strand; PAM type: YTN; PAM sequence: TTC
agttgattgccaacctttgg

SEQ ID NO: 67480 - DNA, 20 bp, Artificial Sequence
  Description of Artificial Sequence: Synthetic oligonucleotide
  Target: SCN10A; (+) strand; PAM type: YTN; PAM sequence: TTG
attgccaacctttggccaca

SEQ ID NO: 67481 - DNA, 20 bp, Artificial Sequence
  Description of Artificial Sequence: Synthetic oligonucleotide
  Target: SCN10A; (+) strand; PAM type: YTN; PAM sequence: TTG
ccaacctttggccacagggc

SEQ ID NO: 67482 - DNA, 20 bp, Artificial Sequence
  Description of Artificial Sequence: Synthetic oligonucleotide
  Target: SCN10A; (+) strand; PAM type: YTN; PAM sequence: CTT
tggccacagggctagacaaa

SEQ ID NO: 67483 - DNA, 20 bp, Artificial Sequence
  Description of Artificial Sequence: Synthetic oligonucleotide
  Target: SCN10A; (+) strand; PAM type: YTN; PAM sequence: TTT
ggccacagggctagacaaag

SEQ ID NO: 67484 - DNA, 20 bp, Artificial Sequence
  Description of Artificial Sequence: Synthetic oligonucleotide
  Target: SCN10A; (+) strand; PAM type: YTN; PAM sequence: TTG
gccacagggctagacaaagc

SEQ ID NO: 67485 - DNA, 20 bp, Artificial Sequence
  Description of Artificial Sequence: Synthetic oligonucleotide
  Target: SCN10A; (+) strand; PAM type: YTN; PAM sequence: CTA
gacaaagctgtcctaagttc

SEQ ID NO: 67486 - DNA, 20 bp, Artificial Sequence
  Description of Artificial Sequence: Synthetic oligonucleotide
  Target: SCN10A; (+) strand; PAM type: YTN; PAM sequence: CTG
tcctaagttcacttttccac

SEQ ID NO: 67487 - DNA, 20 bp, Artificial Sequence
  Description of Artificial Sequence: Synthetic oligonucleotide
  Target: SCN10A; (+) strand; PAM type: YTN; PAM sequence: CTA
agttcacttttccacatgca

SEQ ID NO: 67488 - DNA, 20 bp, Artificial Sequence
  Description of Artificial Sequence: Synthetic oligonucleotide
  Target: SCN10A; (+) strand; PAM type: YTN; PAM sequence: TTC
acttttccacatgcaaagtt

SEQ ID NO: 67489 - DNA, 20 bp, Artificial Sequence
  Description of Artificial Sequence: Synthetic oligonucleotide
  Target: SCN10A; (+) strand; PAM type: YTN; PAM sequence: CTT
ttccacatgcaaagttgtga

SEQ ID NO: 67490 - DNA, 20 bp, Artificial Sequence
  Description of Artificial Sequence: Synthetic oligonucleotide
  Target: SCN10A; (+) strand; PAM type: YTN; PAM sequence: TTT
tccacatgcaaagttgtgac

SEQ ID NO: 67491 - DNA, 20 bp, Artificial Sequence
  Description of Artificial Sequence: Synthetic oligonucleotide
  Target: SCN10A; (+) strand; PAM type: YTN; PAM sequence: TTT
ccacatgcaaagttgtgacc

SEQ ID NO: 67492 - DNA, 20 bp, Artificial Sequence
  Description of Artificial Sequence: Synthetic oligonucleotide
  Target: SCN10A; (+) strand; PAM type: YTN; PAM sequence: TTC
cacatgcaaagttgtgacct

SEQ ID NO: 67493 - DNA, 20 bp, Artificial Sequence
  Description of Artificial Sequence: Synthetic oligonucleotide
  Target: SCN10A; (+) strand; PAM type: YTN; PAM sequence: TTG
tgacctaaggaggctactat

SEQ ID NO: 67494 - DNA, 20 bp, Artificial Sequence
  Description of Artificial Sequence: Synthetic oligonucleotide
  Target: SCN10A; (+) strand; PAM type: YTN; PAM sequence: CTA
aggaggctactatgcacacc

SEQ ID NO: 67495 - DNA, 20 bp, Artificial Sequence
  Description of Artificial Sequence: Synthetic oligonucleotide
  Target: SCN10A; (+) strand; PAM type: YTN; PAM sequence: CTA
ctatgcacaccagtactgga

SEQ ID NO: 67496 - DNA, 20 bp, Artificial Sequence
  Description of Artificial Sequence: Synthetic oligonucleotide
  Target: SCN10A; (+) strand; PAM type: YTN; PAM sequence: CTA
tgcacaccagtactggaaca

SEQ ID NO: 67497 - DNA, 20 bp, Artificial Sequence
  Description of Artificial Sequence: Synthetic oligonucleotide
  Target: SCN10A; (+) strand; PAM type: YTN; PAM sequence: CTG
gaacatacttggtaagtggt

SEQ ID NO: 67498 - DNA, 20 bp, Artificial Sequence
  Description of Artificial Sequence: Synthetic oligonucleotide
  Target: SCN10A; (+) strand; PAM type: YTN; PAM sequence: CTT
ggtaagtggttgttgaatga

SEQ ID NO: 67499 - DNA, 20 bp, Artificial Sequence
  Description of Artificial Sequence: Synthetic oligonucleotide
  Target: SCN10A; (+) strand; PAM type: YTN; PAM sequence: TTG
gtaagtggttgttgaatgaa

SEQ ID NO: 67500 - DNA, 20 bp, Artificial Sequence
  Description of Artificial Sequence: Synthetic oligonucleotide
  Target: SCN10A; (+) strand; PAM type: YTN; PAM sequence: TTG
ttgaatgaataagtgcactt

SEQ ID NO: 67501 - DNA, 20 bp, Artificial Sequence
  Description of Artificial Sequence: Synthetic oligonucleotide
  Target: SCN10A; (+) strand; PAM type: YTN; PAM sequence: TTG
aatgaataagtgcacttcat

SEQ ID NO: 67502 - DNA, 20 bp, Artificial Sequence
  Description of Artificial Sequence: Synthetic oligonucleotide
  Target: SCN10A; (+) strand; PAM type: YTN; PAM sequence: CTT
cattgtctgaaaattaggta

SEQ ID NO: 67503 - DNA, 20 bp, Artificial Sequence
  Description of Artificial Sequence: Synthetic oligonucleotide
  Target: SCN10A; (+) strand; PAM type: YTN; PAM sequence: TTC
attgtctgaaaattaggtag

SEQ ID NO: 67504 - DNA, 20 bp, Artificial Sequence
  Description of Artificial Sequence: Synthetic oligonucleotide
  Target: SCN10A; (+) strand; PAM type: YTN; PAM sequence: TTG
tctgaaaattaggtagtaca

SEQ ID NO: 67505 - DNA, 20 bp, Artificial Sequence
  Description of Artificial Sequence: Synthetic oligonucleotide
  Target: SCN10A; (+) strand; PAM type: YTN; PAM sequence: CTG
aaaattaggtagtacaattc

SEQ ID NO: 67506 - DNA, 20 bp, Artificial Sequence
  Description of Artificial Sequence: Synthetic oligonucleotide
  Target: SCN10A; (+) strand; PAM type: YTN; PAM sequence: TTA
ggtagtacaattcattagat

SEQ ID NO: 67507 - DNA, 20 bp, Artificial Sequence
  Description of Artificial Sequence: Synthetic oligonucleotide
  Target: SCN10A; (+) strand; PAM type: YTN; PAM sequence: TTC
attagatcccatctgtatga

SEQ ID NO: 67508 - DNA, 20 bp, Artificial Sequence
  Description of Artificial Sequence: Synthetic oligonucleotide
  Target: SCN10A; (+) strand; PAM type: YTN; PAM sequence: TTA
gatcccatctgtatgaatgt

SEQ ID NO: 67509 - DNA, 20 bp, Artificial Sequence
  Description of Artificial Sequence: Synthetic oligonucleotide
  Target: SCN10A; (+) strand; PAM type: YTN; PAM sequence: CTG
tatgaatgtgagagtttgtg

SEQ ID NO: 67510 - DNA, 20 bp, Artificial Sequence
  Description of Artificial Sequence: Synthetic oligonucleotide
  Target: SCN10A; (+) strand; PAM type: YTN; PAM sequence: TTT
gtgttgcaaaggaggagaca

SEQ ID NO: 67511 - DNA, 20 bp, Artificial Sequence
  Description of Artificial Sequence: Synthetic oligonucleotide
  Target: SCN10A; (+) strand; PAM type: YTN; PAM sequence: TTG
tgttgcaaaggaggagacaa

SEQ ID NO: 67512 - DNA, 20 bp, Artificial Sequence
  Description of Artificial Sequence: Synthetic oligonucleotide
  Target: SCN10A; (+) strand; PAM type: YTN; PAM sequence: TTG
caaaggaggagacaagagct

SEQ ID NO: 67513 - DNA, 20 bp, Artificial Sequence
  Description of Artificial Sequence: Synthetic oligonucleotide
  Target: SCN10A; (+) strand; PAM type: YTN; PAM sequence: CTG
tacagtgcaatgagtttcta

SEQ ID NO: 67514 - DNA, 20 bp, Artificial Sequence
  Description of Artificial Sequence: Synthetic oligonucleotide
  Target: SCN10A; (+) strand; PAM type: YTN; PAM sequence: TTT
ctaggatccctcgaggcttg

SEQ ID NO: 67515 - DNA, 20 bp, Artificial Sequence
  Description of Artificial Sequence: Synthetic oligonucleotide
  Target: SCN10A; (+) strand; PAM type: YTN; PAM sequence: TTC
taggatccctcgaggcttga

SEQ ID NO: 67516 - DNA, 20 bp, Artificial Sequence
  Description of Artificial Sequence: Synthetic oligonucleotide
  Target: SCN10A; (+) strand; PAM type: YTN; PAM sequence: CTA
ggatccctcgaggcttgaac

SEQ ID NO: 67517 - DNA, 20 bp, Artificial Sequence
  Description of Artificial Sequence: Synthetic oligonucleotide
  Target: SCN10A; (+) strand; PAM type: YTN; PAM sequence: CTC
gaggcttgaacagtcaacaa

SEQ ID NO: 67518 - DNA, 20 bp, Artificial Sequence
  Description of Artificial Sequence: Synthetic oligonucleotide
  Target: SCN10A; (+) strand; PAM type: YTN; PAM sequence: CTT
gaacagtcaacaatggagag

SEQ ID NO: 67519 - DNA, 20 bp, Artificial Sequence
  Description of Artificial Sequence: Synthetic oligonucleotide
  Target: SCN10A; (+) strand; PAM type: YTN; PAM sequence: TTG
aacagtcaacaatggagaga

SEQ ID NO: 67520 - DNA, 20 bp, Artificial Sequence
  Description of Artificial Sequence: Synthetic oligonucleotide
  Target: SCN10A; (+) strand; PAM type: YTN; PAM sequence: CTG
aaggaagggttgcagcctaa

SEQ ID NO: 67521 - DNA, 20 bp, Artificial Sequence
  Description of Artificial Sequence: Synthetic oligonucleotide
  Target: SCN10A; (+) strand; PAM type: YTN; PAM sequence: TTG
cagcctaatttcctggaaga

SEQ ID NO: 67522 - DNA, 20 bp, Artificial Sequence
  Description of Artificial Sequence: Synthetic oligonucleotide
  Target: SCN10A; (+) strand; PAM type: YTN; PAM sequence: CTA
atttcctggaagaataatgt

SEQ ID NO: 67523 - DNA, 20 bp, Artificial Sequence
  Description of Artificial Sequence: Synthetic oligonucleotide
  Target: SCN10A; (+) strand; PAM type: YTN; PAM sequence: TTT
cctggaagaataatgtcatt

SEQ ID NO: 67524 - DNA, 20 bp, Artificial Sequence
  Description of Artificial Sequence: Synthetic oligonucleotide
  Target: SCN10A; (+) strand; PAM type: YTN; PAM sequence: TTC
ctggaagaataatgtcattc

SEQ ID NO: 67525 - DNA, 20 bp, Artificial Sequence
  Description of Artificial Sequence: Synthetic oligonucleotide
  Target: SCN10A; (+) strand; PAM type: YTN; PAM sequence: CTG
gaagaataatgtcattcctc

SEQ ID NO: 67526 - DNA, 20 bp, Artificial Sequence
  Description of Artificial Sequence: Synthetic oligonucleotide
  Target: SCN10A; (+) strand; PAM type: YTN; PAM sequence: TTC
ctccaaatcaataaacattt

SEQ ID NO: 67527 - DNA, 20 bp, Artificial Sequence
  Description of Artificial Sequence: Synthetic oligonucleotide
  Target: SCN10A; (+) strand; PAM type: YTN; PAM sequence: CTC
caaatcaataaacatttccc

SEQ ID NO: 67528 - DNA, 20 bp, Artificial Sequence
  Description of Artificial Sequence: Synthetic oligonucleotide
  Target: SCN10A; (+) strand; PAM type: YTN; PAM sequence: TTT
cccatcaaaatcttccattg

SEQ ID NO: 67529 - DNA, 20 bp, Artificial Sequence
  Description of Artificial Sequence: Synthetic oligonucleotide
  Target: SCN10A; (+) strand; PAM type: YTN; PAM sequence: TTC
ccatcaaaatcttccattga

SEQ ID NO: 67530 - DNA, 20 bp, Artificial Sequence
  Description of Artificial Sequence: Synthetic oligonucleotide
  Target: SCN10A; (+) strand; PAM type: YTN; PAM sequence: CTT
ccattgagggaactgtgtgg

SEQ ID NO: 67531 - DNA, 20 bp, Artificial Sequence
  Description of Artificial Sequence: Synthetic oligonucleotide
  Target: SCN10A; (+) strand; PAM type: YTN; PAM sequence: TTC
cattgagggaactgtgtggc

SEQ ID NO: 67532 - DNA, 20 bp, Artificial Sequence
  Description of Artificial Sequence: Synthetic oligonucleotide
  Target: SCN10A; (+) strand; PAM type: YTN; PAM sequence: TTG
agggaactgtgtggcttaaa

SEQ ID NO: 67533 - DNA, 20 bp, Artificial Sequence
  Description of Artificial Sequence: Synthetic oligonucleotide
  Target: SCN10A; (+) strand; PAM type: YTN; PAM sequence: CTG
tgtggcttaaagttgccaga

SEQ ID NO: 67534 - DNA, 20 bp, Artificial Sequence
  Description of Artificial Sequence: Synthetic oligonucleotide
  Target: SCN10A; (+) strand; PAM type: YTN; PAM sequence: CTT
aaagttgccagagaaaagag

SEQ ID NO: 67535 - DNA, 20 bp, Artificial Sequence
  Description of Artificial Sequence: Synthetic oligonucleotide
  Target: SCN10A; (+) strand; PAM type: YTN; PAM sequence: TTA
aagttgccagagaaaagagc

SEQ ID NO: 67536 - DNA, 20 bp, Artificial Sequence
  Description of Artificial Sequence: Synthetic oligonucleotide
  Target: SCN10A; (+) strand; PAM type: YTN; PAM sequence: TTG
ccagagaaaagagctaattc

SEQ ID NO: 67537 - DNA, 20 bp, Artificial Sequence
  Description of Artificial Sequence: Synthetic oligonucleotide
  Target: SCN10A; (+) strand; PAM type: YTN; PAM sequence: CTA
attcataaacccagagccct

SEQ ID NO: 67538 - DNA, 20 bp, Artificial Sequence
  Description of Artificial Sequence: Synthetic oligonucleotide
  Target: SCN10A; (+) strand; PAM type: YTN; PAM sequence: TTC
ataaacccagagccctcaga

SEQ ID NO: 67539 - DNA, 20 bp, Artificial Sequence
  Description of Artificial Sequence: Synthetic oligonucleotide
  Target: SCN10A; (+) strand; PAM type: YTN; PAM sequence: CTC
agagaattagtgtgctgggt

SEQ ID NO: 67540 - DNA, 20 bp, Artificial Sequence
  Description of Artificial Sequence: Synthetic oligonucleotide
  Target: SCN10A; (+) strand; PAM type: YTN; PAM sequence: TTA
gtgtgctgggttaggtagtt

SEQ ID NO: 67541 - DNA, 20 bp, Artificial Sequence
  Description of Artificial Sequence: Synthetic oligonucleotide
  Target: SCN10A; (+) strand; PAM type: YTN; PAM sequence: CTG
ggttaggtagttcccatgac

SEQ ID NO: 67542 - DNA, 20 bp, Artificial Sequence
  Description of Artificial Sequence: Synthetic oligonucleotide
  Target: SCN10A; (+) strand; PAM type: YTN; PAM sequence: TTA
ggtagttcccatgaccatag

SEQ ID NO: 67543 - DNA, 20 bp, Artificial Sequence
  Description of Artificial Sequence: Synthetic oligonucleotide
  Target: SCN10A; (+) strand; PAM type: YTN; PAM sequence: TTC
ccatgaccatagtgaaactt

SEQ ID NO: 67544 - DNA, 20 bp, Artificial Sequence
  Description of Artificial Sequence: Synthetic oligonucleotide
  Target: SCN10A; (+) strand; PAM type: YTN; PAM sequence: CTT
gaccataataaaccatcatt

SEQ ID NO: 67545 - DNA, 20 bp, Artificial Sequence
  Description of Artificial Sequence: Synthetic oligonucleotide
  Target: SCN10A; (+) strand; PAM type: YTN; PAM sequence: TTG
accataataaaccatcattt

SEQ ID NO: 67546 - DNA, 20 bp, Artificial Sequence
  Description of Artificial Sequence: Synthetic oligonucleotide
  Target: SCN10A; (+) strand; PAM type: YTN; PAM sequence: TTT
gtgtcctcaggtggtctata

SEQ ID NO: 67547 - DNA, 20 bp, Artificial Sequence
  Description of Artificial Sequence: Synthetic oligonucleotide
  Target: SCN10A; (+) strand; PAM type: YTN; PAM sequence: TTG
tgtcctcaggtggtctatag

SEQ ID NO: 67548 - DNA, 20 bp, Artificial Sequence
  Description of Artificial Sequence: Synthetic oligonucleotide
  Target: SCN10A; (+) strand; PAM type: YTN; PAM sequence: CTC
aggtggtctatagtatgtac

SEQ ID NO: 67549 - DNA, 20 bp, Artificial Sequence
  Description of Artificial Sequence: Synthetic oligonucleotide
  Target: SCN10A; (+) strand; PAM type: YTN; PAM sequence: CTA
tagtatgtacaaaatctaaa

SEQ ID NO: 67550 - DNA, 20 bp, Artificial Sequence
  Description of Artificial Sequence: Synthetic oligonucleotide
  Target: SCN10A; (+) strand; PAM type: YTN; PAM sequence: CTA
aacattgacttcataccaaa

SEQ ID NO: 67551 - DNA, 20 bp, Artificial Sequence
  Description of Artificial Sequence: Synthetic oligonucleotide
  Target: SCN10A; (+) strand; PAM type: YTN; PAM sequence: TTG
acttcataccaaactctgat

SEQ ID NO: 67552 - DNA, 20 bp, Artificial Sequence
  Description of Artificial Sequence: Synthetic oligonucleotide
  Target: SCN10A; (+) strand; PAM type: YTN; PAM sequence: CTT
cataccaaactctgatcata

SEQ ID NO: 67553 - DNA, 20 bp, Artificial Sequence
  Description of Artificial Sequence: Synthetic oligonucleotide
  Target: SCN10A; (+) strand; PAM type: YTN; PAM sequence: TTC
ataccaaactctgatcatac

SEQ ID NO: 67554 - DNA, 20 bp, Artificial Sequence
  Description of Artificial Sequence: Synthetic oligonucleotide
  Target: SCN10A; (+) strand; PAM type: YTN; PAM sequence: CTC
tgatcataccgatttattcc

SEQ ID NO: 67555 - DNA, 20 bp, Artificial Sequence
  Description of Artificial Sequence: Synthetic oligonucleotide
  Target: SCN10A; (+) strand; PAM type: YTN; PAM sequence: CTG
atcataccgatttattccac

SEQ ID NO: 67556 - DNA, 20 bp, Artificial Sequence
  Description of Artificial Sequence: Synthetic oligonucleotide
  Target: SCN10A; (+) strand; PAM type: YTN; PAM sequence: TTT
attccactcaccttccttaa

SEQ ID NO: 67557 - DNA, 20 bp, Artificial Sequence
  Description of Artificial Sequence: Synthetic oligonucleotide
  Target: SCN10A; (+) strand; PAM type: YTN; PAM sequence: TTA
ttccactcaccttccttaac

SEQ ID NO: 67558 - DNA, 20 bp, Artificial Sequence
  Description of Artificial Sequence: Synthetic oligonucleotide
  Target: SCN10A; (+) strand; PAM type: YTN; PAM sequence: TTC
cactcaccttccttaactcc

SEQ ID NO: 67559 - DNA, 20 bp, Artificial Sequence
  Description of Artificial Sequence: Synthetic oligonucleotide
  Target: SCN10A; (+) strand; PAM type: YTN; PAM sequence: CTC
accttccttaactccttttt

SEQ ID NO: 67560 - DNA, 20 bp, Artificial Sequence
  Description of Artificial Sequence: Synthetic oligonucleotide
  Target: SCN10A; (+) strand; PAM type: YTN; PAM sequence: CTT
ccttaactcctttttattac

SEQ ID NO: 67561 - DNA, 20 bp, Artificial Sequence
  Description of Artificial Sequence: Synthetic oligonucleotide
  Target: SCN10A; (+) strand; PAM type: YTN; PAM sequence: TTC
cttaactcctttttattact

SEQ ID NO: 67562 - DNA, 20 bp, Artificial Sequence
  Description of Artificial Sequence: Synthetic oligonucleotide
  Target: SCN10A; (+) strand; PAM type: YTN; PAM sequence: CTT
aactcctttttattactaag

SEQ ID NO: 67563 - DNA, 20 bp, Artificial Sequence
  Description of Artificial Sequence: Synthetic oligonucleotide
  Target: SCN10A; (+) strand; PAM type: YTN; PAM sequence: TTA
actcctttttattactaagc

SEQ ID NO: 67564 - DNA, 20 bp, Artificial Sequence
  Description of Artificial Sequence: Synthetic oligonucleotide
  Target: SCN10A; (+) strand; PAM type: YTN; PAM sequence: CTC
ctttttattactaagctact

SEQ ID NO: 67565 - DNA, 20 bp, Artificial Sequence
  Description of Artificial Sequence: Synthetic oligonucleotide
  Target: SCN10A; (+) strand; PAM type: YTN; PAM sequence: CTT
tttattactaagctactaaa

SEQ ID NO: 67566 - DNA, 20 bp, Artificial Sequence
  Description of Artificial Sequence: Synthetic oligonucleotide
  Target: SCN10A; (+) strand; PAM type: YTN; PAM sequence: TTT
ttattactaagctactaaag

SEQ ID NO: 67567 - DNA, 20 bp, Artificial Sequence
  Description of Artificial Sequence: Synthetic oligonucleotide
  Target: SCN10A; (+) strand; PAM type: YTN; PAM sequence: TTT
tattactaagctactaaagt

SEQ ID NO: 67568 - DNA, 20 bp, Artificial Sequence
  Description of Artificial Sequence: Synthetic oligonucleotide
  Target: SCN10A; (+) strand; PAM type: YTN; PAM sequence: TTT
attactaagctactaaagtg

SEQ ID NO: 67569 - DNA, 20 bp, Artificial Sequence
  Description of Artificial Sequence: Synthetic oligonucleotide
  Target: SCN10A; (+) strand; PAM type: YTN; PAM sequence: TTA
ttactaagctactaaagtgg

SEQ ID NO: 67570 - DNA, 20 bp, Artificial Sequence
  Description of Artificial Sequence: Synthetic oligonucleotide
  Target: SCN10A; (+) strand; PAM type: YTN; PAM sequence: TTA
ctaagctactaaagtggaga

SEQ ID NO: 67571 - DNA, 20 bp, Artificial Sequence
  Description of Artificial Sequence: Synthetic oligonucleotide
  Target: SCN10A; (+) strand; PAM type: YTN; PAM sequence: CTA
agctactaaagtggagaatc

SEQ ID NO: 67572 - DNA, 20 bp, Artificial Sequence
  Description of Artificial Sequence: Synthetic oligonucleotide
  Target: SCN10A; (+) strand; PAM type: YTN; PAM sequence: CTA
ctaaagtggagaatcttgcc

SEQ ID NO: 67573 - DNA, 20 bp, Artificial Sequence
  Description of Artificial Sequence: Synthetic oligonucleotide
  Target: SCN10A; (+) strand; PAM type: YTN; PAM sequence: CTA
aagtggagaatcttgccaat

SEQ ID NO: 67574 - DNA, 20 bp, Artificial Sequence
  Description of Artificial Sequence: Synthetic oligonucleotide
  Target: SCN10A; (+) strand; PAM type: YTN; PAM sequence: CTT
gccaattggggttctcctta

SEQ ID NO: 67575 - DNA, 20 bp, Artificial Sequence
  Description of Artificial Sequence: Synthetic oligonucleotide
  Target: SCN10A; (+) strand; PAM type: YTN; PAM sequence: TTG
ccaattggggttctccttac

SEQ ID NO: 67576 - DNA, 20 bp, Artificial Sequence
  Description of Artificial Sequence: Synthetic oligonucleotide
  Target: SCN10A; (+) strand; PAM type: YTN; PAM sequence: TTG
gggttctccttactaatccc

SEQ ID NO: 67577 - DNA, 20 bp, Artificial Sequence
  Description of Artificial Sequence: Synthetic oligonucleotide
  Target: SCN10A; (+) strand; PAM type: YTN; PAM sequence: TTC
tccttactaatccccttatc

SEQ ID NO: 67578 - DNA, 20 bp, Artificial Sequence
  Description of Artificial Sequence: Synthetic oligonucleotide
  Target: SCN10A; (+) strand; PAM type: YTN; PAM sequence: CTC
cttactaatccccttatctc

SEQ ID NO: 67579 - DNA, 20 bp, Artificial Sequence
  Description of Artificial Sequence: Synthetic oligonucleotide
  Target: SCN10A; (+) strand; PAM type: YTN; PAM sequence: CTT
actaatccccttatctcaca

SEQ ID NO: 67580 - DNA, 20 bp, Artificial Sequence
  Description of Artificial Sequence: Synthetic oligonucleotide
  Target: SCN10A; (+) strand; PAM type: YTN; PAM sequence: TTA
ctaatccccttatctcacag

SEQ ID NO: 67581 - DNA, 20 bp, Artificial Sequence
  Description of Artificial Sequence: Synthetic oligonucleotide
  Target: SCN10A; (+) strand; PAM type: YTN; PAM sequence: CTA
atccccttatctcacagaac

SEQ ID NO: 67582 - DNA, 20 bp, Artificial Sequence
  Description of Artificial Sequence: Synthetic oligonucleotide
  Target: SCN10A; (+) strand; PAM type: YTN; PAM sequence: CTT
atctcacagaactgaagttt

SEQ ID NO: 67583 - DNA, 20 bp, Artificial Sequence
  Description of Artificial Sequence: Synthetic oligonucleotide
  Target: SCN10A; (+) strand; PAM type: YTN; PAM sequence: TTA
tctcacagaactgaagtttc

SEQ ID NO: 67584 - DNA, 20 bp, Artificial Sequence
  Description of Artificial Sequence: Synthetic oligonucleotide
  Target: SCN10A; (+) strand; PAM type: YTN; PAM sequence: CTC
acagaactgaagtttcctct

SEQ ID NO: 67585 - DNA, 20 bp, Artificial Sequence
  Description of Artificial Sequence: Synthetic oligonucleotide
  Target: SCN10A; (+) strand; PAM type: YTN; PAM sequence: CTG
aagtttcctctcttgataat

SEQ ID NO: 67586 - DNA, 20 bp, Artificial Sequence
  Description of Artificial Sequence: Synthetic oligonucleotide
  Target: SCN10A; (+) strand; PAM type: YTN; PAM sequence: TTT
cctctcttgataatttgaag

SEQ ID NO: 67587 - DNA, 20 bp, Artificial Sequence
  Description of Artificial Sequence: Synthetic oligonucleotide
  Target: SCN10A; (+) strand; PAM type: YTN; PAM sequence: TTC
ctctcttgataatttgaagc

SEQ ID NO: 67588 - DNA, 20 bp, Artificial Sequence
  Description of Artificial Sequence: Synthetic oligonucleotide
  Target: SCN10A; (+) strand; PAM type: YTN; PAM sequence: CTC
tcttgataatttgaagcctg

SEQ ID NO: 67589 - DNA, 20 bp, Artificial Sequence
  Description of Artificial Sequence: Synthetic oligonucleotide
  Target: SCN10A; (+) strand; PAM type: YTN; PAM sequence: CTC
ttgataatttgaagcctgat

SEQ ID NO: 67590 - DNA, 20 bp, Artificial Sequence
  Description of Artificial Sequence: Synthetic oligonucleotide
  Target: SCN10A; (+) strand; PAM type: YTN; PAM sequence: CTT
gataatttgaagcctgatcc

SEQ ID NO: 67591 - DNA, 20 bp, Artificial Sequence
  Description of Artificial Sequence: Synthetic oligonucleotide
  Target: SCN10A; (+) strand; PAM type: YTN; PAM sequence: TTG
ataatttgaagcctgatcct

SEQ ID NO: 67592 - DNA, 20 bp, Artificial Sequence
  Description of Artificial Sequence: Synthetic oligonucleotide
  Target: SCN10A; (+) strand; PAM type: YTN; PAM sequence: TTT
gaagcctgatcctgtttagc

SEQ ID NO: 67593 - DNA, 20 bp, Artificial Sequence
  Description of Artificial Sequence: Synthetic oligonucleotide
  Target: SCN10A; (+) strand; PAM type: YTN; PAM sequence: TTG
aagcctgatcctgtttagca

SEQ ID NO: 67594 - DNA, 20 bp, Artificial Sequence
  Description of Artificial Sequence: Synthetic oligonucleotide
  Target: SCN10A; (+) strand; PAM type: YTN; PAM sequence: CTG
atcctgtttagcaaccatta

SEQ ID NO: 67595 - DNA, 20 bp, Artificial Sequence
  Description of Artificial Sequence: Synthetic oligonucleotide
  Target: SCN10A; (+) strand; PAM type: YTN; PAM sequence: CTG
tttagcaaccattattaaaa

SEQ ID NO: 67596 - DNA, 20 bp, Artificial Sequence
  Description of Artificial Sequence: Synthetic oligonucleotide
  Target: SCN10A; (+) strand; PAM type: YTN; PAM sequence: TTT
agcaaccattattaaaagct

SEQ ID NO: 67597 - DNA, 20 bp, Artificial Sequence
  Description of Artificial Sequence: Synthetic oligonucleotide
  Target: SCN10A; (+) strand; PAM type: YTN; PAM sequence: TTA
gcaaccattattaaaagctc

SEQ ID NO: 67598 - DNA, 20 bp, Artificial Sequence
  Description of Artificial Sequence: Synthetic oligonucleotide
  Target: SCN10A; (+) strand; PAM type: YTN; PAM sequence: TTA
ttaaaagctcagtattataa

SEQ ID NO: 67599 - DNA, 20 bp, Artificial Sequence
  Description of Artificial Sequence: Synthetic oligonucleotide
  Target: SCN10A; (+) strand; PAM type: YTN; PAM sequence: TTA
aaagctcagtattataaata

SEQ ID NO: 67600 - DNA, 20 bp, Artificial Sequence
  Description of Artificial Sequence: Synthetic oligonucleotide
  Target: SCN10A; (+) strand; PAM type: YTN; PAM sequence: CTC
agtattataaatagagtact

SEQ ID NO: 67601 - DNA, 20 bp, Artificial Sequence
  Description of Artificial Sequence: Synthetic oligonucleotide
  Target: SCN10A; (+) strand; PAM type: YTN; PAM sequence: TTA
taaatagagtactctctgcc

SEQ ID NO: 67602 - DNA, 20 bp, Artificial Sequence
  Description of Artificial Sequence: Synthetic oligonucleotide
  Target: SCN10A; (+) strand; PAM type: YTN; PAM sequence: CTC
tctgcctgtaatacatgccc

SEQ ID NO: 67603 - DNA, 20 bp, Artificial Sequence
  Description of Artificial Sequence: Synthetic oligonucleotide
  Target: SCN10A; (+) strand; PAM type: YTN; PAM sequence: CTC
tgcctgtaatacatgcccaa

SEQ ID NO: 67604 - DNA, 20 bp, Artificial Sequence
  Description of Artificial Sequence: Synthetic oligonucleotide
  Target: SCN10A; (+) strand; PAM type: YTN; PAM sequence: CTG
cctgtaatacatgcccaagg

SEQ ID NO: 67605 - DNA, 20 bp, Artificial Sequence
  Description of Artificial Sequence: Synthetic oligonucleotide
  Target: SCN10A; (+) strand; PAM type: YTN; PAM sequence: CTG
taatacatgcccaaggacta

SEQ ID NO: 67606 - DNA, 20 bp, Artificial Sequence
  Description of Artificial Sequence: Synthetic oligonucleotide
  Target: SCN10A; (+) strand; PAM type: YTN; PAM sequence: CTA
tagaactcataaaatgcaaa

SEQ ID NO: 67607 - DNA, 20 bp, Artificial Sequence
  Description of Artificial Sequence: Synthetic oligonucleotide
  Target: SCN10A; (+) strand; PAM type: YTN; PAM sequence: CTC
ataaaatgcaaaaatccttc

SEQ ID NO: 67608 - DNA, 20 bp, Artificial Sequence
  Description of Artificial Sequence: Synthetic oligonucleotide
  Target: SCN10A; (+) strand; PAM type: YTN; PAM sequence: CTT
ccaatttttgaagcaaatga

SEQ ID NO: 67609 - DNA, 20 bp, Artificial Sequence
  Description of Artificial Sequence: Synthetic oligonucleotide
  Target: SCN10A; (+) strand; PAM type: YTN; PAM sequence: TTC
caatttttgaagcaaatgag

SEQ ID NO: 67610 - DNA, 20 bp, Artificial Sequence
  Description of Artificial Sequence: Synthetic oligonucleotide
  Target: SCN10A; (+) strand; PAM type: YTN; PAM sequence: TTT
ttgaagcaaatgagaaaaat

SEQ ID NO: 67611 - DNA, 20 bp, Artificial Sequence
  Description of Artificial Sequence: Synthetic oligonucleotide
  Target: SCN10A; (+) strand; PAM type: YTN; PAM sequence: TTT
tgaagcaaatgagaaaaatt

SEQ ID NO: 67612 - DNA, 20 bp, Artificial Sequence
  Description of Artificial Sequence: Synthetic oligonucleotide
  Target: SCN10A; (+) strand; PAM type: YTN; PAM sequence: TTT
gaagcaaatgagaaaaattg

SEQ ID NO: 67613 - DNA, 20 bp, Artificial Sequence
  Description of Artificial Sequence: Synthetic oligonucleotide
  Target: SCN10A; (+) strand; PAM type: YTN; PAM sequence: TTG
aagcaaatgagaaaaattga

SEQ ID NO: 67614 - DNA, 20 bp, Artificial Sequence
  Description of Artificial Sequence: Synthetic oligonucleotide
  Target: SCN10A; (+) strand; PAM type: YTN; PAM sequence: TTG
acacatccatattaaggaag

SEQ ID NO: 67615 - DNA, 20 bp, Artificial Sequence
  Description of Artificial Sequence: Synthetic oligonucleotide
  Target: SCN10A; (+) strand; PAM type: YTN; PAM sequence: TTA
aggaagggaatactacatta

SEQ ID NO: 67616 - DNA, 20 bp, Artificial Sequence
  Description of Artificial Sequence: Synthetic oligonucleotide
  Target: SCN10A; (+) strand; PAM type: YTN; PAM sequence: CTA
cattatttgcacttgagcac

SEQ ID NO: 67617 - DNA, 20 bp, Artificial Sequence
  Description of Artificial Sequence: Synthetic oligonucleotide
  Target: SCN10A; (+) strand; PAM type: YTN; PAM sequence: TTA
tttgcacttgagcaccaagc

SEQ ID NO: 67618 - DNA, 20 bp, Artificial Sequence
  Description of Artificial Sequence: Synthetic oligonucleotide
  Target: SCN10A; (+) strand; PAM type: YTN; PAM sequence: TTT
gcacttgagcaccaagcaaa

SEQ ID NO: 67619 - DNA, 20 bp, Artificial Sequence
  Description of Artificial Sequence: Synthetic oligonucleotide
  Target: SCN10A; (+) strand; PAM type: YTN; PAM sequence: TTG
cacttgagcaccaagcaaac

SEQ ID NO: 67620 - DNA, 20 bp, Artificial Sequence
  Description of Artificial Sequence: Synthetic oligonucleotide
  Target: SCN10A; (+) strand; PAM type: YTN; PAM sequence: CTT
gagcaccaagcaaaccaatg

SEQ ID NO: 67621 - DNA, 20 bp, Artificial Sequence
  Description of Artificial Sequence: Synthetic oligonucleotide
  Target: SCN10A; (+) strand; PAM type: YTN; PAM sequence: TTG
agcaccaagcaaaccaatga

SEQ ID NO: 67622 - DNA, 20 bp, Artificial Sequence
  Description of Artificial Sequence: Synthetic oligonucleotide
  Target: SCN10A; (+) strand; PAM type: YTN; PAM sequence: CTG
agaagaaaattttggttgca

SEQ ID NO: 67623 - DNA, 20 bp, Artificial Sequence
  Description of Artificial Sequence: Synthetic oligonucleotide
  Target: SCN10A; (+) strand; PAM type: YTN; PAM sequence: TTT
tggttgcatatttgacagca

SEQ ID NO: 67624 - DNA, 20 bp, Artificial Sequence
  Description of Artificial Sequence: Synthetic oligonucleotide
  Target: SCN10A; (+) strand; PAM type: YTN; PAM sequence: TTT
ggttgcatatttgacagcag

SEQ ID NO: 67625 - DNA, 20 bp, Artificial Sequence
  Description of Artificial Sequence: Synthetic oligonucleotide
  Target: SCN10A; (+) strand; PAM type: YTN; PAM sequence: TTG
gttgcatatttgacagcagt

SEQ ID NO: 67626 - DNA, 20 bp, Artificial Sequence
  Description of Artificial Sequence: Synthetic oligonucleotide
  Target: SCN10A; (+) strand; PAM type: YTN; PAM sequence: TTG
catatttgacagcagtgtct

SEQ ID NO: 67627 - DNA, 20 bp, Artificial Sequence
  Description of Artificial Sequence: Synthetic oligonucleotide
  Target: SCN10A; (+) strand; PAM type: YTN; PAM sequence: TTT
gacagcagtgtctccttggc

SEQ ID NO: 67628 - DNA, 20 bp, Artificial Sequence
  Description of Artificial Sequence: Synthetic oligonucleotide
  Target: SCN10A; (+) strand; PAM type: YTN; PAM sequence: TTG
acagcagtgtctccttggcc

SEQ ID NO: 67629 - DNA, 20 bp, Artificial Sequence
  Description of Artificial Sequence: Synthetic oligonucleotide
  Target: SCN10A; (+) strand; PAM type: YTN; PAM sequence: CTC
cttggccacgagttatttta

SEQ ID NO: 67630 - DNA, 20 bp, Artificial Sequence
  Description of Artificial Sequence: Synthetic oligonucleotide
  Target: SCN10A; (+) strand; PAM type: YTN; PAM sequence: CTT
ggccacgagttattttagaa

SEQ ID NO: 67631 - DNA, 20 bp, Artificial Sequence
  Description of Artificial Sequence: Synthetic oligonucleotide
  Target: SCN10A; (+) strand; PAM type: YTN; PAM sequence: TTG
gccacgagttattttagaat

SEQ ID NO: 67632 - DNA, 20 bp, Artificial Sequence
  Description of Artificial Sequence: Synthetic oligonucleotide
  Target: SCN10A; (+) strand; PAM type: YTN; PAM sequence: TTA
ttttagaattaaggttttga

SEQ ID NO: 67633 - DNA, 20 bp, Artificial Sequence
  Description of Artificial Sequence: Synthetic oligonucleotide
  Target: SCN10A; (+) strand; PAM type: YTN; PAM sequence: TTT
tagaattaaggttttgacaa

SEQ ID NO: 67634 - DNA, 20 bp, Artificial Sequence
  Description of Artificial Sequence: Synthetic oligonucleotide
  Target: SCN10A; (+) strand; PAM type: YTN; PAM sequence: TTT
agaattaaggttttgacaaa

SEQ ID NO: 67635 - DNA, 20 bp, Artificial Sequence
  Description of Artificial Sequence: Synthetic oligonucleotide
  Target: SCN10A; (+) strand; PAM type: YTN; PAM sequence: TTA
gaattaaggttttgacaaat

SEQ ID NO: 67636 - DNA, 20 bp, Artificial Sequence
  Description of Artificial Sequence: Synthetic oligonucleotide
  Target: SCN10A; (+) strand; PAM type: YTN; PAM sequence: TTA
aggttttgacaaatggtggg

SEQ ID NO: 67637 - DNA, 20 bp, Artificial Sequence
  Description of Artificial Sequence: Synthetic oligonucleotide
  Target: SCN10A; (+) strand; PAM type: YTN; PAM sequence: TTT
tgacaaatggtgggcaatgt

SEQ ID NO: 67638 - DNA, 20 bp, Artificial Sequence
  Description of Artificial Sequence: Synthetic oligonucleotide
  Target: SCN10A; (+) strand; PAM type: YTN; PAM sequence: TTT
gacaaatggtgggcaatgtc

SEQ ID NO: 67639 - DNA, 20 bp, Artificial Sequence
  Description of Artificial Sequence: Synthetic oligonucleotide
  Target: SCN10A; (+) strand; PAM type: YTN; PAM sequence: TTG
acaaatggtgggcaatgtct

SEQ ID NO: 67640 - DNA, 20 bp, Artificial Sequence
  Description of Artificial Sequence: Synthetic oligonucleotide
  Target: SCN10A; (+) strand; PAM type: YTN; PAM sequence: CTT
ctgagtataagcattagaat

SEQ ID NO: 67641 - DNA, 20 bp, Artificial Sequence
  Description of Artificial Sequence: Synthetic oligonucleotide
  Target: SCN10A; (+) strand; PAM type: YTN; PAM sequence: TTC
tgagtataagcattagaatt

SEQ ID NO: 67642 - DNA, 20 bp, Artificial Sequence
  Description of Artificial Sequence: Synthetic oligonucleotide
  Target: SCN10A; (+) strand; PAM type: YTN; PAM sequence: CTG
agtataagcattagaattgc

SEQ ID NO: 67643 - DNA, 20 bp, Artificial Sequence
  Description of Artificial Sequence: Synthetic oligonucleotide
  Target: SCN10A; (+) strand; PAM type: YTN; PAM sequence: TTA
gaattgctttaaaattcatc

SEQ ID NO: 67644 - DNA, 20 bp, Artificial Sequence
  Description of Artificial Sequence: Synthetic oligonucleotide
  Target: SCN10A; (+) strand; PAM type: YTN; PAM sequence: TTG
ctttaaaattcatcctctaa

SEQ ID NO: 67645 - DNA, 20 bp, Artificial Sequence
  Description of Artificial Sequence: Synthetic oligonucleotide
  Target: SCN10A; (+) strand; PAM type: YTN; PAM sequence: CTT
taaaattcatcctctaacga

SEQ ID NO: 67646 - DNA, 20 bp, Artificial Sequence
  Description of Artificial Sequence: Synthetic oligonucleotide
  Target: SCN10A; (+) strand; PAM type: YTN; PAM sequence: TTT
aaaattcatcctctaacgag

SEQ ID NO: 67647 - DNA, 20 bp, Artificial Sequence
  Description of Artificial Sequence: Synthetic oligonucleotide
  Target: SCN10A; (+) strand; PAM type: YTN; PAM sequence: TTA
aaattcatcctctaacgaga

SEQ ID NO: 67648 - DNA, 20 bp, Artificial Sequence
  Description of Artificial Sequence: Synthetic oligonucleotide
  Target: SCN10A; (+) strand; PAM type: YTN; PAM sequence: TTC
atcctctaacgagaccaact

SEQ ID NO: 67649 - DNA, 20 bp, Artificial Sequence
  Description of Artificial Sequence: Synthetic oligonucleotide
  Target: SCN10A; (+) strand; PAM type: YTN; PAM sequence: CTC
taacgagaccaactggtctg

SEQ ID NO: 67650 - DNA, 20 bp, Artificial Sequence
  Description of Artificial Sequence: Synthetic oligonucleotide
  Target: SCN10A; (+) strand; PAM type: YTN; PAM sequence: CTA
acgagaccaactggtctgtg

SEQ ID NO: 67651 - DNA, 20 bp, Artificial Sequence
  Description of Artificial Sequence: Synthetic oligonucleotide
  Target: SCN10A; (+) strand; PAM type: YTN; PAM sequence: CTG
gtctgtgattttccacaaaa

SEQ ID NO: 67652 - DNA, 20 bp, Artificial Sequence
  Description of Artificial Sequence: Synthetic oligonucleotide
  Target: SCN10A; (+) strand; PAM type: YTN; PAM sequence: CTG
tgattttccacaaaaaccct

SEQ ID NO: 67653 - DNA, 20 bp, Artificial Sequence
  Description of Artificial Sequence: Synthetic oligonucleotide
  Target: SCN10A; (+) strand; PAM type: YTN; PAM sequence: TTT
tccacaaaaaccctcctggg

SEQ ID NO: 67654 - DNA, 20 bp, Artificial Sequence
  Description of Artificial Sequence: Synthetic oligonucleotide
  Target: SCN10A; (+) strand; PAM type: YTN; PAM sequence: TTT
ccacaaaaaccctcctgggt

SEQ ID NO: 67655 - DNA, 20 bp, Artificial Sequence
  Description of Artificial Sequence: Synthetic oligonucleotide
  Target: SCN10A; (+) strand; PAM type: YTN; PAM sequence: TTC
cacaaaaaccctcctgggtc

SEQ ID NO: 67656 - DNA, 20 bp, Artificial Sequence
  Description of Artificial Sequence: Synthetic oligonucleotide
  Target: SCN10A; (+) strand; PAM type: YTN; PAM sequence: CTC
ctgggtctcttctatatatt

SEQ ID NO: 67657 - DNA, 20 bp, Artificial Sequence
  Description of Artificial Sequence: Synthetic oligonucleotide
  Target: SCN10A; (+) strand; PAM type: YTN; PAM sequence: CTG
ggtctcttctatatattcct

SEQ ID NO: 67658 - DNA, 20 bp, Artificial Sequence
  Description of Artificial Sequence: Synthetic oligonucleotide
  Target: SCN10A; (+) strand; PAM type: YTN; PAM sequence: CTC
ttctatatattcctctattt

SEQ ID NO: 67659 - DNA, 20 bp, Artificial Sequence
  Description of Artificial Sequence: Synthetic oligonucleotide
  Target: SCN10A; (+) strand; PAM type: YTN; PAM sequence: CTT
ctatatattcctctatttaa

SEQ ID NO: 67660 - DNA, 20 bp, Artificial Sequence
  Description of Artificial Sequence: Synthetic oligonucleotide
  Target: SCN10A; (+) strand; PAM type: YTN; PAM sequence: TTC
tatatattcctctatttaat

SEQ ID NO: 67661 - DNA, 20 bp, Artificial Sequence
  Description of Artificial Sequence: Synthetic oligonucleotide
  Target: SCN10A; (+) strand; PAM type: YTN; PAM sequence: CTA
tatattcctctatttaattt

SEQ ID NO: 67662 - DNA, 20 bp, Artificial Sequence
  Description of Artificial Sequence: Synthetic oligonucleotide
  Target: SCN10A; (+) strand; PAM type: YTN; PAM sequence: TTC
ctctatttaatttctattgg

SEQ ID NO: 67663 - DNA, 20 bp, Artificial Sequence
  Description of Artificial Sequence: Synthetic oligonucleotide
  Target: SCN10A; (+) strand; PAM type: YTN; PAM sequence: CTC
tatttaatttctattggtta

SEQ ID NO: 67664 - DNA, 20 bp, Artificial Sequence
  Description of Artificial Sequence: Synthetic oligonucleotide
  Target: SCN10A; (+) strand; PAM type: YTN; PAM sequence: CTA
tttaatttctattggttata

SEQ ID NO: 67665 - DNA, 20 bp, Artificial Sequence
  Description of Artificial Sequence: Synthetic oligonucleotide
  Target: SCN10A; (+) strand; PAM type: YTN; PAM sequence: TTT
aatttctattggttataaaa

SEQ ID NO: 67666 - DNA, 20 bp, Artificial Sequence
  Description of Artificial Sequence: Synthetic oligonucleotide
  Target: SCN10A; (+) strand; PAM type: YTN; PAM sequence: TTA
atttctattggttataaaat

SEQ ID NO: 67667 - DNA, 20 bp, Artificial Sequence
  Description of Artificial Sequence: Synthetic oligonucleotide
  Target: SCN10A; (+) strand; PAM type: YTN; PAM sequence: TTT
ctattggttataaaatggct

SEQ ID NO: 67668 - DNA, 20 bp, Artificial Sequence
  Description of Artificial Sequence: Synthetic oligonucleotide
  Target: SCN10A; (+) strand; PAM type: YTN; PAM sequence: TTC
tattggttataaaatggctt

SEQ ID NO: 67669 - DNA, 20 bp, Artificial Sequence
  Description of Artificial Sequence: Synthetic oligonucleotide
  Target: SCN10A; (+) strand; PAM type: YTN; PAM sequence: CTA
ttggttataaaatggcttta

SEQ ID NO: 67670 - DNA, 20 bp, Artificial Sequence
  Description of Artificial Sequence: Synthetic oligonucleotide
  Target: SCN10A; (+) strand; PAM type: YTN; PAM sequence: TTG
gttataaaatggctttagat

SEQ ID NO: 67671 - DNA, 20 bp, Artificial Sequence
  Description of Artificial Sequence: Synthetic oligonucleotide
  Target: SCN10A; (+) strand; PAM type: YTN; PAM sequence: TTA
taaaatggctttagataaaa

SEQ ID NO: 67672 - DNA, 20 bp, Artificial Sequence
  Description of Artificial Sequence: Synthetic oligonucleotide
  Target: SCN10A; (+) strand; PAM type: YTN; PAM sequence: CTT
tagataaaaactgcattagg

SEQ ID NO: 67673 - DNA, 20 bp, Artificial Sequence
  Description of Artificial Sequence: Synthetic oligonucleotide
  Target: SCN10A; (+) strand; PAM type: YTN; PAM sequence: TTT
agataaaaactgcattaggt

SEQ ID NO: 67674 - DNA, 20 bp, Artificial Sequence
  Description of Artificial Sequence: Synthetic oligonucleotide
  Target: SCN10A; (+) strand; PAM type: YTN; PAM sequence: TTA
gataaaaactgcattaggtc

SEQ ID NO: 67675 - DNA, 20 bp, Artificial Sequence
  Description of Artificial Sequence: Synthetic oligonucleotide
  Target: SCN10A; (+) strand; PAM type: YTN; PAM sequence: CTG
cattaggtctatttaccaca

SEQ ID NO: 67676 - DNA, 20 bp, Artificial Sequence
  Description of Artificial Sequence: Synthetic oligonucleotide
  Target: SCN10A; (+) strand; PAM type: YTN; PAM sequence: TTA
ggtctatttaccacatgaat

SEQ ID NO: 67677 - DNA, 20 bp, Artificial Sequence
  Description of Artificial Sequence: Synthetic oligonucleotide
  Target: SCN10A; (+) strand; PAM type: YTN; PAM sequence: CTA
tttaccacatgaatgtacct

SEQ ID NO: 67678 - DNA, 20 bp, Artificial Sequence
  Description of Artificial Sequence: Synthetic oligonucleotide
  Target: SCN10A; (+) strand; PAM type: YTN; PAM sequence: TTT
accacatgaatgtacctggg

SEQ ID NO: 67679 - DNA, 20 bp, Artificial Sequence
  Description of Artificial Sequence: Synthetic oligonucleotide
  Target: SCN10A; (+) strand; PAM type: YTN; PAM sequence: TTA
ccacatgaatgtacctggga

SEQ ID NO: 67680 - DNA, 20 bp, Artificial Sequence
  Description of Artificial Sequence: Synthetic oligonucleotide
  Target: SCN10A; (+) strand; PAM type: YTN; PAM sequence: CTG
ggaaaagagggagaggatgc

SEQ ID NO: 67681 - DNA, 20 bp, Artificial Sequence
  Description of Artificial Sequence: Synthetic oligonucleotide
  Target: SCN10A; (+) strand; PAM type: YTN; PAM sequence: CTT
cctgagtgggctccaataaa

SEQ ID NO: 67682 - DNA, 20 bp, Artificial Sequence
  Description of Artificial Sequence: Synthetic oligonucleotide
  Target: SCN10A; (+) strand; PAM type: YTN; PAM sequence: TTC
ctgagtgggctccaataaat

SEQ ID NO: 67683 - DNA, 20 bp, Artificial Sequence
  Description of Artificial Sequence: Synthetic oligonucleotide
  Target: SCN10A; (+) strand; PAM type: YTN; PAM sequence: CTG
agtgggctccaataaatcaa

SEQ ID NO: 67684 - DNA, 20 bp, Artificial Sequence
  Description of Artificial Sequence: Synthetic oligonucleotide
  Target: SCN10A; (+) strand; PAM type: YTN; PAM sequence: CTC
caataaatcaattagcatta

SEQ ID NO: 67685 - DNA, 20 bp, Artificial Sequence
  Description of Artificial Sequence: Synthetic oligonucleotide
  Target: SCN10A; (+) strand; PAM type: YTN; PAM sequence: TTA
gcattaaagaagtacttaaa

SEQ ID NO: 67686 - DNA, 20 bp, Artificial Sequence
  Description of Artificial Sequence: Synthetic oligonucleotide
  Target: SCN10A; (+) strand; PAM type: YTN; PAM sequence: TTA
aagaagtacttaaatggtgc

SEQ ID NO: 67687 - DNA, 20 bp, Artificial Sequence
  Description of Artificial Sequence: Synthetic oligonucleotide
  Target: SCN10A; (+) strand; PAM type: YTN; PAM sequence: CTT
aaatggtgcctccctgtctt

SEQ ID NO: 67688 - DNA, 20 bp, Artificial Sequence
  Description of Artificial Sequence: Synthetic oligonucleotide
  Target: SCN10A; (+) strand; PAM type: YTN; PAM sequence: TTA
aatggtgcctccctgtcttt

SEQ ID NO: 67689 - DNA, 20 bp, Artificial Sequence
  Description of Artificial Sequence: Synthetic oligonucleotide
  Target: SCN10A; (+) strand; PAM type: YTN; PAM sequence: CTC
cctgtctttgcacatacatg

SEQ ID NO: 67690 - DNA, 20 bp, Artificial Sequence
  Description of Artificial Sequence: Synthetic oligonucleotide
  Target: SCN10A; (+) strand; PAM type: YTN; PAM sequence: CTG
tctttgcacatacatgttgt

SEQ ID NO: 67691 - DNA, 20 bp, Artificial Sequence
  Description of Artificial Sequence: Synthetic oligonucleotide
  Target: SCN10A; (+) strand; PAM type: YTN; PAM sequence: CTT
tgcacatacatgttgttctt

SEQ ID NO: 67692 - DNA, 20 bp, Artificial Sequence
  Description of Artificial Sequence: Synthetic oligonucleotide
  Target: SCN10A; (+) strand; PAM type: YTN; PAM sequence: TTT
gcacatacatgttgttcttt

SEQ ID NO: 67693 - DNA, 20 bp, Artificial Sequence
  Description of Artificial Sequence: Synthetic oligonucleotide
  Target: SCN10A; (+) strand; PAM type: YTN; PAM sequence: TTG
cacatacatgttgttctttc

SEQ ID NO: 67694 - DNA, 20 bp, Artificial Sequence
  Description of Artificial Sequence: Synthetic oligonucleotide
  Target: SCN10A; (+) strand; PAM type: YTN; PAM sequence: TTG
ttctttctgccaggaaaata

SEQ ID NO: 67695 - DNA, 20 bp, Artificial Sequence
  Description of Artificial Sequence: Synthetic oligonucleotide
  Target: SCN10A; (+) strand; PAM type: YTN; PAM sequence: TTC
tttctgccaggaaaatactc

SEQ ID NO: 67696 - DNA, 20 bp, Artificial Sequence
  Description of Artificial Sequence: Synthetic oligonucleotide
  Target: SCN10A; (+) strand; PAM type: YTN; PAM sequence: CTT
tctgccaggaaaatactcct

SEQ ID NO: 67697 - DNA, 20 bp, Artificial Sequence
  Description of Artificial Sequence: Synthetic oligonucleotide
  Target: SCN10A; (+) strand; PAM type: YTN; PAM sequence: TTT
ctgccaggaaaatactcctc

SEQ ID NO: 67698 - DNA, 20 bp, Artificial Sequence
  Description of Artificial Sequence: Synthetic oligonucleotide
  Target: SCN10A; (+) strand; PAM type: YTN; PAM sequence: TTC
tgccaggaaaatactcctcc

SEQ ID NO: 67699 - DNA, 20 bp, Artificial Sequence
  Description of Artificial Sequence: Synthetic oligonucleotide
  Target: SCN10A; (+) strand; PAM type: YTN; PAM sequence: CTG
ccaggaaaatactcctcccc

SEQ ID NO: 67700 - DNA, 20 bp, Artificial Sequence
  Description of Artificial Sequence: Synthetic oligonucleotide
  Target: SCN10A; (+) strand; PAM type: YTN; PAM sequence: CTC
ctccccaaactctctcaagt

SEQ ID NO: 67701 - DNA, 20 bp, Artificial Sequence
  Description of Artificial Sequence: Synthetic oligonucleotide
  Target: SCN10A; (+) strand; PAM type: YTN; PAM sequence: CTC
cccaaactctctcaagtctt

SEQ ID NO: 67702 - DNA, 20 bp, Artificial Sequence
  Description of Artificial Sequence: Synthetic oligonucleotide
  Target: SCN10A; (+) strand; PAM type: YTN; PAM sequence: CTC
tctcaagtcttcaattacta

SEQ ID NO: 67703 - DNA, 20 bp, Artificial Sequence
  Description of Artificial Sequence: Synthetic oligonucleotide
  Target: SCN10A; (+) strand; PAM type: YTN; PAM sequence: CTC
tcaagtcttcaattactaga

SEQ ID NO: 67704 - DNA, 20 bp, Artificial Sequence
  Description of Artificial Sequence: Synthetic oligonucleotide
  Target: SCN10A; (+) strand; PAM type: YTN; PAM sequence: CTC
aagtcttcaattactagaag

SEQ ID NO: 67705 - DNA, 20 bp, Artificial Sequence
  Description of Artificial Sequence: Synthetic oligonucleotide
  Target: SCN10A; (+) strand; PAM type: YTN; PAM sequence: CTT
caattactagaagaacccct

SEQ ID NO: 67706 - DNA, 20 bp, Artificial Sequence
  Description of Artificial Sequence: Synthetic oligonucleotide
  Target: SCN10A; (+) strand; PAM type: YTN; PAM sequence: TTC
aattactagaagaaccccta

SEQ ID NO: 67707 - DNA, 20 bp, Artificial Sequence
  Description of Artificial Sequence: Synthetic oligonucleotide
  Target: SCN10A; (+) strand; PAM type: YTN; PAM sequence: TTA
ctagaagaacccctacatgc

SEQ ID NO: 67708 - DNA, 20 bp, Artificial Sequence
  Description of Artificial Sequence: Synthetic oligonucleotide
  Target: SCN10A; (+) strand; PAM type: YTN; PAM sequence: CTA
gaagaacccctacatgctat

SEQ ID NO: 67709 - DNA, 20 bp, Artificial Sequence
  Description of Artificial Sequence: Synthetic oligonucleotide
  Target: SCN10A; (+) strand; PAM type: YTN; PAM sequence: CTA
catgctatttattgttgatc

SEQ ID NO: 67710 - DNA, 20 bp, Artificial Sequence
  Description of Artificial Sequence: Synthetic oligonucleotide
  Target: SCN10A; (+) strand; PAM type: YTN; PAM sequence: CTA
tttattgttgatcccaatta

SEQ ID NO: 67711 - DNA, 20 bp, Artificial Sequence
  Description of Artificial Sequence: Synthetic oligonucleotide
  Target: SCN10A; (+) strand; PAM type: YTN; PAM sequence: TTT
attgttgatcccaattatgc

SEQ ID NO: 67712 - DNA, 20 bp, Artificial Sequence
  Description of Artificial Sequence: Synthetic oligonucleotide
  Target: SCN10A; (+) strand; PAM type: YTN; PAM sequence: TTA
ttgttgatcccaattatgcc

SEQ ID NO: 67713 - DNA, 20 bp, Artificial Sequence
  Description of Artificial Sequence: Synthetic oligonucleotide
  Target: SCN10A; (+) strand; PAM type: YTN; PAM sequence: TTG
ttgatcccaattatgccttc

SEQ ID NO: 67714 - DNA, 20 bp, Artificial Sequence
  Description of Artificial Sequence: Synthetic oligonucleotide
  Target: SCN10A; (+) strand; PAM type: YTN; PAM sequence: TTG
atcccaattatgccttcctc

SEQ ID NO: 67715 - DNA, 20 bp, Artificial Sequence
  Description of Artificial Sequence: Synthetic oligonucleotide
  Target: SCN10A; (+) strand; PAM type: YTN; PAM sequence: TTA
tgccttcctccaggaagcct

SEQ ID NO: 67716 - DNA, 20 bp, Artificial Sequence
  Description of Artificial Sequence: Synthetic oligonucleotide
  Target: SCN10A; (+) strand; PAM type: YTN; PAM sequence: CTT
cctccaggaagccttttctg

SEQ ID NO: 67717 - DNA, 20 bp, Artificial Sequence
  Description of Artificial Sequence: Synthetic oligonucleotide
  Target: SCN10A; (+) strand; PAM type: YTN; PAM sequence: TTC
ctccaggaagccttttctga

SEQ ID NO: 67718 - DNA, 20 bp, Artificial Sequence
  Description of Artificial Sequence: Synthetic oligonucleotide
  Target: SCN10A; (+) strand; PAM type: YTN; PAM sequence: CTC
caggaagccttttctgatac

SEQ ID NO: 67719 - DNA, 20 bp, Artificial Sequence
  Description of Artificial Sequence: Synthetic oligonucleotide
  Target: SCN10A; (+) strand; PAM type: YTN; PAM sequence: CTT
ttctgatacctatccagccc

SEQ ID NO: 67720 - DNA, 20 bp, Artificial Sequence
  Description of Artificial Sequence: Synthetic oligonucleotide
  Target: SCN10A; (+) strand; PAM type: YTN; PAM sequence: TTT
tctgatacctatccagcccc

SEQ ID NO: 67721 - DNA, 20 bp, Artificial Sequence
  Description of Artificial Sequence: Synthetic oligonucleotide
  Target: SCN10A; (+) strand; PAM type: YTN; PAM sequence: TTT
ctgatacctatccagcccca

SEQ ID NO: 67722 - DNA, 20 bp, Artificial Sequence
  Description of Artificial Sequence: Synthetic oligonucleotide
  Target: SCN10A; (+) strand; PAM type: YTN; PAM sequence: TTC
tgatacctatccagccccat

SEQ ID NO: 67723 - DNA, 20 bp, Artificial Sequence
  Description of Artificial Sequence: Synthetic oligonucleotide
  Target: SCN10A; (+) strand; PAM type: YTN; PAM sequence: CTG
atacctatccagccccataa

SEQ ID NO: 67724 - DNA, 20 bp, Artificial Sequence
  Description of Artificial Sequence: Synthetic oligonucleotide
  Target: SCN10A; (+) strand; PAM type: YTN; PAM sequence: CTA
tccagccccataagagtgga

SEQ ID NO: 67725 - DNA, 20 bp, Artificial Sequence
  Description of Artificial Sequence: Synthetic oligonucleotide
  Target: SCN10A; (+) strand; PAM type: YTN; PAM sequence: TTT
cttccctgattctcaaaaca

SEQ ID NO: 67726 - DNA, 20 bp, Artificial Sequence
  Description of Artificial Sequence: Synthetic oligonucleotide
  Target: SCN10A; (+) strand; PAM type: YTN; PAM sequence: TTC
ttccctgattctcaaaacac

SEQ ID NO: 67727 - DNA, 20 bp, Artificial Sequence
  Description of Artificial Sequence: Synthetic oligonucleotide
  Target: SCN10A; (+) strand; PAM type: YTN; PAM sequence: CTT
ccctgattctcaaaacacca

SEQ ID NO: 67728 - DNA, 20 bp, Artificial Sequence
  Description of Artificial Sequence: Synthetic oligonucleotide
  Target: SCN10A; (+) strand; PAM type: YTN; PAM sequence: TTC
cctgattctcaaaacaccat

SEQ ID NO: 67729 - DNA, 20 bp, Artificial Sequence
  Description of Artificial Sequence: Synthetic oligonucleotide
  Target: SCN10A; (+) strand; PAM type: YTN; PAM sequence: CTG
attctcaaaacaccatgtat

SEQ ID NO: 67730 - DNA, 20 bp, Artificial Sequence
  Description of Artificial Sequence: Synthetic oligonucleotide
  Target: SCN10A; (+) strand; PAM type: YTN; PAM sequence: TTC
tcaaaacaccatgtatgtgt

SEQ ID NO: 67731 - DNA, 20 bp, Artificial Sequence
  Description of Artificial Sequence: Synthetic oligonucleotide
  Target: SCN10A; (+) strand; PAM type: YTN; PAM sequence: CTC
aaaacaccatgtatgtgtct

SEQ ID NO: 67732 - DNA, 20 bp, Artificial Sequence
  Description of Artificial Sequence: Synthetic oligonucleotide
  Target: SCN10A; (+) strand; PAM type: YTN; PAM sequence: CTC
taatacactatttaacacat

SEQ ID NO: 67733 - DNA, 20 bp, Artificial Sequence
  Description of Artificial Sequence: Synthetic oligonucleotide
  Target: SCN10A; (+) strand; PAM type: YTN; PAM sequence: CTA
atacactatttaacacatag

SEQ ID NO: 67734 - DNA, 20 bp, Artificial Sequence
  Description of Artificial Sequence: Synthetic oligonucleotide
  Target: SCN10A; (+) strand; PAM type: YTN; PAM sequence: CTA
tttaacacatagctgtgttt

SEQ ID NO: 67735 - DNA, 20 bp, Artificial Sequence
  Description of Artificial Sequence: Synthetic oligonucleotide
  Target: SCN10A; (+) strand; PAM type: YTN; PAM sequence: TTT
aacacatagctgtgtttata

SEQ ID NO: 67736 - DNA, 20 bp, Artificial Sequence
  Description of Artificial Sequence: Synthetic oligonucleotide
  Target: SCN10A; (+) strand; PAM type: YTN; PAM sequence: TTA
acacatagctgtgtttatat

SEQ ID NO: 67737 - DNA, 20 bp, Artificial Sequence
  Description of Artificial Sequence: Synthetic oligonucleotide
  Target: SCN10A; (+) strand; PAM type: YTN; PAM sequence: CTG
tgtttatatctgcctcctcc

SEQ ID NO: 67738 - DNA, 20 bp, Artificial Sequence
  Description of Artificial Sequence: Synthetic oligonucleotide
  Target: SCN10A; (+) strand; PAM type: YTN; PAM sequence: TTT
atatctgcctcctccaccca

SEQ ID NO: 67739 - DNA, 20 bp, Artificial Sequence
  Description of Artificial Sequence: Synthetic oligonucleotide
  Target: SCN10A; (+) strand; PAM type: YTN; PAM sequence: TTA
tatctgcctcctccacccaa

SEQ ID NO: 67740 - DNA, 20 bp, Artificial Sequence
  Description of Artificial Sequence: Synthetic oligonucleotide
  Target: SCN10A; (+) strand; PAM type: YTN; PAM sequence: CTG
cctcctccacccaaatggaa

SEQ ID NO: 67741 - DNA, 20 bp, Artificial Sequence
  Description of Artificial Sequence: Synthetic oligonucleotide
  Target: SCN10A; (+) strand; PAM type: YTN; PAM sequence: CTC
ctccacccaaatggaaatcc

SEQ ID NO: 67742 - DNA, 20 bp, Artificial Sequence
  Description of Artificial Sequence: Synthetic oligonucleotide
  Target: SCN10A; (+) strand; PAM type: YTN; PAM sequence: CTC
cacccaaatggaaatcctta

SEQ ID NO: 67743 - DNA, 20 bp, Artificial Sequence
  Description of Artificial Sequence: Synthetic oligonucleotide
  Target: SCN10A; (+) strand; PAM type: YTN; PAM sequence: CTT
agggaaaagaacatgttcta

SEQ ID NO: 67744 - DNA, 20 bp, Artificial Sequence
  Description of Artificial Sequence: Synthetic oligonucleotide
  Target: SCN10A; (+) strand; PAM type: YTN; PAM sequence: TTA
gggaaaagaacatgttctag

SEQ ID NO: 67745 - DNA, 20 bp, Artificial Sequence
  Description of Artificial Sequence: Synthetic oligonucleotide
  Target: SCN10A; (+) strand; PAM type: YTN; PAM sequence: TTC
tagtcatctctttataccaa

SEQ ID NO: 67746 - DNA, 20 bp, Artificial Sequence
  Description of Artificial Sequence: Synthetic oligonucleotide
  Target: SCN10A; (+) strand; PAM type: YTN; PAM sequence: CTA
gtcatctctttataccaagc

SEQ ID NO: 67747 - DNA, 20 bp, Artificial Sequence
  Description of Artificial Sequence: Synthetic oligonucleotide
  Target: SCN10A; (+) strand; PAM type: YTN; PAM sequence: CTC
tttataccaagcacctagta

SEQ ID NO: 67748 - DNA, 20 bp, Artificial Sequence
  Description of Artificial Sequence: Synthetic oligonucleotide
  Target: SCN10A; (+) strand; PAM type: YTN; PAM sequence: CTT
tataccaagcacctagtatt

SEQ ID NO: 67749 - DNA, 20 bp, Artificial Sequence
  Description of Artificial Sequence: Synthetic oligonucleotide
  Target: SCN10A; (+) strand; PAM type: YTN; PAM sequence: TTT
ataccaagcacctagtattg

SEQ ID NO: 67750 - DNA, 20 bp, Artificial Sequence
  Description of Artificial Sequence: Synthetic oligonucleotide
  Target: SCN10A; (+) strand; PAM type: YTN; PAM sequence: TTA
taccaagcacctagtattgt

SEQ ID NO: 67751 - DNA, 20 bp, Artificial Sequence
  Description of Artificial Sequence: Synthetic oligonucleotide
  Target: SCN10A; (+) strand; PAM type: YTN; PAM sequence: CTA
gtattgttgaatgaacaagt

SEQ ID NO: 67752 - DNA, 20 bp, Artificial Sequence
  Description of Artificial Sequence: Synthetic oligonucleotide
  Target: SCN10A; (+) strand; PAM type: YTN; PAM sequence: TTG
ttgaatgaacaagttacagc

SEQ ID NO: 67753 - DNA, 20 bp, Artificial Sequence
  Description of Artificial Sequence: Synthetic oligonucleotide
  Target: SCN10A; (+) strand; PAM type: YTN; PAM sequence: TTG
aatgaacaagttacagctcc

SEQ ID NO: 67754 - DNA, 20 bp, Artificial Sequence
  Description of Artificial Sequence: Synthetic oligonucleotide
  Target: SCN10A; (+) strand; PAM type: YTN; PAM sequence: TTA
cagctcctcttttttccctt

SEQ ID NO: 67755 - DNA, 20 bp, Artificial Sequence
  Description of Artificial Sequence: Synthetic oligonucleotide
  Target: SCN10A; (+) strand; PAM type: YTN; PAM sequence: CTC
ctcttttttccctttgaaag

SEQ ID NO: 67756 - DNA, 20 bp, Artificial Sequence
  Description of Artificial Sequence: Synthetic oligonucleotide
  Target: SCN10A; (+) strand; PAM type: YTN; PAM sequence: CTC
ttttttccctttgaaagtaa

SEQ ID NO: 67757 - DNA, 20 bp, Artificial Sequence
  Description of Artificial Sequence: Synthetic oligonucleotide
  Target: SCN10A; (+) strand; PAM type: YTN; PAM sequence: CTT
ttttccctttgaaagtaagc

SEQ ID NO: 67758 - DNA, 20 bp, Artificial Sequence
  Description of Artificial Sequence: Synthetic oligonucleotide
  Target: SCN10A; (+) strand; PAM type: YTN; PAM sequence: TTT
tttccctttgaaagtaagca

SEQ ID NO: 67759 - DNA, 20 bp, Artificial Sequence
  Description of Artificial Sequence: Synthetic oligonucleotide
  Target: SCN10A; (+) strand; PAM type: YTN; PAM sequence: TTT
ttccctttgaaagtaagcat

SEQ ID NO: 67760 - DNA, 20 bp, Artificial Sequence
  Description of Artificial Sequence: Synthetic oligonucleotide
  Target: SCN10A; (+) strand; PAM type: YTN; PAM sequence: TTT
tccctttgaaagtaagcatc

SEQ ID NO: 67761 - DNA, 20 bp, Artificial Sequence
  Description of Artificial Sequence: Synthetic oligonucleotide
  Target: SCN10A; (+) strand; PAM type: YTN; PAM sequence: TTT
ccctttgaaagtaagcatca

SEQ ID NO: 67762 - DNA, 20 bp, Artificial Sequence
  Description of Artificial Sequence: Synthetic oligonucleotide
  Target: SCN10A; (+) strand; PAM type: YTN; PAM sequence: TTC
cctttgaaagtaagcatcac

SEQ ID NO: 67763 - DNA, 20 bp, Artificial Sequence
  Description of Artificial Sequence: Synthetic oligonucleotide
  Target: SCN10A; (+) strand; PAM type: YTN; PAM sequence: CTT
tgaaagtaagcatcactgga

SEQ ID NO: 67764 - DNA, 20 bp, Artificial Sequence
  Description of Artificial Sequence: Synthetic oligonucleotide
  Target: SCN10A; (+) strand; PAM type: YTN; PAM sequence: TTT
gaaagtaagcatcactggag

SEQ ID NO: 67765 - DNA, 20 bp, Artificial Sequence
  Description of Artificial Sequence: Synthetic oligonucleotide
  Target: SCN10A; (+) strand; PAM type: YTN; PAM sequence: TTG
aaagtaagcatcactggaga

SEQ ID NO: 67766 - DNA, 20 bp, Artificial Sequence
  Description of Artificial Sequence: Synthetic oligonucleotide
  Target: SCN10A; (+) strand; PAM type: YTN; PAM sequence: CTG
gagagacaagcacacatacc

SEQ ID NO: 67767 - DNA, 20 bp, Artificial Sequence
  Description of Artificial Sequence: Synthetic oligonucleotide
  Target: SCN10A; (+) strand; PAM type: YTN; PAM sequence: TTA
ttggacatccaagtgctaat

SEQ ID NO: 67768 - DNA, 20 bp, Artificial Sequence
  Description of Artificial Sequence: Synthetic oligonucleotide
  Target: SCN10A; (+) strand; PAM type: YTN; PAM sequence: TTG
gacatccaagtgctaatctg

SEQ ID NO: 67769 - DNA, 20 bp, Artificial Sequence
  Description of Artificial Sequence: Synthetic oligonucleotide
  Target: SCN10A; (+) strand; PAM type: YTN; PAM sequence: CTA
atctgtgtggggctgacaga

SEQ ID NO: 67770 - DNA, 20 bp, Artificial Sequence
  Description of Artificial Sequence: Synthetic oligonucleotide
  Target: SCN10A; (+) strand; PAM type: YTN; PAM sequence: CTG
tgtggggctgacagaatggg

SEQ ID NO: 67771 - DNA, 20 bp, Artificial Sequence
  Description of Artificial Sequence: Synthetic oligonucleotide
  Target: SCN10A; (+) strand; PAM type: YTN; PAM sequence: CTG
acagaatgggggaaattaaa

SEQ ID NO: 67772 - DNA, 20 bp, Artificial Sequence
  Description of Artificial Sequence: Synthetic oligonucleotide
  Target: SCN10A; (+) strand; PAM type: YTN; PAM sequence: TTA
aagcccaattcagtgtcatt

SEQ ID NO: 67773 - DNA, 20 bp, Artificial Sequence
  Description of Artificial Sequence: Synthetic oligonucleotide
  Target: SCN10A; (+) strand; PAM type: YTN; PAM sequence: TTC
agtgtcattgacatttccat

SEQ ID NO: 67774 - DNA, 20 bp, Artificial Sequence
  Description of Artificial Sequence: Synthetic oligonucleotide
  Target: SCN10A; (+) strand; PAM type: YTN; PAM sequence: TTG
acatttccatggaagctgtg

SEQ ID NO: 67775 - DNA, 20 bp, Artificial Sequence
  Description of Artificial Sequence: Synthetic oligonucleotide
  Target: SCN10A; (+) strand; PAM type: YTN; PAM sequence: TTT
ccatggaagctgtgattcat

SEQ ID NO: 67776 - DNA, 20 bp, Artificial Sequence
  Description of Artificial Sequence: Synthetic oligonucleotide
  Target: SCN10A; (+) strand; PAM type: YTN; PAM sequence: TTC
catggaagctgtgattcatc

SEQ ID NO: 67777 - DNA, 20 bp, Artificial Sequence
  Description of Artificial Sequence: Synthetic oligonucleotide
  Target: SCN10A; (+) strand; PAM type: YTN; PAM sequence: CTG
tgattcatcctgttctgtga

SEQ ID NO: 67778 - DNA, 20 bp, Artificial Sequence
  Description of Artificial Sequence: Synthetic oligonucleotide
  Target: SCN10A; (+) strand; PAM type: YTN; PAM sequence: TTC
atcctgttctgtgattgtct

SEQ ID NO: 67779 - DNA, 20 bp, Artificial Sequence
  Description of Artificial Sequence: Synthetic oligonucleotide
  Target: SCN10A; (+) strand; PAM type: YTN; PAM sequence: CTG
ttctgtgattgtctgaactg

SEQ ID NO: 67780 - DNA, 20 bp, Artificial Sequence
  Description of Artificial Sequence: Synthetic oligonucleotide
  Target: SCN10A; (+) strand; PAM type: YTN; PAM sequence: TTC
tgtgattgtctgaactgtgc

SEQ ID NO: 67781 - DNA, 20 bp, Artificial Sequence
  Description of Artificial Sequence: Synthetic oligonucleotide
  Target: SCN10A; (+) strand; PAM type: YTN; PAM sequence: CTG
tgattgtctgaactgtgccc

SEQ ID NO: 67782 - DNA, 20 bp, Artificial Sequence
  Description of Artificial Sequence: Synthetic oligonucleotide
  Target: SCN10A; (+) strand; PAM type: YTN; PAM sequence: TTG
tctgaactgtgccccatgta

SEQ ID NO: 67783 - DNA, 20 bp, Artificial Sequence
  Description of Artificial Sequence: Synthetic oligonucleotide
  Target: SCN10A; (+) strand; PAM type: YTN; PAM sequence: CTG
aactgtgccccatgtatgcc

SEQ ID NO: 67784 - DNA, 20 bp, Artificial Sequence
  Description of Artificial Sequence: Synthetic oligonucleotide
  Target: SCN10A; (+) strand; PAM type: YTN; PAM sequence: CTG
tgccccatgtatgccaggtg

SEQ ID NO: 67785 - DNA, 20 bp, Artificial Sequence
  Description of Artificial Sequence: Synthetic oligonucleotide
  Target: SCN10A; (+) strand; PAM type: YTN; PAM sequence: CTG
ctcaaaaggggcaaagcaag

SEQ ID NO: 67786 - DNA, 20 bp, Artificial Sequence
  Description of Artificial Sequence: Synthetic oligonucleotide
  Target: SCN10A; (+) strand; PAM type: YTN; PAM sequence: CTC
aaaaggggcaaagcaagaaa

SEQ ID NO: 67787 - DNA, 20 bp, Artificial Sequence
  Description of Artificial Sequence: Synthetic oligonucleotide
  Target: SCN10A; (+) strand; PAM type: YTN; PAM sequence: CTG
aagtgtggatgtgtcatgag

SEQ ID NO: 67788 - DNA, 20 bp, Artificial Sequence
  Description of Artificial Sequence: Synthetic oligonucleotide
  Target: SCN10A; (+) strand; PAM type: YTN; PAM sequence: CTG
tgtttgtatatgcacacata

SEQ ID NO: 67789 - DNA, 20 bp, Artificial Sequence
  Description of Artificial Sequence: Synthetic oligonucleotide
  Target: SCN10A; (+) strand; PAM type: YTN; PAM sequence: TTT
gtatatgcacacataaatct

SEQ ID NO: 67790 - DNA, 20 bp, Artificial Sequence
  Description of Artificial Sequence: Synthetic oligonucleotide
  Target: SCN10A; (+) strand; PAM type: YTN; PAM sequence: TTG
tatatgcacacataaatctg

SEQ ID NO: 67791 - DNA, 20 bp, Artificial Sequence
  Description of Artificial Sequence: Synthetic oligonucleotide
  Target: SCN10A; (+) strand; PAM type: YTN; PAM sequence: CTG
agggttggagagatggtatt

SEQ ID NO: 67792 - DNA, 20 bp, Artificial Sequence
  Description of Artificial Sequence: Synthetic oligonucleotide
  Target: SCN10A; (+) strand; PAM type: YTN; PAM sequence: TTG
gagagatggtattgcaaaaa

SEQ ID NO: 67793 - DNA, 20 bp, Artificial Sequence
  Description of Artificial Sequence: Synthetic oligonucleotide
  Target: SCN10A; (+) strand; PAM type: YTN; PAM sequence: TTG
caaaaaagtaaaatatcctt

SEQ ID NO: 67794 - DNA, 20 bp, Artificial Sequence
  Description of Artificial Sequence: Synthetic oligonucleotide
  Target: SCN10A; (+) strand; PAM type: YTN; PAM sequence: CTT
cggcttagcacaggaaaaga

SEQ ID NO: 67795 - DNA, 20 bp, Artificial Sequence
  Description of Artificial Sequence: Synthetic oligonucleotide
  Target: SCN10A; (+) strand; PAM type: YTN; PAM sequence: TTC
ggcttagcacaggaaaagag

SEQ ID NO: 67796 - DNA, 20 bp, Artificial Sequence
  Description of Artificial Sequence: Synthetic oligonucleotide
  Target: SCN10A; (+) strand; PAM type: YTN; PAM sequence: CTT
agcacaggaaaagagattga

SEQ ID NO: 67797 - DNA, 20 bp, Artificial Sequence
  Description of Artificial Sequence: Synthetic oligonucleotide
  Target: SCN10A; (+) strand; PAM type: YTN; PAM sequence: TTA
gcacaggaaaagagattgag

SEQ ID NO: 67798 - DNA, 20 bp, Artificial Sequence
  Description of Artificial Sequence: Synthetic oligonucleotide
  Target: SCN10A; (+) strand; PAM type: YTN; PAM sequence: TTG
agagggaagtgagaggtata

SEQ ID NO: 67799 - DNA, 20 bp, Artificial Sequence
  Description of Artificial Sequence: Synthetic oligonucleotide
  Target: SCN10A; (+) strand; PAM type: YTN; PAM sequence: TTG
atccccttttccacactgtt

SEQ ID NO: 67800 - DNA, 20 bp, Artificial Sequence
  Description of Artificial Sequence: Synthetic oligonucleotide
  Target: SCN10A; (+) strand; PAM type: YTN; PAM sequence: CTT
ttccacactgttagtgtgga

SEQ ID NO: 67801 - DNA, 20 bp, Artificial Sequence
  Description of Artificial Sequence: Synthetic oligonucleotide
  Target: SCN10A; (+) strand; PAM type: YTN; PAM sequence: TTT
tccacactgttagtgtggag

SEQ ID NO: 67802 - DNA, 20 bp, Artificial Sequence
  Description of Artificial Sequence: Synthetic oligonucleotide
  Target: SCN10A; (+) strand; PAM type: YTN; PAM sequence: TTT
ccacactgttagtgtggagc

SEQ ID NO: 67803 - DNA, 20 bp, Artificial Sequence
  Description of Artificial Sequence: Synthetic oligonucleotide
  Target: SCN10A; (+) strand; PAM type: YTN; PAM sequence: TTC
cacactgttagtgtggagcc

SEQ ID NO: 67804 - DNA, 20 bp, Artificial Sequence
  Description of Artificial Sequence: Synthetic oligonucleotide
  Target: SCN10A; (+) strand; PAM type: YTN; PAM sequence: CTG
ttagtgtggagccaccctcc

SEQ ID NO: 67805 - DNA, 20 bp, Artificial Sequence
  Description of Artificial Sequence: Synthetic oligonucleotide
  Target: SCN10A; (+) strand; PAM type: YTN; PAM sequence: TTA
gtgtggagccaccctcccac

SEQ ID NO: 67806 - DNA, 20 bp, Artificial Sequence
  Description of Artificial Sequence: Synthetic oligonucleotide
  Target: SCN10A; (+) strand; PAM type: YTN; PAM sequence: CTC
ccacacagcagatattatct

SEQ ID NO: 67807 - DNA, 20 bp, Artificial Sequence
  Description of Artificial Sequence: Synthetic oligonucleotide
  Target: SCN10A; (+) strand; PAM type: YTN; PAM sequence: TTA
tctgtcagacctatagaaag

SEQ ID NO: 67808 - DNA, 20 bp, Artificial Sequence
  Description of Artificial Sequence: Synthetic oligonucleotide
  Target: SCN10A; (+) strand; PAM type: YTN; PAM sequence: CTG
tcagacctatagaaagggca

SEQ ID NO: 67809 - DNA, 20 bp, Artificial Sequence
  Description of Artificial Sequence: Synthetic oligonucleotide
  Target: SCN10A; (+) strand; PAM type: YTN; PAM sequence: CTA
tagaaagggcatatttgggg

SEQ ID NO: 67810 - DNA, 20 bp, Artificial Sequence
  Description of Artificial Sequence: Synthetic oligonucleotide
  Target: SCN10A; (+) strand; PAM type: YTN; PAM sequence: TTT
ggggtaaaaggactttcaag

SEQ ID NO: 67811 - DNA, 20 bp, Artificial Sequence
  Description of Artificial Sequence: Synthetic oligonucleotide
  Target: SCN10A; (+) strand; PAM type: YTN; PAM sequence: TTG
gggtaaaaggactttcaagg

SEQ ID NO: 67812 - DNA, 20 bp, Artificial Sequence
  Description of Artificial Sequence: Synthetic oligonucleotide
  Target: SCN10A; (+) strand; PAM type: YTN; PAM sequence: CTT
tcaaggggcaggaaggtggt

SEQ ID NO: 67813 - DNA, 20 bp, Artificial Sequence
  Description of Artificial Sequence: Synthetic oligonucleotide
  Target: SCN10A; (+) strand; PAM type: YTN; PAM sequence: TTT
caaggggcaggaaggtggtg

SEQ ID NO: 67814 - DNA, 20 bp, Artificial Sequence
  Description of Artificial Sequence: Synthetic oligonucleotide
  Target: SCN10A; (+) strand; PAM type: YTN; PAM sequence: TTC
aaggggcaggaaggtggtgg

SEQ ID NO: 67815 - DNA, 20 bp, Artificial Sequence
  Description of Artificial Sequence: Synthetic oligonucleotide
  Target: SCN10A; (+) strand; PAM type: YTN; PAM sequence: TTG
cagtgcaaattttagagtgg

SEQ ID NO: 67816 - DNA, 20 bp, Artificial Sequence
  Description of Artificial Sequence: Synthetic oligonucleotide
  Target: SCN10A; (+) strand; PAM type: YTN; PAM sequence: TTT
tagagtgggaggcagaaagt

SEQ ID NO: 67817 - DNA, 20 bp, Artificial Sequence
  Description of Artificial Sequence: Synthetic oligonucleotide
  Target: SCN10A; (+) strand; PAM type: YTN; PAM sequence: TTT
agagtgggaggcagaaagtt

SEQ ID NO: 67818 - DNA, 20 bp, Artificial Sequence
  Description of Artificial Sequence: Synthetic oligonucleotide
  Target: SCN10A; (+) strand; PAM type: YTN; PAM sequence: TTA
gagtgggaggcagaaagtta

SEQ ID NO: 67819 - DNA, 20 bp, Artificial Sequence
  Description of Artificial Sequence: Synthetic oligonucleotide
  Target: SCN10A; (+) strand; PAM type: YTN; PAM sequence: TTA
ttatggggggaaaagaattg

SEQ ID NO: 67820 - DNA, 20 bp, Artificial Sequence
  Description of Artificial Sequence: Synthetic oligonucleotide
  Target: SCN10A; (+) strand; PAM type: YTN; PAM sequence: TTA
tggggggaaaagaattgcta

SEQ ID NO: 67821 - DNA, 20 bp, Artificial Sequence
  Description of Artificial Sequence: Synthetic oligonucleotide
  Target: SCN10A; (+) strand; PAM type: YTN; PAM sequence: TTG
ctacagggtctgaggtgagg

SEQ ID NO: 67822 - DNA, 20 bp, Artificial Sequence
  Description of Artificial Sequence: Synthetic oligonucleotide
  Target: SCN10A; (+) strand; PAM type: YTN; PAM sequence: CTA
cagggtctgaggtgaggtgc

SEQ ID NO: 67823 - DNA, 20 bp, Artificial Sequence
  Description of Artificial Sequence: Synthetic oligonucleotide
  Target: SCN10A; (+) strand; PAM type: YTN; PAM sequence: CTG
aggtgaggtgctgaagccat

SEQ ID NO: 67824 - DNA, 20 bp, Artificial Sequence
  Description of Artificial Sequence: Synthetic oligonucleotide
  Target: SCN10A; (+) strand; PAM type: YTN; PAM sequence: CTG
aagccattcccaggctggat

SEQ ID NO: 67825 - DNA, 20 bp, Artificial Sequence
  Description of Artificial Sequence: Synthetic oligonucleotide
  Target: SCN10A; (+) strand; PAM type: YTN; PAM sequence: TTC
ccaggctggattgtgtcaca

SEQ ID NO: 67826 - DNA, 20 bp, Artificial Sequence
  Description of Artificial Sequence: Synthetic oligonucleotide
  Target: SCN10A; (+) strand; PAM type: YTN; PAM sequence: CTG
gattgtgtcacagagatggg

SEQ ID NO: 67827 - DNA, 20 bp, Artificial Sequence
  Description of Artificial Sequence: Synthetic oligonucleotide
  Target: SCN10A; (+) strand; PAM type: YTN; PAM sequence: TTG
tgtcacagagatgggtgctg

SEQ ID NO: 67828 - DNA, 20 bp, Artificial Sequence
  Description of Artificial Sequence: Synthetic oligonucleotide
  Target: SCN10A; (+) strand; PAM type: YTN; PAM sequence: CTG
gaaacttttctgataacaac

SEQ ID NO: 67829 - DNA, 20 bp, Artificial Sequence
  Description of Artificial Sequence: Synthetic oligonucleotide
  Target: SCN10A; (+) strand; PAM type: YTN; PAM sequence: CTT
ttctgataacaacaggtgac

SEQ ID NO: 67830 - DNA, 20 bp, Artificial Sequence
  Description of Artificial Sequence: Synthetic oligonucleotide
  Target: SCN10A; (+) strand; PAM type: YTN; PAM sequence: TTT
tctgataacaacaggtgaca

SEQ ID NO: 67831 - DNA, 20 bp, Artificial Sequence
  Description of Artificial Sequence: Synthetic oligonucleotide
  Target: SCN10A; (+) strand; PAM type: YTN; PAM sequence: TTT
ctgataacaacaggtgacag

SEQ ID NO: 67832 - DNA, 20 bp, Artificial Sequence
  Description of Artificial Sequence: Synthetic oligonucleotide
  Target: SCN10A; (+) strand; PAM type: YTN; PAM sequence: TTC
tgataacaacaggtgacagc

SEQ ID NO: 67833 - DNA, 20 bp, Artificial Sequence
  Description of Artificial Sequence: Synthetic oligonucleotide
  Target: SCN10A; (+) strand; PAM type: YTN; PAM sequence: CTG
ataacaacaggtgacagctt

SEQ ID NO: 67834 - DNA, 20 bp, Artificial Sequence
  Description of Artificial Sequence: Synthetic oligonucleotide
  Target: SCN10A; (+) strand; PAM type: YTN; PAM sequence: CTT
gaattgcaggaccttaggaa

SEQ ID NO: 67835 - DNA, 20 bp, Artificial Sequence
  Description of Artificial Sequence: Synthetic oligonucleotide
  Target: SCN10A; (+) strand; PAM type: YTN; PAM sequence: TTG
aattgcaggaccttaggaag

SEQ ID NO: 67836 - DNA, 20 bp, Artificial Sequence
  Description of Artificial Sequence: Synthetic oligonucleotide
  Target: SCN10A; (+) strand; PAM type: YTN; PAM sequence: TTG
caggaccttaggaaggaggt

SEQ ID NO: 67837 - DNA, 20 bp, Artificial Sequence
  Description of Artificial Sequence: Synthetic oligonucleotide
  Target: SCN10A; (+) strand; PAM type: YTN; PAM sequence: CTT
aggaaggaggtcagaaatta

SEQ ID NO: 67838 - DNA, 20 bp, Artificial Sequence
  Description of Artificial Sequence: Synthetic oligonucleotide
  Target: SCN10A; (+) strand; PAM type: YTN; PAM sequence: TTA
ggaaggaggtcagaaattat

SEQ ID NO: 67839 - DNA, 20 bp, Artificial Sequence
  Description of Artificial Sequence: Synthetic oligonucleotide
  Target: SCN10A; (+) strand; PAM type: YTN; PAM sequence: TTA
tacccaataattatataaaa

SEQ ID NO: 67840 - DNA, 20 bp, Artificial Sequence
  Description of Artificial Sequence: Synthetic oligonucleotide
  Target: SCN10A; (+) strand; PAM type: YTN; PAM sequence: TTA
tataaaattgtgaagtgtca

SEQ ID NO: 67841 - DNA, 20 bp, Artificial Sequence
  Description of Artificial Sequence: Synthetic oligonucleotide
  Target: SCN10A; (+) strand; PAM type: YTN; PAM sequence: TTG
tgaagtgtcaattaaaaaaa

SEQ ID NO: 67842 - DNA, 20 bp, Artificial Sequence
  Description of Artificial Sequence: Synthetic oligonucleotide
  Target: SCN10A; (+) strand; PAM type: YTN; PAM sequence: TTA
aaaaaaactaagtaaaaaaa

SEQ ID NO: 67843 - DNA, 20 bp, Artificial Sequence
  Description of Artificial Sequence: Synthetic oligonucleotide
  Target: SCN10A; (+) strand; PAM type: YTN; PAM sequence: CTA
agtaaaaaaataaaaaccac

SEQ ID NO: 67844 - DNA, 20 bp, Artificial Sequence
  Description of Artificial Sequence: Synthetic oligonucleotide
  Target: SCN10A; (+) strand; PAM type: YTN; PAM sequence: CTC
gacgcatcagaaaaaaaaaa

SEQ ID NO: 67845 - DNA, 20 bp, Artificial Sequence
  Description of Artificial Sequence: Synthetic oligonucleotide
  Target: SCN10A; (+) strand; PAM type: YTN; PAM sequence: CTC
agcaccacggacagggaacc

SEQ ID NO: 67846 - DNA, 20 bp, Artificial Sequence
  Description of Artificial Sequence: Synthetic oligonucleotide
  Target: SCN10A; (+) strand; PAM type: YTN; PAM sequence: CTT
gcactctagaactgcagacc

SEQ ID NO: 67847 - DNA, 20 bp, Artificial Sequence
  Description of Artificial Sequence: Synthetic oligonucleotide
  Target: SCN10A; (+) strand; PAM type: YTN; PAM sequence: TTG
cactctagaactgcagacca

SEQ ID NO: 67848 - DNA, 20 bp, Artificial Sequence
  Description of Artificial Sequence: Synthetic oligonucleotide
  Target: SCN10A; (+) strand; PAM type: YTN; PAM sequence: CTC
tagaactgcagaccagagcc

SEQ ID NO: 67849 - DNA, 20 bp, Artificial Sequence
  Description of Artificial Sequence: Synthetic oligonucleotide
  Target: SCN10A; (+) strand; PAM type: YTN; PAM sequence: CTA
gaactgcagaccagagcctc

SEQ ID NO: 67850 - DNA, 20 bp, Artificial Sequence
  Description of Artificial Sequence: Synthetic oligonucleotide
  Target: SCN10A; (+) strand; PAM type: YTN; PAM sequence: CTG
cagaccagagcctcagaagg

SEQ ID NO: 67851 - DNA, 20 bp, Artificial Sequence
  Description of Artificial Sequence: Synthetic oligonucleotide
  Target: SCN10A; (+) strand; PAM type: YTN; PAM sequence: CTC
agaaggaagctgacctttga

SEQ ID NO: 67852 - DNA, 20 bp, Artificial Sequence
  Description of Artificial Sequence: Synthetic oligonucleotide
  Target: SCN10A; (+) strand; PAM type: YTN; PAM sequence: CTG
acctttgatgtccgcagaca

SEQ ID NO: 67853 - DNA, 20 bp, Artificial Sequence
  Description of Artificial Sequence: Synthetic oligonucleotide
  Target: SCN10A; (+) strand; PAM type: YTN; PAM sequence: CTT
tgatgtccgcagacacctta

SEQ ID NO: 67854 - DNA, 20 bp, Artificial Sequence
  Description of Artificial Sequence: Synthetic oligonucleotide
  Target: SCN10A; (+) strand; PAM type: YTN; PAM sequence: TTT
gatgtccgcagacaccttaa

SEQ ID NO: 67855 - DNA, 20 bp, Artificial Sequence
  Description of Artificial Sequence: Synthetic oligonucleotide
  Target: SCN10A; (+) strand; PAM type: YTN; PAM sequence: TTG
atgtccgcagacaccttaag

SEQ ID NO: 67856 - DNA, 20 bp, Artificial Sequence
  Description of Artificial Sequence: Synthetic oligonucleotide
  Target: SCN10A; (+) strand; PAM type: YTN; PAM sequence: CTT
aagattggcatgttcagtat

SEQ ID NO: 67857 - DNA, 20 bp, Artificial Sequence
  Description of Artificial Sequence: Synthetic oligonucleotide
  Target: SCN10A; (+) strand; PAM type: YTN; PAM sequence: TTA
agattggcatgttcagtatg

SEQ ID NO: 67858 - DNA, 20 bp, Artificial Sequence
  Description of Artificial Sequence: Synthetic oligonucleotide
  Target: SCN10A; (+) strand; PAM type: YTN; PAM sequence: TTG
gcatgttcagtatgggcttc

SEQ ID NO: 67859 - DNA, 20 bp, Artificial Sequence
  Description of Artificial Sequence: Synthetic oligonucleotide
  Target: SCN10A; (+) strand; PAM type: YTN; PAM sequence: TTC
agtatgggcttcccaccttt

SEQ ID NO: 67860 - DNA, 20 bp, Artificial Sequence
  Description of Artificial Sequence: Synthetic oligonucleotide
  Target: SCN10A; (+) strand; PAM type: YTN; PAM sequence: CTT
cccacctttcctacaaaccg

SEQ ID NO: 67861 - DNA, 20 bp, Artificial Sequence
  Description of Artificial Sequence: Synthetic oligonucleotide
  Target: SCN10A; (+) strand; PAM type: YTN; PAM sequence: TTC
ccacctttcctacaaaccgg

SEQ ID NO: 67862 - DNA, 20 bp, Artificial Sequence
  Description of Artificial Sequence: Synthetic oligonucleotide
  Target: SCN10A; (+) strand; PAM type: YTN; PAM sequence: CTT
tcctacaaaccggggttctt

SEQ ID NO: 67863 - DNA, 20 bp, Artificial Sequence
  Description of Artificial Sequence: Synthetic oligonucleotide
  Target: SCN10A; (+) strand; PAM type: YTN; PAM sequence: TTT
cctacaaaccggggttcttc

SEQ ID NO: 67864 - DNA, 20 bp, Artificial Sequence
  Description of Artificial Sequence: Synthetic oligonucleotide
  Target: SCN10A; (+) strand; PAM type: YTN; PAM sequence: TTC
ctacaaaccggggttcttcc

SEQ ID NO: 67865 - DNA, 20 bp, Artificial Sequence
  Description of Artificial Sequence: Synthetic oligonucleotide
  Target: SCN10A; (+) strand; PAM type: YTN; PAM sequence: CTA
caaaccggggttcttcctcc

SEQ ID NO: 67866 - DNA, 20 bp, Artificial Sequence
  Description of Artificial Sequence: Synthetic oligonucleotide
  Target: SCN10A; (+) strand; PAM type: YTN; PAM sequence: TTC
ttcctccagtgtcctcatct

SEQ ID NO: 67867 - DNA, 20 bp, Artificial Sequence
  Description of Artificial Sequence: Synthetic oligonucleotide
  Target: SCN10A; (+) strand; PAM type: YTN; PAM sequence: CTT
cctccagtgtcctcatcttg

SEQ ID NO: 67868 - DNA, 20 bp, Artificial Sequence
  Description of Artificial Sequence: Synthetic oligonucleotide
  Target: SCN10A; (+) strand; PAM type: YTN; PAM sequence: TTC
ctccagtgtcctcatcttgg

SEQ ID NO: 67869 - DNA, 20 bp, Artificial Sequence
  Description of Artificial Sequence: Synthetic oligonucleotide
  Target: SCN10A; (+) strand; PAM type: YTN; PAM sequence: CTC
cagtgtcctcatcttggaat

SEQ ID NO: 67870 - DNA, 20 bp, Artificial Sequence
  Description of Artificial Sequence: Synthetic oligonucleotide
  Target: SCN10A; (+) strand; PAM type: YTN; PAM sequence: CTC
atcttggaatcaccacccat

SEQ ID NO: 67871 - DNA, 20 bp, Artificial Sequence
  Description of Artificial Sequence: Synthetic oligonucleotide
  Target: SCN10A; (+) strand; PAM type: YTN; PAM sequence: CTT
ggaatcaccacccatttgat

SEQ ID NO: 67872 - DNA, 20 bp, Artificial Sequence
  Description of Artificial Sequence: Synthetic oligonucleotide
  Target: SCN10A; (+) strand; PAM type: YTN; PAM sequence: TTG
gaatcaccacccatttgatt

SEQ ID NO: 67873 - DNA, 20 bp, Artificial Sequence
  Description of Artificial Sequence: Synthetic oligonucleotide
  Target: SCN10A; (+) strand; PAM type: YTN; PAM sequence: TTT
gattgcccaatcctgaaacc

SEQ ID NO: 67874 - DNA, 20 bp, Artificial Sequence
  Description of Artificial Sequence: Synthetic oligonucleotide
  Target: SCN10A; (+) strand; PAM type: YTN; PAM sequence: TTG
attgcccaatcctgaaacct

SEQ ID NO: 67875 - DNA, 20 bp, Artificial Sequence
  Description of Artificial Sequence: Synthetic oligonucleotide
  Target: SCN10A; (+) strand; PAM type: YTN; PAM sequence: TTG
cccaatcctgaaacctggga

SEQ ID NO: 67876 - DNA, 20 bp, Artificial Sequence
  Description of Artificial Sequence: Synthetic oligonucleotide
  Target: SCN10A; (+) strand; PAM type: YTN; PAM sequence: CTG
aaacctgggagtcaaattgg

SEQ ID NO: 67877 - DNA, 20 bp, Artificial Sequence
  Description of Artificial Sequence: Synthetic oligonucleotide
  Target: SCN10A; (+) strand; PAM type: YTN; PAM sequence: CTG
ggagtcaaattggactcccc

SEQ ID NO: 67878 - DNA, 20 bp, Artificial Sequence
  Description of Artificial Sequence: Synthetic oligonucleotide
  Target: SCN10A; (+) strand; PAM type: YTN; PAM sequence: TTG
gactcccctttcctttttcc

SEQ ID NO: 67879 - DNA, 20 bp, Artificial Sequence
  Description of Artificial Sequence: Synthetic oligonucleotide
  Target: SCN10A; (+) strand; PAM type: YTN; PAM sequence: CTC
ccctttcctttttccacagt

SEQ ID NO: 67880 - DNA, 20 bp, Artificial Sequence
  Description of Artificial Sequence: Synthetic oligonucleotide
  Target: SCN10A; (+) strand; PAM type: YTN; PAM sequence: CTT
tcctttttccacagtccaca

SEQ ID NO: 67881 - DNA, 20 bp, Artificial Sequence
  Description of Artificial Sequence: Synthetic oligonucleotide
  Target: SCN10A; (+) strand; PAM type: YTN; PAM sequence: TTT
cctttttccacagtccacaa

SEQ ID NO: 67882 - DNA, 20 bp, Artificial Sequence
  Description of Artificial Sequence: Synthetic oligonucleotide
  Target: SCN10A; (+) strand; PAM type: YTN; PAM sequence: TTC
ctttttccacagtccacaat

SEQ ID NO: 67883 - DNA, 20 bp, Artificial Sequence
  Description of Artificial Sequence: Synthetic oligonucleotide
  Target: SCN10A; (+) strand; PAM type: YTN; PAM sequence: CTT
tttccacagtccacaatccc

SEQ ID NO: 67884 - DNA, 20 bp, Artificial Sequence
  Description of Artificial Sequence: Synthetic oligonucleotide
  Target: SCN10A; (+) strand; PAM type: YTN; PAM sequence: TTT
ttccacagtccacaatccca

SEQ ID NO: 67885 - DNA, 20 bp, Artificial Sequence
  Description of Artificial Sequence: Synthetic oligonucleotide
  Target: SCN10A; (+) strand; PAM type: YTN; PAM sequence: TTT
tccacagtccacaatcccaa

SEQ ID NO: 67886 - DNA, 20 bp, Artificial Sequence
  Description of Artificial Sequence: Synthetic oligonucleotide
  Target: SCN10A; (+) strand; PAM type: YTN; PAM sequence: TTT
ccacagtccacaatcccaat

SEQ ID NO: 67887 - DNA, 20 bp, Artificial Sequence
  Description of Artificial Sequence: Synthetic oligonucleotide
  Target: SCN10A; (+) strand; PAM type: YTN; PAM sequence: TTC
cacagtccacaatcccaatc

SEQ ID NO: 67888 - DNA, 20 bp, Artificial Sequence
  Description of Artificial Sequence: Synthetic oligonucleotide
  Target: SCN10A; (+) strand; PAM type: YTN; PAM sequence: CTT
gttgatccacttccctaagg

SEQ ID NO: 67889 - DNA, 20 bp, Artificial Sequence
  Description of Artificial Sequence: Synthetic oligonucleotide
  Target: SCN10A; (+) strand; PAM type: YTN; PAM sequence: TTG
ttgatccacttccctaaggt

SEQ ID NO: 67890 - DNA, 20 bp, Artificial Sequence
  Description of Artificial Sequence: Synthetic oligonucleotide
  Target: SCN10A; (+) strand; PAM type: YTN; PAM sequence: TTG
atccacttccctaaggtgtc

SEQ ID NO: 67891 - DNA, 20 bp, Artificial Sequence
  Description of Artificial Sequence: Synthetic oligonucleotide
  Target: SCN10A; (+) strand; PAM type: YTN; PAM sequence: CTT
ccctaaggtgtccttataat

SEQ ID NO: 67892 - DNA, 20 bp, Artificial Sequence
  Description of Artificial Sequence: Synthetic oligonucleotide
  Target: SCN10A; (+) strand; PAM type: YTN; PAM sequence: TTC
cctaaggtgtccttataatt

SEQ ID NO: 67893 - DNA, 20 bp, Artificial Sequence
  Description of Artificial Sequence: Synthetic oligonucleotide
  Target: SCN10A; (+) strand; PAM type: YTN; PAM sequence: CTA
aggtgtccttataattcacc

SEQ ID NO: 67894 - DNA, 20 bp, Artificial Sequence
  Description of Artificial Sequence: Synthetic oligonucleotide
  Target: SCN10A; (+) strand; PAM type: YTN; PAM sequence: CTT
ataattcaccccttttcccc

SEQ ID NO: 67895 - DNA, 20 bp, Artificial Sequence
  Description of Artificial Sequence: Synthetic oligonucleotide
  Target: SCN10A; (+) strand; PAM type: YTN; PAM sequence: TTA
taattcaccccttttcccca

SEQ ID NO: 67896 - DNA, 20 bp, Artificial Sequence
  Description of Artificial Sequence: Synthetic oligonucleotide
  Target: SCN10A; (+) strand; PAM type: YTN; PAM sequence: TTC
accccttttccccatctata

SEQ ID NO: 67897 - DNA, 20 bp, Artificial Sequence
  Description of Artificial Sequence: Synthetic oligonucleotide
  Target: SCN10A; (+) strand; PAM type: YTN; PAM sequence: CTT
ttccccatctataattacac

SEQ ID NO: 67898 - DNA, 20 bp, Artificial Sequence
  Description of Artificial Sequence: Synthetic oligonucleotide
  Target: SCN10A; (+) strand; PAM type: YTN; PAM sequence: TTT
tccccatctataattacact

SEQ ID NO: 67899 - DNA, 20 bp, Artificial Sequence
  Description of Artificial Sequence: Synthetic oligonucleotide
  Target: SCN10A; (+) strand; PAM type: YTN; PAM sequence: TTT
ccccatctataattacactt

SEQ ID NO: 67900 - DNA, 20 bp, Artificial Sequence
  Description of Artificial Sequence: Synthetic oligonucleotide
  Target: SCN10A; (+) strand; PAM type: YTN; PAM sequence: TTC
cccatctataattacacttt

SEQ ID NO: 67901 - DNA, 20 bp, Artificial Sequence
  Description of Artificial Sequence: Synthetic oligonucleotide
  Target: SCN10A; (+) strand; PAM type: YTN; PAM sequence: CTA
taattacactttcctagttt

SEQ ID NO: 67902 - DNA, 20 bp, Artificial Sequence
  Description of Artificial Sequence: Synthetic oligonucleotide
  Target: SCN10A; (+) strand; PAM type: YTN; PAM sequence: TTA
cactttcctagtttaagaca

SEQ ID NO: 67903 - DNA, 20 bp, Artificial Sequence
  Description of Artificial Sequence: Synthetic oligonucleotide
  Target: SCN10A; (+) strand; PAM type: YTN; PAM sequence: CTT
tcctagtttaagacaccatt

SEQ ID NO: 67904 - DNA, 20 bp, Artificial Sequence
  Description of Artificial Sequence: Synthetic oligonucleotide
  Target: SCN10A; (+) strand; PAM type: YTN; PAM sequence: TTT
cctagtttaagacaccattt

SEQ ID NO: 67905 - DNA, 20 bp, Artificial Sequence
  Description of Artificial Sequence: Synthetic oligonucleotide
  Target: SCN10A; (+) strand; PAM type: YTN; PAM sequence: TTC
ctagtttaagacaccatttt

SEQ ID NO: 67906 - DNA, 20 bp, Artificial Sequence
  Description of Artificial Sequence: Synthetic oligonucleotide
  Target: SCN10A; (+) strand; PAM type: YTN; PAM sequence: CTA
gtttaagacaccattttgga

SEQ ID NO: 67907 - DNA, 20 bp, Artificial Sequence
  Description of Artificial Sequence: Synthetic oligonucleotide
  Target: SCN10A; (+) strand; PAM type: YTN; PAM sequence: TTT
aagacaccattttggagggg

SEQ ID NO: 67908 - DNA, 20 bp, Artificial Sequence
  Description of Artificial Sequence: Synthetic oligonucleotide
  Target: SCN10A; (+) strand; PAM type: YTN; PAM sequence: TTA
agacaccattttggaggggt

SEQ ID NO: 67909 - DNA, 20 bp, Artificial Sequence
  Description of Artificial Sequence: Synthetic oligonucleotide
  Target: SCN10A; (+) strand; PAM type: YTN; PAM sequence: TTT
tggaggggtgtctggatcct

SEQ ID NO: 67910 - DNA, 20 bp, Artificial Sequence
  Description of Artificial Sequence: Synthetic oligonucleotide
  Target: SCN10A; (+) strand; PAM type: YTN; PAM sequence: TTT
ggaggggtgtctggatcctt

SEQ ID NO: 67911 - DNA, 20 bp, Artificial Sequence
  Description of Artificial Sequence: Synthetic oligonucleotide
  Target: SCN10A; (+) strand; PAM type: YTN; PAM sequence: TTG
gaggggtgtctggatccttt

SEQ ID NO: 67912 - DNA, 20 bp, Artificial Sequence
  Description of Artificial Sequence: Synthetic oligonucleotide
  Target: SCN10A; (+) strand; PAM type: YTN; PAM sequence: CTG
gatccttttaggctctatgc

SEQ ID NO: 67913 - DNA, 20 bp, Artificial Sequence
  Description of Artificial Sequence: Synthetic oligonucleotide
  Target: SCN10A; (+) strand; PAM type: YTN; PAM sequence: CTT
ttaggctctatgcctccagc

SEQ ID NO: 67914 - DNA, 20 bp, Artificial Sequence
  Description of Artificial Sequence: Synthetic oligonucleotide
  Target: SCN10A; (+) strand; PAM type: YTN; PAM sequence: TTT
taggctctatgcctccagct

SEQ ID NO: 67915 - DNA, 20 bp, Artificial Sequence
  Description of Artificial Sequence: Synthetic oligonucleotide
  Target: SCN10A; (+) strand; PAM type: YTN; PAM sequence: TTT
aggctctatgcctccagctc

SEQ ID NO: 67916 - DNA, 20 bp, Artificial Sequence
  Description of Artificial Sequence: Synthetic oligonucleotide
  Target: SCN10A; (+) strand; PAM type: YTN; PAM sequence: TTA
ggctctatgcctccagctct

SEQ ID NO: 67917 - DNA, 20 bp, Artificial Sequence
  Description of Artificial Sequence: Synthetic oligonucleotide
  Target: SCN10A; (+) strand; PAM type: YTN; PAM sequence: CTC
tatgcctccagctctttctc

SEQ ID NO: 67918 - DNA, 20 bp, Artificial Sequence
  Description of Artificial Sequence: Synthetic oligonucleotide
  Target: SCN10A; (+) strand; PAM type: YTN; PAM sequence: CTA
tgcctccagctctttctctg

SEQ ID NO: 67919 - DNA, 20 bp, Artificial Sequence
  Description of Artificial Sequence: Synthetic oligonucleotide
  Target: SCN10A; (+) strand; PAM type: YTN; PAM sequence: CTC
cagctctttctctgccacac

SEQ ID NO: 67920 - DNA, 20 bp, Artificial Sequence
  Description of Artificial Sequence: Synthetic oligonucleotide
  Target: SCN10A; (+) strand; PAM type: YTN; PAM sequence: CTC
tttctctgccacacacctct

SEQ ID NO: 67921 - DNA, 20 bp, Artificial Sequence
  Description of Artificial Sequence: Synthetic oligonucleotide
  Target: SCN10A; (+) strand; PAM type: YTN; PAM sequence: CTT
tctctgccacacacctcttc

SEQ ID NO: 67922 - DNA, 20 bp, Artificial Sequence
  Description of Artificial Sequence: Synthetic oligonucleotide
  Target: SCN10A; (+) strand; PAM type: YTN; PAM sequence: TTT
ctctgccacacacctcttcc

SEQ ID NO: 67923 - DNA, 20 bp, Artificial Sequence
  Description of Artificial Sequence: Synthetic oligonucleotide
  Target: SCN10A; (+) strand; PAM type: YTN; PAM sequence: TTC
tctgccacacacctcttccc

SEQ ID NO: 67924 - DNA, 20 bp, Artificial Sequence
  Description of Artificial Sequence: Synthetic oligonucleotide
  Target: SCN10A; (+) strand; PAM type: YTN; PAM sequence: CTC
tgccacacacctcttcccac

SEQ ID NO: 67925 - DNA, 20 bp, Artificial Sequence
  Description of Artificial Sequence: Synthetic oligonucleotide
  Target: SCN10A; (+) strand; PAM type: YTN; PAM sequence: CTG
ccacacacctcttcccactc

SEQ ID NO: 67926 - DNA, 20 bp, Artificial Sequence
  Description of Artificial Sequence: Synthetic oligonucleotide
  Target: SCN10A; (+) strand; PAM type: YTN; PAM sequence: CTC
ttcccactccaactcattgt

SEQ ID NO: 67927 - DNA, 20 bp, Artificial Sequence
  Description of Artificial Sequence: Synthetic oligonucleotide
  Target: SCN10A; (+) strand; PAM type: YTN; PAM sequence: CTT
cccactccaactcattgtct

SEQ ID NO: 67928 - DNA, 20 bp, Artificial Sequence
  Description of Artificial Sequence: Synthetic oligonucleotide
  Target: SCN10A; (+) strand; PAM type: YTN; PAM sequence: TTC
ccactccaactcattgtcta

SEQ ID NO: 67929 - DNA, 20 bp, Artificial Sequence
  Description of Artificial Sequence: Synthetic oligonucleotide
  Target: SCN10A; (+) strand; PAM type: YTN; PAM sequence: CTC
caactcattgtctacggcag

SEQ ID NO: 67930 - DNA, 20 bp, Artificial Sequence
  Description of Artificial Sequence: Synthetic oligonucleotide
  Target: SCN10A; (+) strand; PAM type: YTN; PAM sequence: CTC
attgtctacggcagctgcaa

SEQ ID NO: 67931 - DNA, 20 bp, Artificial Sequence
  Description of Artificial Sequence: Synthetic oligonucleotide
  Target: SCN10A; (+) strand; PAM type: YTN; PAM sequence: TTG
tctacggcagctgcaatggt

SEQ ID NO: 67932 - DNA, 20 bp, Artificial Sequence
  Description of Artificial Sequence: Synthetic oligonucleotide
  Target: SCN10A; (+) strand; PAM type: YTN; PAM sequence: CTA
cggcagctgcaatggtgggt

SEQ ID NO: 67933 - DNA, 20 bp, Artificial Sequence
  Description of Artificial Sequence: Synthetic oligonucleotide
  Target: SCN10A; (+) strand; PAM type: YTN; PAM sequence: CTG
caatggtgggtaatctttag

SEQ ID NO: 67934 - DNA, 20 bp, Artificial Sequence
  Description of Artificial Sequence: Synthetic oligonucleotide
  Target: SCN10A; (+) strand; PAM type: YTN; PAM sequence: CTT
tagagcacaaacctgagcct

SEQ ID NO: 67935 - DNA, 20 bp, Artificial Sequence
  Description of Artificial Sequence: Synthetic oligonucleotide
  Target: SCN10A; (+) strand; PAM type: YTN; PAM sequence: TTT
agagcacaaacctgagcctc

SEQ ID NO: 67936 - DNA, 20 bp, Artificial Sequence
  Description of Artificial Sequence: Synthetic oligonucleotide
  Target: SCN10A; (+) strand; PAM type: YTN; PAM sequence: TTA
gagcacaaacctgagcctct

SEQ ID NO: 67937 - DNA, 20 bp, Artificial Sequence
  Description of Artificial Sequence: Synthetic oligonucleotide
  Target: SCN10A; (+) strand; PAM type: YTN; PAM sequence: CTG
agcctcttaccatcctgcgc

SEQ ID NO: 67938 - DNA, 20 bp, Artificial Sequence
  Description of Artificial Sequence: Synthetic oligonucleotide
  Target: SCN10A; (+) strand; PAM type: YTN; PAM sequence: CTC
ttaccatcctgcgctggttg

SEQ ID NO: 67939 - DNA, 20 bp, Artificial Sequence
  Description of Artificial Sequence: Synthetic oligonucleotide
  Target: SCN10A; (+) strand; PAM type: YTN; PAM sequence: CTT
accatcctgcgctggttgta

SEQ ID NO: 67940 - DNA, 20 bp, Artificial Sequence
  Description of Artificial Sequence: Synthetic oligonucleotide
  Target: SCN10A; (+) strand; PAM type: YTN; PAM sequence: TTA
ccatcctgcgctggttgtaa

SEQ ID NO: 67941 - DNA, 20 bp, Artificial Sequence
  Description of Artificial Sequence: Synthetic oligonucleotide
  Target: SCN10A; (+) strand; PAM type: YTN; PAM sequence: CTG
cgctggttgtaaggatcaga

SEQ ID NO: 67942 - DNA, 20 bp, Artificial Sequence
  Description of Artificial Sequence: Synthetic oligonucleotide
  Target: SCN10A; (+) strand; PAM type: YTN; PAM sequence: CTG
gttgtaaggatcagagcggg

SEQ ID NO: 67943 - DNA, 20 bp, Artificial Sequence
  Description of Artificial Sequence: Synthetic oligonucleotide
  Target: SCN10A; (+) strand; PAM type: YTN; PAM sequence: TTG
taaggatcagagcggggtga

SEQ ID NO: 67944 - DNA, 20 bp, Artificial Sequence
  Description of Artificial Sequence: Synthetic oligonucleotide
  Target: SCN10A; (+) strand; PAM type: YTN; PAM sequence: TTT
gttgtcttctgtggagccct

SEQ ID NO: 67945 - DNA, 20 bp, Artificial Sequence
  Description of Artificial Sequence: Synthetic oligonucleotide
  Target: SCN10A; (+) strand; PAM type: YTN; PAM sequence: TTG
ttgtcttctgtggagccctc

SEQ ID NO: 67946 - DNA, 20 bp, Artificial Sequence
  Description of Artificial Sequence: Synthetic oligonucleotide
  Target: SCN10A; (+) strand; PAM type: YTN; PAM sequence: TTG
tcttctgtggagccctctga

SEQ ID NO: 67947 - DNA, 20 bp, Artificial Sequence
  Description of Artificial Sequence: Synthetic oligonucleotide
  Target: SCN10A; (+) strand; PAM type: YTN; PAM sequence: CTT
ctgtggagccctctgacact

SEQ ID NO: 67948 - DNA, 20 bp, Artificial Sequence
  Description of Artificial Sequence: Synthetic oligonucleotide
  Target: SCN10A; (+) strand; PAM type: YTN; PAM sequence: TTC
tgtggagccctctgacactc

SEQ ID NO: 67949 - DNA, 20 bp, Artificial Sequence
  Description of Artificial Sequence: Synthetic oligonucleotide
  Target: SCN10A; (+) strand; PAM type: YTN; PAM sequence: CTG
tggagccctctgacactctt

SEQ ID NO: 67950 - DNA, 20 bp, Artificial Sequence
  Description of Artificial Sequence: Synthetic oligonucleotide
  Target: SCN10A; (+) strand; PAM type: YTN; PAM sequence: CTC
tgacactcttggctttattc

SEQ ID NO: 67951 - DNA, 20 bp, Artificial Sequence
  Description of Artificial Sequence: Synthetic oligonucleotide
  Target: SCN10A; (+) strand; PAM type: YTN; PAM sequence: CTG
acactcttggctttattcta

SEQ ID NO: 67952 - DNA, 20 bp, Artificial Sequence
  Description of Artificial Sequence: Synthetic oligonucleotide
  Target: SCN10A; (+) strand; PAM type: YTN; PAM sequence: CTC
ttggctttattctatgcctt

SEQ ID NO: 67953 - DNA, 20 bp, Artificial Sequence
  Description of Artificial Sequence: Synthetic oligonucleotide
  Target: SCN10A; (+) strand; PAM type: YTN; PAM sequence: CTT
ggctttattctatgccttct

SEQ ID NO: 67954 - DNA, 20 bp, Artificial Sequence
  Description of Artificial Sequence: Synthetic oligonucleotide
  Target: SCN10A; (+) strand; PAM type: YTN; PAM sequence: TTG
gctttattctatgccttctc

SEQ ID NO: 67955 - DNA, 20 bp, Artificial Sequence
  Description of Artificial Sequence: Synthetic oligonucleotide
  Target: SCN10A; (+) strand; PAM type: YTN; PAM sequence: CTT
tattctatgccttctctcac

SEQ ID NO: 67956 - DNA, 20 bp, Artificial Sequence
  Description of Artificial Sequence: Synthetic oligonucleotide
  Target: SCN10A; (+) strand; PAM type: YTN; PAM sequence: TTT
attctatgccttctctcact

SEQ ID NO: 67957 - DNA, 20 bp, Artificial Sequence
  Description of Artificial Sequence: Synthetic oligonucleotide
  Target: SCN10A; (+) strand; PAM type: YTN; PAM sequence: TTA
ttctatgccttctctcactg

SEQ ID NO: 67958 - DNA, 20 bp, Artificial Sequence
  Description of Artificial Sequence: Synthetic oligonucleotide
  Target: SCN10A; (+) strand; PAM type: YTN; PAM sequence: TTC
tatgccttctctcactggca

SEQ ID NO: 67959 - DNA, 20 bp, Artificial Sequence
  Description of Artificial Sequence: Synthetic oligonucleotide
  Target: SCN10A; (+) strand; PAM type: YTN; PAM sequence: CTA
tgccttctctcactggcatt

SEQ ID NO: 67960 - DNA, 20 bp, Artificial Sequence
  Description of Artificial Sequence: Synthetic oligonucleotide
  Target: SCN10A; (+) strand; PAM type: YTN; PAM sequence: CTT
ctctcactggcatttttgga

SEQ ID NO: 67961 - DNA, 20 bp, Artificial Sequence
  Description of Artificial Sequence: Synthetic oligonucleotide
  Target: SCN10A; (+) strand; PAM type: YTN; PAM sequence: TTC
tctcactggcatttttggag

SEQ ID NO: 67962 - DNA, 20 bp, Artificial Sequence
  Description of Artificial Sequence: Synthetic oligonucleotide
  Target: SCN10A; (+) strand; PAM type: YTN; PAM sequence: CTC
tcactggcatttttggaggt

SEQ ID NO: 67963 - DNA, 20 bp, Artificial Sequence
  Description of Artificial Sequence: Synthetic oligonucleotide
  Target: SCN10A; (+) strand; PAM type: YTN; PAM sequence: CTC
actggcatttttggaggtta

SEQ ID NO: 67964 - DNA, 20 bp, Artificial Sequence
  Description of Artificial Sequence: Synthetic oligonucleotide
  Target: SCN10A; (+) strand; PAM type: YTN; PAM sequence: CTG
gcatttttggaggttaaagg

SEQ ID NO: 67965 - DNA, 20 bp, Artificial Sequence
  Description of Artificial Sequence: Synthetic oligonucleotide
  Target: SCN10A; (+) strand; PAM type: YTN; PAM sequence: TTT
ttggaggttaaaggtgatcc

SEQ ID NO: 67966 - DNA, 20 bp, Artificial Sequence
  Description of Artificial Sequence: Synthetic oligonucleotide
  Target: SCN10A; (+) strand; PAM type: YTN; PAM sequence: TTT
tggaggttaaaggtgatcca

SEQ ID NO: 67967 - DNA, 20 bp, Artificial Sequence
  Description of Artificial Sequence: Synthetic oligonucleotide
  Target: SCN10A; (+) strand; PAM type: YTN; PAM sequence: TTT
ggaggttaaaggtgatccat

SEQ ID NO: 67968 - DNA, 20 bp, Artificial Sequence
  Description of Artificial Sequence: Synthetic oligonucleotide
  Target: SCN10A; (+) strand; PAM type: YTN; PAM sequence: TTG
gaggttaaaggtgatccatt

SEQ ID NO: 67969 - DNA, 20 bp, Artificial Sequence
  Description of Artificial Sequence: Synthetic oligonucleotide
  Target: SCN10A; (+) strand; PAM type: YTN; PAM sequence: TTA
aaggtgatccattgtgggag

SEQ ID NO: 67970 - DNA, 20 bp, Artificial Sequence
  Description of Artificial Sequence: Synthetic oligonucleotide
  Target: SCN10A; (+) strand; PAM type: YTN; PAM sequence: TTG
tgggagtggagagaggttgt

SEQ ID NO: 67971 - DNA, 20 bp, Artificial Sequence
  Description of Artificial Sequence: Synthetic oligonucleotide
  Target: SCN10A; (+) strand; PAM type: YTN; PAM sequence: TTG
tgtcaatccctagtgctgct

SEQ ID NO: 67972 - DNA, 20 bp, Artificial Sequence
  Description of Artificial Sequence: Synthetic oligonucleotide
  Target: SCN10A; (+) strand; PAM type: YTN; PAM sequence: CTA
gtgctgctagcacctgcgaa

SEQ ID NO: 67973 - DNA, 20 bp, Artificial Sequence
  Description of Artificial Sequence: Synthetic oligonucleotide
  Target: SCN10A; (+) strand; PAM type: YTN; PAM sequence: CTG
ctagcacctgcgaagagaga

SEQ ID NO: 67974 - DNA, 20 bp, Artificial Sequence
  Description of Artificial Sequence: Synthetic oligonucleotide
  Target: SCN10A; (+) strand; PAM type: YTN; PAM sequence: CTA
gcacctgcgaagagagaaca

SEQ ID NO: 67975 - DNA, 20 bp, Artificial Sequence
  Description of Artificial Sequence: Synthetic oligonucleotide
  Target: SCN10A; (+) strand; PAM type: YTN; PAM sequence: CTG
cgaagagagaacagcaggtg

SEQ ID NO: 67976 - DNA, 20 bp, Artificial Sequence
  Description of Artificial Sequence: Synthetic oligonucleotide
  Target: SCN10A; (+) strand; PAM type: YTN; PAM sequence: TTT
gcttggacttagcatgaatg

SEQ ID NO: 67977 - DNA, 20 bp, Artificial Sequence
  Description of Artificial Sequence: Synthetic oligonucleotide
  Target: SCN10A; (+) strand; PAM type: YTN; PAM sequence: TTG
cttggacttagcatgaatgt

SEQ ID NO: 67978 - DNA, 20 bp, Artificial Sequence
  Description of Artificial Sequence: Synthetic oligonucleotide
  Target: SCN10A; (+) strand; PAM type: YTN; PAM sequence: CTT
ggacttagcatgaatgtgtc

SEQ ID NO: 67979 - DNA, 20 bp, Artificial Sequence
  Description of Artificial Sequence: Synthetic oligonucleotide
  Target: SCN10A; (+) strand; PAM type: YTN; PAM sequence: TTG
gacttagcatgaatgtgtcc

SEQ ID NO: 67980 - DNA, 20 bp, Artificial Sequence
  Description of Artificial Sequence: Synthetic oligonucleotide
  Target: SCN10A; (+) strand; PAM type: YTN; PAM sequence: CTT
agcatgaatgtgtcccccag

SEQ ID NO: 67981 - DNA, 20 bp, Artificial Sequence
  Description of Artificial Sequence: Synthetic oligonucleotide
  Target: SCN10A; (+) strand; PAM type: YTN; PAM sequence: TTA
gcatgaatgtgtcccccaga

SEQ ID NO: 67982 - DNA, 20 bp, Artificial Sequence
  Description of Artificial Sequence: Synthetic oligonucleotide
  Target: SCN10A; (+) strand; PAM type: YTN; PAM sequence: CTG
aaacagagaagctgaagggt

SEQ ID NO: 67983 - DNA, 20 bp, Artificial Sequence
  Description of Artificial Sequence: Synthetic oligonucleotide
  Target: SCN10A; (+) strand; PAM type: YTN; PAM sequence: CTG
aagggttaggaccagggtgg

SEQ ID NO: 67984 - DNA, 20 bp, Artificial Sequence
  Description of Artificial Sequence: Synthetic oligonucleotide
  Target: SCN10A; (+) strand; PAM type: YTN; PAM sequence: TTA
ggaccagggtggtggtggga

SEQ ID NO: 67985 - DNA, 20 bp, Artificial Sequence
  Description of Artificial Sequence: Synthetic oligonucleotide
  Target: SCN10A; (+) strand; PAM type: YTN; PAM sequence: TTA
ggccatggcaggaacagaca

SEQ ID NO: 67986 - DNA, 20 bp, Artificial Sequence
  Description of Artificial Sequence: Synthetic oligonucleotide
  Target: SCN10A; (+) strand; PAM type: YTN; PAM sequence: CTC
gggtcacccccactcattca

SEQ ID NO: 67987 - DNA, 20 bp, Artificial Sequence
  Description of Artificial Sequence: Synthetic oligonucleotide
  Target: SCN10A; (+) strand; PAM type: YTN; PAM sequence: CTC
attcatggggtactctgttg

SEQ ID NO: 67988 - DNA, 20 bp, Artificial Sequence
  Description of Artificial Sequence: Synthetic oligonucleotide
  Target: SCN10A; (+) strand; PAM type: YTN; PAM sequence: TTC
atggggtactctgttggtgc

SEQ ID NO: 67989 - DNA, 20 bp, Artificial Sequence
  Description of Artificial Sequence: Synthetic oligonucleotide
  Target: SCN10A; (+) strand; PAM type: YTN; PAM sequence: CTC
tgttggtgccccacccagat

SEQ ID NO: 67990 - DNA, 20 bp, Artificial Sequence
  Description of Artificial Sequence: Synthetic oligonucleotide
  Target: SCN10A; (+) strand; PAM type: YTN; PAM sequence: CTG
ttggtgccccacccagatcc

SEQ ID NO: 67991 - DNA, 20 bp, Artificial Sequence
  Description of Artificial Sequence: Synthetic oligonucleotide
  Target: SCN10A; (+) strand; PAM type: YTN; PAM sequence: TTG
gtgccccacccagatccctt

SEQ ID NO: 67992 - DNA, 20 bp, Artificial Sequence
  Description of Artificial Sequence: Synthetic oligonucleotide
  Target: SCN10A; (+) strand; PAM type: YTN; PAM sequence: CTT
tcaccaggtcagcacagcta

SEQ ID NO: 67993 - DNA, 20 bp, Artificial Sequence
  Description of Artificial Sequence: Synthetic oligonucleotide
  Target: SCN10A; (+) strand; PAM type: YTN; PAM sequence: TTT
caccaggtcagcacagctat

SEQ ID NO: 67994 - DNA, 20 bp, Artificial Sequence
  Description of Artificial Sequence: Synthetic oligonucleotide
  Target: SCN10A; (+) strand; PAM type: YTN; PAM sequence: TTC
accaggtcagcacagctatc

SEQ ID NO: 67995 - DNA, 20 bp, Artificial Sequence
  Description of Artificial Sequence: Synthetic oligonucleotide
  Target: SCN10A; (+) strand; PAM type: YTN; PAM sequence: CTA
tcccgagctgcttgcatggc

SEQ ID NO: 67996 - DNA, 20 bp, Artificial Sequence
  Description of Artificial Sequence: Synthetic oligonucleotide
  Target: SCN10A; (+) strand; PAM type: YTN; PAM sequence: CTG
cttgcatggcagcagctgat

SEQ ID NO: 67997 - DNA, 20 bp, Artificial Sequence
  Description of Artificial Sequence: Synthetic oligonucleotide
  Target: SCN10A; (+) strand; PAM type: YTN; PAM sequence: CTT
gcatggcagcagctgatggc

SEQ ID NO: 67998 - DNA, 20 bp, Artificial Sequence
  Description of Artificial Sequence: Synthetic oligonucleotide
  Target: SCN10A; (+) strand; PAM type: YTN; PAM sequence: TTG
catggcagcagctgatggct

SEQ ID NO: 67999 - DNA, 20 bp, Artificial Sequence
  Description of Artificial Sequence: Synthetic oligonucleotide
  Target: SCN10A; (+) strand; PAM type: YTN; PAM sequence: CTG
atggctcatacttgcagcat

SEQ ID NO: 68000 - DNA, 20 bp, Artificial Sequence
  Description of Artificial Sequence: Synthetic oligonucleotide
  Target: SCN10A; (+) strand; PAM type: YTN; PAM sequence: CTC
atacttgcagcattctacaa

SEQ ID NO: 68001 - DNA, 20 bp, Artificial Sequence
  Description of Artificial Sequence: Synthetic oligonucleotide
  Target: SCN10A; (+) strand; PAM type: YTN; PAM sequence: CTT
gcagcattctacaaaaaaag

SEQ ID NO: 68002 - DNA, 20 bp, Artificial Sequence
  Description of Artificial Sequence: Synthetic oligonucleotide
  Target: SCN10A; (+) strand; PAM type: YTN; PAM sequence: TTG
cagcattctacaaaaaaagt

SEQ ID NO: 68003 - DNA, 20 bp, Artificial Sequence
  Description of Artificial Sequence: Synthetic oligonucleotide
  Target: SCN10A; (+) strand; PAM type: YTN; PAM sequence: TTC
tacaaaaaaagtctcttttg

SEQ ID NO: 68004 - DNA, 20 bp, Artificial Sequence
  Description of Artificial Sequence: Synthetic oligonucleotide
  Target: SCN10A; (+) strand; PAM type: YTN; PAM sequence: CTA
caaaaaaagtctcttttggc

SEQ ID NO: 68005 - DNA, 20 bp, Artificial Sequence
  Description of Artificial Sequence: Synthetic oligonucleotide
  Target: SCN10A; (+) strand; PAM type: YTN; PAM sequence: CTC
ttttggctgcctgcttctgg

SEQ ID NO: 68006 - DNA, 20 bp, Artificial Sequence
  Description of Artificial Sequence: Synthetic oligonucleotide
  Target: SCN10A; (+) strand; PAM type: YTN; PAM sequence: CTT
ttggctgcctgcttctggga

SEQ ID NO: 68007 - DNA, 20 bp, Artificial Sequence
  Description of Artificial Sequence: Synthetic oligonucleotide
  Target: SCN10A; (+) strand; PAM type: YTN; PAM sequence: TTT
tggctgcctgcttctgggat

SEQ ID NO: 68008 - DNA, 20 bp, Artificial Sequence
  Description of Artificial Sequence: Synthetic oligonucleotide
  Target: SCN10A; (+) strand; PAM type: YTN; PAM sequence: TTT
ggctgcctgcttctgggata

SEQ ID NO: 68009 - DNA, 20 bp, Artificial Sequence
  Description of Artificial Sequence: Synthetic oligonucleotide
  Target: SCN10A; (+) strand; PAM type: YTN; PAM sequence: TTG
gctgcctgcttctgggatag

SEQ ID NO: 68010 - DNA, 20 bp, Artificial Sequence
  Description of Artificial Sequence: Synthetic oligonucleotide
  Target: SCN10A; (+) strand; PAM type: YTN; PAM sequence: CTG
cctgcttctgggataggtat

SEQ ID NO: 68011 - DNA, 20 bp, Artificial Sequence
  Description of Artificial Sequence: Synthetic oligonucleotide
  Target: SCN10A; (+) strand; PAM type: YTN; PAM sequence: CTG
cttctgggataggtatgggg

SEQ ID NO: 68012 - DNA, 20 bp, Artificial Sequence
  Description of Artificial Sequence: Synthetic oligonucleotide
  Target: SCN10A; (+) strand; PAM type: YTN; PAM sequence: CTT
ctgggataggtatggggagg

SEQ ID NO: 68013 - DNA, 20 bp, Artificial Sequence
  Description of Artificial Sequence: Synthetic oligonucleotide
  Target: SCN10A; (+) strand; PAM type: YTN; PAM sequence: TTC
tgggataggtatggggaggg

SEQ ID NO: 68014 - DNA, 20 bp, Artificial Sequence
  Description of Artificial Sequence: Synthetic oligonucleotide
  Target: SCN10A; (+) strand; PAM type: YTN; PAM sequence: CTG
ggataggtatggggagggta

SEQ ID NO: 68015 - DNA, 20 bp, Artificial Sequence
  Description of Artificial Sequence: Synthetic oligonucleotide
  Target: SCN10A; (+) strand; PAM type: YTN; PAM sequence: CTG
gcccccttgcctcaaggtag

SEQ ID NO: 68016 - DNA, 20 bp, Artificial Sequence
  Description of Artificial Sequence: Synthetic oligonucleotide
  Target: SCN10A; (+) strand; PAM type: YTN; PAM sequence: CTT
gcctcaaggtaggactaact

SEQ ID NO: 68017 - DNA, 20 bp, Artificial Sequence
  Description of Artificial Sequence: Synthetic oligonucleotide
  Target: SCN10A; (+) strand; PAM type: YTN; PAM sequence: TTG
cctcaaggtaggactaactg

SEQ ID NO: 68018 - DNA, 20 bp, Artificial Sequence
  Description of Artificial Sequence: Synthetic oligonucleotide
  Target: SCN10A; (+) strand; PAM type: YTN; PAM sequence: CTC
aaggtaggactaactgtggt

SEQ ID NO: 68019 - DNA, 20 bp, Artificial Sequence
  Description of Artificial Sequence: Synthetic oligonucleotide
  Target: SCN10A; (+) strand; PAM type: YTN; PAM sequence: CTA
actgtggtacaggtcatgcc

SEQ ID NO: 68020 - DNA, 20 bp, Artificial Sequence
  Description of Artificial Sequence: Synthetic oligonucleotide
  Target: SCN10A; (+) strand; PAM type: YTN; PAM sequence: CTG
tggtacaggtcatgccccag

SEQ ID NO: 68021 - DNA, 20 bp, Artificial Sequence
  Description of Artificial Sequence: Synthetic oligonucleotide
  Target: SCN10A; (+) strand; PAM type: YTN; PAM sequence: TTC
cccatgggatcaagctgaag

SEQ ID NO: 68022 - DNA, 20 bp, Artificial Sequence
  Description of Artificial Sequence: Synthetic oligonucleotide
  Target: SCN10A; (+) strand; PAM type: YTN; PAM sequence: CTG
aagctggtctctagctgaga

SEQ ID NO: 68023 - DNA, 20 bp, Artificial Sequence
  Description of Artificial Sequence: Synthetic oligonucleotide
  Target: SCN10A; (+) strand; PAM type: YTN; PAM sequence: CTG
gtctctagctgagaacactc

SEQ ID NO: 68024 - DNA, 20 bp, Artificial Sequence
  Description of Artificial Sequence: Synthetic oligonucleotide
  Target: SCN10A; (+) strand; PAM type: YTN; PAM sequence: CTC
tagctgagaacactccttgt

SEQ ID NO: 68025 - DNA, 20 bp, Artificial Sequence
  Description of Artificial Sequence: Synthetic oligonucleotide
  Target: SCN10A; (+) strand; PAM type: YTN; PAM sequence: CTA
gctgagaacactccttgttt

SEQ ID NO: 68026 - DNA, 20 bp, Artificial Sequence
  Description of Artificial Sequence: Synthetic oligonucleotide
  Target: SCN10A; (+) strand; PAM type: YTN; PAM sequence: CTG
agaacactccttgtttagtt

SEQ ID NO: 68027 - DNA, 20 bp, Artificial Sequence
  Description of Artificial Sequence: Synthetic oligonucleotide
  Target: SCN10A; (+) strand; PAM type: YTN; PAM sequence: CTC
cttgtttagttccaccctct

SEQ ID NO: 68028 - DNA, 20 bp, Artificial Sequence
  Description of Artificial Sequence: Synthetic oligonucleotide
  Target: SCN10A; (+) strand; PAM type: YTN; PAM sequence: CTT
gtttagttccaccctctgcc

SEQ ID NO: 68029 - DNA, 20 bp, Artificial Sequence
  Description of Artificial Sequence: Synthetic oligonucleotide
  Target: SCN10A; (+) strand; PAM type: YTN; PAM sequence: TTG
tttagttccaccctctgccc

SEQ ID NO: 68030 - DNA, 20 bp, Artificial Sequence
  Description of Artificial Sequence: Synthetic oligonucleotide
  Target: SCN10A; (+) strand; PAM type: YTN; PAM sequence: TTT
agttccaccctctgccccat

SEQ ID NO: 68031 - DNA, 20 bp, Artificial Sequence
  Description of Artificial Sequence: Synthetic oligonucleotide
  Target: SCN10A; (+) strand; PAM type: YTN; PAM sequence: TTA
gttccaccctctgccccatt

SEQ ID NO: 68032 - DNA, 20 bp, Artificial Sequence
  Description of Artificial Sequence: Synthetic oligonucleotide
  Target: SCN10A; (+) strand; PAM type: YTN; PAM sequence: TTC
caccctctgccccattctgt

SEQ ID NO: 68033 - DNA, 20 bp, Artificial Sequence
  Description of Artificial Sequence: Synthetic oligonucleotide
  Target: SCN10A; (+) strand; PAM type: YTN; PAM sequence: CTC
tgccccattctgttttgctt

SEQ ID NO: 68034 - DNA, 20 bp, Artificial Sequence
  Description of Artificial Sequence: Synthetic oligonucleotide
  Target: SCN10A; (+) strand; PAM type: YTN; PAM sequence: CTG
ccccattctgttttgcttca

SEQ ID NO: 68035 - DNA, 20 bp, Artificial Sequence
  Description of Artificial Sequence: Synthetic oligonucleotide
  Target: SCN10A; (+) strand; PAM type: YTN; PAM sequence: TTC
tgttttgcttcattcgcttt

SEQ ID NO: 68036 - DNA, 20 bp, Artificial Sequence
  Description of Artificial Sequence: Synthetic oligonucleotide
  Target: SCN10A; (+) strand; PAM type: YTN; PAM sequence: CTG
ttttgcttcattcgctttct

SEQ ID NO: 68037 - DNA, 20 bp, Artificial Sequence
  Description of Artificial Sequence: Synthetic oligonucleotide
  Target: SCN10A; (+) strand; PAM type: YTN; PAM sequence: TTT
tgcttcattcgctttctcct

SEQ ID NO: 68038 - DNA, 20 bp, Artificial Sequence
  Description of Artificial Sequence: Synthetic oligonucleotide
  Target: SCN10A; (+) strand; PAM type: YTN; PAM sequence: TTT
gcttcattcgctttctcctg

SEQ ID NO: 68039 - DNA, 20 bp, Artificial Sequence
  Description of Artificial Sequence: Synthetic oligonucleotide
  Target: SCN10A; (+) strand; PAM type: YTN; PAM sequence: TTG
cttcattcgctttctcctga

SEQ ID NO: 68040 - DNA, 20 bp, Artificial Sequence
  Description of Artificial Sequence: Synthetic oligonucleotide
  Target: SCN10A; (+) strand; PAM type: YTN; PAM sequence: CTT
cattcgctttctcctgagag

SEQ ID NO: 68041 - DNA, 20 bp, Artificial Sequence
  Description of Artificial Sequence: Synthetic oligonucleotide
  Target: SCN10A; (+) strand; PAM type: YTN; PAM sequence: TTC
attcgctttctcctgagagc

SEQ ID NO: 68042 - DNA, 20 bp, Artificial Sequence
  Description of Artificial Sequence: Synthetic oligonucleotide
  Target: SCN10A; (+) strand; PAM type: YTN; PAM sequence: TTC
gctttctcctgagagcactc

SEQ ID NO: 68043 - DNA, 20 bp, Artificial Sequence
  Description of Artificial Sequence: Synthetic oligonucleotide
  Target: SCN10A; (+) strand; PAM type: YTN; PAM sequence: CTT
tctcctgagagcactccctc

SEQ ID NO: 68044 - DNA, 20 bp, Artificial Sequence
  Description of Artificial Sequence: Synthetic oligonucleotide
  Target: SCN10A; (+) strand; PAM type: YTN; PAM sequence: TTT
ctcctgagagcactccctca

SEQ ID NO: 68045 - DNA, 20 bp, Artificial Sequence
  Description of Artificial Sequence: Synthetic oligonucleotide
  Target: SCN10A; (+) strand; PAM type: YTN; PAM sequence: TTC
tcctgagagcactccctcaa

SEQ ID NO: 68046 - DNA, 20 bp, Artificial Sequence
  Description of Artificial Sequence: Synthetic oligonucleotide
  Target: SCN10A; (+) strand; PAM type: YTN; PAM sequence: CTC
ctgagagcactccctcaata

SEQ ID NO: 68047 - DNA, 20 bp, Artificial Sequence
  Description of Artificial Sequence: Synthetic oligonucleotide
  Target: SCN10A; (+) strand; PAM type: YTN; PAM sequence: CTG
agagcactccctcaataggt

SEQ ID NO: 68048 - DNA, 20 bp, Artificial Sequence
  Description of Artificial Sequence: Synthetic oligonucleotide
  Target: SCN10A; (+) strand; PAM type: YTN; PAM sequence: CTC
cctcaataggtcacttgcac

SEQ ID NO: 68049 - DNA, 20 bp, Artificial Sequence
  Description of Artificial Sequence: Synthetic oligonucleotide
  Target: SCN10A; (+) strand; PAM type: YTN; PAM sequence: CTC
aataggtcacttgcacaaga

SEQ ID NO: 68050 - DNA, 20 bp, Artificial Sequence
  Description of Artificial Sequence: Synthetic oligonucleotide
  Target: SCN10A; (+) strand; PAM type: YTN; PAM sequence: CTT
gcacaagaatcctcacttag

SEQ ID NO: 68051 - DNA, 20 bp, Artificial Sequence
  Description of Artificial Sequence: Synthetic oligonucleotide
  Target: SCN10A; (+) strand; PAM type: YTN; PAM sequence: TTG
cacaagaatcctcacttagc

SEQ ID NO: 68052 - DNA, 20 bp, Artificial Sequence
  Description of Artificial Sequence: Synthetic oligonucleotide
  Target: SCN10A; (+) strand; PAM type: YTN; PAM sequence: CTC
acttagcttcttctttgaga

SEQ ID NO: 68053 - DNA, 20 bp, Artificial Sequence
  Description of Artificial Sequence: Synthetic oligonucleotide
  Target: SCN10A; (+) strand; PAM type: YTN; PAM sequence: CTT
agcttcttctttgagaaaac

SEQ ID NO: 68054 - DNA, 20 bp, Artificial Sequence
  Description of Artificial Sequence: Synthetic oligonucleotide
  Target: SCN10A; (+) strand; PAM type: YTN; PAM sequence: TTA
gcttcttctttgagaaaacc

SEQ ID NO: 68055 - DNA, 20 bp, Artificial Sequence
  Description of Artificial Sequence: Synthetic oligonucleotide
  Target: SCN10A; (+) strand; PAM type: YTN; PAM sequence: CTT
cttctttgagaaaacctgat

SEQ ID NO: 68056 - DNA, 20 bp, Artificial Sequence
  Description of Artificial Sequence: Synthetic oligonucleotide
  Target: SCN10A; (+) strand; PAM type: YTN; PAM sequence: TTC
ttctttgagaaaacctgatc

SEQ ID NO: 68057 - DNA, 20 bp, Artificial Sequence
  Description of Artificial Sequence: Synthetic oligonucleotide
  Target: SCN10A; (+) strand; PAM type: YTN; PAM sequence: CTT
ctttgagaaaacctgatcta

SEQ ID NO: 68058 - DNA, 20 bp, Artificial Sequence
  Description of Artificial Sequence: Synthetic oligonucleotide
  Target: SCN10A; (+) strand; PAM type: YTN; PAM sequence: TTC
tttgagaaaacctgatctaa

SEQ ID NO: 68059 - DNA, 20 bp, Artificial Sequence
  Description of Artificial Sequence: Synthetic oligonucleotide
  Target: SCN10A; (+) strand; PAM type: YTN; PAM sequence: CTT
tgagaaaacctgatctaata

SEQ ID NO: 68060 - DNA, 20 bp, Artificial Sequence
  Description of Artificial Sequence: Synthetic oligonucleotide
  Target: SCN10A; (+) strand; PAM type: YTN; PAM sequence: TTT
gagaaaacctgatctaatat

SEQ ID NO: 68061 - DNA, 20 bp, Artificial Sequence
  Description of Artificial Sequence: Synthetic oligonucleotide
  Target: SCN10A; (+) strand; PAM type: YTN; PAM sequence: TTG
agaaaacctgatctaatatg

SEQ ID NO: 68062 - DNA, 20 bp, Artificial Sequence
  Description of Artificial Sequence: Synthetic oligonucleotide
  Target: SCN10A; (+) strand; PAM type: YTN; PAM sequence: CTG
atctaatatggtccctgagg

SEQ ID NO: 68063 - DNA, 20 bp, Artificial Sequence
  Description of Artificial Sequence: Synthetic oligonucleotide
  Target: SCN10A; (+) strand; PAM type: YTN; PAM sequence: CTA
atatggtccctgaggcaaga

SEQ ID NO: 68064 - DNA, 20 bp, Artificial Sequence
  Description of Artificial Sequence: Synthetic oligonucleotide
  Target: SCN10A; (+) strand; PAM type: YTN; PAM sequence: CTG
aggcaagatgattcctccta

SEQ ID NO: 68065 - DNA, 20 bp, Artificial Sequence
  Description of Artificial Sequence: Synthetic oligonucleotide
  Target: SCN10A; (+) strand; PAM type: YTN; PAM sequence: TTC
ctcctatagctccctaaacg

SEQ ID NO: 68066 - DNA, 20 bp, Artificial Sequence
  Description of Artificial Sequence: Synthetic oligonucleotide
  Target: SCN10A; (+) strand; PAM type: YTN; PAM sequence: CTC
ctatagctccctaaacggtg

SEQ ID NO: 68067 - DNA, 20 bp, Artificial Sequence
  Description of Artificial Sequence: Synthetic oligonucleotide
  Target: SCN10A; (+) strand; PAM type: YTN; PAM sequence: CTA
tagctccctaaacggtgccc

SEQ ID NO: 68068 - DNA, 20 bp, Artificial Sequence
  Description of Artificial Sequence: Synthetic oligonucleotide
  Target: SCN10A; (+) strand; PAM type: YTN; PAM sequence: CTC
cctaaacggtgccctaattg

SEQ ID NO: 68069 - DNA, 20 bp, Artificial Sequence
  Description of Artificial Sequence: Synthetic oligonucleotide
  Target: SCN10A; (+) strand; PAM type: YTN; PAM sequence: CTA
aacggtgccctaattgaagt

SEQ ID NO: 68070 - DNA, 20 bp, Artificial Sequence
  Description of Artificial Sequence: Synthetic oligonucleotide
  Target: SCN10A; (+) strand; PAM type: YTN; PAM sequence: CTA
attgaagtggctagtccaga

SEQ ID NO: 68071 - DNA, 20 bp, Artificial Sequence
  Description of Artificial Sequence: Synthetic oligonucleotide
  Target: SCN10A; (+) strand; PAM type: YTN; PAM sequence: TTG
aagtggctagtccagaacag

SEQ ID NO: 68072 - DNA, 20 bp, Artificial Sequence
  Description of Artificial Sequence: Synthetic oligonucleotide
  Target: SCN10A; (+) strand; PAM type: YTN; PAM sequence: CTA
gtccagaacagtatccaaga

SEQ ID NO: 68073 - DNA, 20 bp, Artificial Sequence
  Description of Artificial Sequence: Synthetic oligonucleotide
  Target: SCN10A; (+) strand; PAM type: YTN; PAM sequence: CTG
caaccttcttcacaaagctt

SEQ ID NO: 68074 - DNA, 20 bp, Artificial Sequence
  Description of Artificial Sequence: Synthetic oligonucleotide
  Target: SCN10A; (+) strand; PAM type: YTN; PAM sequence: CTT
cttcacaaagcttccactcc

SEQ ID NO: 68075 - DNA, 20 bp, Artificial Sequence
  Description of Artificial Sequence: Synthetic oligonucleotide
  Target: SCN10A; (+) strand; PAM type: YTN; PAM sequence: TTC
ttcacaaagcttccactcct

SEQ ID NO: 68076 - DNA, 20 bp, Artificial Sequence
  Description of Artificial Sequence: Synthetic oligonucleotide
  Target: SCN10A; (+) strand; PAM type: YTN; PAM sequence: CTT
cacaaagcttccactcctca

SEQ ID NO: 68077 - DNA, 20 bp, Artificial Sequence
  Description of Artificial Sequence: Synthetic oligonucleotide
  Target: SCN10A; (+) strand; PAM type: YTN; PAM sequence: TTC
acaaagcttccactcctcac

SEQ ID NO: 68078 - DNA, 20 bp, Artificial Sequence
  Description of Artificial Sequence: Synthetic oligonucleotide
  Target: SCN10A; (+) strand; PAM type: YTN; PAM sequence: CTT
ccactcctcacaaacctcct

SEQ ID NO: 68079 - DNA, 20 bp, Artificial Sequence
  Description of Artificial Sequence: Synthetic oligonucleotide
  Target: SCN10A; (+) strand; PAM type: YTN; PAM sequence: TTC
cactcctcacaaacctcctg

SEQ ID NO: 68080 - DNA, 20 bp, Artificial Sequence
  Description of Artificial Sequence: Synthetic oligonucleotide
  Target: SCN10A; (+) strand; PAM type: YTN; PAM sequence: CTC
ctcacaaacctcctgctcct

SEQ ID NO: 68081 - DNA, 20 bp, Artificial Sequence
  Description of Artificial Sequence: Synthetic oligonucleotide
  Target: SCN10A; (+) strand; PAM type: YTN; PAM sequence: CTC
acaaacctcctgctccttcc

SEQ ID NO: 68082 - DNA, 20 bp, Artificial Sequence
  Description of Artificial Sequence: Synthetic oligonucleotide
  Target: SCN10A; (+) strand; PAM type: YTN; PAM sequence: CTC
ctgctccttccggagcatct

SEQ ID NO: 68083 - DNA, 20 bp, Artificial Sequence
  Description of Artificial Sequence: Synthetic oligonucleotide
  Target: SCN10A; (+) strand; PAM type: YTN; PAM sequence: CTG
ctccttccggagcatctcga

SEQ ID NO: 68084 - DNA, 20 bp, Artificial Sequence
  Description of Artificial Sequence: Synthetic oligonucleotide
  Target: SCN10A; (+) strand; PAM type: YTN; PAM sequence: CTC
cttccggagcatctcgaggg

SEQ ID NO: 68085 - DNA, 20 bp, Artificial Sequence
  Description of Artificial Sequence: Synthetic oligonucleotide
  Target: SCN10A; (+) strand; PAM type: YTN; PAM sequence: CTT
ccggagcatctcgagggcct

SEQ ID NO: 68086 - DNA, 20 bp, Artificial Sequence
  Description of Artificial Sequence: Synthetic oligonucleotide
  Target: SCN10A; (+) strand; PAM type: YTN; PAM sequence: TTC
cggagcatctcgagggcctc

SEQ ID NO: 68087 - DNA, 20 bp, Artificial Sequence
  Description of Artificial Sequence: Synthetic oligonucleotide
  Target: SCN10A; (+) strand; PAM type: YTN; PAM sequence: CTC
gagggcctcctggaacttct

SEQ ID NO: 68088 - DNA, 20 bp, Artificial Sequence
  Description of Artificial Sequence: Synthetic oligonucleotide
  Target: SCN10A; (+) strand; PAM type: YTN; PAM sequence: CTC
ctggaacttcttctcctttg

SEQ ID NO: 68089 - DNA, 20 bp, Artificial Sequence
  Description of Artificial Sequence: Synthetic oligonucleotide
  Target: SCN10A; (+) strand; PAM type: YTN; PAM sequence: CTG
gaacttcttctcctttgctt

SEQ ID NO: 68090 - DNA, 20 bp, Artificial Sequence
  Description of Artificial Sequence: Synthetic oligonucleotide
  Target: SCN10A; (+) strand; PAM type: YTN; PAM sequence: CTT
cttctcctttgcttcaattt

SEQ ID NO: 68091 - DNA, 20 bp, Artificial Sequence
  Description of Artificial Sequence: Synthetic oligonucleotide
  Target: SCN10A; (+) strand; PAM type: YTN; PAM sequence: TTC
ttctcctttgcttcaatttc

SEQ ID NO: 68092 - DNA, 20 bp, Artificial Sequence
  Description of Artificial Sequence: Synthetic oligonucleotide
  Target: SCN10A; (+) strand; PAM type: YTN; PAM sequence: CTT
ctcctttgcttcaatttcat

SEQ ID NO: 68093 - DNA, 20 bp, Artificial Sequence
  Description of Artificial Sequence: Synthetic oligonucleotide
  Target: SCN10A; (+) strand; PAM type: YTN; PAM sequence: TTC
tcctttgcttcaatttcatc

SEQ ID NO: 68094 - DNA, 20 bp, Artificial Sequence
  Description of Artificial Sequence: Synthetic oligonucleotide
  Target: SCN10A; (+) strand; PAM type: YTN; PAM sequence: CTC
ctttgcttcaatttcatcag

SEQ ID NO: 68095 - DNA, 20 bp, Artificial Sequence
  Description of Artificial Sequence: Synthetic oligonucleotide
  Target: SCN10A; (+) strand; PAM type: YTN; PAM sequence: CTT
tgcttcaatttcatcagtgg

SEQ ID NO: 68096 - DNA, 20 bp, Artificial Sequence
  Description of Artificial Sequence: Synthetic oligonucleotide
  Target: SCN10A; (+) strand; PAM type: YTN; PAM sequence: TTT
gcttcaatttcatcagtggt

SEQ ID NO: 68097 - DNA, 20 bp, Artificial Sequence
  Description of Artificial Sequence: Synthetic oligonucleotide
  Target: SCN10A; (+) strand; PAM type: YTN; PAM sequence: TTG
cttcaatttcatcagtggtt

SEQ ID NO: 68098 - DNA, 20 bp, Artificial Sequence
  Description of Artificial Sequence: Synthetic oligonucleotide
  Target: SCN10A; (+) strand; PAM type: YTN; PAM sequence: CTT
caatttcatcagtggttgcc

SEQ ID NO: 68099 - DNA, 20 bp, Artificial Sequence
  Description of Artificial Sequence: Synthetic oligonucleotide
  Target: SCN10A; (+) strand; PAM type: YTN; PAM sequence: TTC
aatttcatcagtggttgcct

SEQ ID NO: 68100 - DNA, 20 bp, Artificial Sequence
  Description of Artificial Sequence: Synthetic oligonucleotide
  Target: SCN10A; (+) strand; PAM type: YTN; PAM sequence: TTT
catcagtggttgcctggttc

SEQ ID NO: 68101 - DNA, 20 bp, Artificial Sequence
  Description of Artificial Sequence: Synthetic oligonucleotide
  Target: SCN10A; (+) strand; PAM type: YTN; PAM sequence: TTC
atcagtggttgcctggttct

SEQ ID NO: 68102 - DNA, 20 bp, Artificial Sequence
  Description of Artificial Sequence: Synthetic oligonucleotide
  Target: SCN10A; (+) strand; PAM type: YTN; PAM sequence: TTG
cctggttctgctcctcatac

SEQ ID NO: 68103 - DNA, 20 bp, Artificial Sequence
  Description of Artificial Sequence: Synthetic oligonucleotide
  Target: SCN10A; (+) strand; PAM type: YTN; PAM sequence: CTG
gttctgctcctcatacgcca

SEQ ID NO: 68104 - DNA, 20 bp, Artificial Sequence
  Description of Artificial Sequence: Synthetic oligonucleotide
  Target: SCN10A; (+) strand; PAM type: YTN; PAM sequence: TTC
tgctcctcatacgccatggt

SEQ ID NO: 68105 - DNA, 20 bp, Artificial Sequence
  Description of Artificial Sequence: Synthetic oligonucleotide
  Target: SCN10A; (+) strand; PAM type: YTN; PAM sequence: CTG
ctcctcatacgccatggtga

SEQ ID NO: 68106 - DNA, 20 bp, Artificial Sequence
  Description of Artificial Sequence: Synthetic oligonucleotide
  Target: SCN10A; (+) strand; PAM type: YTN; PAM sequence: CTC
ctcatacgccatggtgacta

SEQ ID NO: 68107 - DNA, 20 bp, Artificial Sequence
  Description of Artificial Sequence: Synthetic oligonucleotide
  Target: SCN10A; (+) strand; PAM type: YTN; PAM sequence: CTC
atacgccatggtgactacag

SEQ ID NO: 68108 - DNA, 20 bp, Artificial Sequence
  Description of Artificial Sequence: Synthetic oligonucleotide
  Target: SCN10A; (+) strand; PAM type: YTN; PAM sequence: CTA
cagccaagatcaagttgacc

SEQ ID NO: 68109 - DNA, 20 bp, Artificial Sequence
  Description of Artificial Sequence: Synthetic oligonucleotide
  Target: SCN10A; (+) strand; PAM type: YTN; PAM sequence: TTG
accaggtagaaagatcccag

SEQ ID NO: 68110 - DNA, 20 bp, Artificial Sequence
  Description of Artificial Sequence: Synthetic oligonucleotide
  Target: SCN10A; (+) strand; PAM type: YTN; PAM sequence: TTA
cgagcacaaaaaagatcata

SEQ ID NO: 68111 - DNA, 20 bp, Artificial Sequence
  Description of Artificial Sequence: Synthetic oligonucleotide
  Target: SCN10A; (+) strand; PAM type: YTN; PAM sequence: TTT
tcccagaagtcctcagggtc

SEQ ID NO: 68112 - DNA, 20 bp, Artificial Sequence
  Description of Artificial Sequence: Synthetic oligonucleotide
  Target: SCN10A; (+) strand; PAM type: YTN; PAM sequence: TTT
cccagaagtcctcagggtct

SEQ ID NO: 68113 - DNA, 20 bp, Artificial Sequence
  Description of Artificial Sequence: Synthetic oligonucleotide
  Target: SCN10A; (+) strand; PAM type: YTN; PAM sequence: TTC
ccagaagtcctcagggtctg

SEQ ID NO: 68114 - DNA, 20 bp, Artificial Sequence
  Description of Artificial Sequence: Synthetic oligonucleotide
  Target: SCN10A; (+) strand; PAM type: YTN; PAM sequence: CTC
agggtctgcaggttcaaggg

SEQ ID NO: 68115 - DNA, 20 bp, Artificial Sequence
  Description of Artificial Sequence: Synthetic oligonucleotide
  Target: SCN10A; (+) strand; PAM type: YTN; PAM sequence: CTG
caggttcaagggaaagaaga

SEQ ID NO: 68116 - DNA, 20 bp, Artificial Sequence
  Description of Artificial Sequence: Synthetic oligonucleotide
  Target: SCN10A; (+) strand; PAM type: YTN; PAM sequence: TTC
aagggaaagaagagaaacct

SEQ ID NO: 68117 - DNA, 20 bp, Artificial Sequence
  Description of Artificial Sequence: Synthetic oligonucleotide
  Target: SCN10A; (+) strand; PAM type: YTN; PAM sequence: CTG
tacccatagcacatggaccc

SEQ ID NO: 68118 - DNA, 20 bp, Artificial Sequence
  Description of Artificial Sequence: Synthetic oligonucleotide
  Target: SCN10A; (+) strand; PAM type: YTN; PAM sequence: CTG
aatttaagtcagcctcctcc

SEQ ID NO: 68119 - DNA, 20 bp, Artificial Sequence
  Description of Artificial Sequence: Synthetic oligonucleotide
  Target: SCN10A; (+) strand; PAM type: YTN; PAM sequence: TTT
aagtcagcctcctccaggaa

SEQ ID NO: 68120 - DNA, 20 bp, Artificial Sequence
  Description of Artificial Sequence: Synthetic oligonucleotide
  Target: SCN10A; (+) strand; PAM type: YTN; PAM sequence: TTA
agtcagcctcctccaggaaa

SEQ ID NO: 68121 - DNA, 20 bp, Artificial Sequence
  Description of Artificial Sequence: Synthetic oligonucleotide
  Target: SCN10A; (+) strand; PAM type: YTN; PAM sequence: CTC
ctccaggaaaagcacagcca

SEQ ID NO: 68122 - DNA, 20 bp, Artificial Sequence
  Description of Artificial Sequence: Synthetic oligonucleotide
  Target: SCN10A; (+) strand; PAM type: YTN; PAM sequence: CTC
caggaaaagcacagccatgc

SEQ ID NO: 68123 - DNA, 20 bp, Artificial Sequence
  Description of Artificial Sequence: Synthetic oligonucleotide
  Target: SCN10A; (+) strand; PAM type: YTN; PAM sequence: CTG
acccaccagcctccaaccaa

SEQ ID NO: 68124 - DNA, 20 bp, Artificial Sequence
  Description of Artificial Sequence: Synthetic oligonucleotide
  Target: SCN10A; (+) strand; PAM type: YTN; PAM sequence: CTC
caaccaagtctgcgtggggg

SEQ ID NO: 68125 - DNA, 20 bp, Artificial Sequence
  Description of Artificial Sequence: Synthetic oligonucleotide
  Target: SCN10A; (+) strand; PAM type: YTN; PAM sequence: CTG
cgtgggggaatgcagctcag

SEQ ID NO: 68126 - DNA, 20 bp, Artificial Sequence
  Description of Artificial Sequence: Synthetic oligonucleotide
  Target: SCN10A; (+) strand; PAM type: YTN; PAM sequence: CTC
agtacctgctggtagaggcg

SEQ ID NO: 68127 - DNA, 20 bp, Artificial Sequence
  Description of Artificial Sequence: Synthetic oligonucleotide
  Target: SCN10A; (+) strand; PAM type: YTN; PAM sequence: CTG
ctggtagaggcgttcccagg

SEQ ID NO: 68128 - DNA, 20 bp, Artificial Sequence
  Description of Artificial Sequence: Synthetic oligonucleotide
  Target: SCN10A; (+) strand; PAM type: YTN; PAM sequence: CTG
gtagaggcgttcccaggaat

SEQ ID NO: 68129 - DNA, 20 bp, Artificial Sequence
  Description of Artificial Sequence: Synthetic oligonucleotide
  Target: SCN10A; (+) strand; PAM type: YTN; PAM sequence: TTC
ccaggaatcctgtgtcatga

SEQ ID NO: 68130 - DNA, 20 bp, Artificial Sequence
  Description of Artificial Sequence: Synthetic oligonucleotide
  Target: SCN10A; (+) strand; PAM type: YTN; PAM sequence: CTG
tgtcatgaggcggaacagtg

SEQ ID NO: 68131 - DNA, 20 bp, Artificial Sequence
  Description of Artificial Sequence: Synthetic oligonucleotide
  Target: SCN10A; (+) strand; PAM type: YTN; PAM sequence: CTG
gtgtagttaaaatccgggtt

SEQ ID NO: 68132 - DNA, 20 bp, Artificial Sequence
  Description of Artificial Sequence: Synthetic oligonucleotide
  Target: SCN10A; (+) strand; PAM type: YTN; PAM sequence: TTA
aaatccgggttgtcagaagt

SEQ ID NO: 68133 - DNA, 20 bp, Artificial Sequence
  Description of Artificial Sequence: Synthetic oligonucleotide
  Target: SCN10A; (+) strand; PAM type: YTN; PAM sequence: TTG
tcagaagttttaaggcagat

SEQ ID NO: 68134 - DNA, 20 bp, Artificial Sequence
  Description of Artificial Sequence: Synthetic oligonucleotide
  Target: SCN10A; (+) strand; PAM type: YTN; PAM sequence: TTT
taaggcagatataaccatca

SEQ ID NO: 68135 - DNA, 20 bp, Artificial Sequence
  Description of Artificial Sequence: Synthetic oligonucleotide
  Target: SCN10A; (+) strand; PAM type: YTN; PAM sequence: TTT
aaggcagatataaccatcag

SEQ ID NO: 68136 - DNA, 20 bp, Artificial Sequence
  Description of Artificial Sequence: Synthetic oligonucleotide
  Target: SCN10A; (+) strand; PAM type: YTN; PAM sequence: TTA
aggcagatataaccatcagg

SEQ ID NO: 68137 - DNA, 20 bp, Artificial Sequence
  Description of Artificial Sequence: Synthetic oligonucleotide
  Target: SCN10A; (+) strand; PAM type: YTN; PAM sequence: CTG
cagcaagaacagagaaggtc

SEQ ID NO: 68138 - DNA, 20 bp, Artificial Sequence
  Description of Artificial Sequence: Synthetic oligonucleotide
  Target: SCN10A; (+) strand; PAM type: YTN; PAM sequence: CTG
cttattgcagacaaggtagc

SEQ ID NO: 68139 - DNA, 20 bp, Artificial Sequence
  Description of Artificial Sequence: Synthetic oligonucleotide
  Target: SCN10A; (+) strand; PAM type: YTN; PAM sequence: CTT
attgcagacaaggtagccca

SEQ ID NO: 68140 - DNA, 20 bp, Artificial Sequence
  Description of Artificial Sequence: Synthetic oligonucleotide
  Target: SCN10A; (+) strand; PAM type: YTN; PAM sequence: TTA
ttgcagacaaggtagcccag

SEQ ID NO: 68141 - DNA, 20 bp, Artificial Sequence
  Description of Artificial Sequence: Synthetic oligonucleotide
  Target: SCN10A; (+) strand; PAM type: YTN; PAM sequence: TTG
cagacaaggtagcccagggc

SEQ ID NO: 68142 - DNA, 20 bp, Artificial Sequence
  Description of Artificial Sequence: Synthetic oligonucleotide
  Target: SCN10A; (+) strand; PAM type: YTN; PAM sequence: CTG
cgagacaaccacagagtttt

SEQ ID NO: 68143 - DNA, 20 bp, Artificial Sequence
  Description of Artificial Sequence: Synthetic oligonucleotide
  Target: SCN10A; (+) strand; PAM type: YTN; PAM sequence: TTT
tatgtcagagatcagagttc

SEQ ID NO: 68144 - DNA, 20 bp, Artificial Sequence
  Description of Artificial Sequence: Synthetic oligonucleotide
  Target: SCN10A; (+) strand; PAM type: YTN; PAM sequence: TTT
atgtcagagatcagagttca

SEQ ID NO: 68145 - DNA, 20 bp, Artificial Sequence
  Description of Artificial Sequence: Synthetic oligonucleotide
  Target: SCN10A; (+) strand; PAM type: YTN; PAM sequence: TTA
tgtcagagatcagagttcaa

SEQ ID NO: 68146 - DNA, 20 bp, Artificial Sequence
  Description of Artificial Sequence: Synthetic oligonucleotide
  Target: SCN10A; (+) strand; PAM type: YTN; PAM sequence: TTC
aagacctagtcttcctctta

SEQ ID NO: 68147 - DNA, 20 bp, Artificial Sequence
  Description of Artificial Sequence: Synthetic oligonucleotide
  Target: SCN10A; (+) strand; PAM type: YTN; PAM sequence: CTA
gtcttcctcttattagcagg

SEQ ID NO: 68148 - DNA, 20 bp, Artificial Sequence
  Description of Artificial Sequence: Synthetic oligonucleotide
  Target: SCN10A; (+) strand; PAM type: YTN; PAM sequence: CTT
cctcttattagcaggatgat

SEQ ID NO: 68149 - DNA, 20 bp, Artificial Sequence
  Description of Artificial Sequence: Synthetic oligonucleotide
  Target: SCN10A; (+) strand; PAM type: YTN; PAM sequence: TTC
ctcttattagcaggatgatc

SEQ ID NO: 68150 - DNA, 20 bp, Artificial Sequence
  Description of Artificial Sequence: Synthetic oligonucleotide
  Target: SCN10A; (+) strand; PAM type: YTN; PAM sequence: CTC
ttattagcaggatgatcttg

SEQ ID NO: 68151 - DNA, 20 bp, Artificial Sequence
  Description of Artificial Sequence: Synthetic oligonucleotide
  Target: SCN10A; (+) strand; PAM type: YTN; PAM sequence: CTT
attagcaggatgatcttgga

SEQ ID NO: 68152 - DNA, 20 bp, Artificial Sequence
  Description of Artificial Sequence: Synthetic oligonucleotide
  Target: SCN10A; (+) strand; PAM type: YTN; PAM sequence: TTA
ttagcaggatgatcttggac

SEQ ID NO: 68153 - DNA, 20 bp, Artificial Sequence
  Description of Artificial Sequence: Synthetic oligonucleotide
  Target: SCN10A; (+) strand; PAM type: YTN; PAM sequence: TTA
gcaggatgatcttggacact

SEQ ID NO: 68154 - DNA, 20 bp, Artificial Sequence
  Description of Artificial Sequence: Synthetic oligonucleotide
  Target: SCN10A; (+) strand; PAM type: YTN; PAM sequence: CTT
ggacacttggtctgtttagg

SEQ ID NO: 68155 - DNA, 20 bp, Artificial Sequence
  Description of Artificial Sequence: Synthetic oligonucleotide
  Target: SCN10A; (+) strand; PAM type: YTN; PAM sequence: TTG
gacacttggtctgtttaggt

SEQ ID NO: 68156 - DNA, 20 bp, Artificial Sequence
  Description of Artificial Sequence: Synthetic oligonucleotide
  Target: SCN10A; (+) strand; PAM type: YTN; PAM sequence: CTT
ggtctgtttaggtattggtt

SEQ ID NO: 68157 - DNA, 20 bp, Artificial Sequence
  Description of Artificial Sequence: Synthetic oligonucleotide
  Target: SCN10A; (+) strand; PAM type: YTN; PAM sequence: TTG
gtctgtttaggtattggttt

SEQ ID NO: 68158 - DNA, 20 bp, Artificial Sequence
  Description of Artificial Sequence: Synthetic oligonucleotide
  Target: SCN10A; (+) strand; PAM type: YTN; PAM sequence: CTG
tttaggtattggtttctgtt

SEQ ID NO: 68159 - DNA, 20 bp, Artificial Sequence
  Description of Artificial Sequence: Synthetic oligonucleotide
  Target: SCN10A; (+) strand; PAM type: YTN; PAM sequence: TTT
aggtattggtttctgttatc

SEQ ID NO: 68160 - DNA, 20 bp, Artificial Sequence
  Description of Artificial Sequence: Synthetic oligonucleotide
  Target: SCN10A; (+) strand; PAM type: YTN; PAM sequence: TTA
ggtattggtttctgttatcc

SEQ ID NO: 68161 - DNA, 20 bp, Artificial Sequence
  Description of Artificial Sequence: Synthetic oligonucleotide
  Target: SCN10A; (+) strand; PAM type: YTN; PAM sequence: TTG
gtttctgttatccataaaac

SEQ ID NO: 68162 - DNA, 20 bp, Artificial Sequence
  Description of Artificial Sequence: Synthetic oligonucleotide
  Target: SCN10A; (+) strand; PAM type: YTN; PAM sequence: TTT
ctgttatccataaaacgggg

SEQ ID NO: 68163 - DNA, 20 bp, Artificial Sequence
  Description of Artificial Sequence: Synthetic oligonucleotide
  Target: SCN10A; (+) strand; PAM type: YTN; PAM sequence: TTC
tgttatccataaaacgggga

SEQ ID NO: 68164 - DNA, 20 bp, Artificial Sequence
  Description of Artificial Sequence: Synthetic oligonucleotide
  Target: SCN10A; (+) strand; PAM type: YTN; PAM sequence: CTG
ttatccataaaacggggacg

SEQ ID NO: 68165 - DNA, 20 bp, Artificial Sequence
  Description of Artificial Sequence: Synthetic oligonucleotide
  Target: SCN10A; (+) strand; PAM type: YTN; PAM sequence: TTA
tccataaaacggggacgcta

SEQ ID NO: 68166 - DNA, 20 bp, Artificial Sequence
  Description of Artificial Sequence: Synthetic oligonucleotide
  Target: SCN10A; (+) strand; PAM type: YTN; PAM sequence: CTA
atactttcacgtcagaattt

SEQ ID NO: 68167 - DNA, 20 bp, Artificial Sequence
  Description of Artificial Sequence: Synthetic oligonucleotide
  Target: SCN10A; (+) strand; PAM type: YTN; PAM sequence: CTT
tcacgtcagaatttcataca

SEQ ID NO: 68168 - DNA, 20 bp, Artificial Sequence
  Description of Artificial Sequence: Synthetic oligonucleotide
  Target: SCN10A; (+) strand; PAM type: YTN; PAM sequence: TTT
cacgtcagaatttcatacac

SEQ ID NO: 68169 - DNA, 20 bp, Artificial Sequence
  Description of Artificial Sequence: Synthetic oligonucleotide
  Target: SCN10A; (+) strand; PAM type: YTN; PAM sequence: TTC
acgtcagaatttcatacaca

SEQ ID NO: 68170 - DNA, 20 bp, Artificial Sequence
  Description of Artificial Sequence: Synthetic oligonucleotide
  Target: SCN10A; (+) strand; PAM type: YTN; PAM sequence: TTT
catacacaggggagtggcct

SEQ ID NO: 68171 - DNA, 20 bp, Artificial Sequence
  Description of Artificial Sequence: Synthetic oligonucleotide
  Target: SCN10A; (+) strand; PAM type: YTN; PAM sequence: TTC
atacacaggggagtggcctg

SEQ ID NO: 68172 - DNA, 20 bp, Artificial Sequence
  Description of Artificial Sequence: Synthetic oligonucleotide
  Target: SCN10A; (+) strand; PAM type: YTN; PAM sequence: CTG
gggaaggcagctgactgccc

SEQ ID NO: 68173 - DNA, 20 bp, Artificial Sequence
  Description of Artificial Sequence: Synthetic oligonucleotide
  Target: SCN10A; (+) strand; PAM type: YTN; PAM sequence: CTG
actgcccagacacgatacta

SEQ ID NO: 68174 - DNA, 20 bp, Artificial Sequence
  Description of Artificial Sequence: Synthetic oligonucleotide
  Target: SCN10A; (+) strand; PAM type: YTN; PAM sequence: CTG
cccagacacgatactataag

SEQ ID NO: 68175 - DNA, 20 bp, Artificial Sequence
  Description of Artificial Sequence: Synthetic oligonucleotide
  Target: SCN10A; (+) strand; PAM type: YTN; PAM sequence: CTA
taagctctttgccagttcat

SEQ ID NO: 68176 - DNA, 20 bp, Artificial Sequence
  Description of Artificial Sequence: Synthetic oligonucleotide
  Target: SCN10A; (+) strand; PAM type: YTN; PAM sequence: CTC
tttgccagttcataccaggg

SEQ ID NO: 68177 - DNA, 20 bp, Artificial Sequence
  Description of Artificial Sequence: Synthetic oligonucleotide
  Target: SCN10A; (+) strand; PAM type: YTN; PAM sequence: CTT
tgccagttcataccagggaa

SEQ ID NO: 68178 - DNA, 20 bp, Artificial Sequence
  Description of Artificial Sequence: Synthetic oligonucleotide
  Target: SCN10A; (+) strand; PAM type: YTN; PAM sequence: TTT
gccagttcataccagggaaa

SEQ ID NO: 68179 - DNA, 20 bp, Artificial Sequence
  Description of Artificial Sequence: Synthetic oligonucleotide
  Target: SCN10A; (+) strand; PAM type: YTN; PAM sequence: TTG
ccagttcataccagggaaat

SEQ ID NO: 68180 - DNA, 20 bp, Artificial Sequence
  Description of Artificial Sequence: Synthetic oligonucleotide
  Target: SCN10A; (+) strand; PAM type: YTN; PAM sequence: TTC
ataccagggaaatgagagtc

SEQ ID NO: 68181 - DNA, 20 bp, Artificial Sequence
  Description of Artificial Sequence: Synthetic oligonucleotide
  Target: SCN10A; (+) strand; PAM type: YTN; PAM sequence: CTT
aaaacctgagcctgttggca

SEQ ID NO: 68182 - DNA, 20 bp, Artificial Sequence
  Description of Artificial Sequence: Synthetic oligonucleotide
  Target: SCN10A; (+) strand; PAM type: YTN; PAM sequence: TTA
aaacctgagcctgttggcat

SEQ ID NO: 68183 - DNA, 20 bp, Artificial Sequence
  Description of Artificial Sequence: Synthetic oligonucleotide
  Target: SCN10A; (+) strand; PAM type: YTN; PAM sequence: CTG
agcctgttggcatcatctgc

SEQ ID NO: 68184 - DNA, 20 bp, Artificial Sequence
  Description of Artificial Sequence: Synthetic oligonucleotide
  Target: SCN10A; (+) strand; PAM type: YTN; PAM sequence: CTG
ttggcatcatctgcagagtt

SEQ ID NO: 68185 - DNA, 20 bp, Artificial Sequence
  Description of Artificial Sequence: Synthetic oligonucleotide
  Target: SCN10A; (+) strand; PAM type: YTN; PAM sequence: TTG
gcatcatctgcagagttgtc

SEQ ID NO: 68186 - DNA, 20 bp, Artificial Sequence
  Description of Artificial Sequence: Synthetic oligonucleotide
  Target: SCN10A; (+) strand; PAM type: YTN; PAM sequence: CTG
cagagttgtctatcaaggga

SEQ ID NO: 68187 - DNA, 20 bp, Artificial Sequence
  Description of Artificial Sequence: Synthetic oligonucleotide
  Target: SCN10A; (+) strand; PAM type: YTN; PAM sequence: TTG
tctatcaagggaggtctcac

SEQ ID NO: 68188 - DNA, 20 bp, Artificial Sequence
  Description of Artificial Sequence: Synthetic oligonucleotide
  Target: SCN10A; (+) strand; PAM type: YTN; PAM sequence: CTA
tcaagggaggtctcacatta

SEQ ID NO: 68189 - DNA, 20 bp, Artificial Sequence
  Description of Artificial Sequence: Synthetic oligonucleotide
  Target: SCN10A; (+) strand; PAM type: YTN; PAM sequence: CTC
acattagccaagttcactga

SEQ ID NO: 68190 - DNA, 20 bp, Artificial Sequence
  Description of Artificial Sequence: Synthetic oligonucleotide
  Target: SCN10A; (+) strand; PAM type: YTN; PAM sequence: TTA
gccaagttcactgattaatt

SEQ ID NO: 68191 - DNA, 20 bp, Artificial Sequence
  Description of Artificial Sequence: Synthetic oligonucleotide
  Target: SCN10A; (+) strand; PAM type: YTN; PAM sequence: TTC
actgattaattatatgtaac

SEQ ID NO: 68192 - DNA, 20 bp, Artificial Sequence
  Description of Artificial Sequence: Synthetic oligonucleotide
  Target: SCN10A; (+) strand; PAM type: YTN; PAM sequence: CTG
attaattatatgtaacagtg

SEQ ID NO: 68193 - DNA, 20 bp, Artificial Sequence
  Description of Artificial Sequence: Synthetic oligonucleotide
  Target: SCN10A; (+) strand; PAM type: YTN; PAM sequence: TTA
attatatgtaacagtggaaa

SEQ ID NO: 68194 - DNA, 20 bp, Artificial Sequence
  Description of Artificial Sequence: Synthetic oligonucleotide
  Target: SCN10A; (+) strand; PAM type: YTN; PAM sequence: TTA
tatgtaacagtggaaataac

SEQ ID NO: 68195 - DNA, 20 bp, Artificial Sequence
  Description of Artificial Sequence: Synthetic oligonucleotide
  Target: SCN10A; (+) strand; PAM type: YTN; PAM sequence: CTT
tccacttactgagcactttc

SEQ ID NO: 68196 - DNA, 20 bp, Artificial Sequence
  Description of Artificial Sequence: Synthetic oligonucleotide
  Target: SCN10A; (+) strand; PAM type: YTN; PAM sequence: TTT
ccacttactgagcactttct

SEQ ID NO: 68197 - DNA, 20 bp, Artificial Sequence
  Description of Artificial Sequence: Synthetic oligonucleotide
  Target: SCN10A; (+) strand; PAM type: YTN; PAM sequence: TTC
cacttactgagcactttctg

SEQ ID NO: 68198 - DNA, 20 bp, Artificial Sequence
  Description of Artificial Sequence: Synthetic oligonucleotide
  Target: SCN10A; (+) strand; PAM type: YTN; PAM sequence: CTT
actgagcactttctgtgttc

SEQ ID NO: 68199 - DNA, 20 bp, Artificial Sequence
  Description of Artificial Sequence: Synthetic oligonucleotide
  Target: SCN10A; (+) strand; PAM type: YTN; PAM sequence: TTA
ctgagcactttctgtgttct

SEQ ID NO: 68200 - DNA, 20 bp, Artificial Sequence
  Description of Artificial Sequence: Synthetic oligonucleotide
  Target: SCN10A; (+) strand; PAM type: YTN; PAM sequence: CTG
agcactttctgtgttcttct

SEQ ID NO: 68201 - DNA, 20 bp, Artificial Sequence
  Description of Artificial Sequence: Synthetic oligonucleotide
  Target: SCN10A; (+) strand; PAM type: YTN; PAM sequence: CTT
tctgtgttcttctctctccc

SEQ ID NO: 68202 - DNA, 20 bp, Artificial Sequence
  Description of Artificial Sequence: Synthetic oligonucleotide
  Target: SCN10A; (+) strand; PAM type: YTN; PAM sequence: TTT
ctgtgttcttctctctccct

SEQ ID NO: 68203 - DNA, 20 bp, Artificial Sequence
  Description of Artificial Sequence: Synthetic oligonucleotide
  Target: SCN10A; (+) strand; PAM type: YTN; PAM sequence: TTC
tgtgttcttctctctccctt

SEQ ID NO: 68204 - DNA, 20 bp, Artificial Sequence
  Description of Artificial Sequence: Synthetic oligonucleotide
  Target: SCN10A; (+) strand; PAM type: YTN; PAM sequence: CTG
tgttcttctctctcccttta

SEQ ID NO: 68205 - DNA, 20 bp, Artificial Sequence
  Description of Artificial Sequence: Synthetic oligonucleotide
  Target: SCN10A; (+) strand; PAM type: YTN; PAM sequence: TTC
ttctctctccctttaagtgc

SEQ ID NO: 68206 - DNA, 20 bp, Artificial Sequence
  Description of Artificial Sequence: Synthetic oligonucleotide
  Target: SCN10A; (+) strand; PAM type: YTN; PAM sequence: CTT
ctctctccctttaagtgctt

SEQ ID NO: 68207 - DNA, 20 bp, Artificial Sequence
  Description of Artificial Sequence: Synthetic oligonucleotide
  Target: SCN10A; (+) strand; PAM type: YTN; PAM sequence: TTC
tctctccctttaagtgcttt

SEQ ID NO: 68208 - DNA, 20 bp, Artificial Sequence
  Description of Artificial Sequence: Synthetic oligonucleotide
  Target: SCN10A; (+) strand; PAM type: YTN; PAM sequence: CTC
tctccctttaagtgctttac

SEQ ID NO: 68209 - DNA, 20 bp, Artificial Sequence
  Description of Artificial Sequence: Synthetic oligonucleotide
  Target: SCN10A; (+) strand; PAM type: YTN; PAM sequence: CTC
tccctttaagtgctttacaa

SEQ ID NO: 68210 - DNA, 20 bp, Artificial Sequence
  Description of Artificial Sequence: Synthetic oligonucleotide
  Target: SCN10A; (+) strand; PAM type: YTN; PAM sequence: CTC
cctttaagtgctttacaaac

SEQ ID NO: 68211 - DNA, 20 bp, Artificial Sequence
  Description of Artificial Sequence: Synthetic oligonucleotide
  Target: SCN10A; (+) strand; PAM type: YTN; PAM sequence: CTT
taagtgctttacaaacacta

SEQ ID NO: 68212 - DNA, 20 bp, Artificial Sequence
  Description of Artificial Sequence: Synthetic oligonucleotide
  Target: SCN10A; (+) strand; PAM type: YTN; PAM sequence: TTT
aagtgctttacaaacactat

SEQ ID NO: 68213 - DNA, 20 bp, Artificial Sequence
  Description of Artificial Sequence: Synthetic oligonucleotide
  Target: SCN10A; (+) strand; PAM type: YTN; PAM sequence: TTA
agtgctttacaaacactata

SEQ ID NO: 68214 - DNA, 20 bp, Artificial Sequence
  Description of Artificial Sequence: Synthetic oligonucleotide
  Target: SCN10A; (+) strand; PAM type: YTN; PAM sequence: CTT
tacaaacactataatttaat

SEQ ID NO: 68215 - DNA, 20 bp, Artificial Sequence
  Description of Artificial Sequence: Synthetic oligonucleotide
  Target: SCN10A; (+) strand; PAM type: YTN; PAM sequence: TTT
acaaacactataatttaatc

SEQ ID NO: 68216 - DNA, 20 bp, Artificial Sequence
  Description of Artificial Sequence: Synthetic oligonucleotide
  Target: SCN10A; (+) strand; PAM type: YTN; PAM sequence: TTA
caaacactataatttaatca

SEQ ID NO: 68217 - DNA, 20 bp, Artificial Sequence
  Description of Artificial Sequence: Synthetic oligonucleotide
  Target: SCN10A; (+) strand; PAM type: YTN; PAM sequence: CTA
taatttaatcactcaatgtt

SEQ ID NO: 68218 - DNA, 20 bp, Artificial Sequence
  Description of Artificial Sequence: Synthetic oligonucleotide
  Target: SCN10A; (+) strand; PAM type: YTN; PAM sequence: TTT
aatcactcaatgttctttct

SEQ ID NO: 68219 - DNA, 20 bp, Artificial Sequence
  Description of Artificial Sequence: Synthetic oligonucleotide
  Target: SCN10A; (+) strand; PAM type: YTN; PAM sequence: TTA
atcactcaatgttctttctt

SEQ ID NO: 68220 - DNA, 20 bp, Artificial Sequence
  Description of Artificial Sequence: Synthetic oligonucleotide
  Target: SCN10A; (+) strand; PAM type: YTN; PAM sequence: CTC
aatgttctttctttacagat

SEQ ID NO: 68221 - DNA, 20 bp, Artificial Sequence
  Description of Artificial Sequence: Synthetic oligonucleotide
  Target: SCN10A; (+) strand; PAM type: YTN; PAM sequence: TTC
tttctttacagataaggaat

SEQ ID NO: 68222 - DNA, 20 bp, Artificial Sequence
  Description of Artificial Sequence: Synthetic oligonucleotide
  Target: SCN10A; (+) strand; PAM type: YTN; PAM sequence: CTT
tctttacagataaggaatct

SEQ ID NO: 68223 - DNA, 20 bp, Artificial Sequence
  Description of Artificial Sequence: Synthetic oligonucleotide
  Target: SCN10A; (+) strand; PAM type: YTN; PAM sequence: TTT
ctttacagataaggaatctg

SEQ ID NO: 68224 - DNA, 20 bp, Artificial Sequence
  Description of Artificial Sequence: Synthetic oligonucleotide
  Target: SCN10A; (+) strand; PAM type: YTN; PAM sequence: TTC
tttacagataaggaatctgg

SEQ ID NO: 68225 - DNA, 20 bp, Artificial Sequence
  Description of Artificial Sequence: Synthetic oligonucleotide
  Target: SCN10A; (+) strand; PAM type: YTN; PAM sequence: CTT
tacagataaggaatctgggg

SEQ ID NO: 68226 - DNA, 20 bp, Artificial Sequence
  Description of Artificial Sequence: Synthetic oligonucleotide
  Target: SCN10A; (+) strand; PAM type: YTN; PAM sequence: TTT
acagataaggaatctggggg

SEQ ID NO: 68227 - DNA, 20 bp, Artificial Sequence
  Description of Artificial Sequence: Synthetic oligonucleotide
  Target: SCN10A; (+) strand; PAM type: YTN; PAM sequence: TTA
cagataaggaatctgggggt

SEQ ID NO: 68228 - DNA, 20 bp, Artificial Sequence
  Description of Artificial Sequence: Synthetic oligonucleotide
  Target: SCN10A; (+) strand; PAM type: YTN; PAM sequence: CTG
ggggtcagaaagaagtcagt

SEQ ID NO: 68229 - DNA, 20 bp, Artificial Sequence
  Description of Artificial Sequence: Synthetic oligonucleotide
  Target: SCN10A; (+) strand; PAM type: YTN; PAM sequence: TTG
cctaaaactacgcaggtgtc

SEQ ID NO: 68230 - DNA, 20 bp, Artificial Sequence
  Description of Artificial Sequence: Synthetic oligonucleotide
  Target: SCN10A; (+) strand; PAM type: YTN; PAM sequence: CTA
aaactacgcaggtgtcaata

SEQ ID NO: 68231 - DNA, 20 bp, Artificial Sequence
  Description of Artificial Sequence: Synthetic oligonucleotide
  Target: SCN10A; (+) strand; PAM type: YTN; PAM sequence: CTA
cgcaggtgtcaatatattta

SEQ ID NO: 68232 - DNA, 20 bp, Artificial Sequence
  Description of Artificial Sequence: Synthetic oligonucleotide
  Target: SCN10A; (+) strand; PAM type: YTN; PAM sequence: TTT
attaaaaggagaaatataac

SEQ ID NO: 68233 - DNA, 20 bp, Artificial Sequence
  Description of Artificial Sequence: Synthetic oligonucleotide
  Target: SCN10A; (+) strand; PAM type: YTN; PAM sequence: TTA
ttaaaaggagaaatataact

SEQ ID NO: 68234 - DNA, 20 bp, Artificial Sequence
  Description of Artificial Sequence: Synthetic oligonucleotide
  Target: SCN10A; (+) strand; PAM type: YTN; PAM sequence: TTA
aaaggagaaatataactgtc

SEQ ID NO: 68235 - DNA, 20 bp, Artificial Sequence
  Description of Artificial Sequence: Synthetic oligonucleotide
  Target: SCN10A; (+) strand; PAM type: YTN; PAM sequence: CTG
tcaagtagcccaatacttga

SEQ ID NO: 68236 - DNA, 20 bp, Artificial Sequence
  Description of Artificial Sequence: Synthetic oligonucleotide
  Target: SCN10A; (+) strand; PAM type: YTN; PAM sequence: CTT
gagtcagcctagcctcctcc

SEQ ID NO: 68237 - DNA, 20 bp, Artificial Sequence
  Description of Artificial Sequence: Synthetic oligonucleotide
  Target: SCN10A; (+) strand; PAM type: YTN; PAM sequence: TTG
agtcagcctagcctcctcct

SEQ ID NO: 68238 - DNA, 20 bp, Artificial Sequence
  Description of Artificial Sequence: Synthetic oligonucleotide
  Target: SCN10A; (+) strand; PAM type: YTN; PAM sequence: CTA
gcctcctcctgaagatggcc

SEQ ID NO: 68239 - DNA, 20 bp, Artificial Sequence
  Description of Artificial Sequence: Synthetic oligonucleotide
  Target: SCN10A; (+) strand; PAM type: YTN; PAM sequence: CTC
ctcctgaagatggcctatga

SEQ ID NO: 68240 - DNA, 20 bp, Artificial Sequence
  Description of Artificial Sequence: Synthetic oligonucleotide
  Target: SCN10A; (+) strand; PAM type: YTN; PAM sequence: CTC
ctgaagatggcctatgaagg

SEQ ID NO: 68241 - DNA, 20 bp, Artificial Sequence
  Description of Artificial Sequence: Synthetic oligonucleotide
  Target: SCN10A; (+) strand; PAM type: YTN; PAM sequence: CTG
aagatggcctatgaaggaag

SEQ ID NO: 68242 - DNA, 20 bp, Artificial Sequence
  Description of Artificial Sequence: Synthetic oligonucleotide
  Target: SCN10A; (+) strand; PAM type: YTN; PAM sequence: CTA
tgaaggaaggccagattaaa

SEQ ID NO: 68243 - DNA, 20 bp, Artificial Sequence
  Description of Artificial Sequence: Synthetic oligonucleotide
  Target: SCN10A; (+) strand; PAM type: YTN; PAM sequence: TTA
aaaatgactgcctggtgagt

SEQ ID NO: 68244 - DNA, 20 bp, Artificial Sequence
  Description of Artificial Sequence: Synthetic oligonucleotide
  Target: SCN10A; (+) strand; PAM type: YTN; PAM sequence: CTG
cctggtgagtattgaggtgg

SEQ ID NO: 68245 - DNA, 20 bp, Artificial Sequence
  Description of Artificial Sequence: Synthetic oligonucleotide
  Target: SCN10A; (+) strand; PAM type: YTN; PAM sequence: CTG
gtgagtattgaggtgggaat

SEQ ID NO: 68246 - DNA, 20 bp, Artificial Sequence
  Description of Artificial Sequence: Synthetic oligonucleotide
  Target: SCN10A; (+) strand; PAM type: YTN; PAM sequence: TTG
aggtgggaatgctgaactcc

SEQ ID NO: 68247 - DNA, 20 bp, Artificial Sequence
  Description of Artificial Sequence: Synthetic oligonucleotide
  Target: SCN10A; (+) strand; PAM type: YTN; PAM sequence: CTG
aactccttcctctctctcat

SEQ ID NO: 68248 - DNA, 20 bp, Artificial Sequence
  Description of Artificial Sequence: Synthetic oligonucleotide
  Target: SCN10A; (+) strand; PAM type: YTN; PAM sequence: CTC
cttcctctctctcataatag

SEQ ID NO: 68249 - DNA, 20 bp, Artificial Sequence
  Description of Artificial Sequence: Synthetic oligonucleotide
  Target: SCN10A; (+) strand; PAM type: YTN; PAM sequence: CTT
cctctctctcataataggag

SEQ ID NO: 68250 - DNA, 20 bp, Artificial Sequence
  Description of Artificial Sequence: Synthetic oligonucleotide
  Target: SCN10A; (+) strand; PAM type: YTN; PAM sequence: TTC
ctctctctcataataggagg

SEQ ID NO: 68251 - DNA, 20 bp, Artificial Sequence
  Description of Artificial Sequence: Synthetic oligonucleotide
  Target: SCN10A; (+) strand; PAM type: YTN; PAM sequence: CTC
tctctcataataggaggatg

SEQ ID NO: 68252 - DNA, 20 bp, Artificial Sequence
  Description of Artificial Sequence: Synthetic oligonucleotide
  Target: SCN10A; (+) strand; PAM type: YTN; PAM sequence: CTC
tctcataataggaggatgag

SEQ ID NO: 68253 - DNA, 20 bp, Artificial Sequence
  Description of Artificial Sequence: Synthetic oligonucleotide
  Target: SCN10A; (+) strand; PAM type: YTN; PAM sequence: CTC
tcataataggaggatgagtc

SEQ ID NO: 68254 - DNA, 20 bp, Artificial Sequence
  Description of Artificial Sequence: Synthetic oligonucleotide
  Target: SCN10A; (+) strand; PAM type: YTN; PAM sequence: CTC
ataataggaggatgagtcga

SEQ ID NO: 68255 - DNA, 20 bp, Artificial Sequence
  Description of Artificial Sequence: Synthetic oligonucleotide
  Target: SCN10A; (+) strand; PAM type: YTN; PAM sequence: CTG
tcagctcagggagcgtaaag

SEQ ID NO: 68256 - DNA, 20 bp, Artificial Sequence
  Description of Artificial Sequence: Synthetic oligonucleotide
  Target: SCN10A; (+) strand; PAM type: YTN; PAM sequence: CTC
agggagcgtaaagtgctctc

SEQ ID NO: 68257 - DNA, 20 bp, Artificial Sequence
  Description of Artificial Sequence: Synthetic oligonucleotide
  Target: SCN10A; (+) strand; PAM type: YTN; PAM sequence: CTC
tcatccaccctagcagagat

SEQ ID NO: 68258 - DNA, 20 bp, Artificial Sequence
  Description of Artificial Sequence: Synthetic oligonucleotide
  Target: SCN10A; (+) strand; PAM type: YTN; PAM sequence: CTC
atccaccctagcagagatgg

SEQ ID NO: 68259 - DNA, 20 bp, Artificial Sequence
  Description of Artificial Sequence: Synthetic oligonucleotide
  Target: SCN10A; (+) strand; PAM type: YTN; PAM sequence: CTA
gcagagatggcctgatcaat

SEQ ID NO: 68260 - DNA, 20 bp, Artificial Sequence
  Description of Artificial Sequence: Synthetic oligonucleotide
  Target: SCN10A; (+) strand; PAM type: YTN; PAM sequence: CTG
atcaatgaaacagcaatgcc

SEQ ID NO: 68261 - DNA, 20 bp, Artificial Sequence
  Description of Artificial Sequence: Synthetic oligonucleotide
  Target: SCN10A; (+) strand; PAM type: YTN; PAM sequence: CTC
gtttgaagtccagaattatt

SEQ ID NO: 68262 - DNA, 20 bp, Artificial Sequence
  Description of Artificial Sequence: Synthetic oligonucleotide
  Target: SCN10A; (+) strand; PAM type: YTN; PAM sequence: TTT
gaagtccagaattatttttt

SEQ ID NO: 68263 - DNA, 20 bp, Artificial Sequence
  Description of Artificial Sequence: Synthetic oligonucleotide
  Target: SCN10A; (+) strand; PAM type: YTN; PAM sequence: TTG
aagtccagaattattttttt

SEQ ID NO: 68264 - DNA, 20 bp, Artificial Sequence
  Description of Artificial Sequence: Synthetic oligonucleotide
  Target: SCN10A; (+) strand; PAM type: YTN; PAM sequence: TTA
tttttttaaatttttttctt

SEQ ID NO: 68265 - DNA, 20 bp, Artificial Sequence
  Description of Artificial Sequence: Synthetic oligonucleotide
  Target: SCN10A; (+) strand; PAM type: YTN; PAM sequence: TTT
ttttaaatttttttcttttt

SEQ ID NO: 68266 - DNA, 20 bp, Artificial Sequence
  Description of Artificial Sequence: Synthetic oligonucleotide
  Target: SCN10A; (+) strand; PAM type: YTN; PAM sequence: TTT
tttaaatttttttctttttc

SEQ ID NO: 68267 - DNA, 20 bp, Artificial Sequence
  Description of Artificial Sequence: Synthetic oligonucleotide
  Target: SCN10A; (+) strand; PAM type: YTN; PAM sequence: TTT
ttaaatttttttctttttct

SEQ ID NO: 68268 - DNA, 20 bp, Artificial Sequence
  Description of Artificial Sequence: Synthetic oligonucleotide
  Target: SCN10A; (+) strand; PAM type: YTN; PAM sequence: TTT
taaatttttttctttttctc

SEQ ID NO: 68269 - DNA, 20 bp, Artificial Sequence
  Description of Artificial Sequence: Synthetic oligonucleotide
  Target: SCN10A; (+) strand; PAM type: YTN; PAM sequence: TTT
aaatttttttctttttctcc

SEQ ID NO: 68270 - DNA, 20 bp, Artificial Sequence
  Description of Artificial Sequence: Synthetic oligonucleotide
  Target: SCN10A; (+) strand; PAM type: YTN; PAM sequence: TTA
aatttttttctttttctcct

SEQ ID NO: 68271 - DNA, 20 bp, Artificial Sequence
  Description of Artificial Sequence: Synthetic oligonucleotide
  Target: SCN10A; (+) strand; PAM type: YTN; PAM sequence: TTT
ttttctttttctcctgtttt

SEQ ID NO: 68272 - DNA, 20 bp, Artificial Sequence
  Description of Artificial Sequence: Synthetic oligonucleotide
  Target: SCN10A; (+) strand; PAM type: YTN; PAM sequence: TTT
tttctttttctcctgtttta

SEQ ID NO: 68273 - DNA, 20 bp, Artificial Sequence
  Description of Artificial Sequence: Synthetic oligonucleotide
  Target: SCN10A; (+) strand; PAM type: YTN; PAM sequence: TTT
ttctttttctcctgttttat

SEQ ID NO: 68274 - DNA, 20 bp, Artificial Sequence
  Description of Artificial Sequence: Synthetic oligonucleotide
  Target: SCN10A; (+) strand; PAM type: YTN; PAM sequence: TTT
tctttttctcctgttttatt

SEQ ID NO: 68275 - DNA, 20 bp, Artificial Sequence
  Description of Artificial Sequence: Synthetic oligonucleotide
  Target: SCN10A; (+) strand; PAM type: YTN; PAM sequence: TTT
ctttttctcctgttttattt

SEQ ID NO: 68276 - DNA, 20 bp, Artificial Sequence
  Description of Artificial Sequence: Synthetic oligonucleotide
  Target: SCN10A; (+) strand; PAM type: YTN; PAM sequence: TTC
tttttctcctgttttattta

SEQ ID NO: 68277 - DNA, 20 bp, Artificial Sequence
  Description of Artificial Sequence: Synthetic oligonucleotide
  Target: SCN10A; (+) strand; PAM type: YTN; PAM sequence: CTT
tttctcctgttttatttacc

SEQ ID NO: 68278 - DNA, 20 bp, Artificial Sequence
  Description of Artificial Sequence: Synthetic oligonucleotide
  Target: SCN10A; (+) strand; PAM type: YTN; PAM sequence: TTT
ttctcctgttttatttacct

SEQ ID NO: 68279 - DNA, 20 bp, Artificial Sequence
  Description of Artificial Sequence: Synthetic oligonucleotide
  Target: SCN10A; (+) strand; PAM type: YTN; PAM sequence: TTT
tctcctgttttatttacctg

SEQ ID NO: 68280 - DNA, 20 bp, Artificial Sequence
  Description of Artificial Sequence: Synthetic oligonucleotide
  Target: SCN10A; (+) strand; PAM type: YTN; PAM sequence: TTT
ctcctgttttatttacctgc

SEQ ID NO: 68281 - DNA, 20 bp, Artificial Sequence
  Description of Artificial Sequence: Synthetic oligonucleotide
  Target: SCN10A; (+) strand; PAM type: YTN; PAM sequence: TTC
tcctgttttatttacctgca

SEQ ID NO: 68282 - DNA, 20 bp, Artificial Sequence
  Description of Artificial Sequence: Synthetic oligonucleotide
  Target: SCN10A; (+) strand; PAM type: YTN; PAM sequence: CTC
ctgttttatttacctgcatt

SEQ ID NO: 68283 - DNA, 20 bp, Artificial Sequence
  Description of Artificial Sequence: Synthetic oligonucleotide
  Target: SCN10A; (+) strand; PAM type: YTN; PAM sequence: CTG
ttttatttacctgcattcct

SEQ ID NO: 68284 - DNA, 20 bp, Artificial Sequence
  Description of Artificial Sequence: Synthetic oligonucleotide
  Target: SCN10A; (+) strand; PAM type: YTN; PAM sequence: TTT
tatttacctgcattccttgt

SEQ ID NO: 68285 - DNA, 20 bp, Artificial Sequence
  Description of Artificial Sequence: Synthetic oligonucleotide
  Target: SCN10A; (+) strand; PAM type: YTN; PAM sequence: TTT
atttacctgcattccttgtg

SEQ ID NO: 68286 - DNA, 20 bp, Artificial Sequence
  Description of Artificial Sequence: Synthetic oligonucleotide
  Target: SCN10A; (+) strand; PAM type: YTN; PAM sequence: TTA
tttacctgcattccttgtga

SEQ ID NO: 68287 - DNA, 20 bp, Artificial Sequence
  Description of Artificial Sequence: Synthetic oligonucleotide
  Target: SCN10A; (+) strand; PAM type: YTN; PAM sequence: TTT
acctgcattccttgtgaata

SEQ ID NO: 68288 - DNA, 20 bp, Artificial Sequence
  Description of Artificial Sequence: Synthetic oligonucleotide
  Target: SCN10A; (+) strand; PAM type: YTN; PAM sequence: TTA
cctgcattccttgtgaatac

SEQ ID NO: 68289 - DNA, 20 bp, Artificial Sequence
  Description of Artificial Sequence: Synthetic oligonucleotide
  Target: SCN10A; (+) strand; PAM type: YTN; PAM sequence: CTG
cattccttgtgaatacatgg

SEQ ID NO: 68290 - DNA, 20 bp, Artificial Sequence
  Description of Artificial Sequence: Synthetic oligonucleotide
  Target: SCN10A; (+) strand; PAM type: YTN; PAM sequence: TTC
cttgtgaatacatggaattc

SEQ ID NO: 68291 - DNA, 20 bp, Artificial Sequence
  Description of Artificial Sequence: Synthetic oligonucleotide
  Target: SCN10A; (+) strand; PAM type: YTN; PAM sequence: CTT
gtgaatacatggaattcttt

SEQ ID NO: 68292 - DNA, 20 bp, Artificial Sequence
  Description of Artificial Sequence: Synthetic oligonucleotide
  Target: SCN10A; (+) strand; PAM type: YTN; PAM sequence: TTG
tgaatacatggaattctttt

SEQ ID NO: 68293 - DNA, 20 bp, Artificial Sequence
  Description of Artificial Sequence: Synthetic oligonucleotide
  Target: SCN10A; (+) strand; PAM type: YTN; PAM sequence: TTC
ttttactcccaggatttctc

SEQ ID NO: 68294 - DNA, 20 bp, Artificial Sequence
  Description of Artificial Sequence: Synthetic oligonucleotide
  Target: SCN10A; (+) strand; PAM type: YTN; PAM sequence: CTT
ttactcccaggatttctcca

SEQ ID NO: 68295 - DNA, 20 bp, Artificial Sequence
  Description of Artificial Sequence: Synthetic oligonucleotide
  Target: SCN10A; (+) strand; PAM type: YTN; PAM sequence: TTT
tactcccaggatttctccat

SEQ ID NO: 68296 - DNA, 20 bp, Artificial Sequence
  Description of Artificial Sequence: Synthetic oligonucleotide
  Target: SCN10A; (+) strand; PAM type: YTN; PAM sequence: TTT
actcccaggatttctccatg

SEQ ID NO: 68297 - DNA, 20 bp, Artificial Sequence
  Description of Artificial Sequence: Synthetic oligonucleotide
  Target: SCN10A; (+) strand; PAM type: YTN; PAM sequence: TTA
ctcccaggatttctccatga

SEQ ID NO: 68298 - DNA, 20 bp, Artificial Sequence
  Description of Artificial Sequence: Synthetic oligonucleotide
  Target: SCN10A; (+) strand; PAM type: YTN; PAM sequence: CTC
ccaggatttctccatgaact

SEQ ID NO: 68299 - DNA, 20 bp, Artificial Sequence
  Description of Artificial Sequence: Synthetic oligonucleotide
  Target: SCN10A; (+) strand; PAM type: YTN; PAM sequence: TTT
ctccatgaactccaacctct

SEQ ID NO: 68300 - DNA, 20 bp, Artificial Sequence
  Description of Artificial Sequence: Synthetic oligonucleotide
  Target: SCN10A; (+) strand; PAM type: YTN; PAM sequence: TTC
tccatgaactccaacctctg

SEQ ID NO: 68301 - DNA, 20 bp, Artificial Sequence
  Description of Artificial Sequence: Synthetic oligonucleotide
  Target: SCN10A; (+) strand; PAM type: YTN; PAM sequence: CTC
catgaactccaacctctggg

SEQ ID NO: 68302 - DNA, 20 bp, Artificial Sequence
  Description of Artificial Sequence: Synthetic oligonucleotide
  Target: SCN10A; (+) strand; PAM type: YTN; PAM sequence: CTC
caacctctggggctctcctt

SEQ ID NO: 68303 - DNA, 20 bp, Artificial Sequence
  Description of Artificial Sequence: Synthetic oligonucleotide
  Target: SCN10A; (+) strand; PAM type: YTN; PAM sequence: CTC
tggggctctccttatcccag

SEQ ID NO: 68304 - DNA, 20 bp, Artificial Sequence
  Description of Artificial Sequence: Synthetic oligonucleotide
  Target: SCN10A; (+) strand; PAM type: YTN; PAM sequence: CTG
gggctctccttatcccagac

SEQ ID NO: 68305 - DNA, 20 bp, Artificial Sequence
  Description of Artificial Sequence: Synthetic oligonucleotide
  Target: SCN10A; (+) strand; PAM type: YTN; PAM sequence: CTC
tccttatcccagacatccat

SEQ ID NO: 68306 - DNA, 20 bp, Artificial Sequence
  Description of Artificial Sequence: Synthetic oligonucleotide
  Target: SCN10A; (+) strand; PAM type: YTN; PAM sequence: CTC
cttatcccagacatccatgt

SEQ ID NO: 68307 - DNA, 20 bp, Artificial Sequence
  Description of Artificial Sequence: Synthetic oligonucleotide
  Target: SCN10A; (+) strand; PAM type: YTN; PAM sequence: CTT
atcccagacatccatgtgaa

SEQ ID NO: 68308 - DNA, 20 bp, Artificial Sequence
  Description of Artificial Sequence: Synthetic oligonucleotide
  Target: SCN10A; (+) strand; PAM type: YTN; PAM sequence: TTA
tcccagacatccatgtgaac

SEQ ID NO: 68309 - DNA, 20 bp, Artificial Sequence
  Description of Artificial Sequence: Synthetic oligonucleotide
  Target: SCN10A; (+) strand; PAM type: YTN; PAM sequence: TTA
gagctctgacaacttaattc

SEQ ID NO: 68310 - DNA, 20 bp, Artificial Sequence
  Description of Artificial Sequence: Synthetic oligonucleotide
  Target: SCN10A; (+) strand; PAM type: YTN; PAM sequence: CTC
tgacaacttaattctaatca

SEQ ID NO: 68311 - DNA, 20 bp, Artificial Sequence
  Description of Artificial Sequence: Synthetic oligonucleotide
  Target: SCN10A; (+) strand; PAM type: YTN; PAM sequence: CTG
acaacttaattctaatcagt

SEQ ID NO: 68312 - DNA, 20 bp, Artificial Sequence
  Description of Artificial Sequence: Synthetic oligonucleotide
  Target: SCN10A; (+) strand; PAM type: YTN; PAM sequence: CTT
aattctaatcagttccaagt

SEQ ID NO: 68313 - DNA, 20 bp, Artificial Sequence
  Description of Artificial Sequence: Synthetic oligonucleotide
  Target: SCN10A; (+) strand; PAM type: YTN; PAM sequence: TTA
attctaatcagttccaagtc

SEQ ID NO: 68314 - DNA, 20 bp, Artificial Sequence
  Description of Artificial Sequence: Synthetic oligonucleotide
  Target: SCN10A; (+) strand; PAM type: YTN; PAM sequence: TTC
taatcagttccaagtctatc

SEQ ID NO: 68315 - DNA, 20 bp, Artificial Sequence
  Description of Artificial Sequence: Synthetic oligonucleotide
  Target: SCN10A; (+) strand; PAM type: YTN; PAM sequence: CTA
atcagttccaagtctatctc

SEQ ID NO: 68316 - DNA, 20 bp, Artificial Sequence
  Description of Artificial Sequence: Synthetic oligonucleotide
  Target: SCN10A; (+) strand; PAM type: YTN; PAM sequence: TTC
caagtctatctccacttcga

SEQ ID NO: 68317 - DNA, 20 bp, Artificial Sequence
  Description of Artificial Sequence: Synthetic oligonucleotide
  Target: SCN10A; (+) strand; PAM type: YTN; PAM sequence: CTA
tctccacttcgattgaagat

SEQ ID NO: 68318 - DNA, 20 bp, Artificial Sequence
  Description of Artificial Sequence: Synthetic oligonucleotide
  Target: SCN10A; (+) strand; PAM type: YTN; PAM sequence: CTC
cacttcgattgaagattgca

SEQ ID NO: 68319 - DNA, 20 bp, Artificial Sequence
  Description of Artificial Sequence: Synthetic oligonucleotide
  Target: SCN10A; (+) strand; PAM type: YTN; PAM sequence: CTT
cgattgaagattgcaagttc

SEQ ID NO: 68320 - DNA, 20 bp, Artificial Sequence
  Description of Artificial Sequence: Synthetic oligonucleotide
  Target: SCN10A; (+) strand; PAM type: YTN; PAM sequence: TTC
gattgaagattgcaagttcc

SEQ ID NO: 68321 - DNA, 20 bp, Artificial Sequence
  Description of Artificial Sequence: Synthetic oligonucleotide
  Target: SCN10A; (+) strand; PAM type: YTN; PAM sequence: TTG
aagattgcaagttccctggc

SEQ ID NO: 68322 - DNA, 20 bp, Artificial Sequence
  Description of Artificial Sequence: Synthetic oligonucleotide
  Target: SCN10A; (+) strand; PAM type: YTN; PAM sequence: TTG
caagttccctggctttgtag

SEQ ID NO: 68323 - DNA, 20 bp, Artificial Sequence
  Description of Artificial Sequence: Synthetic oligonucleotide
  Target: SCN10A; (+) strand; PAM type: YTN; PAM sequence: TTC
cctggctttgtagacccaca

SEQ ID NO: 68324 - DNA, 20 bp, Artificial Sequence
  Description of Artificial Sequence: Synthetic oligonucleotide
  Target: SCN10A; (+) strand; PAM type: YTN; PAM sequence: CTG
gctttgtagacccacattta

SEQ ID NO: 68325 - DNA, 20 bp, Artificial Sequence
  Description of Artificial Sequence: Synthetic oligonucleotide
  Target: SCN10A; (+) strand; PAM type: YTN; PAM sequence: CTT
tgtagacccacatttaaaga

SEQ ID NO: 68326 - DNA, 20 bp, Artificial Sequence
  Description of Artificial Sequence: Synthetic oligonucleotide
  Target: SCN10A; (+) strand; PAM type: YTN; PAM sequence: TTT
gtagacccacatttaaagat

SEQ ID NO: 68327 - DNA, 20 bp, Artificial Sequence
  Description of Artificial Sequence: Synthetic oligonucleotide
  Target: SCN10A; (+) strand; PAM type: YTN; PAM sequence: TTG
tagacccacatttaaagata

SEQ ID NO: 68328 - DNA, 20 bp, Artificial Sequence
  Description of Artificial Sequence: Synthetic oligonucleotide
  Target: SCN10A; (+) strand; PAM type: YTN; PAM sequence: TTT
aaagataggctcttggtttg

SEQ ID NO: 68329 - DNA, 20 bp, Artificial Sequence
  Description of Artificial Sequence: Synthetic oligonucleotide
  Target: SCN10A; (+) strand; PAM type: YTN; PAM sequence: TTA
aagataggctcttggtttgc

SEQ ID NO: 68330 - DNA, 20 bp, Artificial Sequence
  Description of Artificial Sequence: Synthetic oligonucleotide
  Target: SCN10A; (+) strand; PAM type: YTN; PAM sequence: CTC
ttggtttgctcttccaaggg

SEQ ID NO: 68331 - DNA, 20 bp, Artificial Sequence
  Description of Artificial Sequence: Synthetic oligonucleotide
  Target: SCN10A; (+) strand; PAM type: YTN; PAM sequence: CTT
ggtttgctcttccaaggggc

SEQ ID NO: 68332 - DNA, 20 bp, Artificial Sequence
  Description of Artificial Sequence: Synthetic oligonucleotide
  Target: SCN10A; (+) strand; PAM type: YTN; PAM sequence: TTG
gtttgctcttccaaggggct

SEQ ID NO: 68333 - DNA, 20 bp, Artificial Sequence
  Description of Artificial Sequence: Synthetic oligonucleotide
  Target: SCN10A; (+) strand; PAM type: YTN; PAM sequence: TTT
gctcttccaaggggctaggc

SEQ ID NO: 68334 - DNA, 20 bp, Artificial Sequence
  Description of Artificial Sequence: Synthetic oligonucleotide
  Target: SCN10A; (+) strand; PAM type: YTN; PAM sequence: TTG
ctcttccaaggggctaggca

SEQ ID NO: 68335 - DNA, 20 bp, Artificial Sequence
  Description of Artificial Sequence: Synthetic oligonucleotide
  Target: SCN10A; (+) strand; PAM type: YTN; PAM sequence: CTC
ttccaaggggctaggcaacc

SEQ ID NO: 68336 - DNA, 20 bp, Artificial Sequence
  Description of Artificial Sequence: Synthetic oligonucleotide
  Target: SCN10A; (+) strand; PAM type: YTN; PAM sequence: CTT
ccaaggggctaggcaaccca

SEQ ID NO: 68337 - DNA, 20 bp, Artificial Sequence
  Description of Artificial Sequence: Synthetic oligonucleotide
  Target: SCN10A; (+) strand; PAM type: YTN; PAM sequence: TTC
caaggggctaggcaacccat

SEQ ID NO: 68338 - DNA, 20 bp, Artificial Sequence
  Description of Artificial Sequence: Synthetic oligonucleotide
  Target: SCN10A; (+) strand; PAM type: YTN; PAM sequence: CTA
ggcaacccatttcctgtagg

SEQ ID NO: 68339 - DNA, 20 bp, Artificial Sequence
  Description of Artificial Sequence: Synthetic oligonucleotide
  Target: SCN10A; (+) strand; PAM type: YTN; PAM sequence: TTT
cctgtaggtttcttaattaa

SEQ ID NO: 68340 - DNA, 20 bp, Artificial Sequence
  Description of Artificial Sequence: Synthetic oligonucleotide
  Target: SCN10A; (+) strand; PAM type: YTN; PAM sequence: TTC
ctgtaggtttcttaattaac

SEQ ID NO: 68341 - DNA, 20 bp, Artificial Sequence
  Description of Artificial Sequence: Synthetic oligonucleotide
  Target: SCN10A; (+) strand; PAM type: YTN; PAM sequence: CTG
taggtttcttaattaactct

SEQ ID NO: 68342 - DNA, 20 bp, Artificial Sequence
  Description of Artificial Sequence: Synthetic oligonucleotide
  Target: SCN10A; (+) strand; PAM type: YTN; PAM sequence: TTT
cttaattaactctgagggca

SEQ ID NO: 68343 - DNA, 20 bp, Artificial Sequence
  Description of Artificial Sequence: Synthetic oligonucleotide
  Target: SCN10A; (+) strand; PAM type: YTN; PAM sequence: TTC
ttaattaactctgagggcag

SEQ ID NO: 68344 - DNA, 20 bp, Artificial Sequence
  Description of Artificial Sequence: Synthetic oligonucleotide
  Target: SCN10A; (+) strand; PAM type: YTN; PAM sequence: CTT
aattaactctgagggcagcc

SEQ ID NO: 68345 - DNA, 20 bp, Artificial Sequence
  Description of Artificial Sequence: Synthetic oligonucleotide
  Target: SCN10A; (+) strand; PAM type: YTN; PAM sequence: TTA
attaactctgagggcagcct

SEQ ID NO: 68346 - DNA, 20 bp, Artificial Sequence
  Description of Artificial Sequence: Synthetic oligonucleotide
  Target: SCN10A; (+) strand; PAM type: YTN; PAM sequence: TTA
actctgagggcagccttgtt

SEQ ID NO: 68347 - DNA, 20 bp, Artificial Sequence
  Description of Artificial Sequence: Synthetic oligonucleotide
  Target: SCN10A; (+) strand; PAM type: YTN; PAM sequence: CTC
tgagggcagccttgtttcta

SEQ ID NO: 68348 - DNA, 20 bp, Artificial Sequence
  Description of Artificial Sequence: Synthetic oligonucleotide
  Target: SCN10A; (+) strand; PAM type: YTN; PAM sequence: CTG
agggcagccttgtttctatg

SEQ ID NO: 68349 - DNA, 20 bp, Artificial Sequence
  Description of Artificial Sequence: Synthetic oligonucleotide
  Target: SCN10A; (+) strand; PAM type: YTN; PAM sequence: CTT
gtttctatgtcttctgtaga

SEQ ID NO: 68350 - DNA, 20 bp, Artificial Sequence
  Description of Artificial Sequence: Synthetic oligonucleotide
  Target: SCN10A; (+) strand; PAM type: YTN; PAM sequence: TTG
tttctatgtcttctgtagaa

SEQ ID NO: 68351 - DNA, 20 bp, Artificial Sequence
  Description of Artificial Sequence: Synthetic oligonucleotide
  Target: SCN10A; (+) strand; PAM type: YTN; PAM sequence: TTT
ctatgtcttctgtagaaatc

SEQ ID NO: 68352 - DNA, 20 bp, Artificial Sequence
  Description of Artificial Sequence: Synthetic oligonucleotide
  Target: SCN10A; (+) strand; PAM type: YTN; PAM sequence: TTC
tatgtcttctgtagaaatcc

SEQ ID NO: 68353 - DNA, 20 bp, Artificial Sequence
  Description of Artificial Sequence: Synthetic oligonucleotide
  Target: SCN10A; (+) strand; PAM type: YTN; PAM sequence: CTA
tgtcttctgtagaaatccac

SEQ ID NO: 68354 - DNA, 20 bp, Artificial Sequence
  Description of Artificial Sequence: Synthetic oligonucleotide
  Target: SCN10A; (+) strand; PAM type: YTN; PAM sequence: CTT
ctgtagaaatccaccatagc

SEQ ID NO: 68355 - DNA, 20 bp, Artificial Sequence
  Description of Artificial Sequence: Synthetic oligonucleotide
  Target: SCN10A; (+) strand; PAM type: YTN; PAM sequence: TTC
tgtagaaatccaccatagcc

SEQ ID NO: 68356 - DNA, 20 bp, Artificial Sequence
  Description of Artificial Sequence: Synthetic oligonucleotide
  Target: SCN10A; (+) strand; PAM type: YTN; PAM sequence: CTG
tagaaatccaccatagccac

SEQ ID NO: 68357 - DNA, 20 bp, Artificial Sequence
  Description of Artificial Sequence: Synthetic oligonucleotide
  Target: SCN10A; (+) strand; PAM type: YTN; PAM sequence: CTG
catataaacagttcactgct

SEQ ID NO: 68358 - DNA, 20 bp, Artificial Sequence
  Description of Artificial Sequence: Synthetic oligonucleotide
  Target: SCN10A; (+) strand; PAM type: YTN; PAM sequence: TTC
actgctctgaggattaaatg

SEQ ID NO: 68359 - DNA, 20 bp, Artificial Sequence
  Description of Artificial Sequence: Synthetic oligonucleotide
  Target: SCN10A; (+) strand; PAM type: YTN; PAM sequence: CTG
ctctgaggattaaatgagat

SEQ ID NO: 68360 - DNA, 20 bp, Artificial Sequence
  Description of Artificial Sequence: Synthetic oligonucleotide
  Target: SCN10A; (+) strand; PAM type: YTN; PAM sequence: CTC
tgaggattaaatgagatcac

SEQ ID NO: 68361 - DNA, 20 bp, Artificial Sequence
  Description of Artificial Sequence: Synthetic oligonucleotide
  Target: SCN10A; (+) strand; PAM type: YTN; PAM sequence: CTG
aggattaaatgagatcactg

SEQ ID NO: 68362 - DNA, 20 bp, Artificial Sequence
  Description of Artificial Sequence: Synthetic oligonucleotide
  Target: SCN10A; (+) strand; PAM type: YTN; PAM sequence: TTA
aatgagatcactgtatagtg

SEQ ID NO: 68363 - DNA, 20 bp, Artificial Sequence
  Description of Artificial Sequence: Synthetic oligonucleotide
  Target: SCN10A; (+) strand; PAM type: YTN; PAM sequence: CTG
tatagtgtcttgcacttctg

SEQ ID NO: 68364 - DNA, 20 bp, Artificial Sequence
  Description of Artificial Sequence: Synthetic oligonucleotide
  Target: SCN10A; (+) strand; PAM type: YTN; PAM sequence: CTT
gcacttctgcatagtaaata

SEQ ID NO: 68365 - DNA, 20 bp, Artificial Sequence
  Description of Artificial Sequence: Synthetic oligonucleotide
  Target: SCN10A; (+) strand; PAM type: YTN; PAM sequence: TTG
cacttctgcatagtaaatat

SEQ ID NO: 68366 - DNA, 20 bp, Artificial Sequence
  Description of Artificial Sequence: Synthetic oligonucleotide
  Target: SCN10A; (+) strand; PAM type: YTN; PAM sequence: CTT
ctgcatagtaaatattgtat

SEQ ID NO: 68367 - DNA, 20 bp, Artificial Sequence
  Description of Artificial Sequence: Synthetic oligonucleotide
  Target: SCN10A; (+) strand; PAM type: YTN; PAM sequence: TTC
tgcatagtaaatattgtata

SEQ ID NO: 68368 - DNA, 20 bp, Artificial Sequence
  Description of Artificial Sequence: Synthetic oligonucleotide
  Target: SCN10A; (+) strand; PAM type: YTN; PAM sequence: CTG
catagtaaatattgtatata

SEQ ID NO: 68369 - DNA, 20 bp, Artificial Sequence
  Description of Artificial Sequence: Synthetic oligonucleotide
  Target: SCN10A; (+) strand; PAM type: YTN; PAM sequence: TTG
tatataaactgcaaaggaaa

SEQ ID NO: 68370 - DNA, 20 bp, Artificial Sequence
  Description of Artificial Sequence: Synthetic oligonucleotide
  Target: SCN10A; (+) strand; PAM type: YTN; PAM sequence: CTG
caaaggaaaattcctattgt

SEQ ID NO: 68371 - DNA, 20 bp, Artificial Sequence
  Description of Artificial Sequence: Synthetic oligonucleotide
  Target: SCN10A; (+) strand; PAM type: YTN; PAM sequence: TTC
ctattgtttttaaccttgga

SEQ ID NO: 68372 - DNA, 20 bp, Artificial Sequence
  Description of Artificial Sequence: Synthetic oligonucleotide
  Target: SCN10A; (+) strand; PAM type: YTN; PAM sequence: CTA
ttgtttttaaccttggaagc

SEQ ID NO: 68373 - DNA, 20 bp, Artificial Sequence
  Description of Artificial Sequence: Synthetic oligonucleotide
  Target: SCN10A; (+) strand; PAM type: YTN; PAM sequence: TTG
tttttaaccttggaagctgc

SEQ ID NO: 68374 - DNA, 20 bp, Artificial Sequence
  Description of Artificial Sequence: Synthetic oligonucleotide
  Target: SCN10A; (+) strand; PAM type: YTN; PAM sequence: TTT
ttaaccttggaagctgctga

SEQ ID NO: 68375 - DNA, 20 bp, Artificial Sequence
  Description of Artificial Sequence: Synthetic oligonucleotide
  Target: SCN10A; (+) strand; PAM type: YTN; PAM sequence: TTT
taaccttggaagctgctgaa

SEQ ID NO: 68376 - DNA, 20 bp, Artificial Sequence
  Description of Artificial Sequence: Synthetic oligonucleotide
  Target: SCN10A; (+) strand; PAM type: YTN; PAM sequence: TTT
aaccttggaagctgctgaaa

SEQ ID NO: 68377 - DNA, 20 bp, Artificial Sequence
  Description of Artificial Sequence: Synthetic oligonucleotide
  Target: SCN10A; (+) strand; PAM type: YTN; PAM sequence: TTA
accttggaagctgctgaaag

SEQ ID NO: 68378 - DNA, 20 bp, Artificial Sequence
  Description of Artificial Sequence: Synthetic oligonucleotide
  Target: SCN10A; (+) strand; PAM type: YTN; PAM sequence: CTT
ggaagctgctgaaaggataa

SEQ ID NO: 68379 - DNA, 20 bp, Artificial Sequence
  Description of Artificial Sequence: Synthetic oligonucleotide
  Target: SCN10A; (+) strand; PAM type: YTN; PAM sequence: TTG
gaagctgctgaaaggataaa

SEQ ID NO: 68380 - DNA, 20 bp, Artificial Sequence
  Description of Artificial Sequence: Synthetic oligonucleotide
  Target: SCN10A; (+) strand; PAM type: YTN; PAM sequence: CTG
ctgaaaggataaactggaat

SEQ ID NO: 68381 - DNA, 20 bp, Artificial Sequence
  Description of Artificial Sequence: Synthetic oligonucleotide
  Target: SCN10A; (+) strand; PAM type: YTN; PAM sequence: CTG
aaaggataaactggaataat

SEQ ID NO: 68382 - DNA, 20 bp, Artificial Sequence
  Description of Artificial Sequence: Synthetic oligonucleotide
  Target: SCN10A; (+) strand; PAM type: YTN; PAM sequence: CTG
gaataatatatgtggaagaa

SEQ ID NO: 68383 - DNA, 20 bp, Artificial Sequence
  Description of Artificial Sequence: Synthetic oligonucleotide
  Target: SCN10A; (+) strand; PAM type: YTN; PAM sequence: CTG
aaaattatcaactattttct

SEQ ID NO: 68384 - DNA, 20 bp, Artificial Sequence
  Description of Artificial Sequence: Synthetic oligonucleotide
  Target: SCN10A; (+) strand; PAM type: YTN; PAM sequence: TTA
tcaactattttctggtatcc

SEQ ID NO: 68385 - DNA, 20 bp, Artificial Sequence
  Description of Artificial Sequence: Synthetic oligonucleotide
  Target: SCN10A; (+) strand; PAM type: YTN; PAM sequence: CTA
ttttctggtatccattttct

SEQ ID NO: 68386 - DNA, 20 bp, Artificial Sequence
  Description of Artificial Sequence: Synthetic oligonucleotide
  Target: SCN10A; (+) strand; PAM type: YTN; PAM sequence: TTT
tctggtatccattttctgcc

SEQ ID NO: 68387 - DNA, 20 bp, Artificial Sequence
  Description of Artificial Sequence: Synthetic oligonucleotide
  Target: SCN10A; (+) strand; PAM type: YTN; PAM sequence: TTT
ctggtatccattttctgcct

SEQ ID NO: 68388 - DNA, 20 bp, Artificial Sequence
  Description of Artificial Sequence: Synthetic oligonucleotide
  Target: SCN10A; (+) strand; PAM type: YTN; PAM sequence: TTC
tggtatccattttctgcctt

SEQ ID NO: 68389 - DNA, 20 bp, Artificial Sequence
  Description of Artificial Sequence: Synthetic oligonucleotide
  Target: SCN10A; (+) strand; PAM type: YTN; PAM sequence: CTG
gtatccattttctgccttga

SEQ ID NO: 68390 - DNA, 20 bp, Artificial Sequence
  Description of Artificial Sequence: Synthetic oligonucleotide
  Target: SCN10A; (+) strand; PAM type: YTN; PAM sequence: TTT
tctgccttgagacccctgac

SEQ ID NO: 68391 - DNA, 20 bp, Artificial Sequence
  Description of Artificial Sequence: Synthetic oligonucleotide
  Target: SCN10A; (+) strand; PAM type: YTN; PAM sequence: TTT
ctgccttgagacccctgacc

SEQ ID NO: 68392 - DNA, 20 bp, Artificial Sequence
  Description of Artificial Sequence: Synthetic oligonucleotide
  Target: SCN10A; (+) strand; PAM type: YTN; PAM sequence: TTC
tgccttgagacccctgacct

SEQ ID NO: 68393 - DNA, 20 bp, Artificial Sequence
  Description of Artificial Sequence: Synthetic oligonucleotide
  Target: SCN10A; (+) strand; PAM type: YTN; PAM sequence: CTG
ccttgagacccctgaccttc

SEQ ID NO: 68394 - DNA, 20 bp, Artificial Sequence
  Description of Artificial Sequence: Synthetic oligonucleotide
  Target: SCN10A; (+) strand; PAM type: YTN; PAM sequence: CTT
gagacccctgaccttcctcc

SEQ ID NO: 68395 - DNA, 20 bp, Artificial Sequence
  Description of Artificial Sequence: Synthetic oligonucleotide
  Target: SCN10A; (+) strand; PAM type: YTN; PAM sequence: TTG
agacccctgaccttcctccc

SEQ ID NO: 68396 - DNA, 20 bp, Artificial Sequence
  Description of Artificial Sequence: Synthetic oligonucleotide
  Target: SCN10A; (+) strand; PAM type: YTN; PAM sequence: CTG
accttcctcccacagtgcca

SEQ ID NO: 68397 - DNA, 20 bp, Artificial Sequence
  Description of Artificial Sequence: Synthetic oligonucleotide
  Target: SCN10A; (+) strand; PAM type: YTN; PAM sequence: CTT
cctcccacagtgccattggc

SEQ ID NO: 68398 - DNA, 20 bp, Artificial Sequence
  Description of Artificial Sequence: Synthetic oligonucleotide
  Target: SCN10A; (+) strand; PAM type: YTN; PAM sequence: TTC
ctcccacagtgccattggcc

SEQ ID NO: 68399 - DNA, 20 bp, Artificial Sequence
  Description of Artificial Sequence: Synthetic oligonucleotide
  Target: SCN10A; (+) strand; PAM type: YTN; PAM sequence: CTC
ccacagtgccattggccaat

SEQ ID NO: 68400 - DNA, 20 bp, Artificial Sequence
  Description of Artificial Sequence: Synthetic oligonucleotide
  Target: SCN10A; (+) strand; PAM type: YTN; PAM sequence: TTG
gccaatgtgggcctttcctc

SEQ ID NO: 68401 - DNA, 20 bp, Artificial Sequence
  Description of Artificial Sequence: Synthetic oligonucleotide
  Target: SCN10A; (+) strand; PAM type: YTN; PAM sequence: CTT
tcctcaggactctggcttct

SEQ ID NO: 68402 - DNA, 20 bp, Artificial Sequence
  Description of Artificial Sequence: Synthetic oligonucleotide
  Target: SCN10A; (+) strand; PAM type: YTN; PAM sequence: TTT
cctcaggactctggcttctc

SEQ ID NO: 68403 - DNA, 20 bp, Artificial Sequence
  Description of Artificial Sequence: Synthetic oligonucleotide
  Target: SCN10A; (+) strand; PAM type: YTN; PAM sequence: TTC
ctcaggactctggcttctct

SEQ ID NO: 68404 - DNA, 20 bp, Artificial Sequence
  Description of Artificial Sequence: Synthetic oligonucleotide
  Target: SCN10A; (+) strand; PAM type: YTN; PAM sequence: CTC
aggactctggcttctctgca

SEQ ID NO: 68405 - DNA, 20 bp, Artificial Sequence
  Description of Artificial Sequence: Synthetic oligonucleotide
  Target: SCN10A; (+) strand; PAM type: YTN; PAM sequence: CTC
tggcttctctgcagccccac

SEQ ID NO: 68406 - DNA, 20 bp, Artificial Sequence
  Description of Artificial Sequence: Synthetic oligonucleotide
  Target: SCN10A; (+) strand; PAM type: YTN; PAM sequence: CTG
gcttctctgcagccccacag

SEQ ID NO: 68407 - DNA, 20 bp, Artificial Sequence
  Description of Artificial Sequence: Synthetic oligonucleotide
  Target: SCN10A; (+) strand; PAM type: YTN; PAM sequence: CTT
ctctgcagccccacagagga

SEQ ID NO: 68408 - DNA, 20 bp, Artificial Sequence
  Description of Artificial Sequence: Synthetic oligonucleotide
  Target: SCN10A; (+) strand; PAM type: YTN; PAM sequence: TTC
tctgcagccccacagaggac

SEQ ID NO: 68409 - DNA, 20 bp, Artificial Sequence
  Description of Artificial Sequence: Synthetic oligonucleotide
  Target: SCN10A; (+) strand; PAM type: YTN; PAM sequence: CTC
tgcagccccacagaggaccc

SEQ ID NO: 68410 - DNA, 20 bp, Artificial Sequence
  Description of Artificial Sequence: Synthetic oligonucleotide
  Target: SCN10A; (+) strand; PAM type: YTN; PAM sequence: CTG
cagccccacagaggacccag

SEQ ID NO: 68411 - DNA, 20 bp, Artificial Sequence
  Description of Artificial Sequence: Synthetic oligonucleotide
  Target: SCN10A; (+) strand; PAM type: YTN; PAM sequence: TTT
agctttcacggcatgccccg

SEQ ID NO: 68412 - DNA, 20 bp, Artificial Sequence
  Description of Artificial Sequence: Synthetic oligonucleotide
  Target: SCN10A; (+) strand; PAM type: YTN; PAM sequence: TTA
gctttcacggcatgccccgg

SEQ ID NO: 68413 - DNA, 20 bp, Artificial Sequence
  Description of Artificial Sequence: Synthetic oligonucleotide
  Target: SCN10A; (+) strand; PAM type: YTN; PAM sequence: CTT
tcacggcatgccccggcagg

SEQ ID NO: 68414 - DNA, 20 bp, Artificial Sequence
  Description of Artificial Sequence: Synthetic oligonucleotide
  Target: SCN10A; (+) strand; PAM type: YTN; PAM sequence: TTT
cacggcatgccccggcaggg

SEQ ID NO: 68415 - DNA, 20 bp, Artificial Sequence
  Description of Artificial Sequence: Synthetic oligonucleotide
  Target: SCN10A; (+) strand; PAM type: YTN; PAM sequence: TTC
acggcatgccccggcagggt

SEQ ID NO: 68416 - DNA, 20 bp, Artificial Sequence
  Description of Artificial Sequence: Synthetic oligonucleotide
  Target: SCN10A; (+) strand; PAM type: YTN; PAM sequence: TTC
actctgtccgttatcctgag

SEQ ID NO: 68417 - DNA, 20 bp, Artificial Sequence
  Description of Artificial Sequence: Synthetic oligonucleotide
  Target: SCN10A; (+) strand; PAM type: YTN; PAM sequence: CTC
tgtccgttatcctgagctgg

SEQ ID NO: 68418 - DNA, 20 bp, Artificial Sequence
  Description of Artificial Sequence: Synthetic oligonucleotide
  Target: SCN10A; (+) strand; PAM type: YTN; PAM sequence: CTG
tccgttatcctgagctggcc

SEQ ID NO: 68419 - DNA, 20 bp, Artificial Sequence
  Description of Artificial Sequence: Synthetic oligonucleotide
  Target: SCN10A; (+) strand; PAM type: YTN; PAM sequence: TTA
tcctgagctggcctctctct

SEQ ID NO: 68420 - DNA, 20 bp, Artificial Sequence
  Description of Artificial Sequence: Synthetic oligonucleotide
  Target: SCN10A; (+) strand; PAM type: YTN; PAM sequence: CTG
agctggcctctctctgccat

SEQ ID NO: 68421 - DNA, 20 bp, Artificial Sequence
  Description of Artificial Sequence: Synthetic oligonucleotide
  Target: SCN10A; (+) strand; PAM type: YTN; PAM sequence: CTG
gcctctctctgccatcccag

SEQ ID NO: 68422 - DNA, 20 bp, Artificial Sequence
  Description of Artificial Sequence: Synthetic oligonucleotide
  Target: SCN10A; (+) strand; PAM type: YTN; PAM sequence: CTC
tctctgccatcccagcctgg

SEQ ID NO: 68423 - DNA, 20 bp, Artificial Sequence
  Description of Artificial Sequence: Synthetic oligonucleotide
  Target: SCN10A; (+) strand; PAM type: YTN; PAM sequence: CTC
tctgccatcccagcctggtc

SEQ ID NO: 68424 - DNA, 20 bp, Artificial Sequence
  Description of Artificial Sequence: Synthetic oligonucleotide
  Target: SCN10A; (+) strand; PAM type: YTN; PAM sequence: CTC
tgccatcccagcctggtcca

SEQ ID NO: 68425 - DNA, 20 bp, Artificial Sequence
  Description of Artificial Sequence: Synthetic oligonucleotide
  Target: SCN10A; (+) strand; PAM type: YTN; PAM sequence: CTG
ccatcccagcctggtccact

SEQ ID NO: 68426 - DNA, 20 bp, Artificial Sequence
  Description of Artificial Sequence: Synthetic oligonucleotide
  Target: SCN10A; (+) strand; PAM type: YTN; PAM sequence: CTG
gtccactcccccactgcctg

SEQ ID NO: 68427 - DNA, 20 bp, Artificial Sequence
  Description of Artificial Sequence: Synthetic oligonucleotide
  Target: SCN10A; (+) strand; PAM type: YTN; PAM sequence: CTC
ccccactgcctggctggcac

SEQ ID NO: 68428 - DNA, 20 bp, Artificial Sequence
  Description of Artificial Sequence: Synthetic oligonucleotide
  Target: SCN10A; (+) strand; PAM type: YTN; PAM sequence: CTG
cctggctggcacctgcccaa

SEQ ID NO: 68429 - DNA, 20 bp, Artificial Sequence
  Description of Artificial Sequence: Synthetic oligonucleotide
  Target: SCN10A; (+) strand; PAM type: YTN; PAM sequence: CTG
gctggcacctgcccaatagc

SEQ ID NO: 68430 - DNA, 20 bp, Artificial Sequence
  Description of Artificial Sequence: Synthetic oligonucleotide
  Target: SCN10A; (+) strand; PAM type: YTN; PAM sequence: CTG
gcacctgcccaatagcaggc

SEQ ID NO: 68431 - DNA, 20 bp, Artificial Sequence
  Description of Artificial Sequence: Synthetic oligonucleotide
  Target: SCN10A; (+) strand; PAM type: YTN; PAM sequence: CTG
cccaatagcaggcctggcct

SEQ ID NO: 68432 - DNA, 20 bp, Artificial Sequence
  Description of Artificial Sequence: Synthetic oligonucleotide
  Target: SCN10A; (+) strand; PAM type: YTN; PAM sequence: CTG
gcctctcagggagctgagct

SEQ ID NO: 68433 - DNA, 20 bp, Artificial Sequence
  Description of Artificial Sequence: Synthetic oligonucleotide
  Target: SCN10A; (+) strand; PAM type: YTN; PAM sequence: CTC
tcagggagctgagctgtaga

SEQ ID NO: 68434 - DNA, 20 bp, Artificial Sequence
  Description of Artificial Sequence: Synthetic oligonucleotide
  Target: SCN10A; (+) strand; PAM type: YTN; PAM sequence: CTC
agggagctgagctgtagagg

SEQ ID NO: 68435 - DNA, 20 bp, Artificial Sequence
  Description of Artificial Sequence: Synthetic oligonucleotide
  Target: SCN10A; (+) strand; PAM type: YTN; PAM sequence: CTG
agctgtagaggtgtgtagat

SEQ ID NO: 68436 - DNA, 20 bp, Artificial Sequence
  Description of Artificial Sequence: Synthetic oligonucleotide
  Target: SCN10A; (+) strand; PAM type: YTN; PAM sequence: CTG
tagaggtgtgtagatggacc

SEQ ID NO: 68437 - DNA, 20 bp, Artificial Sequence
  Description of Artificial Sequence: Synthetic oligonucleotide
  Target: SCN10A; (+) strand; PAM type: YTN; PAM sequence: CTT
taccacaaaaaggacttgag

SEQ ID NO: 68438 - DNA, 20 bp, Artificial Sequence
  Description of Artificial Sequence: Synthetic oligonucleotide
  Target: SCN10A; (+) strand; PAM type: YTN; PAM sequence: TTT
accacaaaaaggacttgagc

SEQ ID NO: 68439 - DNA, 20 bp, Artificial Sequence
  Description of Artificial Sequence: Synthetic oligonucleotide
  Target: SCN10A; (+) strand; PAM type: YTN; PAM sequence: TTA
ccacaaaaaggacttgagct

SEQ ID NO: 68440 - DNA, 20 bp, Artificial Sequence
  Description of Artificial Sequence: Synthetic oligonucleotide
  Target: SCN10A; (+) strand; PAM type: YTN; PAM sequence: CTT
gagctgctctggagccattg

SEQ ID NO: 68441 - DNA, 20 bp, Artificial Sequence
  Description of Artificial Sequence: Synthetic oligonucleotide
  Target: SCN10A; (+) strand; PAM type: YTN; PAM sequence: TTG
agctgctctggagccattgc

SEQ ID NO: 68442 - DNA, 20 bp, Artificial Sequence
  Description of Artificial Sequence: Synthetic oligonucleotide
  Target: SCN10A; (+) strand; PAM type: YTN; PAM sequence: CTG
ctctggagccattgccttga

SEQ ID NO: 68443 - DNA, 20 bp, Artificial Sequence
  Description of Artificial Sequence: Synthetic oligonucleotide
  Target: SCN10A; (+) strand; PAM type: YTN; PAM sequence: CTC
tggagccattgccttgagaa

SEQ ID NO: 68444 - DNA, 20 bp, Artificial Sequence
  Description of Artificial Sequence: Synthetic oligonucleotide
  Target: SCN10A; (+) strand; PAM type: YTN; PAM sequence: CTG
gagccattgccttgagaaat

SEQ ID NO: 68445 - DNA, 20 bp, Artificial Sequence
  Description of Artificial Sequence: Synthetic oligonucleotide
  Target: SCN10A; (+) strand; PAM type: YTN; PAM sequence: TTG
ccttgagaaatgccattatc

SEQ ID NO: 68446 - DNA, 20 bp, Artificial Sequence
  Description of Artificial Sequence: Synthetic oligonucleotide
  Target: SCN10A; (+) strand; PAM type: YTN; PAM sequence: CTT
gagaaatgccattatctaga

SEQ ID NO: 68447 - DNA, 20 bp, Artificial Sequence
  Description of Artificial Sequence: Synthetic oligonucleotide
  Target: SCN10A; (+) strand; PAM type: YTN; PAM sequence: TTG
agaaatgccattatctagac

SEQ ID NO: 68448 - DNA, 20 bp, Artificial Sequence
  Description of Artificial Sequence: Synthetic oligonucleotide
  Target: SCN10A; (+) strand; PAM type: YTN; PAM sequence: TTA
tctagacagaaggatgctga

SEQ ID NO: 68449 - DNA, 20 bp, Artificial Sequence
  Description of Artificial Sequence: Synthetic oligonucleotide
  Target: SCN10A; (+) strand; PAM type: YTN; PAM sequence: CTA
gacagaaggatgctgagggg

SEQ ID NO: 68450 - DNA, 20 bp, Artificial Sequence
  Description of Artificial Sequence: Synthetic oligonucleotide
  Target: SCN10A; (+) strand; PAM type: YTN; PAM sequence: CTG
aggggctcttggtttacatt

SEQ ID NO: 68451 - DNA, 20 bp, Artificial Sequence
  Description of Artificial Sequence: Synthetic oligonucleotide
  Target: SCN10A; (+) strand; PAM type: YTN; PAM sequence: CTC
ttggtttacatttaagtcaa

SEQ ID NO: 68452 - DNA, 20 bp, Artificial Sequence
  Description of Artificial Sequence: Synthetic oligonucleotide
  Target: SCN10A; (+) strand; PAM type: YTN; PAM sequence: CTT
ggtttacatttaagtcaaag

SEQ ID NO: 68453 - DNA, 20 bp, Artificial Sequence
  Description of Artificial Sequence: Synthetic oligonucleotide
  Target: SCN10A; (+) strand; PAM type: YTN; PAM sequence: TTG
gtttacatttaagtcaaagg

SEQ ID NO: 68454 - DNA, 20 bp, Artificial Sequence
  Description of Artificial Sequence: Synthetic oligonucleotide
  Target: SCN10A; (+) strand; PAM type: YTN; PAM sequence: TTT
acatttaagtcaaaggcaaa

SEQ ID NO: 68455 - DNA, 20 bp, Artificial Sequence
  Description of Artificial Sequence: Synthetic oligonucleotide
  Target: SCN10A; (+) strand; PAM type: YTN; PAM sequence: TTA
catttaagtcaaaggcaaat

SEQ ID NO: 68456 - DNA, 20 bp, Artificial Sequence
  Description of Artificial Sequence: Synthetic oligonucleotide
  Target: SCN10A; (+) strand; PAM type: YTN; PAM sequence: TTT
aagtcaaaggcaaatgaaaa

SEQ ID NO: 68457 - DNA, 20 bp, Artificial Sequence
  Description of Artificial Sequence: Synthetic oligonucleotide
  Target: SCN10A; (+) strand; PAM type: YTN; PAM sequence: TTA
agtcaaaggcaaatgaaaac

SEQ ID NO: 68458 - DNA, 20 bp, Artificial Sequence
  Description of Artificial Sequence: Synthetic oligonucleotide
  Target: SCN10A; (+) strand; PAM type: YTN; PAM sequence: CTG
atgtcagaacaaccctctca

SEQ ID NO: 68459 - DNA, 20 bp, Artificial Sequence
  Description of Artificial Sequence: Synthetic oligonucleotide
  Target: SCN10A; (+) strand; PAM type: YTN; PAM sequence: CTC
tcatgagccaaagaaccaaa

SEQ ID NO: 68460 - DNA, 20 bp, Artificial Sequence
  Description of Artificial Sequence: Synthetic oligonucleotide
  Target: SCN10A; (+) strand; PAM type: YTN; PAM sequence: CTC
atgagccaaagaaccaaatg

SEQ ID NO: 68461 - DNA, 20 bp, Artificial Sequence
  Description of Artificial Sequence: Synthetic oligonucleotide
  Target: SCN10A; (+) strand; PAM type: YTN; PAM sequence: TTT
gtgaaagaacagtccaagga

SEQ ID NO: 68462 - DNA, 20 bp, Artificial Sequence
  Description of Artificial Sequence: Synthetic oligonucleotide
  Target: SCN10A; (+) strand; PAM type: YTN; PAM sequence: TTG
tgaaagaacagtccaaggaa

SEQ ID NO: 68463 - DNA, 20 bp, Artificial Sequence
  Description of Artificial Sequence: Synthetic oligonucleotide
  Target: SCN10A; (+) strand; PAM type: YTN; PAM sequence: CTG
atgttgaccaaatgctcctg

SEQ ID NO: 68464 - DNA, 20 bp, Artificial Sequence
  Description of Artificial Sequence: Synthetic oligonucleotide
  Target: SCN10A; (+) strand; PAM type: YTN; PAM sequence: TTG
accaaatgctcctgcttgtt

SEQ ID NO: 68465 - DNA, 20 bp, Artificial Sequence
  Description of Artificial Sequence: Synthetic oligonucleotide
  Target: SCN10A; (+) strand; PAM type: YTN; PAM sequence: CTC
ctgcttgtttccagtcctca

SEQ ID NO: 68466 - DNA, 20 bp, Artificial Sequence
  Description of Artificial Sequence: Synthetic oligonucleotide
  Target: SCN10A; (+) strand; PAM type: YTN; PAM sequence: CTG
cttgtttccagtcctcagct

SEQ ID NO: 68467 - DNA, 20 bp, Artificial Sequence
  Description of Artificial Sequence: Synthetic oligonucleotide
  Target: SCN10A; (+) strand; PAM type: YTN; PAM sequence: CTT
gtttccagtcctcagctcca

SEQ ID NO: 68468 - DNA, 20 bp, Artificial Sequence
  Description of Artificial Sequence: Synthetic oligonucleotide
  Target: SCN10A; (+) strand; PAM type: YTN; PAM sequence: TTG
tttccagtcctcagctccaa

SEQ ID NO: 68469 - DNA, 20 bp, Artificial Sequence
  Description of Artificial Sequence: Synthetic oligonucleotide
  Target: SCN10A; (+) strand; PAM type: YTN; PAM sequence: TTT
ccagtcctcagctccaactg

SEQ ID NO: 68470 - DNA, 20 bp, Artificial Sequence
  Description of Artificial Sequence: Synthetic oligonucleotide
  Target: SCN10A; (+) strand; PAM type: YTN; PAM sequence: TTC
cagtcctcagctccaactga

SEQ ID NO: 68471 - DNA, 20 bp, Artificial Sequence
  Description of Artificial Sequence: Synthetic oligonucleotide
  Target: SCN10A; (+) strand; PAM type: YTN; PAM sequence: CTC
agctccaactgagatagttt

SEQ ID NO: 68472 - DNA, 20 bp, Artificial Sequence
  Description of Artificial Sequence: Synthetic oligonucleotide
  Target: SCN10A; (+) strand; PAM type: YTN; PAM sequence: CTC
caactgagatagttttccta

SEQ ID NO: 68473 - DNA, 20 bp, Artificial Sequence
  Description of Artificial Sequence: Synthetic oligonucleotide
  Target: SCN10A; (+) strand; PAM type: YTN; PAM sequence: CTG
agatagttttcctagtgagc

SEQ ID NO: 68474 - DNA, 20 bp, Artificial Sequence
  Description of Artificial Sequence: Synthetic oligonucleotide
  Target: SCN10A; (+) strand; PAM type: YTN; PAM sequence: TTT
tcctagtgagctgatgaagg

SEQ ID NO: 68475 - DNA, 20 bp, Artificial Sequence
  Description of Artificial Sequence: Synthetic oligonucleotide
  Target: SCN10A; (+) strand; PAM type: YTN; PAM sequence: TTT
cctagtgagctgatgaaggt

SEQ ID NO: 68476 - DNA, 20 bp, Artificial Sequence
  Description of Artificial Sequence: Synthetic oligonucleotide
  Target: SCN10A; (+) strand; PAM type: YTN; PAM sequence: TTC
ctagtgagctgatgaaggtg

SEQ ID NO: 68477 - DNA, 20 bp, Artificial Sequence
  Description of Artificial Sequence: Synthetic oligonucleotide
  Target: SCN10A; (+) strand; PAM type: YTN; PAM sequence: CTA
gtgagctgatgaaggtggag

SEQ ID NO: 68478 - DNA, 20 bp, Artificial Sequence
  Description of Artificial Sequence: Synthetic oligonucleotide
  Target: SCN10A; (+) strand; PAM type: YTN; PAM sequence: CTG
atgaaggtggagcctcatgc

SEQ ID NO: 68479 - DNA, 20 bp, Artificial Sequence
  Description of Artificial Sequence: Synthetic oligonucleotide
  Target: SCN10A; (+) strand; PAM type: YTN; PAM sequence: CTC
atgcaggctccacacaggtc

SEQ ID NO: 68480 - DNA, 20 bp, Artificial Sequence
  Description of Artificial Sequence: Synthetic oligonucleotide
  Target: SCN10A; (+) strand; PAM type: YTN; PAM sequence: CTC
cacacaggtcgacctgggca

SEQ ID NO: 68481 - DNA, 20 bp, Artificial Sequence
  Description of Artificial Sequence: Synthetic oligonucleotide
  Target: SCN10A; (+) strand; PAM type: YTN; PAM sequence: CTG
ggcaacatggagccgtcagc

SEQ ID NO: 68482 - DNA, 20 bp, Artificial Sequence
  Description of Artificial Sequence: Synthetic oligonucleotide
  Target: SCN10A; (+) strand; PAM type: YTN; PAM sequence: CTC
tcaggcactgggggtgttgt

SEQ ID NO: 68483 - DNA, 20 bp, Artificial Sequence
  Description of Artificial Sequence: Synthetic oligonucleotide
  Target: SCN10A; (+) strand; PAM type: YTN; PAM sequence: CTC
aggcactgggggtgttgtga

SEQ ID NO: 68484 - DNA, 20 bp, Artificial Sequence
  Description of Artificial Sequence: Synthetic oligonucleotide
  Target: SCN10A; (+) strand; PAM type: YTN; PAM sequence: CTG
ggggtgttgtgagctctgct

SEQ ID NO: 68485 - DNA, 20 bp, Artificial Sequence
  Description of Artificial Sequence: Synthetic oligonucleotide
  Target: SCN10A; (+) strand; PAM type: YTN; PAM sequence: TTG
tgagctctgcttttccaagc

SEQ ID NO: 68486 - DNA, 20 bp, Artificial Sequence
  Description of Artificial Sequence: Synthetic oligonucleotide
  Target: SCN10A; (+) strand; PAM type: YTN; PAM sequence: CTC
tgcttttccaagctctcagc

SEQ ID NO: 68487 - DNA, 20 bp, Artificial Sequence
  Description of Artificial Sequence: Synthetic oligonucleotide
  Target: SCN10A; (+) strand; PAM type: YTN; PAM sequence: CTG
cttttccaagctctcagcca

SEQ ID NO: 68488 - DNA, 20 bp, Artificial Sequence
  Description of Artificial Sequence: Synthetic oligonucleotide
  Target: SCN10A; (+) strand; PAM type: YTN; PAM sequence: CTT
ttccaagctctcagccatgg

SEQ ID NO: 68489 - DNA, 20 bp, Artificial Sequence
  Description of Artificial Sequence: Synthetic oligonucleotide
  Target: SCN10A; (+) strand; PAM type: YTN; PAM sequence: TTT
tccaagctctcagccatgga

SEQ ID NO: 68490 - DNA, 20 bp, Artificial Sequence
  Description of Artificial Sequence: Synthetic oligonucleotide
  Target: SCN10A; (+) strand; PAM type: YTN; PAM sequence: TTT
ccaagctctcagccatggag

SEQ ID NO: 68491 - DNA, 20 bp, Artificial Sequence
  Description of Artificial Sequence: Synthetic oligonucleotide
  Target: SCN10A; (+) strand; PAM type: YTN; PAM sequence: TTC
caagctctcagccatggagg

SEQ ID NO: 68492 - DNA, 20 bp, Artificial Sequence
  Description of Artificial Sequence: Synthetic oligonucleotide
  Target: SCN10A; (+) strand; PAM type: YTN; PAM sequence: CTC
tcagccatggaggtgggtga

SEQ ID NO: 68493 - DNA, 20 bp, Artificial Sequence
  Description of Artificial Sequence: Synthetic oligonucleotide
  Target: SCN10A; (+) strand; PAM type: YTN; PAM sequence: CTC
agccatggaggtgggtgaga

SEQ ID NO: 68494 - DNA, 20 bp, Artificial Sequence
  Description of Artificial Sequence: Synthetic oligonucleotide
  Target: SCN10A; (+) strand; PAM type: YTN; PAM sequence: CTT
tttgatcttttgcctaaagt

SEQ ID NO: 68495 - DNA, 20 bp, Artificial Sequence
  Description of Artificial Sequence: Synthetic oligonucleotide
  Target: SCN10A; (+) strand; PAM type: YTN; PAM sequence: TTT
ttgatcttttgcctaaagtc

SEQ ID NO: 68496 - DNA, 20 bp, Artificial Sequence
  Description of Artificial Sequence: Synthetic oligonucleotide
  Target: SCN10A; (+) strand; PAM type: YTN; PAM sequence: TTT
tgatcttttgcctaaagtct

SEQ ID NO: 68497 - DNA, 20 bp, Artificial Sequence
  Description of Artificial Sequence: Synthetic oligonucleotide
  Target: SCN10A; (+) strand; PAM type: YTN; PAM sequence: TTT
gatcttttgcctaaagtctt

SEQ ID NO: 68498 - DNA, 20 bp, Artificial Sequence
  Description of Artificial Sequence: Synthetic oligonucleotide
  Target: SCN10A; (+) strand; PAM type: YTN; PAM sequence: TTG
atcttttgcctaaagtcttt

SEQ ID NO: 68499 - DNA, 20 bp, Artificial Sequence
  Description of Artificial Sequence: Synthetic oligonucleotide
  Target: SCN10A; (+) strand; PAM type: YTN; PAM sequence: CTT
ttgcctaaagtctttctgct

SEQ ID NO: 68500 - DNA, 20 bp, Artificial Sequence
  Description of Artificial Sequence: Synthetic oligonucleotide
  Target: SCN10A; (+) strand; PAM type: YTN; PAM sequence: TTT
tgcctaaagtctttctgctc

SEQ ID NO: 68501 - DNA, 20 bp, Artificial Sequence
  Description of Artificial Sequence: Synthetic oligonucleotide
  Target: SCN10A; (+) strand; PAM type: YTN; PAM sequence: TTT
gcctaaagtctttctgctca

SEQ ID NO: 68502 - DNA, 20 bp, Artificial Sequence
  Description of Artificial Sequence: Synthetic oligonucleotide
  Target: SCN10A; (+) strand; PAM type: YTN; PAM sequence: TTG
cctaaagtctttctgctcat

SEQ ID NO: 68503 - DNA, 20 bp, Artificial Sequence
  Description of Artificial Sequence: Synthetic oligonucleotide
  Target: SCN10A; (+) strand; PAM type: YTN; PAM sequence: CTA
aagtctttctgctcatgcct

SEQ ID NO: 68504 - DNA, 20 bp, Artificial Sequence
  Description of Artificial Sequence: Synthetic oligonucleotide
  Target: SCN10A; (+) strand; PAM type: YTN; PAM sequence: CTT
tctgctcatgccttcctcca

SEQ ID NO: 68505 - DNA, 20 bp, Artificial Sequence
  Description of Artificial Sequence: Synthetic oligonucleotide
  Target: SCN10A; (+) strand; PAM type: YTN; PAM sequence: TTT
ctgctcatgccttcctccag

SEQ ID NO: 68506 - DNA, 20 bp, Artificial Sequence
  Description of Artificial Sequence: Synthetic oligonucleotide
  Target: SCN10A; (+) strand; PAM type: YTN; PAM sequence: TTC
tgctcatgccttcctccagt

SEQ ID NO: 68507 - DNA, 20 bp, Artificial Sequence
  Description of Artificial Sequence: Synthetic oligonucleotide
  Target: SCN10A; (+) strand; PAM type: YTN; PAM sequence: CTG
ctcatgccttcctccagtgg

SEQ ID NO: 68508 - DNA, 20 bp, Artificial Sequence
  Description of Artificial Sequence: Synthetic oligonucleotide
  Target: SCN10A; (+) strand; PAM type: YTN; PAM sequence: CTC
atgccttcctccagtggcca

SEQ ID NO: 68509 - DNA, 20 bp, Artificial Sequence
  Description of Artificial Sequence: Synthetic oligonucleotide
  Target: SCN10A; (+) strand; PAM type: YTN; PAM sequence: CTT
cctccagtggccaaagcagc

SEQ ID NO: 68510 - DNA, 20 bp, Artificial Sequence
  Description of Artificial Sequence: Synthetic oligonucleotide
  Target: SCN10A; (+) strand; PAM type: YTN; PAM sequence: TTC
ctccagtggccaaagcagca

SEQ ID NO: 68511 - DNA, 20 bp, Artificial Sequence
  Description of Artificial Sequence: Synthetic oligonucleotide
  Target: SCN10A; (+) strand; PAM type: YTN; PAM sequence: CTC
cagtggccaaagcagcaggc

SEQ ID NO: 68512 - DNA, 20 bp, Artificial Sequence
  Description of Artificial Sequence: Synthetic oligonucleotide
  Target: SCN10A; (+) strand; PAM type: YTN; PAM sequence: CTG
aggggtcctcatcccttagc

SEQ ID NO: 68513 - DNA, 20 bp, Artificial Sequence
  Description of Artificial Sequence: Synthetic oligonucleotide
  Target: SCN10A; (+) strand; PAM type: YTN; PAM sequence: CTC
atcccttagctttgtctcac

SEQ ID NO: 68514 - DNA, 20 bp, Artificial Sequence
  Description of Artificial Sequence: Synthetic oligonucleotide
  Target: SCN10A; (+) strand; PAM type: YTN; PAM sequence: CTT
agctttgtctcacattctgt

SEQ ID NO: 68515 - DNA, 20 bp, Artificial Sequence
  Description of Artificial Sequence: Synthetic oligonucleotide
  Target: SCN10A; (+) strand; PAM type: YTN; PAM sequence: TTA
gctttgtctcacattctgtt

SEQ ID NO: 68516 - DNA, 20 bp, Artificial Sequence
  Description of Artificial Sequence: Synthetic oligonucleotide
  Target: SCN10A; (+) strand; PAM type: YTN; PAM sequence: CTT
tgtctcacattctgttctgc

SEQ ID NO: 68517 - DNA, 20 bp, Artificial Sequence
  Description of Artificial Sequence: Synthetic oligonucleotide
  Target: SCN10A; (+) strand; PAM type: YTN; PAM sequence: TTT
gtctcacattctgttctgcc

SEQ ID NO: 68518 - DNA, 20 bp, Artificial Sequence
  Description of Artificial Sequence: Synthetic oligonucleotide
  Target: SCN10A; (+) strand; PAM type: YTN; PAM sequence: TTG
tctcacattctgttctgcca

SEQ ID NO: 68519 - DNA, 20 bp, Artificial Sequence
  Description of Artificial Sequence: Synthetic oligonucleotide
  Target: SCN10A; (+) strand; PAM type: YTN; PAM sequence: CTC
acattctgttctgccacctg

SEQ ID NO: 68520 - DNA, 20 bp, Artificial Sequence
  Description of Artificial Sequence: Synthetic oligonucleotide
  Target: SCN10A; (+) strand; PAM type: YTN; PAM sequence: TTC
tgttctgccacctggaatgg

SEQ ID NO: 68521 - DNA, 20 bp, Artificial Sequence
  Description of Artificial Sequence: Synthetic oligonucleotide
  Target: SCN10A; (+) strand; PAM type: YTN; PAM sequence: CTG
ttctgccacctggaatggtc

SEQ ID NO: 68522 - DNA, 20 bp, Artificial Sequence
  Description of Artificial Sequence: Synthetic oligonucleotide
  Target: SCN10A; (+) strand; PAM type: YTN; PAM sequence: TTC
tgccacctggaatggtcttc

SEQ ID NO: 68523 - DNA, 20 bp, Artificial Sequence
  Description of Artificial Sequence: Synthetic oligonucleotide
  Target: SCN10A; (+) strand; PAM type: YTN; PAM sequence: CTG
ccacctggaatggtcttcgc

SEQ ID NO: 68524 - DNA, 20 bp, Artificial Sequence
  Description of Artificial Sequence: Synthetic oligonucleotide
  Target: SCN10A; (+) strand; PAM type: YTN; PAM sequence: CTG
gaatggtcttcgctgaaact

SEQ ID NO: 68525 - DNA, 20 bp, Artificial Sequence
  Description of Artificial Sequence: Synthetic oligonucleotide
  Target: SCN10A; (+) strand; PAM type: YTN; PAM sequence: CTT
cgctgaaactatctcgtatt

SEQ ID NO: 68526 - DNA, 20 bp, Artificial Sequence
  Description of Artificial Sequence: Synthetic oligonucleotide
  Target: SCN10A; (+) strand; PAM type: YTN; PAM sequence: TTC
gctgaaactatctcgtattc

SEQ ID NO: 68527 - DNA, 20 bp, Artificial Sequence
  Description of Artificial Sequence: Synthetic oligonucleotide
  Target: SCN10A; (+) strand; PAM type: YTN; PAM sequence: CTG
aaactatctcgtattcaccc

SEQ ID NO: 68528 - DNA, 20 bp, Artificial Sequence
  Description of Artificial Sequence: Synthetic oligonucleotide
  Target: SCN10A; (+) strand; PAM type: YTN; PAM sequence: CTA
tctcgtattcacccagcctg

SEQ ID NO: 68529 - DNA, 20 bp, Artificial Sequence
  Description of Artificial Sequence: Synthetic oligonucleotide
  Target: SCN10A; (+) strand; PAM type: YTN; PAM sequence: CTC
gtattcacccagcctggaga

SEQ ID NO: 68530 - DNA, 20 bp, Artificial Sequence
  Description of Artificial Sequence: Synthetic oligonucleotide
  Target: SCN10A; (+) strand; PAM type: YTN; PAM sequence: TTC
acccagcctggagacatcct

SEQ ID NO: 68531 - DNA, 20 bp, Artificial Sequence
  Description of Artificial Sequence: Synthetic oligonucleotide
  Target: SCN10A; (+) strand; PAM type: YTN; PAM sequence: CTG
gagacatcctacctgccctt

SEQ ID NO: 68532 - DNA, 20 bp, Artificial Sequence
  Description of Artificial Sequence: Synthetic oligonucleotide
  Target: SCN10A; (+) strand; PAM type: YTN; PAM sequence: CTA
cctgcccttgaaagctcacc

SEQ ID NO: 68533 - DNA, 20 bp, Artificial Sequence
  Description of Artificial Sequence: Synthetic oligonucleotide
  Target: SCN10A; (+) strand; PAM type: YTN; PAM sequence: CTG
cccttgaaagctcacctcaa

SEQ ID NO: 68534 - DNA, 20 bp, Artificial Sequence
  Description of Artificial Sequence: Synthetic oligonucleotide
  Target: SCN10A; (+) strand; PAM type: YTN; PAM sequence: CTT
gaaagctcacctcaaacacc

SEQ ID NO: 68535 - DNA, 20 bp, Artificial Sequence
  Description of Artificial Sequence: Synthetic oligonucleotide
  Target: SCN10A; (+) strand; PAM type: YTN; PAM sequence: TTG
aaagctcacctcaaacacca

SEQ ID NO: 68536 - DNA, 20 bp, Artificial Sequence
  Description of Artificial Sequence: Synthetic oligonucleotide
  Target: SCN10A; (+) strand; PAM type: YTN; PAM sequence: CTC
acctcaaacaccacctccag

SEQ ID NO: 68537 - DNA, 20 bp, Artificial Sequence
  Description of Artificial Sequence: Synthetic oligonucleotide
  Target: SCN10A; (+) strand; PAM type: YTN; PAM sequence: CTC
aaacaccacctccaggaagc

SEQ ID NO: 68538 - DNA, 20 bp, Artificial Sequence
  Description of Artificial Sequence: Synthetic oligonucleotide
  Target: SCN10A; (+) strand; PAM type: YTN; PAM sequence: CTC
caggaagccttccctacttt

SEQ ID NO: 68539 - DNA, 20 bp, Artificial Sequence
  Description of Artificial Sequence: Synthetic oligonucleotide
  Target: SCN10A; (+) strand; PAM type: YTN; PAM sequence: CTT
ccctactttctctcttgcct

SEQ ID NO: 68540 - DNA, 20 bp, Artificial Sequence
  Description of Artificial Sequence: Synthetic oligonucleotide
  Target: SCN10A; (+) strand; PAM type: YTN; PAM sequence: TTC
cctactttctctcttgcctc

SEQ ID NO: 68541 - DNA, 20 bp, Artificial Sequence
  Description of Artificial Sequence: Synthetic oligonucleotide
  Target: SCN10A; (+) strand; PAM type: YTN; PAM sequence: CTA
ctttctctcttgcctcacac

SEQ ID NO: 68542 - DNA, 20 bp, Artificial Sequence
  Description of Artificial Sequence: Synthetic oligonucleotide
  Target: SCN10A; (+) strand; PAM type: YTN; PAM sequence: CTT
tctctcttgcctcacaccgc

SEQ ID NO: 68543 - DNA, 20 bp, Artificial Sequence
  Description of Artificial Sequence: Synthetic oligonucleotide
  Target: SCN10A; (+) strand; PAM type: YTN; PAM sequence: TTT
ctctcttgcctcacaccgcc

SEQ ID NO: 68544 - DNA, 20 bp, Artificial Sequence
  Description of Artificial Sequence: Synthetic oligonucleotide
  Target: SCN10A; (+) strand; PAM type: YTN; PAM sequence: TTC
tctcttgcctcacaccgcca

SEQ ID NO: 68545 - DNA, 20 bp, Artificial Sequence
  Description of Artificial Sequence: Synthetic oligonucleotide
  Target: SCN10A; (+) strand; PAM type: YTN; PAM sequence: CTC
tcttgcctcacaccgccacc

SEQ ID NO: 68546 - DNA, 20 bp, Artificial Sequence
  Description of Artificial Sequence: Synthetic oligonucleotide
  Target: SCN10A; (+) strand; PAM type: YTN; PAM sequence: CTC
ttgcctcacaccgccacctc

SEQ ID NO: 68547 - DNA, 20 bp, Artificial Sequence
  Description of Artificial Sequence: Synthetic oligonucleotide
  Target: SCN10A; (+) strand; PAM type: YTN; PAM sequence: CTT
gcctcacaccgccacctcac

SEQ ID NO: 68548 - DNA, 20 bp, Artificial Sequence
  Description of Artificial Sequence: Synthetic oligonucleotide
  Target: SCN10A; (+) strand; PAM type: YTN; PAM sequence: TTG
cctcacaccgccacctcact

SEQ ID NO: 68549 - DNA, 20 bp, Artificial Sequence
  Description of Artificial Sequence: Synthetic oligonucleotide
  Target: SCN10A; (+) strand; PAM type: YTN; PAM sequence: CTC
acaccgccacctcactgtgt

SEQ ID NO: 68550 - DNA, 20 bp, Artificial Sequence
  Description of Artificial Sequence: Synthetic oligonucleotide
  Target: SCN10A; (+) strand; PAM type: YTN; PAM sequence: CTC
actgtgtttgcccagcctat

SEQ ID NO: 68551 - DNA, 20 bp, Artificial Sequence
  Description of Artificial Sequence: Synthetic oligonucleotide
  Target: SCN10A; (+) strand; PAM type: YTN; PAM sequence: CTG
tgtttgcccagcctatgaag

SEQ ID NO: 68552 - DNA, 20 bp, Artificial Sequence
  Description of Artificial Sequence: Synthetic oligonucleotide
  Target: SCN10A; (+) strand; PAM type: YTN; PAM sequence: TTT
gcccagcctatgaagcctct

SEQ ID NO: 68553 - DNA, 20 bp, Artificial Sequence
  Description of Artificial Sequence: Synthetic oligonucleotide
  Target: SCN10A; (+) strand; PAM type: YTN; PAM sequence: TTG
cccagcctatgaagcctcta

SEQ ID NO: 68554 - DNA, 20 bp, Artificial Sequence
  Description of Artificial Sequence: Synthetic oligonucleotide
  Target: SCN10A; (+) strand; PAM type: YTN; PAM sequence: CTA
tgaagcctctagtaaagaac

SEQ ID NO: 68555 - DNA, 20 bp, Artificial Sequence
  Description of Artificial Sequence: Synthetic oligonucleotide
  Target: SCN10A; (+) strand; PAM type: YTN; PAM sequence: CTC
tagtaaagaacttgttttcc

SEQ ID NO: 68556 - DNA, 20 bp, Artificial Sequence
  Description of Artificial Sequence: Synthetic oligonucleotide
  Target: SCN10A; (+) strand; PAM type: YTN; PAM sequence: CTA
gtaaagaacttgttttccac

SEQ ID NO: 68557 - DNA, 20 bp, Artificial Sequence
  Description of Artificial Sequence: Synthetic oligonucleotide
  Target: SCN10A; (+) strand; PAM type: YTN; PAM sequence: CTT
gttttccacagggtagcatc

SEQ ID NO: 68558 - DNA, 20 bp, Artificial Sequence
  Description of Artificial Sequence: Synthetic oligonucleotide
  Target: SCN10A; (+) strand; PAM type: YTN; PAM sequence: TTG
ttttccacagggtagcatct

SEQ ID NO: 68559 - DNA, 20 bp, Artificial Sequence
  Description of Artificial Sequence: Synthetic oligonucleotide
  Target: SCN10A; (+) strand; PAM type: YTN; PAM sequence: TTT
tccacagggtagcatcttta

SEQ ID NO: 68560 - DNA, 20 bp, Artificial Sequence
  Description of Artificial Sequence: Synthetic oligonucleotide
  Target: SCN10A; (+) strand; PAM type: YTN; PAM sequence: TTT
ccacagggtagcatctttat

SEQ ID NO: 68561 - DNA, 20 bp, Artificial Sequence
  Description of Artificial Sequence: Synthetic oligonucleotide
  Target: SCN10A; (+) strand; PAM type: YTN; PAM sequence: TTC
cacagggtagcatctttatg

SEQ ID NO: 68562 - DNA, 20 bp, Artificial Sequence
  Description of Artificial Sequence: Synthetic oligonucleotide
  Target: SCN10A; (+) strand; PAM type: YTN; PAM sequence: CTT
tatgtctatgaatgagaaat

SEQ ID NO: 68563 - DNA, 20 bp, Artificial Sequence
  Description of Artificial Sequence: Synthetic oligonucleotide
  Target: SCN10A; (+) strand; PAM type: YTN; PAM sequence: TTT
atgtctatgaatgagaaatt

SEQ ID NO: 68564 - DNA, 20 bp, Artificial Sequence
  Description of Artificial Sequence: Synthetic oligonucleotide
  Target: SCN10A; (+) strand; PAM type: YTN; PAM sequence: TTA
tgtctatgaatgagaaattg

SEQ ID NO: 68565 - DNA, 20 bp, Artificial Sequence
  Description of Artificial Sequence: Synthetic oligonucleotide
  Target: SCN10A; (+) strand; PAM type: YTN; PAM sequence: CTA
tgaatgagaaattgcaaact

SEQ ID NO: 68566 - DNA, 20 bp, Artificial Sequence
  Description of Artificial Sequence: Synthetic oligonucleotide
  Target: SCN10A; (+) strand; PAM type: YTN; PAM sequence: TTG
caaactagcagcttataggc

SEQ ID NO: 68567 - DNA, 20 bp, Artificial Sequence
  Description of Artificial Sequence: Synthetic oligonucleotide
  Target: SCN10A; (+) strand; PAM type: YTN; PAM sequence: CTA
gcagcttataggctggattt

SEQ ID NO: 68568 - DNA, 20 bp, Artificial Sequence
  Description of Artificial Sequence: Synthetic oligonucleotide
  Target: SCN10A; (+) strand; PAM type: YTN; PAM sequence: CTT
ataggctggatttggcccac

SEQ ID NO: 68569 - DNA, 20 bp, Artificial Sequence
  Description of Artificial Sequence: Synthetic oligonucleotide
  Target: SCN10A; (+) strand; PAM type: YTN; PAM sequence: TTA
taggctggatttggcccaca

SEQ ID NO: 68570 - DNA, 20 bp, Artificial Sequence
  Description of Artificial Sequence: Synthetic oligonucleotide
  Target: SCN10A; (+) strand; PAM type: YTN; PAM sequence: CTG
gatttggcccacagaaatat

SEQ ID NO: 68571 - DNA, 20 bp, Artificial Sequence
  Description of Artificial Sequence: Synthetic oligonucleotide
  Target: SCN10A; (+) strand; PAM type: YTN; PAM sequence: TTT
ggcccacagaaatattttgt

SEQ ID NO: 68572 - DNA, 20 bp, Artificial Sequence
  Description of Artificial Sequence: Synthetic oligonucleotide
  Target: SCN10A; (+) strand; PAM type: YTN; PAM sequence: TTG
gcccacagaaatattttgtt

SEQ ID NO: 68573 - DNA, 20 bp, Artificial Sequence
  Description of Artificial Sequence: Synthetic oligonucleotide
  Target: SCN10A; (+) strand; PAM type: YTN; PAM sequence: TTT
tgtttggcccaacaatatgt

SEQ ID NO: 68574 - DNA, 20 bp, Artificial Sequence
  Description of Artificial Sequence: Synthetic oligonucleotide
  Target: SCN10A; (+) strand; PAM type: YTN; PAM sequence: TTT
gtttggcccaacaatatgta

SEQ ID NO: 68575 - DNA, 20 bp, Artificial Sequence
  Description of Artificial Sequence: Synthetic oligonucleotide
  Target: SCN10A; (+) strand; PAM type: YTN; PAM sequence: TTG
tttggcccaacaatatgtag

SEQ ID NO: 68576 - DNA, 20 bp, Artificial Sequence
  Description of Artificial Sequence: Synthetic oligonucleotide
  Target: SCN10A; (+) strand; PAM type: YTN; PAM sequence: TTT
ggcccaacaatatgtagaca

SEQ ID NO: 68577 - DNA, 20 bp, Artificial Sequence
  Description of Artificial Sequence: Synthetic oligonucleotide
  Target: SCN10A; (+) strand; PAM type: YTN; PAM sequence: TTG
gcccaacaatatgtagacat

SEQ ID NO: 68578 - DNA, 20 bp, Artificial Sequence
  Description of Artificial Sequence: Synthetic oligonucleotide
  Target: SCN10A; (+) strand; PAM type: YTN; PAM sequence: TTT
tttggaataggtagccaatg

SEQ ID NO: 68579 - DNA, 20 bp, Artificial Sequence
  Description of Artificial Sequence: Synthetic oligonucleotide
  Target: SCN10A; (+) strand; PAM type: YTN; PAM sequence: TTT
ttggaataggtagccaatgt

SEQ ID NO: 68580 - DNA, 20 bp, Artificial Sequence
  Description of Artificial Sequence: Synthetic oligonucleotide
  Target: SCN10A; (+) strand; PAM type: YTN; PAM sequence: TTT
tggaataggtagccaatgtt

SEQ ID NO: 68581 - DNA, 20 bp, Artificial Sequence
  Description of Artificial Sequence: Synthetic oligonucleotide
  Target: SCN10A; (+) strand; PAM type: YTN; PAM sequence: TTT
ggaataggtagccaatgttt

SEQ ID NO: 68582 - DNA, 20 bp, Artificial Sequence
  Description of Artificial Sequence: Synthetic oligonucleotide
  Target: SCN10A; (+) strand; PAM type: YTN; PAM sequence: TTG
gaataggtagccaatgttta

SEQ ID NO: 68583 - DNA, 20 bp, Artificial Sequence
  Description of Artificial Sequence: Synthetic oligonucleotide
  Target: SCN10A; (+) strand; PAM type: YTN; PAM sequence: TTT
acggttgggagattttatat

SEQ ID NO: 68584 - DNA, 20 bp, Artificial Sequence
  Description of Artificial Sequence: Synthetic oligonucleotide
  Target: SCN10A; (+) strand; PAM type: YTN; PAM sequence: TTA
cggttgggagattttatata

SEQ ID NO: 68585 - DNA, 20 bp, Artificial Sequence
  Description of Artificial Sequence: Synthetic oligonucleotide
  Target: SCN10A; (+) strand; PAM type: YTN; PAM sequence: TTG
ggagattttatataaaaatc

SEQ ID NO: 68586 - DNA, 20 bp, Artificial Sequence
  Description of Artificial Sequence: Synthetic oligonucleotide
  Target: SCN10A; (+) strand; PAM type: YTN; PAM sequence: TTT
tatataaaaatctaaatttc

SEQ ID NO: 68587 - DNA, 20 bp, Artificial Sequence
  Description of Artificial Sequence: Synthetic oligonucleotide
  Target: SCN10A; (+) strand; PAM type: YTN; PAM sequence: TTT
atataaaaatctaaatttcc

SEQ ID NO: 68588 - DNA, 20 bp, Artificial Sequence
  Description of Artificial Sequence: Synthetic oligonucleotide
  Target: SCN10A; (+) strand; PAM type: YTN; PAM sequence: TTA
tataaaaatctaaatttcct

SEQ ID NO: 68589 - DNA, 20 bp, Artificial Sequence
  Description of Artificial Sequence: Synthetic oligonucleotide
  Target: SCN10A; (+) strand; PAM type: YTN; PAM sequence: CTA
aatttcctatctctatttta

SEQ ID NO: 68590 - DNA, 20 bp, Artificial Sequence
  Description of Artificial Sequence: Synthetic oligonucleotide
  Target: SCN10A; (+) strand; PAM type: YTN; PAM sequence: TTT
cctatctctattttaaaagt

SEQ ID NO: 68591 - DNA, 20 bp, Artificial Sequence
  Description of Artificial Sequence: Synthetic oligonucleotide
  Target: SCN10A; (+) strand; PAM type: YTN; PAM sequence: TTC
ctatctctattttaaaagtt

SEQ ID NO: 68592 - DNA, 20 bp, Artificial Sequence
  Description of Artificial Sequence: Synthetic oligonucleotide
  Target: SCN10A; (+) strand; PAM type: YTN; PAM sequence: CTA
tctctattttaaaagttgga

SEQ ID NO: 68593 - DNA, 20 bp, Artificial Sequence
  Description of Artificial Sequence: Synthetic oligonucleotide
  Target: SCN10A; (+) strand; PAM type: YTN; PAM sequence: CTC
tattttaaaagttggaagag

SEQ ID NO: 68594 - DNA, 20 bp, Artificial Sequence
  Description of Artificial Sequence: Synthetic oligonucleotide
  Target: SCN10A; (+) strand; PAM type: YTN; PAM sequence: CTA
ttttaaaagttggaagagct

SEQ ID NO: 68595 - DNA, 20 bp, Artificial Sequence
  Description of Artificial Sequence: Synthetic oligonucleotide
  Target: SCN10A; (+) strand; PAM type: YTN; PAM sequence: TTT
taaaagttggaagagctgga

SEQ ID NO: 68596 - DNA, 20 bp, Artificial Sequence
  Description of Artificial Sequence: Synthetic oligonucleotide
  Target: SCN10A; (+) strand; PAM type: YTN; PAM sequence: TTT
aaaagttggaagagctggaa

SEQ ID NO: 68597 - DNA, 20 bp, Artificial Sequence
  Description of Artificial Sequence: Synthetic oligonucleotide
  Target: SCN10A; (+) strand; PAM type: YTN; PAM sequence: TTA
aaagttggaagagctggaaa

SEQ ID NO: 68598 - DNA, 20 bp, Artificial Sequence
  Description of Artificial Sequence: Synthetic oligonucleotide
  Target: SCN10A; (+) strand; PAM type: YTN; PAM sequence: TTG
gaagagctggaaacagtgaa

SEQ ID NO: 68599 - DNA, 20 bp, Artificial Sequence
  Description of Artificial Sequence: Synthetic oligonucleotide
  Target: SCN10A; (+) strand; PAM type: YTN; PAM sequence: CTG
gaaacagtgaacccacattt

SEQ ID NO: 68600 - DNA, 20 bp, Artificial Sequence
  Description of Artificial Sequence: Synthetic oligonucleotide
  Target: SCN10A; (+) strand; PAM type: YTN; PAM sequence: TTT
ccacatggcaaccaaaagct

SEQ ID NO: 68601 - DNA, 20 bp, Artificial Sequence
  Description of Artificial Sequence: Synthetic oligonucleotide
  Target: SCN10A; (+) strand; PAM type: YTN; PAM sequence: TTC
cacatggcaaccaaaagctg

SEQ ID NO: 68602 - DNA, 20 bp, Artificial Sequence
  Description of Artificial Sequence: Synthetic oligonucleotide
  Target: SCN10A; (+) strand; PAM type: YTN; PAM sequence: CTG
gaccgagcagtggggctgtc

SEQ ID NO: 68603 - DNA, 20 bp, Artificial Sequence
  Description of Artificial Sequence: Synthetic oligonucleotide
  Target: SCN10A; (+) strand; PAM type: YTN; PAM sequence: CTG
tcccctttagaggaggcatg

SEQ ID NO: 68604 - DNA, 20 bp, Artificial Sequence
  Description of Artificial Sequence: Synthetic oligonucleotide
  Target: SCN10A; (+) strand; PAM type: YTN; PAM sequence: CTT
tagaggaggcatgaactctc

SEQ ID NO: 68605 - DNA, 20 bp, Artificial Sequence
  Description of Artificial Sequence: Synthetic oligonucleotide
  Target: SCN10A; (+) strand; PAM type: YTN; PAM sequence: TTT
agaggaggcatgaactctca

SEQ ID NO: 68606 - DNA, 20 bp, Artificial Sequence
  Description of Artificial Sequence: Synthetic oligonucleotide
  Target: SCN10A; (+) strand; PAM type: YTN; PAM sequence: TTA
gaggaggcatgaactctcag

SEQ ID NO: 68607 - DNA, 20 bp, Artificial Sequence
  Description of Artificial Sequence: Synthetic oligonucleotide
  Target: SCN10A; (+) strand; PAM type: YTN; PAM sequence: CTC
tcagctcctaggttccctcc

SEQ ID NO: 68608 - DNA, 20 bp, Artificial Sequence
  Description of Artificial Sequence: Synthetic oligonucleotide
  Target: SCN10A; (+) strand; PAM type: YTN; PAM sequence: CTC
agctcctaggttccctcctg

SEQ ID NO: 68609 - DNA, 20 bp, Artificial Sequence
  Description of Artificial Sequence: Synthetic oligonucleotide
  Target: SCN10A; (+) strand; PAM type: YTN; PAM sequence: CTC
ctaggttccctcctggccca

SEQ ID NO: 68610 - DNA, 20 bp, Artificial Sequence
  Description of Artificial Sequence: Synthetic oligonucleotide
  Target: SCN10A; (+) strand; PAM type: YTN; PAM sequence: CTA
ggttccctcctggcccactc

SEQ ID NO: 68611 - DNA, 20 bp, Artificial Sequence
  Description of Artificial Sequence: Synthetic oligonucleotide
  Target: SCN10A; (+) strand; PAM type: YTN; PAM sequence: TTC
cctcctggcccactccactc

SEQ ID NO: 68612 - DNA, 20 bp, Artificial Sequence
  Description of Artificial Sequence: Synthetic oligonucleotide
  Target: SCN10A; (+) strand; PAM type: YTN; PAM sequence: CTC
ctggcccactccactcattt

SEQ ID NO: 68613 - DNA, 20 bp, Artificial Sequence
  Description of Artificial Sequence: Synthetic oligonucleotide
  Target: SCN10A; (+) strand; PAM type: YTN; PAM sequence: CTG
gcccactccactcatttgtt

SEQ ID NO: 68614 - DNA, 20 bp, Artificial Sequence
  Description of Artificial Sequence: Synthetic oligonucleotide
  Target: SCN10A; (+) strand; PAM type: YTN; PAM sequence: CTC
cactcatttgttgttatgaa

SEQ ID NO: 68615 - DNA, 20 bp, Artificial Sequence
  Description of Artificial Sequence: Synthetic oligonucleotide
  Target: SCN10A; (+) strand; PAM type: YTN; PAM sequence: CTC
atttgttgttatgaatctgg

SEQ ID NO: 68616 - DNA, 20 bp, Artificial Sequence
  Description of Artificial Sequence: Synthetic oligonucleotide
  Target: SCN10A; (+) strand; PAM type: YTN; PAM sequence: TTT
gttgttatgaatctggcctc

SEQ ID NO: 68617 - DNA, 20 bp, Artificial Sequence
  Description of Artificial Sequence: Synthetic oligonucleotide
  Target: SCN10A; (+) strand; PAM type: YTN; PAM sequence: TTG
ttgttatgaatctggcctct

SEQ ID NO: 68618 - DNA, 20 bp, Artificial Sequence
  Description of Artificial Sequence: Synthetic oligonucleotide
  Target: SCN10A; (+) strand; PAM type: YTN; PAM sequence: TTG
ttatgaatctggcctctgta

SEQ ID NO: 68619 - DNA, 20 bp, Artificial Sequence
  Description of Artificial Sequence: Synthetic oligonucleotide
  Target: SCN10A; (+) strand; PAM type: YTN; PAM sequence: TTA
tgaatctggcctctgtaaga

SEQ ID NO: 68620 - DNA, 20 bp, Artificial Sequence
  Description of Artificial Sequence: Synthetic oligonucleotide
  Target: SCN10A; (+) strand; PAM type: YTN; PAM sequence: CTG
gcctctgtaagaattcgaaa

SEQ ID NO: 68621 - DNA, 20 bp, Artificial Sequence
  Description of Artificial Sequence: Synthetic oligonucleotide
  Target: SCN10A; (+) strand; PAM type: YTN; PAM sequence: CTC
tgtaagaattcgaaattgca

SEQ ID NO: 68622 - DNA, 20 bp, Artificial Sequence
  Description of Artificial Sequence: Synthetic oligonucleotide
  Target: SCN10A; (+) strand; PAM type: YTN; PAM sequence: CTG
taagaattcgaaattgcaaa

SEQ ID NO: 68623 - DNA, 20 bp, Artificial Sequence
  Description of Artificial Sequence: Synthetic oligonucleotide
  Target: SCN10A; (+) strand; PAM type: YTN; PAM sequence: TTC
gaaattgcaaagtctgatac

SEQ ID NO: 68624 - DNA, 20 bp, Artificial Sequence
  Description of Artificial Sequence: Synthetic oligonucleotide
  Target: SCN10A; (+) strand; PAM type: YTN; PAM sequence: TTG
caaagtctgatacatgtgtt

SEQ ID NO: 68625 - DNA, 20 bp, Artificial Sequence
  Description of Artificial Sequence: Synthetic oligonucleotide
  Target: SCN10A; (+) strand; PAM type: YTN; PAM sequence: CTG
atacatgtgttttttcctct

SEQ ID NO: 68626 - DNA, 20 bp, Artificial Sequence
  Description of Artificial Sequence: Synthetic oligonucleotide
  Target: SCN10A; (+) strand; PAM type: YTN; PAM sequence: TTT
tttcctctacttgtgagggt

SEQ ID NO: 68627 - DNA, 20 bp, Artificial Sequence
  Description of Artificial Sequence: Synthetic oligonucleotide
  Target: SCN10A; (+) strand; PAM type: YTN; PAM sequence: TTT
ttcctctacttgtgagggta

SEQ ID NO: 68628 - DNA, 20 bp, Artificial Sequence
  Description of Artificial Sequence: Synthetic oligonucleotide
  Target: SCN10A; (+) strand; PAM type: YTN; PAM sequence: TTT
tcctctacttgtgagggtaa

SEQ ID NO: 68629 - DNA, 20 bp, Artificial Sequence
  Description of Artificial Sequence: Synthetic oligonucleotide
  Target: SCN10A; (+) strand; PAM type: YTN; PAM sequence: TTT
cctctacttgtgagggtaat

SEQ ID NO: 68630 - DNA, 20 bp, Artificial Sequence
  Description of Artificial Sequence: Synthetic oligonucleotide
  Target: SCN10A; (+) strand; PAM type: YTN; PAM sequence: TTC
ctctacttgtgagggtaatg

SEQ ID NO: 68631 - DNA, 20 bp, Artificial Sequence
  Description of Artificial Sequence: Synthetic oligonucleotide
  Target: SCN10A; (+) strand; PAM type: YTN; PAM sequence: CTC
tacttgtgagggtaatgtgg

SEQ ID NO: 68632 - DNA, 20 bp, Artificial Sequence
  Description of Artificial Sequence: Synthetic oligonucleotide
  Target: SCN10A; (+) strand; PAM type: YTN; PAM sequence: CTA
cttgtgagggtaatgtggct

SEQ ID NO: 68633 - DNA, 20 bp, Artificial Sequence
  Description of Artificial Sequence: Synthetic oligonucleotide
  Target: SCN10A; (+) strand; PAM type: YTN; PAM sequence: CTT
gtgagggtaatgtggctata

SEQ ID NO: 68634 - DNA, 20 bp, Artificial Sequence
  Description of Artificial Sequence: Synthetic oligonucleotide
  Target: SCN10A; (+) strand; PAM type: YTN; PAM sequence: TTG
tgagggtaatgtggctatag

SEQ ID NO: 68635 - DNA, 20 bp, Artificial Sequence
  Description of Artificial Sequence: Synthetic oligonucleotide
  Target: SCN10A; (+) strand; PAM type: YTN; PAM sequence: CTA
tagaatggagttagctgtga

SEQ ID NO: 68636 - DNA, 20 bp, Artificial Sequence
  Description of Artificial Sequence: Synthetic oligonucleotide
  Target: SCN10A; (+) strand; PAM type: YTN; PAM sequence: TTA
gctgtgatgattaagtgtag

SEQ ID NO: 68637 - DNA, 20 bp, Artificial Sequence
  Description of Artificial Sequence: Synthetic oligonucleotide
  Target: SCN10A; (+) strand; PAM type: YTN; PAM sequence: CTG
tgatgattaagtgtagagca

SEQ ID NO: 68638 - DNA, 20 bp, Artificial Sequence
  Description of Artificial Sequence: Synthetic oligonucleotide
  Target: SCN10A; (+) strand; PAM type: YTN; PAM sequence: TTA
agtgtagagcatttgacaca

SEQ ID NO: 68639 - DNA, 20 bp, Artificial Sequence
  Description of Artificial Sequence: Synthetic oligonucleotide
  Target: SCN10A; (+) strand; PAM type: YTN; PAM sequence: TTT
gacacaaataagtattggtt

SEQ ID NO: 68640 - DNA, 20 bp, Artificial Sequence
  Description of Artificial Sequence: Synthetic oligonucleotide
  Target: SCN10A; (+) strand; PAM type: YTN; PAM sequence: TTG
acacaaataagtattggttc

SEQ ID NO: 68641 - DNA, 20 bp, Artificial Sequence
  Description of Artificial Sequence: Synthetic oligonucleotide
  Target: SCN10A; (+) strand; PAM type: YTN; PAM sequence: TTG
gttccttcctggggtagatt

SEQ ID NO: 68642 - DNA, 20 bp, Artificial Sequence
  Description of Artificial Sequence: Synthetic oligonucleotide
  Target: SCN10A; (+) strand; PAM type: YTN; PAM sequence: TTC
cttcctggggtagattattt

SEQ ID NO: 68643 - DNA, 20 bp, Artificial Sequence
  Description of Artificial Sequence: Synthetic oligonucleotide
  Target: SCN10A; (+) strand; PAM type: YTN; PAM sequence: CTT
cctggggtagattatttatt

SEQ ID NO: 68644 - DNA, 20 bp, Artificial Sequence
  Description of Artificial Sequence: Synthetic oligonucleotide
  Target: SCN10A; (+) strand; PAM type: YTN; PAM sequence: TTC
ctggggtagattatttatta

SEQ ID NO: 68645 - DNA, 20 bp, Artificial Sequence
  Description of Artificial Sequence: Synthetic oligonucleotide
  Target: SCN10A; (+) strand; PAM type: YTN; PAM sequence: CTG
gggtagattatttattaaaa

SEQ ID NO: 68646 - DNA, 20 bp, Artificial Sequence
  Description of Artificial Sequence: Synthetic oligonucleotide
  Target: SCN10A; (+) strand; PAM type: YTN; PAM sequence: TTA
tttattaaaatggctataat

SEQ ID NO: 68647 - DNA, 20 bp, Artificial Sequence
  Description of Artificial Sequence: Synthetic oligonucleotide
  Target: SCN10A; (+) strand; PAM type: YTN; PAM sequence: TTT
attaaaatggctataattct

SEQ ID NO: 68648 - DNA, 20 bp, Artificial Sequence
  Description of Artificial Sequence: Synthetic oligonucleotide
  Target: SCN10A; (+) strand; PAM type: YTN; PAM sequence: TTA
ttaaaatggctataattctt

SEQ ID NO: 68649 - DNA, 20 bp, Artificial Sequence
  Description of Artificial Sequence: Synthetic oligonucleotide
  Target: SCN10A; (+) strand; PAM type: YTN; PAM sequence: TTA
aaatggctataattcttgtc

SEQ ID NO: 68650 - DNA, 20 bp, Artificial Sequence
  Description of Artificial Sequence: Synthetic oligonucleotide
  Target: SCN10A; (+) strand; PAM type: YTN; PAM sequence: CTA
taattcttgtctctatgtat

SEQ ID NO: 68651 - DNA, 20 bp, Artificial Sequence
  Description of Artificial Sequence: Synthetic oligonucleotide
  Target: SCN10A; (+) strand; PAM type: YTN; PAM sequence: TTC
ttgtctctatgtatccacac

SEQ ID NO: 68652 - DNA, 20 bp, Artificial Sequence
  Description of Artificial Sequence: Synthetic oligonucleotide
  Target: SCN10A; (+) strand; PAM type: YTN; PAM sequence: CTT
gtctctatgtatccacaccc

SEQ ID NO: 68653 - DNA, 20 bp, Artificial Sequence
  Description of Artificial Sequence: Synthetic oligonucleotide
  Target: SCN10A; (+) strand; PAM type: YTN; PAM sequence: TTG
tctctatgtatccacaccct

SEQ ID NO: 68654 - DNA, 20 bp, Artificial Sequence
  Description of Artificial Sequence: Synthetic oligonucleotide
  Target: SCN10A; (+) strand; PAM type: YTN; PAM sequence: CTC
tatgtatccacaccctttcc

SEQ ID NO: 68655 - DNA, 20 bp, Artificial Sequence
  Description of Artificial Sequence: Synthetic oligonucleotide
  Target: SCN10A; (+) strand; PAM type: YTN; PAM sequence: CTA
tgtatccacaccctttccaa

SEQ ID NO: 68656 - DNA, 20 bp, Artificial Sequence
  Description of Artificial Sequence: Synthetic oligonucleotide
  Target: SCN10A; (+) strand; PAM type: YTN; PAM sequence: CTT
tccaatgtgacttttcagct

SEQ ID NO: 68657 - DNA, 20 bp, Artificial Sequence
  Description of Artificial Sequence: Synthetic oligonucleotide
  Target: SCN10A; (+) strand; PAM type: YTN; PAM sequence: TTT
ccaatgtgacttttcagctc

SEQ ID NO: 68658 - DNA, 20 bp, Artificial Sequence
  Description of Artificial Sequence: Synthetic oligonucleotide
  Target: SCN10A; (+) strand; PAM type: YTN; PAM sequence: TTC
caatgtgacttttcagctct

SEQ ID NO: 68659 - DNA, 20 bp, Artificial Sequence
  Description of Artificial Sequence: Synthetic oligonucleotide
  Target: SCN10A; (+) strand; PAM type: YTN; PAM sequence: CTT
ttcagctctttccattgagt

SEQ ID NO: 68660 - DNA, 20 bp, Artificial Sequence
  Description of Artificial Sequence: Synthetic oligonucleotide
  Target: SCN10A; (+) strand; PAM type: YTN; PAM sequence: TTT
tcagctctttccattgagtg

SEQ ID NO: 68661 - DNA, 20 bp, Artificial Sequence
  Description of Artificial Sequence: Synthetic oligonucleotide
  Target: SCN10A; (+) strand; PAM type: YTN; PAM sequence: TTT
cagctctttccattgagtga

SEQ ID NO: 68662 - DNA, 20 bp, Artificial Sequence
  Description of Artificial Sequence: Synthetic oligonucleotide
  Target: SCN10A; (+) strand; PAM type: YTN; PAM sequence: TTC
agctctttccattgagtgat

SEQ ID NO: 68663 - DNA, 20 bp, Artificial Sequence
  Description of Artificial Sequence: Synthetic oligonucleotide
  Target: SCN10A; (+) strand; PAM type: YTN; PAM sequence: CTC
tttccattgagtgatgaagt

SEQ ID NO: 68664 - DNA, 20 bp, Artificial Sequence
  Description of Artificial Sequence: Synthetic oligonucleotide
  Target: SCN10A; (+) strand; PAM type: YTN; PAM sequence: CTT
tccattgagtgatgaagtct

SEQ ID NO: 68665 - DNA, 20 bp, Artificial Sequence
  Description of Artificial Sequence: Synthetic oligonucleotide
  Target: SCN10A; (+) strand; PAM type: YTN; PAM sequence: TTT
ccattgagtgatgaagtcta

SEQ ID NO: 68666 - DNA, 20 bp, Artificial Sequence
  Description of Artificial Sequence: Synthetic oligonucleotide
  Target: SCN10A; (+) strand; PAM type: YTN; PAM sequence: TTC
cattgagtgatgaagtctat

SEQ ID NO: 68667 - DNA, 20 bp, Artificial Sequence
  Description of Artificial Sequence: Synthetic oligonucleotide
  Target: SCN10A; (+) strand; PAM type: YTN; PAM sequence: TTG
agtgatgaagtctatttctc

SEQ ID NO: 68668 - DNA, 20 bp, Artificial Sequence
  Description of Artificial Sequence: Synthetic oligonucleotide
  Target: SCN10A; (+) strand; PAM type: YTN; PAM sequence: CTA
tttctctgtctcttggatct

SEQ ID NO: 68669 - DNA, 20 bp, Artificial Sequence
  Description of Artificial Sequence: Synthetic oligonucleotide
  Target: SCN10A; (+) strand; PAM type: YTN; PAM sequence: TTT
ctctgtctcttggatctcta

SEQ ID NO: 68670 - DNA, 20 bp, Artificial Sequence
  Description of Artificial Sequence: Synthetic oligonucleotide
  Target: SCN10A; (+) strand; PAM type: YTN; PAM sequence: TTC
tctgtctcttggatctctac

SEQ ID NO: 68671 - DNA, 20 bp, Artificial Sequence
  Description of Artificial Sequence: Synthetic oligonucleotide
  Target: SCN10A; (+) strand; PAM type: YTN; PAM sequence: CTC
tgtctcttggatctctactg

SEQ ID NO: 68672 - DNA, 20 bp, Artificial Sequence
  Description of Artificial Sequence: Synthetic oligonucleotide
  Target: SCN10A; (+) strand; PAM type: YTN; PAM sequence: CTG
tctcttggatctctactgga

SEQ ID NO: 68673 - DNA, 20 bp, Artificial Sequence
  Description of Artificial Sequence: Synthetic oligonucleotide
  Target: SCN10A; (+) strand; PAM type: YTN; PAM sequence: CTC
ttggatctctactggactgc

SEQ ID NO: 68674 - DNA, 20 bp, Artificial Sequence
  Description of Artificial Sequence: Synthetic oligonucleotide
  Target: SCN10A; (+) strand; PAM type: YTN; PAM sequence: CTT
ggatctctactggactgcaa

SEQ ID NO: 68675 - DNA, 20 bp, Artificial Sequence
  Description of Artificial Sequence: Synthetic oligonucleotide
  Target: SCN10A; (+) strand; PAM type: YTN; PAM sequence: TTG
gatctctactggactgcaac

SEQ ID NO: 68676 - DNA, 20 bp, Artificial Sequence
  Description of Artificial Sequence: Synthetic oligonucleotide
  Target: SCN10A; (+) strand; PAM type: YTN; PAM sequence: CTC
tactggactgcaacttgctt

SEQ ID NO: 68677 - DNA, 20 bp, Artificial Sequence
  Description of Artificial Sequence: Synthetic oligonucleotide
  Target: SCN10A; (+) strand; PAM type: YTN; PAM sequence: CTA
ctggactgcaacttgcttta

SEQ ID NO: 68678 - DNA, 20 bp, Artificial Sequence
  Description of Artificial Sequence: Synthetic oligonucleotide
  Target: SCN10A; (+) strand; PAM type: YTN; PAM sequence: CTG
gactgcaacttgctttagtc

SEQ ID NO: 68679 - DNA, 20 bp, Artificial Sequence
  Description of Artificial Sequence: Synthetic oligonucleotide
  Target: SCN10A; (+) strand; PAM type: YTN; PAM sequence: CTG
caacttgctttagtcaagaa

SEQ ID NO: 68680 - DNA, 20 bp, Artificial Sequence
  Description of Artificial Sequence: Synthetic oligonucleotide
  Target: SCN10A; (+) strand; PAM type: YTN; PAM sequence: CTT
gctttagtcaagaatgtatc

SEQ ID NO: 68681 - DNA, 20 bp, Artificial Sequence
  Description of Artificial Sequence: Synthetic oligonucleotide
  Target: SCN10A; (+) strand; PAM type: YTN; PAM sequence: TTG
ctttagtcaagaatgtatca

SEQ ID NO: 68682 - DNA, 20 bp, Artificial Sequence
  Description of Artificial Sequence: Synthetic oligonucleotide
  Target: SCN10A; (+) strand; PAM type: YTN; PAM sequence: CTT
tagtcaagaatgtatcagaa

SEQ ID NO: 68683 - DNA, 20 bp, Artificial Sequence
  Description of Artificial Sequence: Synthetic oligonucleotide
  Target: SCN10A; (+) strand; PAM type: YTN; PAM sequence: TTT
agtcaagaatgtatcagaat

SEQ ID NO: 68684 - DNA, 20 bp, Artificial Sequence
  Description of Artificial Sequence: Synthetic oligonucleotide
  Target: SCN10A; (+) strand; PAM type: YTN; PAM sequence: TTA
gtcaagaatgtatcagaatg

SEQ ID NO: 68685 - DNA, 20 bp, Artificial Sequence
  Description of Artificial Sequence: Synthetic oligonucleotide
  Target: SCN10A; (+) strand; PAM type: YTN; PAM sequence: TTG
tgttggttctaagcctaggc

SEQ ID NO: 68686 - DNA, 20 bp, Artificial Sequence
  Description of Artificial Sequence: Synthetic oligonucleotide
  Target: SCN10A; (+) strand; PAM type: YTN; PAM sequence: TTG
gttctaagcctaggcctgaa

SEQ ID NO: 68687 - DNA, 20 bp, Artificial Sequence
  Description of Artificial Sequence: Synthetic oligonucleotide
  Target: SCN10A; (+) strand; PAM type: YTN; PAM sequence: TTC
taagcctaggcctgaagaag

SEQ ID NO: 68688 - DNA, 20 bp, Artificial Sequence
  Description of Artificial Sequence: Synthetic oligonucleotide
  Target: SCN10A; (+) strand; PAM type: YTN; PAM sequence: CTA
agcctaggcctgaagaagcc

SEQ ID NO: 68689 - DNA, 20 bp, Artificial Sequence
  Description of Artificial Sequence: Synthetic oligonucleotide
  Target: SCN10A; (+) strand; PAM type: YTN; PAM sequence: CTA
ggcctgaagaagccttgcaa

SEQ ID NO: 68690 - DNA, 20 bp, Artificial Sequence
  Description of Artificial Sequence: Synthetic oligonucleotide
  Target: SCN10A; (+) strand; PAM type: YTN; PAM sequence: CTG
aagaagccttgcaaacttcc

SEQ ID NO: 68691 - DNA, 20 bp, Artificial Sequence
  Description of Artificial Sequence: Synthetic oligonucleotide
  Target: SCN10A; (+) strand; PAM type: YTN; PAM sequence: CTT
gcaaacttccactgtttttc

SEQ ID NO: 68692 - DNA, 20 bp, Artificial Sequence
  Description of Artificial Sequence: Synthetic oligonucleotide
  Target: SCN10A; (+) strand; PAM type: YTN; PAM sequence: TTG
caaacttccactgtttttct

SEQ ID NO: 68693 - DNA, 20 bp, Artificial Sequence
  Description of Artificial Sequence: Synthetic oligonucleotide
  Target: SCN10A; (+) strand; PAM type: YTN; PAM sequence: CTT
ccactgtttttctgggaaca

SEQ ID NO: 68694 - DNA, 20 bp, Artificial Sequence
  Description of Artificial Sequence: Synthetic oligonucleotide
  Target: SCN10A; (+) strand; PAM type: YTN; PAM sequence: TTC
cactgtttttctgggaacac

SEQ ID NO: 68695 - DNA, 20 bp, Artificial Sequence
  Description of Artificial Sequence: Synthetic oligonucleotide
  Target: SCN10A; (+) strand; PAM type: YTN; PAM sequence: CTG
tttttctgggaacactgcca

SEQ ID NO: 68696 - DNA, 20 bp, Artificial Sequence
  Description of Artificial Sequence: Synthetic oligonucleotide
  Target: SCN10A; (+) strand; PAM type: YTN; PAM sequence: TTT
ttctgggaacactgccatga

SEQ ID NO: 68697 - DNA, 20 bp, Artificial Sequence
  Description of Artificial Sequence: Synthetic oligonucleotide
  Target: SCN10A; (+) strand; PAM type: YTN; PAM sequence: TTT
tctgggaacactgccatgag

SEQ ID NO: 68698 - DNA, 20 bp, Artificial Sequence
  Description of Artificial Sequence: Synthetic oligonucleotide
  Target: SCN10A; (+) strand; PAM type: YTN; PAM sequence: TTT
ctgggaacactgccatgaga

SEQ ID NO: 68699 - DNA, 20 bp, Artificial Sequence
  Description of Artificial Sequence: Synthetic oligonucleotide
  Target: SCN10A; (+) strand; PAM type: YTN; PAM sequence: TTC
tgggaacactgccatgagaa

SEQ ID NO: 68700 - DNA, 20 bp, Artificial Sequence
  Description of Artificial Sequence: Synthetic oligonucleotide
  Target: SCN10A; (+) strand; PAM type: YTN; PAM sequence: CTG
ggaacactgccatgagaaca

SEQ ID NO: 68701 - DNA, 20 bp, Artificial Sequence
  Description of Artificial Sequence: Synthetic oligonucleotide
  Target: SCN10A; (+) strand; PAM type: YTN; PAM sequence: CTG
ccatgagaacaggcccaggc

SEQ ID NO: 68702 - DNA, 20 bp, Artificial Sequence
  Description of Artificial Sequence: Synthetic oligonucleotide
  Target: SCN10A; (+) strand; PAM type: YTN; PAM sequence: CTA
acctgtttgggggtgagagg

SEQ ID NO: 68703 - DNA, 20 bp, Artificial Sequence
  Description of Artificial Sequence: Synthetic oligonucleotide
  Target: SCN10A; (+) strand; PAM type: YTN; PAM sequence: CTG
tttgggggtgagaggccaca

SEQ ID NO: 68704 - DNA, 20 bp, Artificial Sequence
  Description of Artificial Sequence: Synthetic oligonucleotide
  Target: SCN10A; (+) strand; PAM type: YTN; PAM sequence: TTT
gggggtgagaggccacatga

SEQ ID NO: 68705 - DNA, 20 bp, Artificial Sequence
  Description of Artificial Sequence: Synthetic oligonucleotide
  Target: SCN10A; (+) strand; PAM type: YTN; PAM sequence: TTG
ggggtgagaggccacatgag

SEQ ID NO: 68706 - DNA, 20 bp, Artificial Sequence
  Description of Artificial Sequence: Synthetic oligonucleotide
  Target: SCN10A; (+) strand; PAM type: YTN; PAM sequence: CTA
gaccagccatctccaagtta

SEQ ID NO: 68707 - DNA, 20 bp, Artificial Sequence
  Description of Artificial Sequence: Synthetic oligonucleotide
  Target: SCN10A; (+) strand; PAM type: YTN; PAM sequence: CTC
caagttaatatgctgtctgc

SEQ ID NO: 68708 - DNA, 20 bp, Artificial Sequence
  Description of Artificial Sequence: Synthetic oligonucleotide
  Target: SCN10A; (+) strand; PAM type: YTN; PAM sequence: TTA
atatgctgtctgcatatgca

SEQ ID NO: 68709 - DNA, 20 bp, Artificial Sequence
  Description of Artificial Sequence: Synthetic oligonucleotide
  Target: SCN10A; (+) strand; PAM type: YTN; PAM sequence: CTG
tctgcatatgcatgaatgag

SEQ ID NO: 68710 - DNA, 20 bp, Artificial Sequence
  Description of Artificial Sequence: Synthetic oligonucleotide
  Target: SCN10A; (+) strand; PAM type: YTN; PAM sequence: CTG
catatgcatgaatgagccta

SEQ ID NO: 68711 - DNA, 20 bp, Artificial Sequence
  Description of Artificial Sequence: Synthetic oligonucleotide
  Target: SCN10A; (+) strand; PAM type: YTN; PAM sequence: CTA
gtcaatgtcacccaatgccc

SEQ ID NO: 68712 - DNA, 20 bp, Artificial Sequence
  Description of Artificial Sequence: Synthetic oligonucleotide
  Target: SCN10A; (+) strand; PAM type: YTN; PAM sequence: CTG
atcccagtccaaaatgctga

SEQ ID NO: 68713 - DNA, 20 bp, Artificial Sequence
  Description of Artificial Sequence: Synthetic oligonucleotide
  Target: SCN10A; (+) strand; PAM type: YTN; PAM sequence: CTG
atgcacagaatcatgaatta

SEQ ID NO: 68714 - DNA, 20 bp, Artificial Sequence
  Description of Artificial Sequence: Synthetic oligonucleotide
  Target: SCN10A; (+) strand; PAM type: YTN; PAM sequence: TTA
aatacattgttgttttaatt

SEQ ID NO: 68715 - DNA, 20 bp, Artificial Sequence
  Description of Artificial Sequence: Synthetic oligonucleotide
  Target: SCN10A; (+) strand; PAM type: YTN; PAM sequence: TTG
ttgttttaattcacaaaatt

SEQ ID NO: 68716 - DNA, 20 bp, Artificial Sequence
  Description of Artificial Sequence: Synthetic oligonucleotide
  Target: SCN10A; (+) strand; PAM type: YTN; PAM sequence: TTG
ttttaattcacaaaattttg

SEQ ID NO: 68717 - DNA, 20 bp, Artificial Sequence
  Description of Artificial Sequence: Synthetic oligonucleotide
  Target: SCN10A; (+) strand; PAM type: YTN; PAM sequence: TTT
taattcacaaaattttgggg

SEQ ID NO: 68718 - DNA, 20 bp, Artificial Sequence
  Description of Artificial Sequence: Synthetic oligonucleotide
  Target: SCN10A; (+) strand; PAM type: YTN; PAM sequence: TTT
aattcacaaaattttggggt

SEQ ID NO: 68719 - DNA, 20 bp, Artificial Sequence
  Description of Artificial Sequence: Synthetic oligonucleotide
  Target: SCN10A; (+) strand; PAM type: YTN; PAM sequence: TTA
attcacaaaattttggggtc

SEQ ID NO: 68720 - DNA, 20 bp, Artificial Sequence
  Description of Artificial Sequence: Synthetic oligonucleotide
  Target: SCN10A; (+) strand; PAM type: YTN; PAM sequence: TTC
acaaaattttggggtcattt

SEQ ID NO: 68721 - DNA, 20 bp, Artificial Sequence
  Description of Artificial Sequence: Synthetic oligonucleotide
  Target: SCN10A; (+) strand; PAM type: YTN; PAM sequence: TTT
tggggtcatttgttacacag

SEQ ID NO: 68722 - DNA, 20 bp, Artificial Sequence
  Description of Artificial Sequence: Synthetic oligonucleotide
  Target: SCN10A; (+) strand; PAM type: YTN; PAM sequence: TTT
ggggtcatttgttacacagc

SEQ ID NO: 68723 - DNA, 20 bp, Artificial Sequence
  Description of Artificial Sequence: Synthetic oligonucleotide
  Target: SCN10A; (+) strand; PAM type: YTN; PAM sequence: TTG
gggtcatttgttacacagcg

SEQ ID NO: 68724 - DNA, 20 bp, Artificial Sequence
  Description of Artificial Sequence: Synthetic oligonucleotide
  Target: SCN10A; (+) strand; PAM type: YTN; PAM sequence: TTT
gttacacagcgaaagctaac

SEQ ID NO: 68725 - DNA, 20 bp, Artificial Sequence
  Description of Artificial Sequence: Synthetic oligonucleotide
  Target: SCN10A; (+) strand; PAM type: YTN; PAM sequence: TTG
ttacacagcgaaagctaact

SEQ ID NO: 68726 - DNA, 20 bp, Artificial Sequence
  Description of Artificial Sequence: Synthetic oligonucleotide
  Target: SCN10A; (+) strand; PAM type: YTN; PAM sequence: TTA
cacagcgaaagctaactcat

SEQ ID NO: 68727 - DNA, 20 bp, Artificial Sequence
  Description of Artificial Sequence: Synthetic oligonucleotide
  Target: SCN10A; (+) strand; PAM type: YTN; PAM sequence: CTA
actcatacattccctcccca

SEQ ID NO: 68728 - DNA, 20 bp, Artificial Sequence
  Description of Artificial Sequence: Synthetic oligonucleotide
  Target: SCN10A; (+) strand; PAM type: YTN; PAM sequence: CTC
atacattccctccccatgag

SEQ ID NO: 68729 - DNA, 20 bp, Artificial Sequence
  Description of Artificial Sequence: Synthetic oligonucleotide
  Target: SCN10A; (+) strand; PAM type: YTN; PAM sequence: TTC
cctccccatgagctctgggt

SEQ ID NO: 68730 - DNA, 20 bp, Artificial Sequence
  Description of Artificial Sequence: Synthetic oligonucleotide
  Target: SCN10A; (+) strand; PAM type: YTN; PAM sequence: CTC
cccatgagctctgggttggc

SEQ ID NO: 68731 - DNA, 20 bp, Artificial Sequence
  Description of Artificial Sequence: Synthetic oligonucleotide
  Target: SCN10A; (+) strand; PAM type: YTN; PAM sequence: CTC
tgggttggcaaaggccatga

SEQ ID NO: 68732 - DNA, 20 bp, Artificial Sequence
  Description of Artificial Sequence: Synthetic oligonucleotide
  Target: SCN10A; (+) strand; PAM type: YTN; PAM sequence: CTG
ggttggcaaaggccatgatt

SEQ ID NO: 68733 - DNA, 20 bp, Artificial Sequence
  Description of Artificial Sequence: Synthetic oligonucleotide
  Target: SCN10A; (+) strand; PAM type: YTN; PAM sequence: TTG
gcaaaggccatgatttattt

SEQ ID NO: 68734 - DNA, 20 bp, Artificial Sequence
  Description of Artificial Sequence: Synthetic oligonucleotide
  Target: SCN10A; (+) strand; PAM type: YTN; PAM sequence: TTT
atttatttatacatctttcc

SEQ ID NO: 68735 - DNA, 20 bp, Artificial Sequence
  Description of Artificial Sequence: Synthetic oligonucleotide
  Target: SCN10A; (+) strand; PAM type: YTN; PAM sequence: TTA
tttatttatacatctttccc

SEQ ID NO: 68736 - DNA, 20 bp, Artificial Sequence
  Description of Artificial Sequence: Synthetic oligonucleotide
  Target: SCN10A; (+) strand; PAM type: YTN; PAM sequence: TTT
atttatacatctttcccagg

SEQ ID NO: 68737 - DNA, 20 bp, Artificial Sequence
  Description of Artificial Sequence: Synthetic oligonucleotide
  Target: SCN10A; (+) strand; PAM type: YTN; PAM sequence: TTA
tttatacatctttcccagga

SEQ ID NO: 68738 - DNA, 20 bp, Artificial Sequence
  Description of Artificial Sequence: Synthetic oligonucleotide
  Target: SCN10A; (+) strand; PAM type: YTN; PAM sequence: TTT
atacatctttcccaggacct

SEQ ID NO: 68739 - DNA, 20 bp, Artificial Sequence
  Description of Artificial Sequence: Synthetic oligonucleotide
  Target: SCN10A; (+) strand; PAM type: YTN; PAM sequence: TTA
tacatctttcccaggacctg

SEQ ID NO: 68740 - DNA, 20 bp, Artificial Sequence
  Description of Artificial Sequence: Synthetic oligonucleotide
  Target: SCN10A; (+) strand; PAM type: YTN; PAM sequence: CTT
tcccaggacctgcaacccca

SEQ ID NO: 68741 - DNA, 20 bp, Artificial Sequence
  Description of Artificial Sequence: Synthetic oligonucleotide
  Target: SCN10A; (+) strand; PAM type: YTN; PAM sequence: TTT
cccaggacctgcaaccccat

SEQ ID NO: 68742 - DNA, 20 bp, Artificial Sequence
  Description of Artificial Sequence: Synthetic oligonucleotide
  Target: SCN10A; (+) strand; PAM type: YTN; PAM sequence: TTC
ccaggacctgcaaccccatc

SEQ ID NO: 68743 - DNA, 20 bp, Artificial Sequence
  Description of Artificial Sequence: Synthetic oligonucleotide
  Target: SCN10A; (+) strand; PAM type: YTN; PAM sequence: CTG
caaccccatctgtgcccata

SEQ ID NO: 68744 - DNA, 20 bp, Artificial Sequence
  Description of Artificial Sequence: Synthetic oligonucleotide
  Target: SCN10A; (+) strand; PAM type: YTN; PAM sequence: CTG
tgcccataatatgccaagga

SEQ ID NO: 68745 - DNA, 20 bp, Artificial Sequence
  Description of Artificial Sequence: Synthetic oligonucleotide
  Target: SCN10A; (+) strand; PAM type: YTN; PAM sequence: TTG
ttgggcactcgtgctttgtc

SEQ ID NO: 68746 - DNA, 20 bp, Artificial Sequence
  Description of Artificial Sequence: Synthetic oligonucleotide
  Target: SCN10A; (+) strand; PAM type: YTN; PAM sequence: TTG
ggcactcgtgctttgtcata

SEQ ID NO: 68747 - DNA, 20 bp, Artificial Sequence
  Description of Artificial Sequence: Synthetic oligonucleotide
  Target: SCN10A; (+) strand; PAM type: YTN; PAM sequence: CTC
gtgctttgtcataagttggg

SEQ ID NO: 68748 - DNA, 20 bp, Artificial Sequence
  Description of Artificial Sequence: Synthetic oligonucleotide
  Target: SCN10A; (+) strand; PAM type: YTN; PAM sequence: CTT
tgtcataagttgggaactca

SEQ ID NO: 68749 - DNA, 20 bp, Artificial Sequence
  Description of Artificial Sequence: Synthetic oligonucleotide
  Target: SCN10A; (+) strand; PAM type: YTN; PAM sequence: TTT
gtcataagttgggaactcac

SEQ ID NO: 68750 - DNA, 20 bp, Artificial Sequence
  Description of Artificial Sequence: Synthetic oligonucleotide
  Target: SCN10A; (+) strand; PAM type: YTN; PAM sequence: TTG
tcataagttgggaactcacc

SEQ ID NO: 68751 - DNA, 20 bp, Artificial Sequence
  Description of Artificial Sequence: Synthetic oligonucleotide
  Target: SCN10A; (+) strand; PAM type: YTN; PAM sequence: TTG
ggaactcaccctgagtcaga

SEQ ID NO: 68752 - DNA, 20 bp, Artificial Sequence
  Description of Artificial Sequence: Synthetic oligonucleotide
  Target: SCN10A; (+) strand; PAM type: YTN; PAM sequence: CTC
accctgagtcagatccattg

SEQ ID NO: 68753 - DNA, 20 bp, Artificial Sequence
  Description of Artificial Sequence: Synthetic oligonucleotide
  Target: SCN10A; (+) strand; PAM type: YTN; PAM sequence: CTG
agtcagatccattgccacac

SEQ ID NO: 68754 - DNA, 20 bp, Artificial Sequence
  Description of Artificial Sequence: Synthetic oligonucleotide
  Target: SCN10A; (+) strand; PAM type: YTN; PAM sequence: TTG
ccacacagtaaggggtcaga

SEQ ID NO: 68755 - DNA, 20 bp, Artificial Sequence
  Description of Artificial Sequence: Synthetic oligonucleotide
  Target: SCN10A; (+) strand; PAM type: YTN; PAM sequence: CTC
gcttatttatgtagatatct

SEQ ID NO: 68756 - DNA, 20 bp, Artificial Sequence
  Description of Artificial Sequence: Synthetic oligonucleotide
  Target: SCN10A; (+) strand; PAM type: YTN; PAM sequence: CTT
atttatgtagatatctgctg

SEQ ID NO: 68757 - DNA, 20 bp, Artificial Sequence
  Description of Artificial Sequence: Synthetic oligonucleotide
  Target: SCN10A; (+) strand; PAM type: YTN; PAM sequence: TTA
tttatgtagatatctgctga

SEQ ID NO: 68758 - DNA, 20 bp, Artificial Sequence
  Description of Artificial Sequence: Synthetic oligonucleotide
  Target: SCN10A; (+) strand; PAM type: YTN; PAM sequence: TTT
atgtagatatctgctgaaga

SEQ ID NO: 68759 - DNA, 20 bp, Artificial Sequence
  Description of Artificial Sequence: Synthetic oligonucleotide
  Target: SCN10A; (+) strand; PAM type: YTN; PAM sequence: TTA
tgtagatatctgctgaagaa

SEQ ID NO: 68760 - DNA, 20 bp, Artificial Sequence
  Description of Artificial Sequence: Synthetic oligonucleotide
  Target: SCN10A; (+) strand; PAM type: YTN; PAM sequence: CTG
ctgaagaaaggaagaaaaga

SEQ ID NO: 68761 - DNA, 20 bp, Artificial Sequence
  Description of Artificial Sequence: Synthetic oligonucleotide
  Target: SCN10A; (+) strand; PAM type: YTN; PAM sequence: CTG
aagaaaggaagaaaagaaag

SEQ ID NO: 68762 - DNA, 20 bp, Artificial Sequence
  Description of Artificial Sequence: Synthetic oligonucleotide
  Target: SCN10A; (+) strand; PAM type: YTN; PAM sequence: CTC
acagatggttctgaaccctc

SEQ ID NO: 68763 - DNA, 20 bp, Artificial Sequence
  Description of Artificial Sequence: Synthetic oligonucleotide
  Target: SCN10A; (+) strand; PAM type: YTN; PAM sequence: TTC
tgaaccctccaacccaagcc

SEQ ID NO: 68764 - DNA, 20 bp, Artificial Sequence
  Description of Artificial Sequence: Synthetic oligonucleotide
  Target: SCN10A; (+) strand; PAM type: YTN; PAM sequence: CTG
aaccctccaacccaagcctt

SEQ ID NO: 68765 - DNA, 20 bp, Artificial Sequence
  Description of Artificial Sequence: Synthetic oligonucleotide
  Target: SCN10A; (+) strand; PAM type: YTN; PAM sequence: CTC
caacccaagccttgtgtggt

SEQ ID NO: 68766 - DNA, 20 bp, Artificial Sequence
  Description of Artificial Sequence: Synthetic oligonucleotide
  Target: SCN10A; (+) strand; PAM type: YTN; PAM sequence: CTT
gtgtggtgaatgcaatattc

SEQ ID NO: 68767 - DNA, 20 bp, Artificial Sequence
  Description of Artificial Sequence: Synthetic oligonucleotide
  Target: SCN10A; (+) strand; PAM type: YTN; PAM sequence: TTG
tgtggtgaatgcaatattcc

SEQ ID NO: 68768 - DNA, 20 bp, Artificial Sequence
  Description of Artificial Sequence: Synthetic oligonucleotide
  Target: SCN10A; (+) strand; PAM type: YTN; PAM sequence: TTC
ccaagtcttccaaagtgagc

SEQ ID NO: 68769 - DNA, 20 bp, Artificial Sequence
  Description of Artificial Sequence: Synthetic oligonucleotide
  Target: SCN10A; (+) strand; PAM type: YTN; PAM sequence: CTT
ccaaagtgagctcctttggc

SEQ ID NO: 68770 - DNA, 20 bp, Artificial Sequence
  Description of Artificial Sequence: Synthetic oligonucleotide
  Target: SCN10A; (+) strand; PAM type: YTN; PAM sequence: TTC
caaagtgagctcctttggct

SEQ ID NO: 68771 - DNA, 20 bp, Artificial Sequence
  Description of Artificial Sequence: Synthetic oligonucleotide
  Target: SCN10A; (+) strand; PAM type: YTN; PAM sequence: CTC
ctttggctacatgtactcag

SEQ ID NO: 68772 - DNA, 20 bp, Artificial Sequence
  Description of Artificial Sequence: Synthetic oligonucleotide
  Target: SCN10A; (+) strand; PAM type: YTN; PAM sequence: CTT
tggctacatgtactcagtgg

SEQ ID NO: 68773 - DNA, 20 bp, Artificial Sequence
  Description of Artificial Sequence: Synthetic oligonucleotide
  Target: SCN10A; (+) strand; PAM type: YTN; PAM sequence: TTT
ggctacatgtactcagtggg

SEQ ID NO: 68774 - DNA, 20 bp, Artificial Sequence
  Description of Artificial Sequence: Synthetic oligonucleotide
  Target: SCN10A; (+) strand; PAM type: YTN; PAM sequence: TTG
gctacatgtactcagtgggc

SEQ ID NO: 68775 - DNA, 20 bp, Artificial Sequence
  Description of Artificial Sequence: Synthetic oligonucleotide
  Target: SCN10A; (+) strand; PAM type: YTN; PAM sequence: CTA
catgtactcagtgggcatgc

SEQ ID NO: 68776 - DNA, 20 bp, Artificial Sequence
  Description of Artificial Sequence: Synthetic oligonucleotide
  Target: SCN10A; (+) strand; PAM type: YTN; PAM sequence: CTC
agtgggcatgctgggccaca

SEQ ID NO: 68777 - DNA, 20 bp, Artificial Sequence
  Description of Artificial Sequence: Synthetic oligonucleotide
  Target: SCN10A; (+) strand; PAM type: YTN; PAM sequence: CTG
ggccacatggaagttgtaaa

SEQ ID NO: 68778 - DNA, 20 bp, Artificial Sequence
  Description of Artificial Sequence: Synthetic oligonucleotide
  Target: SCN10A; (+) strand; PAM type: YTN; PAM sequence: TTG
taaagtcacatctgaaaaga

SEQ ID NO: 68779 - DNA, 20 bp, Artificial Sequence
  Description of Artificial Sequence: Synthetic oligonucleotide
  Target: SCN10A; (+) strand; PAM type: YTN; PAM sequence: CTG
aaaagagaagagctaagcag

SEQ ID NO: 68780 - DNA, 20 bp, Artificial Sequence
  Description of Artificial Sequence: Synthetic oligonucleotide
  Target: SCN10A; (+) strand; PAM type: YTN; PAM sequence: CTA
agcagtgacttcggctctca

SEQ ID NO: 68781 - DNA, 20 bp, Artificial Sequence
  Description of Artificial Sequence: Synthetic oligonucleotide
  Target: SCN10A; (+) strand; PAM type: YTN; PAM sequence: CTT
cggctctcaatctcccccag

SEQ ID NO: 68782 - DNA, 20 bp, Artificial Sequence
  Description of Artificial Sequence: Synthetic oligonucleotide
  Target: SCN10A; (+) strand; PAM type: YTN; PAM sequence: TTC
ggctctcaatctcccccagc

SEQ ID NO: 68783 - DNA, 20 bp, Artificial Sequence
  Description of Artificial Sequence: Synthetic oligonucleotide
  Target: SCN10A; (+) strand; PAM type: YTN; PAM sequence: CTC
tcaatctcccccagcagagg

SEQ ID NO: 68784 - DNA, 20 bp, Artificial Sequence
  Description of Artificial Sequence: Synthetic oligonucleotide
  Target: SCN10A; (+) strand; PAM type: YTN; PAM sequence: CTC
aatctcccccagcagaggta

SEQ ID NO: 68785 - DNA, 20 bp, Artificial Sequence
  Description of Artificial Sequence: Synthetic oligonucleotide
  Target: SCN10A; (+) strand; PAM type: YTN; PAM sequence: CTC
ccccagcagaggtagaatga

SEQ ID NO: 68786 - DNA, 20 bp, Artificial Sequence
  Description of Artificial Sequence: Synthetic oligonucleotide
  Target: SCN10A; (+) strand; PAM type: YTN; PAM sequence: CTT
gcctctagatttatggctca

SEQ ID NO: 68787 - DNA, 20 bp, Artificial Sequence
  Description of Artificial Sequence: Synthetic oligonucleotide
  Target: SCN10A; (+) strand; PAM type: YTN; PAM sequence: TTG
cctctagatttatggctcat

SEQ ID NO: 68788 - DNA, 20 bp, Artificial Sequence
  Description of Artificial Sequence: Synthetic oligonucleotide
  Target: SCN10A; (+) strand; PAM type: YTN; PAM sequence: CTC
tagatttatggctcatttcc

SEQ ID NO: 68789 - DNA, 20 bp, Artificial Sequence
  Description of Artificial Sequence: Synthetic oligonucleotide
  Target: SCN10A; (+) strand; PAM type: YTN; PAM sequence: CTA
gatttatggctcatttcctt

SEQ ID NO: 68790 - DNA, 20 bp, Artificial Sequence
  Description of Artificial Sequence: Synthetic oligonucleotide
  Target: SCN10A; (+) strand; PAM type: YTN; PAM sequence: TTT
atggctcatttccttgcaag

SEQ ID NO: 68791 - DNA, 20 bp, Artificial Sequence
  Description of Artificial Sequence: Synthetic oligonucleotide
  Target: SCN10A; (+) strand; PAM type: YTN; PAM sequence: TTA
tggctcatttccttgcaaga

SEQ ID NO: 68792 - DNA, 20 bp, Artificial Sequence
  Description of Artificial Sequence: Synthetic oligonucleotide
  Target: SCN10A; (+) strand; PAM type: YTN; PAM sequence: CTC
atttccttgcaagagggatg

SEQ ID NO: 68793 - DNA, 20 bp, Artificial Sequence
  Description of Artificial Sequence: Synthetic oligonucleotide
  Target: SCN10A; (+) strand; PAM type: YTN; PAM sequence: TTT
ccttgcaagagggatgctga

SEQ ID NO: 68794 - DNA, 20 bp, Artificial Sequence
  Description of Artificial Sequence: Synthetic oligonucleotide
  Target: SCN10A; (+) strand; PAM type: YTN; PAM sequence: TTC
cttgcaagagggatgctgag

SEQ ID NO: 68795 - DNA, 20 bp, Artificial Sequence
  Description of Artificial Sequence: Synthetic oligonucleotide
  Target: SCN10A; (+) strand; PAM type: YTN; PAM sequence: CTT
gcaagagggatgctgagcaa

SEQ ID NO: 68796 - DNA, 20 bp, Artificial Sequence
  Description of Artificial Sequence: Synthetic oligonucleotide
  Target: SCN10A; (+) strand; PAM type: YTN; PAM sequence: TTG
caagagggatgctgagcaac

SEQ ID NO: 68797 - DNA, 20 bp, Artificial Sequence
  Description of Artificial Sequence: Synthetic oligonucleotide
  Target: SCN10A; (+) strand; PAM type: YTN; PAM sequence: CTG
agcaacaggaaatagaatac

SEQ ID NO: 68798 - DNA, 20 bp, Artificial Sequence
  Description of Artificial Sequence: Synthetic oligonucleotide
  Target: SCN10A; (+) strand; PAM type: YTN; PAM sequence: CTC
aagagaaccattttggcagg

SEQ ID NO: 68799 - DNA, 20 bp, Artificial Sequence
  Description of Artificial Sequence: Synthetic oligonucleotide
  Target: SCN10A; (+) strand; PAM type: YTN; PAM sequence: TTT
tggcaggaaaggggagtcaa

SEQ ID NO: 68800 - DNA, 20 bp, Artificial Sequence
  Description of Artificial Sequence: Synthetic oligonucleotide
  Target: SCN10A; (+) strand; PAM type: YTN; PAM sequence: TTT
ggcaggaaaggggagtcaaa

SEQ ID NO: 68801 - DNA, 20 bp, Artificial Sequence
  Description of Artificial Sequence: Synthetic oligonucleotide
  Target: SCN10A; (+) strand; PAM type: YTN; PAM sequence: TTG
gcaggaaaggggagtcaaaa

SEQ ID NO: 68802 - DNA, 20 bp, Artificial Sequence
  Description of Artificial Sequence: Synthetic oligonucleotide
  Target: SCN10A; (+) strand; PAM type: YTN; PAM sequence: CTA
tacacacacacaggggctcc

SEQ ID NO: 68803 - DNA, 20 bp, Artificial Sequence
  Description of Artificial Sequence: Synthetic oligonucleotide
  Target: SCN10A; (+) strand; PAM type: YTN; PAM sequence: CTC
catatcccctgtccctatat

SEQ ID NO: 68804 - DNA, 20 bp, Artificial Sequence
  Description of Artificial Sequence: Synthetic oligonucleotide
  Target: SCN10A; (+) strand; PAM type: YTN; PAM sequence: CTG
tccctatatgataccaaggg

SEQ ID NO: 68805 - DNA, 20 bp, Artificial Sequence
  Description of Artificial Sequence: Synthetic oligonucleotide
  Target: SCN10A; (+) strand; PAM type: YTN; PAM sequence: CTA
tatgataccaagggtccaac

SEQ ID NO: 68806 - DNA, 20 bp, Artificial Sequence
  Description of Artificial Sequence: Synthetic oligonucleotide
  Target: SCN10A; (+) strand; PAM type: YTN; PAM sequence: CTT
ggtccctatggaagagactc

SEQ ID NO: 68807 - DNA, 20 bp, Artificial Sequence
  Description of Artificial Sequence: Synthetic oligonucleotide
  Target: SCN10A; (+) strand; PAM type: YTN; PAM sequence: TTG
gtccctatggaagagactcc

SEQ ID NO: 68808 - DNA, 20 bp, Artificial Sequence
  Description of Artificial Sequence: Synthetic oligonucleotide
  Target: SCN10A; (+) strand; PAM type: YTN; PAM sequence: CTA
tggaagagactccactcacg

SEQ ID NO: 68809 - DNA, 20 bp, Artificial Sequence
  Description of Artificial Sequence: Synthetic oligonucleotide
  Target: SCN10A; (+) strand; PAM type: YTN; PAM sequence: CTC
cactcacgttttctgtgaga

SEQ ID NO: 68810 - DNA, 20 bp, Artificial Sequence
  Description of Artificial Sequence: Synthetic oligonucleotide
  Target: SCN10A; (+) strand; PAM type: YTN; PAM sequence: CTC
acgttttctgtgagatgagt

SEQ ID NO: 68811 - DNA, 20 bp, Artificial Sequence
  Description of Artificial Sequence: Synthetic oligonucleotide
  Target: SCN10A; (+) strand; PAM type: YTN; PAM sequence: TTT
tctgtgagatgagtagttgg

SEQ ID NO: 68812 - DNA, 20 bp, Artificial Sequence
  Description of Artificial Sequence: Synthetic oligonucleotide
  Target: SCN10A; (+) strand; PAM type: YTN; PAM sequence: TTT
ctgtgagatgagtagttggt

SEQ ID NO: 68813 - DNA, 20 bp, Artificial Sequence
  Description of Artificial Sequence: Synthetic oligonucleotide
  Target: SCN10A; (+) strand; PAM type: YTN; PAM sequence: TTC
tgtgagatgagtagttggtt

SEQ ID NO: 68814 - DNA, 20 bp, Artificial Sequence
  Description of Artificial Sequence: Synthetic oligonucleotide
  Target: SCN10A; (+) strand; PAM type: YTN; PAM sequence: CTG
tgagatgagtagttggttgt

SEQ ID NO: 68815 - DNA, 20 bp, Artificial Sequence
  Description of Artificial Sequence: Synthetic oligonucleotide
  Target: SCN10A; (+) strand; PAM type: YTN; PAM sequence: TTG
gttgtctcattgacagccat

SEQ ID NO: 68816 - DNA, 20 bp, Artificial Sequence
  Description of Artificial Sequence: Synthetic oligonucleotide
  Target: SCN10A; (+) strand; PAM type: YTN; PAM sequence: TTG
tctcattgacagccatgtca

SEQ ID NO: 68817 - DNA, 20 bp, Artificial Sequence
  Description of Artificial Sequence: Synthetic oligonucleotide
  Target: SCN10A; (+) strand; PAM type: YTN; PAM sequence: CTC
attgacagccatgtcattct

SEQ ID NO: 68818 - DNA, 20 bp, Artificial Sequence
  Description of Artificial Sequence: Synthetic oligonucleotide
  Target: SCN10A; (+) strand; PAM type: YTN; PAM sequence: TTG
acagccatgtcattcttgac

SEQ ID NO: 68819 - DNA, 20 bp, Artificial Sequence
  Description of Artificial Sequence: Synthetic oligonucleotide
  Target: SCN10A; (+) strand; PAM type: YTN; PAM sequence: TTC
ttgacacatttatttttgag

SEQ ID NO: 68820 - DNA, 20 bp, Artificial Sequence
  Description of Artificial Sequence: Synthetic oligonucleotide
  Target: SCN10A; (+) strand; PAM type: YTN; PAM sequence: CTT
gacacatttatttttgaggt

SEQ ID NO: 68821 - DNA, 20 bp, Artificial Sequence
  Description of Artificial Sequence: Synthetic oligonucleotide
  Target: SCN10A; (+) strand; PAM type: YTN; PAM sequence: TTG
acacatttatttttgaggtt

SEQ ID NO: 68822 - DNA, 20 bp, Artificial Sequence
  Description of Artificial Sequence: Synthetic oligonucleotide
  Target: SCN10A; (+) strand; PAM type: YTN; PAM sequence: TTT
atttttgaggttgcccttga

SEQ ID NO: 68823 - DNA, 20 bp, Artificial Sequence
  Description of Artificial Sequence: Synthetic oligonucleotide
  Target: SCN10A; (+) strand; PAM type: YTN; PAM sequence: TTA
tttttgaggttgcccttgaa

SEQ ID NO: 68824 - DNA, 20 bp, Artificial Sequence
  Description of Artificial Sequence: Synthetic oligonucleotide
  Target: SCN10A; (+) strand; PAM type: YTN; PAM sequence: TTT
ttgaggttgcccttgaagag

SEQ ID NO: 68825 - DNA, 20 bp, Artificial Sequence
  Description of Artificial Sequence: Synthetic oligonucleotide
  Target: SCN10A; (+) strand; PAM type: YTN; PAM sequence: TTT
tgaggttgcccttgaagagt

SEQ ID NO: 68826 - DNA, 20 bp, Artificial Sequence
  Description of Artificial Sequence: Synthetic oligonucleotide
  Target: SCN10A; (+) strand; PAM type: YTN; PAM sequence: TTT
gaggttgcccttgaagagtt

SEQ ID NO: 68827 - DNA, 20 bp, Artificial Sequence
  Description of Artificial Sequence: Synthetic oligonucleotide
  Target: SCN10A; (+) strand; PAM type: YTN; PAM sequence: TTG
aggttgcccttgaagagttg

SEQ ID NO: 68828 - DNA, 20 bp, Artificial Sequence
  Description of Artificial Sequence: Synthetic oligonucleotide
  Target: SCN10A; (+) strand; PAM type: YTN; PAM sequence: TTG
cccttgaagagttgcagccc

SEQ ID NO: 68829 - DNA, 20 bp, Artificial Sequence
  Description of Artificial Sequence: Synthetic oligonucleotide
  Target: SCN10A; (+) strand; PAM type: YTN; PAM sequence: CTT
gaagagttgcagccccacca

SEQ ID NO: 68830 - DNA, 20 bp, Artificial Sequence
  Description of Artificial Sequence: Synthetic oligonucleotide
  Target: SCN10A; (+) strand; PAM type: YTN; PAM sequence: TTG
aagagttgcagccccaccaa

SEQ ID NO: 68831 - DNA, 20 bp, Artificial Sequence
  Description of Artificial Sequence: Synthetic oligonucleotide
  Target: SCN10A; (+) strand; PAM type: YTN; PAM sequence: TTG
cagccccaccaaggcaaaaa

SEQ ID NO: 68832 - DNA, 20 bp, Artificial Sequence
  Description of Artificial Sequence: Synthetic oligonucleotide
  Target: SCN10A; (+) strand; PAM type: YTN; PAM sequence: CTT
aggcagaagatggtgaggat

SEQ ID NO: 68833 - DNA, 20 bp, Artificial Sequence
  Description of Artificial Sequence: Synthetic oligonucleotide
  Target: SCN10A; (+) strand; PAM type: YTN; PAM sequence: TTA
ggcagaagatggtgaggatg

SEQ ID NO: 68834 - DNA, 20 bp, Artificial Sequence
  Description of Artificial Sequence: Synthetic oligonucleotide
  Target: SCN10A; (+) strand; PAM type: YTN; PAM sequence: TTT
cttcactgagtgaatcaggg

SEQ ID NO: 68835 - DNA, 20 bp, Artificial Sequence
  Description of Artificial Sequence: Synthetic oligonucleotide
  Target: SCN10A; (+) strand; PAM type: YTN; PAM sequence: TTC
ttcactgagtgaatcagggc

SEQ ID NO: 68836 - DNA, 20 bp, Artificial Sequence
  Description of Artificial Sequence: Synthetic oligonucleotide
  Target: SCN10A; (+) strand; PAM type: YTN; PAM sequence: CTT
cactgagtgaatcagggccc

SEQ ID NO: 68837 - DNA, 20 bp, Artificial Sequence
  Description of Artificial Sequence: Synthetic oligonucleotide
  Target: SCN10A; (+) strand; PAM type: YTN; PAM sequence: TTC
actgagtgaatcagggcccc

SEQ ID NO: 68838 - DNA, 20 bp, Artificial Sequence
  Description of Artificial Sequence: Synthetic oligonucleotide
  Target: SCN10A; (+) strand; PAM type: YTN; PAM sequence: CTG
agtgaatcagggcccccaca

SEQ ID NO: 68839 - DNA, 20 bp, Artificial Sequence
  Description of Artificial Sequence: Synthetic oligonucleotide
  Target: SCN10A; (+) strand; PAM type: YTN; PAM sequence: CTT
caggcctgcgggaagatgac

SEQ ID NO: 68840 - DNA, 20 bp, Artificial Sequence
  Description of Artificial Sequence: Synthetic oligonucleotide
  Target: SCN10A; (+) strand; PAM type: YTN; PAM sequence: TTC
aggcctgcgggaagatgaca

SEQ ID NO: 68841 - DNA, 20 bp, Artificial Sequence
  Description of Artificial Sequence: Synthetic oligonucleotide
  Target: SCN10A; (+) strand; PAM type: YTN; PAM sequence: CTG
cgggaagatgacagtggtat

SEQ ID NO: 68842 - DNA, 20 bp, Artificial Sequence
  Description of Artificial Sequence: Synthetic oligonucleotide
  Target: SCN10A; (+) strand; PAM type: YTN; PAM sequence: CTT
cttcatcttagccatcctcc

SEQ ID NO: 68843 - DNA, 20 bp, Artificial Sequence
  Description of Artificial Sequence: Synthetic oligonucleotide
  Target: SCN10A; (+) strand; PAM type: YTN; PAM sequence: TTC
ttcatcttagccatcctcct

SEQ ID NO: 68844 - DNA, 20 bp, Artificial Sequence
  Description of Artificial Sequence: Synthetic oligonucleotide
  Target: SCN10A; (+) strand; PAM type: YTN; PAM sequence: CTT
catcttagccatcctccttc

SEQ ID NO: 68845 - DNA, 20 bp, Artificial Sequence
  Description of Artificial Sequence: Synthetic oligonucleotide
  Target: SCN10A; (+) strand; PAM type: YTN; PAM sequence: TTC
atcttagccatcctccttca

SEQ ID NO: 68846 - DNA, 20 bp, Artificial Sequence
  Description of Artificial Sequence: Synthetic oligonucleotide
  Target: SCN10A; (+) strand; PAM type: YTN; PAM sequence: CTT
agccatcctccttcatctct

SEQ ID NO: 68847 - DNA, 20 bp, Artificial Sequence
  Description of Artificial Sequence: Synthetic oligonucleotide
  Target: SCN10A; (+) strand; PAM type: YTN; PAM sequence: TTA
gccatcctccttcatctcta

SEQ ID NO: 68848 - DNA, 20 bp, Artificial Sequence
  Description of Artificial Sequence: Synthetic oligonucleotide
  Target: SCN10A; (+) strand; PAM type: YTN; PAM sequence: CTC
cttcatctctacatacagga

SEQ ID NO: 68849 - DNA, 20 bp, Artificial Sequence
  Description of Artificial Sequence: Synthetic oligonucleotide
  Target: SCN10A; (+) strand; PAM type: YTN; PAM sequence: CTT
catctctacatacaggagtg

SEQ ID NO: 68850 - DNA, 20 bp, Artificial Sequence
  Description of Artificial Sequence: Synthetic oligonucleotide
  Target: SCN10A; (+) strand; PAM type: YTN; PAM sequence: TTC
atctctacatacaggagtga

SEQ ID NO: 68851 - DNA, 20 bp, Artificial Sequence
  Description of Artificial Sequence: Synthetic oligonucleotide
  Target: SCN10A; (+) strand; PAM type: YTN; PAM sequence: CTC
tacatacaggagtgaagtat

SEQ ID NO: 68852 - DNA, 20 bp, Artificial Sequence
  Description of Artificial Sequence: Synthetic oligonucleotide
  Target: SCN10A; (+) strand; PAM type: YTN; PAM sequence: CTA
catacaggagtgaagtatgt

SEQ ID NO: 68853 - DNA, 20 bp, Artificial Sequence
  Description of Artificial Sequence: Synthetic oligonucleotide
  Target: SCN10A; (+) strand; PAM type: YTN; PAM sequence: CTC
cagggcagttccaagacctt

SEQ ID NO: 68854 - DNA, 20 bp, Artificial Sequence
  Description of Artificial Sequence: Synthetic oligonucleotide
  Target: SCN10A; (+) strand; PAM type: YTN; PAM sequence: TTC
caagacctttctcatccgaa

SEQ ID NO: 68855 - DNA, 20 bp, Artificial Sequence
  Description of Artificial Sequence: Synthetic oligonucleotide
  Target: SCN10A; (+) strand; PAM type: YTN; PAM sequence: CTT
tctcatccgaagcttgcatt

SEQ ID NO: 68856 - DNA, 20 bp, Artificial Sequence
  Description of Artificial Sequence: Synthetic oligonucleotide
  Target: SCN10A; (+) strand; PAM type: YTN; PAM sequence: TTT
ctcatccgaagcttgcattt

SEQ ID NO: 68857 - DNA, 20 bp, Artificial Sequence
  Description of Artificial Sequence: Synthetic oligonucleotide
  Target: SCN10A; (+) strand; PAM type: YTN; PAM sequence: TTC
tcatccgaagcttgcattta

SEQ ID NO: 68858 - DNA, 20 bp, Artificial Sequence
  Description of Artificial Sequence: Synthetic oligonucleotide
  Target: SCN10A; (+) strand; PAM type: YTN; PAM sequence: CTC
atccgaagcttgcatttact

SEQ ID NO: 68859 - DNA, 20 bp, Artificial Sequence
  Description of Artificial Sequence: Synthetic oligonucleotide
  Target: SCN10A; (+) strand; PAM type: YTN; PAM sequence: CTT
gcatttactctgagaggcag

SEQ ID NO: 68860 - DNA, 20 bp, Artificial Sequence
  Description of Artificial Sequence: Synthetic oligonucleotide
  Target: SCN10A; (+) strand; PAM type: YTN; PAM sequence: TTG
catttactctgagaggcagg

SEQ ID NO: 68861 - DNA, 20 bp, Artificial Sequence
  Description of Artificial Sequence: Synthetic oligonucleotide
  Target: SCN10A; (+) strand; PAM type: YTN; PAM sequence: TTT
actctgagaggcaggcagag

SEQ ID NO: 68862 - DNA, 20 bp, Artificial Sequence
  Description of Artificial Sequence: Synthetic oligonucleotide
  Target: SCN10A; (+) strand; PAM type: YTN; PAM sequence: TTA
ctctgagaggcaggcagaga

SEQ ID NO: 68863 - DNA, 20 bp, Artificial Sequence
  Description of Artificial Sequence: Synthetic oligonucleotide
  Target: SCN10A; (+) strand; PAM type: YTN; PAM sequence: CTC
tgagaggcaggcagagagtc

SEQ ID NO: 68864 - DNA, 20 bp, Artificial Sequence
  Description of Artificial Sequence: Synthetic oligonucleotide
  Target: SCN10A; (+) strand; PAM type: YTN; PAM sequence: CTG
agaggcaggcagagagtcag

SEQ ID NO: 68865 - DNA, 20 bp, Artificial Sequence
  Description of Artificial Sequence: Synthetic oligonucleotide
  Target: SCN10A; (+) strand; PAM type: YTN; PAM sequence: CTA
ttctcattataaagacgatg

SEQ ID NO: 68866 - DNA, 20 bp, Artificial Sequence
  Description of Artificial Sequence: Synthetic oligonucleotide
  Target: SCN10A; (+) strand; PAM type: YTN; PAM sequence: TTC
tcattataaagacgatgcaa

SEQ ID NO: 68867 - DNA, 20 bp, Artificial Sequence
  Description of Artificial Sequence: Synthetic oligonucleotide
  Target: SCN10A; (+) strand; PAM type: YTN; PAM sequence: CTC
attataaagacgatgcaact

SEQ ID NO: 68868 - DNA, 20 bp, Artificial Sequence
  Description of Artificial Sequence: Synthetic oligonucleotide
  Target: SCN10A; (+) strand; PAM type: YTN; PAM sequence: TTA
taaagacgatgcaactgaga

SEQ ID NO: 68869 - DNA, 20 bp, Artificial Sequence
  Description of Artificial Sequence: Synthetic oligonucleotide
  Target: SCN10A; (+) strand; PAM type: YTN; PAM sequence: CTG
agacccaggcaatgcatttt

SEQ ID NO: 68870 - DNA, 20 bp, Artificial Sequence
  Description of Artificial Sequence: Synthetic oligonucleotide
  Target: SCN10A; (+) strand; PAM type: YTN; PAM sequence: TTT
tttatcatcttgaggctaat

SEQ ID NO: 68871 - DNA, 20 bp, Artificial Sequence
  Description of Artificial Sequence: Synthetic oligonucleotide
  Target: SCN10A; (+) strand; PAM type: YTN; PAM sequence: TTT
ttatcatcttgaggctaata

SEQ ID NO: 68872 - DNA, 20 bp, Artificial Sequence
  Description of Artificial Sequence: Synthetic oligonucleotide
  Target: SCN10A; (+) strand; PAM type: YTN; PAM sequence: TTT
tatcatcttgaggctaataa

SEQ ID NO: 68873 - DNA, 20 bp, Artificial Sequence
  Description of Artificial Sequence: Synthetic oligonucleotide
  Target: SCN10A; (+) strand; PAM type: YTN; PAM sequence: TTT
atcatcttgaggctaataaa

SEQ ID NO: 68874 - DNA, 20 bp, Artificial Sequence
  Description of Artificial Sequence: Synthetic oligonucleotide
  Target: SCN10A; (+) strand; PAM type: YTN; PAM sequence: TTA
tcatcttgaggctaataaaa

SEQ ID NO: 68875 - DNA, 20 bp, Artificial Sequence
  Description of Artificial Sequence: Synthetic oligonucleotide
  Target: SCN10A; (+) strand; PAM type: YTN; PAM sequence: CTT
gaggctaataaaattcctga

SEQ ID NO: 68876 - DNA, 20 bp, Artificial Sequence
  Description of Artificial Sequence: Synthetic oligonucleotide
  Target: SCN10A; (+) strand; PAM type: YTN; PAM sequence: TTG
aggctaataaaattcctgac

SEQ ID NO: 68877 - DNA, 20 bp, Artificial Sequence
  Description of Artificial Sequence: Synthetic oligonucleotide
  Target: SCN10A; (+) strand; PAM type: YTN; PAM sequence: CTA
ataaaattcctgacactagc

SEQ ID NO: 68878 - DNA, 20 bp, Artificial Sequence
  Description of Artificial Sequence: Synthetic oligonucleotide
  Target: SCN10A; (+) strand; PAM type: YTN; PAM sequence: TTC
ctgacactagcaattcaatt

SEQ ID NO: 68879 - DNA, 20 bp, Artificial Sequence
  Description of Artificial Sequence: Synthetic oligonucleotide
  Target: SCN10A; (+) strand; PAM type: YTN; PAM sequence: CTG
acactagcaattcaatttaa

SEQ ID NO: 68880 - DNA, 20 bp, Artificial Sequence
  Description of Artificial Sequence: Synthetic oligonucleotide
  Target: SCN10A; (+) strand; PAM type: YTN; PAM sequence: CTA
gcaattcaatttaaataatt

SEQ ID NO: 68881 - DNA, 20 bp, Artificial Sequence
  Description of Artificial Sequence: Synthetic oligonucleotide
  Target: SCN10A; (+) strand; PAM type: YTN; PAM sequence: TTC
aatttaaataatttatgctg

SEQ ID NO: 68882 - DNA, 20 bp, Artificial Sequence
  Description of Artificial Sequence: Synthetic oligonucleotide
  Target: SCN10A; (+) strand; PAM type: YTN; PAM sequence: TTT
aaataatttatgctgagtac

SEQ ID NO: 68883 - DNA, 20 bp, Artificial Sequence
  Description of Artificial Sequence: Synthetic oligonucleotide
  Target: SCN10A; (+) strand; PAM type: YTN; PAM sequence: TTA
aataatttatgctgagtacc

SEQ ID NO: 68884 - DNA, 20 bp, Artificial Sequence
  Description of Artificial Sequence: Synthetic oligonucleotide
  Target: SCN10A; (+) strand; PAM type: YTN; PAM sequence: TTT
atgctgagtacctacttttt

SEQ ID NO: 68885 - DNA, 20 bp, Artificial Sequence
  Description of Artificial Sequence: Synthetic oligonucleotide
  Target: SCN10A; (+) strand; PAM type: YTN; PAM sequence: TTA
tgctgagtacctactttttc

SEQ ID NO: 68886 - DNA, 20 bp, Artificial Sequence
  Description of Artificial Sequence: Synthetic oligonucleotide
  Target: SCN10A; (+) strand; PAM type: YTN; PAM sequence: CTG
agtacctactttttccaggc

SEQ ID NO: 68887 - DNA, 20 bp, Artificial Sequence
  Description of Artificial Sequence: Synthetic oligonucleotide
  Target: SCN10A; (+) strand; PAM type: YTN; PAM sequence: CTA
ctttttccaggcactgtgct

SEQ ID NO: 68888 - DNA, 20 bp, Artificial Sequence
  Description of Artificial Sequence: Synthetic oligonucleotide
  Target: SCN10A; (+) strand; PAM type: YTN; PAM sequence: CTT
tttccaggcactgtgctagg

SEQ ID NO: 68889 - DNA, 20 bp, Artificial Sequence
  Description of Artificial Sequence: Synthetic oligonucleotide
  Target: SCN10A; (+) strand; PAM type: YTN; PAM sequence: TTT
ttccaggcactgtgctaggc

SEQ ID NO: 68890 - DNA, 20 bp, Artificial Sequence
  Description of Artificial Sequence: Synthetic oligonucleotide
  Target: SCN10A; (+) strand; PAM type: YTN; PAM sequence: TTT
tccaggcactgtgctaggca

SEQ ID NO: 68891 - DNA, 20 bp, Artificial Sequence
  Description of Artificial Sequence: Synthetic oligonucleotide
  Target: SCN10A; (+) strand; PAM type: YTN; PAM sequence: TTT
ccaggcactgtgctaggcat

SEQ ID NO: 68892 - DNA, 20 bp, Artificial Sequence
  Description of Artificial Sequence: Synthetic oligonucleotide
  Target: SCN10A; (+) strand; PAM type: YTN; PAM sequence: TTC
caggcactgtgctaggcatg

SEQ ID NO: 68893 - DNA, 20 bp, Artificial Sequence
  Description of Artificial Sequence: Synthetic oligonucleotide
  Target: SCN10A; (+) strand; PAM type: YTN; PAM sequence: CTG
tgctaggcatgaagctacta

SEQ ID NO: 68894 - DNA, 20 bp, Artificial Sequence
  Description of Artificial Sequence: Synthetic oligonucleotide
  Target: SCN10A; (+) strand; PAM type: YTN; PAM sequence: CTA
ggcatgaagctactaacttc

SEQ ID NO: 68895 - DNA, 20 bp, Artificial Sequence
  Description of Artificial Sequence: Synthetic oligonucleotide
  Target: SCN10A; (+) strand; PAM type: YTN; PAM sequence: CTA
ctaacttcaccccagtaatt

SEQ ID NO: 68896 - DNA, 20 bp, Artificial Sequence
  Description of Artificial Sequence: Synthetic oligonucleotide
  Target: SCN10A; (+) strand; PAM type: YTN; PAM sequence: CTA
acttcaccccagtaatttgg

SEQ ID NO: 68897 - DNA, 20 bp, Artificial Sequence
  Description of Artificial Sequence: Synthetic oligonucleotide
  Target: SCN10A; (+) strand; PAM type: YTN; PAM sequence: CTT
caccccagtaatttggcatc

SEQ ID NO: 68898 - DNA, 20 bp, Artificial Sequence
  Description of Artificial Sequence: Synthetic oligonucleotide
  Target: SCN10A; (+) strand; PAM type: YTN; PAM sequence: TTC
accccagtaatttggcatct

SEQ ID NO: 68899 - DNA, 20 bp, Artificial Sequence
  Description of Artificial Sequence: Synthetic oligonucleotide
  Target: SCN10A; (+) strand; PAM type: YTN; PAM sequence: TTT
ggcatctgtctttctgcatg

SEQ ID NO: 68900 - DNA, 20 bp, Artificial Sequence
  Description of Artificial Sequence: Synthetic oligonucleotide
  Target: SCN10A; (+) strand; PAM type: YTN; PAM sequence: TTG
gcatctgtctttctgcatgc

SEQ ID NO: 68901 - DNA, 20 bp, Artificial Sequence
  Description of Artificial Sequence: Synthetic oligonucleotide
  Target: SCN10A; (+) strand; PAM type: YTN; PAM sequence: CTG
tctttctgcatgcatctggg

SEQ ID NO: 68902 - DNA, 20 bp, Artificial Sequence
  Description of Artificial Sequence: Synthetic oligonucleotide
  Target: SCN10A; (+) strand; PAM type: YTN; PAM sequence: CTT
tctgcatgcatctgggaggc

SEQ ID NO: 68903 - DNA, 20 bp, Artificial Sequence
  Description of Artificial Sequence: Synthetic oligonucleotide
  Target: SCN10A; (+) strand; PAM type: YTN; PAM sequence: TTT
ctgcatgcatctgggaggca

SEQ ID NO: 68904 - DNA, 20 bp, Artificial Sequence
  Description of Artificial Sequence: Synthetic oligonucleotide
  Target: SCN10A; (+) strand; PAM type: YTN; PAM sequence: TTC
tgcatgcatctgggaggcag

SEQ ID NO: 68905 - DNA, 20 bp, Artificial Sequence
  Description of Artificial Sequence: Synthetic oligonucleotide
  Target: SCN10A; (+) strand; PAM type: YTN; PAM sequence: CTG
catgcatctgggaggcagct

SEQ ID NO: 68906 - DNA, 20 bp, Artificial Sequence
  Description of Artificial Sequence: Synthetic oligonucleotide
  Target: SCN10A; (+) strand; PAM type: YTN; PAM sequence: CTG
ggaggcagcttgagacttgg

SEQ ID NO: 68907 - DNA, 20 bp, Artificial Sequence
  Description of Artificial Sequence: Synthetic oligonucleotide
  Target: SCN10A; (+) strand; PAM type: YTN; PAM sequence: CTT
gagacttgggacacatgaac

SEQ ID NO: 68908 - DNA, 20 bp, Artificial Sequence
  Description of Artificial Sequence: Synthetic oligonucleotide
  Target: SCN10A; (+) strand; PAM type: YTN; PAM sequence: TTG
agacttgggacacatgaacc

SEQ ID NO: 68909 - DNA, 20 bp, Artificial Sequence
  Description of Artificial Sequence: Synthetic oligonucleotide
  Target: SCN10A; (+) strand; PAM type: YTN; PAM sequence: CTT
gggacacatgaacctcactg

SEQ ID NO: 68910 - DNA, 20 bp, Artificial Sequence
  Description of Artificial Sequence: Synthetic oligonucleotide
  Target: SCN10A; (+) strand; PAM type: YTN; PAM sequence: TTG
ggacacatgaacctcactgt

SEQ ID NO: 68911 - DNA, 20 bp, Artificial Sequence
  Description of Artificial Sequence: Synthetic oligonucleotide
  Target: SCN10A; (+) strand; PAM type: YTN; PAM sequence: CTC
actgtgtgtgagtgtgtgtg

SEQ ID NO: 68912 - DNA, 20 bp, Artificial Sequence
  Description of Artificial Sequence: Synthetic oligonucleotide
  Target: SCN10A; (+) strand; PAM type: YTN; PAM sequence: CTG
tgtgtgagtgtgtgtgtgtg

SEQ ID NO: 68913 - DNA, 20 bp, Artificial Sequence
  Description of Artificial Sequence: Synthetic oligonucleotide
  Target: SCN10A; (+) strand; PAM type: YTN; PAM sequence: TTT
agcaatagaaagagactata

SEQ ID NO: 68914 - DNA, 20 bp, Artificial Sequence
  Description of Artificial Sequence: Synthetic oligonucleotide
  Target: SCN10A; (+) strand; PAM type: YTN; PAM sequence: TTA
gcaatagaaagagactataa

SEQ ID NO: 68915 - DNA, 20 bp, Artificial Sequence
  Description of Artificial Sequence: Synthetic oligonucleotide
  Target: SCN10A; (+) strand; PAM type: YTN; PAM sequence: CTA
taagaaacactgagacagtc

SEQ ID NO: 68916 - DNA, 20 bp, Artificial Sequence
  Description of Artificial Sequence: Synthetic oligonucleotide
  Target: SCN10A; (+) strand; PAM type: YTN; PAM sequence: CTG
agacagtcactggggcataa

SEQ ID NO: 68917 - DNA, 20 bp, Artificial Sequence
  Description of Artificial Sequence: Synthetic oligonucleotide
  Target: SCN10A; (+) strand; PAM type: YTN; PAM sequence: CTG
gggcataaatagaacttgtg

SEQ ID NO: 68918 - DNA, 20 bp, Artificial Sequence
  Description of Artificial Sequence: Synthetic oligonucleotide
  Target: SCN10A; (+) strand; PAM type: YTN; PAM sequence: CTT
gtgccaagcacagctggcag

SEQ ID NO: 68919 - DNA, 20 bp, Artificial Sequence
  Description of Artificial Sequence: Synthetic oligonucleotide
  Target: SCN10A; (+) strand; PAM type: YTN; PAM sequence: TTG
tgccaagcacagctggcagc

SEQ ID NO: 68920 - DNA, 20 bp, Artificial Sequence
  Description of Artificial Sequence: Synthetic oligonucleotide
  Target: SCN10A; (+) strand; PAM type: YTN; PAM sequence: CTG
gcagcaaagaaggatacacc

SEQ ID NO: 68921 - DNA, 20 bp, Artificial Sequence
  Description of Artificial Sequence: Synthetic oligonucleotide
  Target: SCN10A; (+) strand; PAM type: YTN; PAM sequence: CTG
cttgtttaaggagggatgat

SEQ ID NO: 68922 - DNA, 20 bp, Artificial Sequence
  Description of Artificial Sequence: Synthetic oligonucleotide
  Target: SCN10A; (+) strand; PAM type: YTN; PAM sequence: CTT
gtttaaggagggatgatttg

SEQ ID NO: 68923 - DNA, 20 bp, Artificial Sequence
  Description of Artificial Sequence: Synthetic oligonucleotide
  Target: SCN10A; (+) strand; PAM type: YTN; PAM sequence: TTG
tttaaggagggatgatttgt

SEQ ID NO: 68924 - DNA, 20 bp, Artificial Sequence
  Description of Artificial Sequence: Synthetic oligonucleotide
  Target: SCN10A; (+) strand; PAM type: YTN; PAM sequence: TTT
aaggagggatgatttgttgc

SEQ ID NO: 68925 - DNA, 20 bp, Artificial Sequence
  Description of Artificial Sequence: Synthetic oligonucleotide
  Target: SCN10A; (+) strand; PAM type: YTN; PAM sequence: TTA
aggagggatgatttgttgct

SEQ ID NO: 68926 - DNA, 20 bp, Artificial Sequence
  Description of Artificial Sequence: Synthetic oligonucleotide
  Target: SCN10A; (+) strand; PAM type: YTN; PAM sequence: TTT
gttgctctggtaagtaaaat

SEQ ID NO: 68927 - DNA, 20 bp, Artificial Sequence
  Description of Artificial Sequence: Synthetic oligonucleotide
  Target: SCN10A; (+) strand; PAM type: YTN; PAM sequence: TTG
ttgctctggtaagtaaaatc

SEQ ID NO: 68928 - DNA, 20 bp, Artificial Sequence
  Description of Artificial Sequence: Synthetic oligonucleotide
  Target: SCN10A; (+) strand; PAM type: YTN; PAM sequence: TTG
ctctggtaagtaaaatcaac

SEQ ID NO: 68929 - DNA, 20 bp, Artificial Sequence
  Description of Artificial Sequence: Synthetic oligonucleotide
  Target: SCN10A; (+) strand; PAM type: YTN; PAM sequence: CTC
tggtaagtaaaatcaacttc

SEQ ID NO: 68930 - DNA, 20 bp, Artificial Sequence
  Description of Artificial Sequence: Synthetic oligonucleotide
  Target: SCN10A; (+) strand; PAM type: YTN; PAM sequence: CTG
gtaagtaaaatcaacttctt

SEQ ID NO: 68931 - DNA, 20 bp, Artificial Sequence
  Description of Artificial Sequence: Synthetic oligonucleotide
  Target: SCN10A; (+) strand; PAM type: YTN; PAM sequence: CTT
ctttgggagagcagcttcgc

SEQ ID NO: 68932 - DNA, 20 bp, Artificial Sequence
  Description of Artificial Sequence: Synthetic oligonucleotide
  Target: SCN10A; (+) strand; PAM type: YTN; PAM sequence: TTC
tttgggagagcagcttcgca

SEQ ID NO: 68933 - DNA, 20 bp, Artificial Sequence
  Description of Artificial Sequence: Synthetic oligonucleotide
  Target: SCN10A; (+) strand; PAM type: YTN; PAM sequence: CTT
tgggagagcagcttcgcagg

SEQ ID NO: 68934 - DNA, 20 bp, Artificial Sequence
  Description of Artificial Sequence: Synthetic oligonucleotide
  Target: SCN10A; (+) strand; PAM type: YTN; PAM sequence: TTT
gggagagcagcttcgcaggt

SEQ ID NO: 68935 - DNA, 20 bp, Artificial Sequence
  Description of Artificial Sequence: Synthetic oligonucleotide
  Target: SCN10A; (+) strand; PAM type: YTN; PAM sequence: TTG
ggagagcagcttcgcaggta

SEQ ID NO: 68936 - DNA, 20 bp, Artificial Sequence
  Description of Artificial Sequence: Synthetic oligonucleotide
  Target: SCN10A; (+) strand; PAM type: YTN; PAM sequence: CTT
cgcaggtagcagaaagagct

SEQ ID NO: 68937 - DNA, 20 bp, Artificial Sequence
  Description of Artificial Sequence: Synthetic oligonucleotide
  Target: SCN10A; (+) strand; PAM type: YTN; PAM sequence: TTC
gcaggtagcagaaagagctc

SEQ ID NO: 68938 - DNA, 20 bp, Artificial Sequence
  Description of Artificial Sequence: Synthetic oligonucleotide
  Target: SCN10A; (+) strand; PAM type: YTN; PAM sequence: CTC
tgaccagggaagcaatctag

SEQ ID NO: 68939 - DNA, 20 bp, Artificial Sequence
  Description of Artificial Sequence: Synthetic oligonucleotide
  Target: SCN10A; (+) strand; PAM type: YTN; PAM sequence: CTG
accagggaagcaatctagga

SEQ ID NO: 68940 - DNA, 20 bp, Artificial Sequence
  Description of Artificial Sequence: Synthetic oligonucleotide
  Target: SCN10A; (+) strand; PAM type: YTN; PAM sequence: CTA
ggatttatttttggttagtc

SEQ ID NO: 68941 - DNA, 20 bp, Artificial Sequence
  Description of Artificial Sequence: Synthetic oligonucleotide
  Target: SCN10A; (+) strand; PAM type: YTN; PAM sequence: TTT
atttttggttagtcattttg

SEQ ID NO: 68942 - DNA, 20 bp, Artificial Sequence
  Description of Artificial Sequence: Synthetic oligonucleotide
  Target: SCN10A; (+) strand; PAM type: YTN; PAM sequence: TTA
tttttggttagtcattttgg

SEQ ID NO: 68943 - DNA, 20 bp, Artificial Sequence
  Description of Artificial Sequence: Synthetic oligonucleotide
  Target: SCN10A; (+) strand; PAM type: YTN; PAM sequence: TTT
ttggttagtcattttggtca

SEQ ID NO: 68944 - DNA, 20 bp, Artificial Sequence
  Description of Artificial Sequence: Synthetic oligonucleotide
  Target: SCN10A; (+) strand; PAM type: YTN; PAM sequence: TTT
tggttagtcattttggtcag

SEQ ID NO: 68945 - DNA, 20 bp, Artificial Sequence
  Description of Artificial Sequence: Synthetic oligonucleotide
  Target: SCN10A; (+) strand; PAM type: YTN; PAM sequence: TTT
ggttagtcattttggtcagc

SEQ ID NO: 68946 - DNA, 20 bp, Artificial Sequence
  Description of Artificial Sequence: Synthetic oligonucleotide
  Target: SCN10A; (+) strand; PAM type: YTN; PAM sequence: TTG
gttagtcattttggtcagca

SEQ ID NO: 68947 - DNA, 20 bp, Artificial Sequence
  Description of Artificial Sequence: Synthetic oligonucleotide
  Target: SCN10A; (+) strand; PAM type: YTN; PAM sequence: TTA
gtcattttggtcagcaaata

SEQ ID NO: 68948 - DNA, 20 bp, Artificial Sequence
  Description of Artificial Sequence: Synthetic oligonucleotide
  Target: SCN10A; (+) strand; PAM type: YTN; PAM sequence: TTT
tggtcagcaaataatccact

SEQ ID NO: 68949 - DNA, 20 bp, Artificial Sequence
  Description of Artificial Sequence: Synthetic oligonucleotide
  Target: SCN10A; (+) strand; PAM type: YTN; PAM sequence: TTT
ggtcagcaaataatccactg

SEQ ID NO: 68950 - DNA, 20 bp, Artificial Sequence
  Description of Artificial Sequence: Synthetic oligonucleotide
  Target: SCN10A; (+) strand; PAM type: YTN; PAM sequence: TTG
gtcagcaaataatccactga

SEQ ID NO: 68951 - DNA, 20 bp, Artificial Sequence
  Description of Artificial Sequence: Synthetic oligonucleotide
  Target: SCN10A; (+) strand; PAM type: YTN; PAM sequence: CTG
agcactacatgtgtcagtcc

SEQ ID NO: 68952 - DNA, 20 bp, Artificial Sequence
  Description of Artificial Sequence: Synthetic oligonucleotide
  Target: SCN10A; (+) strand; PAM type: YTN; PAM sequence: CTA
catgtgtcagtccctggact

SEQ ID NO: 68953 - DNA, 20 bp, Artificial Sequence
  Description of Artificial Sequence: Synthetic oligonucleotide
  Target: SCN10A; (+) strand; PAM type: YTN; PAM sequence: CTG
gactgggagctgagtgatgg

SEQ ID NO: 68954 - DNA, 20 bp, Artificial Sequence
  Description of Artificial Sequence: Synthetic oligonucleotide
  Target: SCN10A; (+) strand; PAM type: YTN; PAM sequence: CTG
ggagctgagtgatggctaag

SEQ ID NO: 68955 - DNA, 20 bp, Artificial Sequence
  Description of Artificial Sequence: Synthetic oligonucleotide
  Target: SCN10A; (+) strand; PAM type: YTN; PAM sequence: CTG
agtgatggctaaggcagcag

SEQ ID NO: 68956 - DNA, 20 bp, Artificial Sequence
  Description of Artificial Sequence: Synthetic oligonucleotide
  Target: SCN10A; (+) strand; PAM type: YTN; PAM sequence: CTA
aggcagcagcatgtcgagtg

SEQ ID NO: 68957 - DNA, 20 bp, Artificial Sequence
  Description of Artificial Sequence: Synthetic oligonucleotide
  Target: SCN10A; (+) strand; PAM type: YTN; PAM sequence: TTG
tctgacaattgaggggaaag

SEQ ID NO: 68958 - DNA, 20 bp, Artificial Sequence
  Description of Artificial Sequence: Synthetic oligonucleotide
  Target: SCN10A; (+) strand; PAM type: YTN; PAM sequence: CTG
acaattgaggggaaagtctg

SEQ ID NO: 68959 - DNA, 20 bp, Artificial Sequence
  Description of Artificial Sequence: Synthetic oligonucleotide
  Target: SCN10A; (+) strand; PAM type: YTN; PAM sequence: TTG
aggggaaagtctgtagcatt

SEQ ID NO: 68960 - DNA, 20 bp, Artificial Sequence
  Description of Artificial Sequence: Synthetic oligonucleotide
  Target: SCN10A; (+) strand; PAM type: YTN; PAM sequence: CTG
tagcattactgagcagatgg

SEQ ID NO: 68961 - DNA, 20 bp, Artificial Sequence
  Description of Artificial Sequence: Synthetic oligonucleotide
  Target: SCN10A; (+) strand; PAM type: YTN; PAM sequence: TTA
ctgagcagatgggcacacag

SEQ ID NO: 68962 - DNA, 20 bp, Artificial Sequence
  Description of Artificial Sequence: Synthetic oligonucleotide
  Target: SCN10A; (+) strand; PAM type: YTN; PAM sequence: CTG
agcagatgggcacacagggg

SEQ ID NO: 68963 - DNA, 20 bp, Artificial Sequence
  Description of Artificial Sequence: Synthetic oligonucleotide
  Target: SCN10A; (+) strand; PAM type: YTN; PAM sequence: CTT
aactgaagttccagaggtgg

SEQ ID NO: 68964 - DNA, 20 bp, Artificial Sequence
  Description of Artificial Sequence: Synthetic oligonucleotide
  Target: SCN10A; (+) strand; PAM type: YTN; PAM sequence: TTA
actgaagttccagaggtggg

SEQ ID NO: 68965 - DNA, 20 bp, Artificial Sequence
  Description of Artificial Sequence: Synthetic oligonucleotide
  Target: SCN10A; (+) strand; PAM type: YTN; PAM sequence: CTG
aagttccagaggtgggaatg

SEQ ID NO: 68966 - DNA, 20 bp, Artificial Sequence
  Description of Artificial Sequence: Synthetic oligonucleotide
  Target: SCN10A; (+) strand; PAM type: YTN; PAM sequence: TTC
cagaggtgggaatggggtgg

SEQ ID NO: 68967 - DNA, 20 bp, Artificial Sequence
  Description of Artificial Sequence: Synthetic oligonucleotide
  Target: SCN10A; (+) strand; PAM type: YTN; PAM sequence: CTT
ggcagagccctgaggaatga

SEQ ID NO: 68968 - DNA, 20 bp, Artificial Sequence
  Description of Artificial Sequence: Synthetic oligonucleotide
  Target: SCN10A; (+) strand; PAM type: YTN; PAM sequence: TTG
gcagagccctgaggaatgag

SEQ ID NO: 68969 - DNA, 20 bp, Artificial Sequence
  Description of Artificial Sequence: Synthetic oligonucleotide
  Target: SCN10A; (+) strand; PAM type: YTN; PAM sequence: CTG
aggaatgagtgtgagttgag

SEQ ID NO: 68970 - DNA, 20 bp, Artificial Sequence
  Description of Artificial Sequence: Synthetic oligonucleotide
  Target: SCN10A; (+) strand; PAM type: YTN; PAM sequence: TTG
agtaaagagaggaggaagga

SEQ ID NO: 68971 - DNA, 20 bp, Artificial Sequence
  Description of Artificial Sequence: Synthetic oligonucleotide
  Target: SCN10A; (+) strand; PAM type: YTN; PAM sequence: CTG
ggaggtgagcaatggtgtgg

SEQ ID NO: 68972 - DNA, 20 bp, Artificial Sequence
  Description of Artificial Sequence: Synthetic oligonucleotide
  Target: SCN10A; (+) strand; PAM type: YTN; PAM sequence: TTT
gcagaaccgtaggtggattc

SEQ ID NO: 68973 - DNA, 20 bp, Artificial Sequence
  Description of Artificial Sequence: Synthetic oligonucleotide
  Target: SCN10A; (+) strand; PAM type: YTN; PAM sequence: TTG
cagaaccgtaggtggattcc

SEQ ID NO: 68974 - DNA, 20 bp, Artificial Sequence
  Description of Artificial Sequence: Synthetic oligonucleotide
  Target: SCN10A; (+) strand; PAM type: YTN; PAM sequence: TTC
cagagcatggtgagatgtga

SEQ ID NO: 68975 - DNA, 20 bp, Artificial Sequence
  Description of Artificial Sequence: Synthetic oligonucleotide
  Target: SCN10A; (+) strand; PAM type: YTN; PAM sequence: CTT
gcaaataagactcagggtct

SEQ ID NO: 68976 - DNA, 20 bp, Artificial Sequence
  Description of Artificial Sequence: Synthetic oligonucleotide
  Target: SCN10A; (+) strand; PAM type: YTN; PAM sequence: TTG
caaataagactcagggtctt

SEQ ID NO: 68977 - DNA, 20 bp, Artificial Sequence
  Description of Artificial Sequence: Synthetic oligonucleotide
  Target: SCN10A; (+) strand; PAM type: YTN; PAM sequence: CTC
agggtcttcccagttgagag

SEQ ID NO: 68978 - DNA, 20 bp, Artificial Sequence
  Description of Artificial Sequence: Synthetic oligonucleotide
  Target: SCN10A; (+) strand; PAM type: YTN; PAM sequence: CTT
cccagttgagagtaagtgag

SEQ ID NO: 68979 - DNA, 20 bp, Artificial Sequence
  Description of Artificial Sequence: Synthetic oligonucleotide
  Target: SCN10A; (+) strand; PAM type: YTN; PAM sequence: TTC
ccagttgagagtaagtgaga

SEQ ID NO: 68980 - DNA, 20 bp, Artificial Sequence
  Description of Artificial Sequence: Synthetic oligonucleotide
  Target: SCN10A; (+) strand; PAM type: YTN; PAM sequence: TTG
agagtaagtgagagagatat

SEQ ID NO: 68981 - DNA, 20 bp, Artificial Sequence
  Description of Artificial Sequence: Synthetic oligonucleotide
  Target: SCN10A; (+) strand; PAM type: YTN; PAM sequence: CTC
tcttcaagaggtgtgtccag

SEQ ID NO: 68982 - DNA, 20 bp, Artificial Sequence
  Description of Artificial Sequence: Synthetic oligonucleotide
  Target: SCN10A; (+) strand; PAM type: YTN; PAM sequence: CTC
ttcaagaggtgtgtccagtg

SEQ ID NO: 68983 - DNA, 20 bp, Artificial Sequence
  Description of Artificial Sequence: Synthetic oligonucleotide
  Target: SCN10A; (+) strand; PAM type: YTN; PAM sequence: CTT
caagaggtgtgtccagtggg

SEQ ID NO: 68984 - DNA, 20 bp, Artificial Sequence
  Description of Artificial Sequence: Synthetic oligonucleotide
  Target: SCN10A; (+) strand; PAM type: YTN; PAM sequence: TTC
aagaggtgtgtccagtggga

SEQ ID NO: 68985 - DNA, 20 bp, Artificial Sequence
  Description of Artificial Sequence: Synthetic oligonucleotide
  Target: SCN10A; (+) strand; PAM type: YTN; PAM sequence: TTG
gcagagagtttcctatcttt

SEQ ID NO: 68986 - DNA, 20 bp, Artificial Sequence
  Description of Artificial Sequence: Synthetic oligonucleotide
  Target: SCN10A; (+) strand; PAM type: YTN; PAM sequence: TTT
cctatctttccctgcagagc

SEQ ID NO: 68987 - DNA, 20 bp, Artificial Sequence
  Description of Artificial Sequence: Synthetic oligonucleotide
  Target: SCN10A; (+) strand; PAM type: YTN; PAM sequence: TTC
ctatctttccctgcagagcc

SEQ ID NO: 68988 - DNA, 20 bp, Artificial Sequence
  Description of Artificial Sequence: Synthetic oligonucleotide
  Target: SCN10A; (+) strand; PAM type: YTN; PAM sequence: CTA
tctttccctgcagagccaga

SEQ ID NO: 68989 - DNA, 20 bp, Artificial Sequence
  Description of Artificial Sequence: Synthetic oligonucleotide
  Target: SCN10A; (+) strand; PAM type: YTN; PAM sequence: CTT
tccctgcagagccagacaag

SEQ ID NO: 68990 - DNA, 20 bp, Artificial Sequence
  Description of Artificial Sequence: Synthetic oligonucleotide
  Target: SCN10A; (+) strand; PAM type: YTN; PAM sequence: TTT
ccctgcagagccagacaaga

SEQ ID NO: 68991 - DNA, 20 bp, Artificial Sequence
  Description of Artificial Sequence: Synthetic oligonucleotide
  Target: SCN10A; (+) strand; PAM type: YTN; PAM sequence: TTC
cctgcagagccagacaagaa

SEQ ID NO: 68992 - DNA, 20 bp, Artificial Sequence
  Description of Artificial Sequence: Synthetic oligonucleotide
  Target: SCN10A; (+) strand; PAM type: YTN; PAM sequence: CTG
cagagccagacaagaaatgg

SEQ ID NO: 68993 - DNA, 20 bp, Artificial Sequence
  Description of Artificial Sequence: Synthetic oligonucleotide
  Target: SCN10A; (+) strand; PAM type: YTN; PAM sequence: CTT
ccactctagaatgggtgttt

SEQ ID NO: 68994 - DNA, 20 bp, Artificial Sequence
  Description of Artificial Sequence: Synthetic oligonucleotide
  Target: SCN10A; (+) strand; PAM type: YTN; PAM sequence: TTC
cactctagaatgggtgtttc

SEQ ID NO: 68995 - DNA, 20 bp, Artificial Sequence
  Description of Artificial Sequence: Synthetic oligonucleotide
  Target: SCN10A; (+) strand; PAM type: YTN; PAM sequence: CTC
tagaatgggtgtttctgttt

SEQ ID NO: 68996 - DNA, 20 bp, Artificial Sequence
  Description of Artificial Sequence: Synthetic oligonucleotide
  Target: SCN10A; (+) strand; PAM type: YTN; PAM sequence: CTA
gaatgggtgtttctgtttac

SEQ ID NO: 68997 - DNA, 20 bp, Artificial Sequence
  Description of Artificial Sequence: Synthetic oligonucleotide
  Target: SCN10A; (+) strand; PAM type: YTN; PAM sequence: TTT
ctgtttacagataagagaac

SEQ ID NO: 68998 - DNA, 20 bp, Artificial Sequence
  Description of Artificial Sequence: Synthetic oligonucleotide
  Target: SCN10A; (+) strand; PAM type: YTN; PAM sequence: TTC
tgtttacagataagagaacg

SEQ ID NO: 68999 - DNA, 20 bp, Artificial Sequence
  Description of Artificial Sequence: Synthetic oligonucleotide
  Target: SCN10A; (+) strand; PAM type: YTN; PAM sequence: CTG
tttacagataagagaacgaa

SEQ ID NO: 69000 - DNA, 20 bp, Artificial Sequence
  Description of Artificial Sequence: Synthetic oligonucleotide
  Target: SCN10A; (+) strand; PAM type: YTN; PAM sequence: TTT
acagataagagaacgaattc

SEQ ID NO: 69001 - DNA, 20 bp, Artificial Sequence
  Description of Artificial Sequence: Synthetic oligonucleotide
  Target: SCN10A; (+) strand; PAM type: YTN; PAM sequence: TTA
cagataagagaacgaattct

SEQ ID NO: 69002 - DNA, 20 bp, Artificial Sequence
  Description of Artificial Sequence: Synthetic oligonucleotide
  Target: SCN10A; (+) strand; PAM type: YTN; PAM sequence: TTC
ttggggtgagaggagagaac

SEQ ID NO: 69003 - DNA, 20 bp, Artificial Sequence
  Description of Artificial Sequence: Synthetic oligonucleotide
  Target: SCN10A; (+) strand; PAM type: YTN; PAM sequence: CTT
ggggtgagaggagagaacct

SEQ ID NO: 69004 - DNA, 20 bp, Artificial Sequence
  Description of Artificial Sequence: Synthetic oligonucleotide
  Target: SCN10A; (+) strand; PAM type: YTN; PAM sequence: TTG
gggtgagaggagagaaccta

SEQ ID NO: 69005 - DNA, 20 bp, Artificial Sequence
  Description of Artificial Sequence: Synthetic oligonucleotide
  Target: SCN10A; (+) strand; PAM type: YTN; PAM sequence: CTA
tcaggccacagaggggaagc

SEQ ID NO: 69006 - DNA, 20 bp, Artificial Sequence
  Description of Artificial Sequence: Synthetic oligonucleotide
  Target: SCN10A; (+) strand; PAM type: YTN; PAM sequence: TTT
cagaaagtttgccttgtctc

SEQ ID NO: 69007 - DNA, 20 bp, Artificial Sequence
  Description of Artificial Sequence: Synthetic oligonucleotide
  Target: SCN10A; (+) strand; PAM type: YTN; PAM sequence: TTC
agaaagtttgccttgtctct

SEQ ID NO: 69008 - DNA, 20 bp, Artificial Sequence
  Description of Artificial Sequence: Synthetic oligonucleotide
  Target: SCN10A; (+) strand; PAM type: YTN; PAM sequence: TTT
gccttgtctctggcctcccc

SEQ ID NO: 69009 - DNA, 20 bp, Artificial Sequence
  Description of Artificial Sequence: Synthetic oligonucleotide
  Target: SCN10A; (+) strand; PAM type: YTN; PAM sequence: TTG
ccttgtctctggcctcccca

SEQ ID NO: 69010 - DNA, 20 bp, Artificial Sequence
  Description of Artificial Sequence: Synthetic oligonucleotide
  Target: SCN10A; (+) strand; PAM type: YTN; PAM sequence: CTT
gtctctggcctccccatcct

SEQ ID NO: 69011 - DNA, 20 bp, Artificial Sequence
  Description of Artificial Sequence: Synthetic oligonucleotide
  Target: SCN10A; (+) strand; PAM type: YTN; PAM sequence: TTG
tctctggcctccccatcctc

SEQ ID NO: 69012 - DNA, 20 bp, Artificial Sequence
  Description of Artificial Sequence: Synthetic oligonucleotide
  Target: SCN10A; (+) strand; PAM type: YTN; PAM sequence: CTC
tggcctccccatcctcacca

SEQ ID NO: 69013 - DNA, 20 bp, Artificial Sequence
  Description of Artificial Sequence: Synthetic oligonucleotide
  Target: SCN10A; (+) strand; PAM type: YTN; PAM sequence: CTG
gcctccccatcctcaccatc

SEQ ID NO: 69014 - DNA, 20 bp, Artificial Sequence
  Description of Artificial Sequence: Synthetic oligonucleotide
  Target: SCN10A; (+) strand; PAM type: YTN; PAM sequence: CTC
cccatcctcaccatcaacct

SEQ ID NO: 69015 - DNA, 20 bp, Artificial Sequence
  Description of Artificial Sequence: Synthetic oligonucleotide
  Target: SCN10A; (+) strand; PAM type: YTN; PAM sequence: CTC
accatcaacctcatgggggc

SEQ ID NO: 69016 - DNA, 20 bp, Artificial Sequence
  Description of Artificial Sequence: Synthetic oligonucleotide
  Target: SCN10A; (+) strand; PAM type: YTN; PAM sequence: CTC
atgggggctgaagagtagtc

SEQ ID NO: 69017 - DNA, 20 bp, Artificial Sequence
  Description of Artificial Sequence: Synthetic oligonucleotide
  Target: SCN10A; (+) strand; PAM type: YTN; PAM sequence: CTG
aagagtagtcgctgggctac

SEQ ID NO: 69018 - DNA, 20 bp, Artificial Sequence
  Description of Artificial Sequence: Synthetic oligonucleotide
  Target: SCN10A; (+) strand; PAM type: YTN; PAM sequence: CTG
ggctactggtgacagtggag

SEQ ID NO: 69019 - DNA, 20 bp, Artificial Sequence
  Description of Artificial Sequence: Synthetic oligonucleotide
  Target: SCN10A; (+) strand; PAM type: YTN; PAM sequence: CTA
ctggtgacagtggagatctt

SEQ ID NO: 69020 - DNA, 20 bp, Artificial Sequence
  Description of Artificial Sequence: Synthetic oligonucleotide
  Target: SCN10A; (+) strand; PAM type: YTN; PAM sequence: CTG
gtgacagtggagatcttaga

SEQ ID NO: 69021 - DNA, 20 bp, Artificial Sequence
  Description of Artificial Sequence: Synthetic oligonucleotide
  Target: SCN10A; (+) strand; PAM type: YTN; PAM sequence: CTT
agaggccccacacaatgagc

SEQ ID NO: 69022 - DNA, 20 bp, Artificial Sequence
  Description of Artificial Sequence: Synthetic oligonucleotide
  Target: SCN10A; (+) strand; PAM type: YTN; PAM sequence: TTA
gaggccccacacaatgagct

SEQ ID NO: 69023 - DNA, 20 bp, Artificial Sequence
  Description of Artificial Sequence: Synthetic oligonucleotide
  Target: SCN10A; (+) strand; PAM type: YTN; PAM sequence: CTT
tgatggactacttttgtttc

SEQ ID NO: 69024 - DNA, 20 bp, Artificial Sequence
  Description of Artificial Sequence: Synthetic oligonucleotide
  Target: SCN10A; (+) strand; PAM type: YTN; PAM sequence: TTT
gatggactacttttgtttct

SEQ ID NO: 69025 - DNA, 20 bp, Artificial Sequence
  Description of Artificial Sequence: Synthetic oligonucleotide
  Target: SCN10A; (+) strand; PAM type: YTN; PAM sequence: TTG
atggactacttttgtttctg

SEQ ID NO: 69026 - DNA, 20 bp, Artificial Sequence
  Description of Artificial Sequence: Synthetic oligonucleotide
  Target: SCN10A; (+) strand; PAM type: YTN; PAM sequence: CTA
cttttgtttctgaattctca

SEQ ID NO: 69027 - DNA, 20 bp, Artificial Sequence
  Description of Artificial Sequence: Synthetic oligonucleotide
  Target: SCN10A; (+) strand; PAM type: YTN; PAM sequence: CTT
ttgtttctgaattctcagta

SEQ ID NO: 69028 - DNA, 20 bp, Artificial Sequence
  Description of Artificial Sequence: Synthetic oligonucleotide
  Target: SCN10A; (+) strand; PAM type: YTN; PAM sequence: TTT
tgtttctgaattctcagtaa

SEQ ID NO: 69029 - DNA, 20 bp, Artificial Sequence
  Description of Artificial Sequence: Synthetic oligonucleotide
  Target: SCN10A; (+) strand; PAM type: YTN; PAM sequence: TTT
gtttctgaattctcagtaat

SEQ ID NO: 69030 - DNA, 20 bp, Artificial Sequence
  Description of Artificial Sequence: Synthetic oligonucleotide
  Target: SCN10A; (+) strand; PAM type: YTN; PAM sequence: TTG
tttctgaattctcagtaatc

SEQ ID NO: 69031 - DNA, 20 bp, Artificial Sequence
  Description of Artificial Sequence: Synthetic oligonucleotide
  Target: SCN10A; (+) strand; PAM type: YTN; PAM sequence: TTT
ctgaattctcagtaatcaag

SEQ ID NO: 69032 - DNA, 20 bp, Artificial Sequence
  Description of Artificial Sequence: Synthetic oligonucleotide
  Target: SCN10A; (+) strand; PAM type: YTN; PAM sequence: TTC
tgaattctcagtaatcaaga

SEQ ID NO: 69033 - DNA, 20 bp, Artificial Sequence
  Description of Artificial Sequence: Synthetic oligonucleotide
  Target: SCN10A; (+) strand; PAM type: YTN; PAM sequence: CTG
aattctcagtaatcaagaat

SEQ ID NO: 69034 - DNA, 20 bp, Artificial Sequence
  Description of Artificial Sequence: Synthetic oligonucleotide
  Target: SCN10A; (+) strand; PAM type: YTN; PAM sequence: TTC
tcagtaatcaagaattgcct

SEQ ID NO: 69035 - DNA, 20 bp, Artificial Sequence
  Description of Artificial Sequence: Synthetic oligonucleotide
  Target: SCN10A; (+) strand; PAM type: YTN; PAM sequence: CTC
agtaatcaagaattgcctaa

SEQ ID NO: 69036 - DNA, 20 bp, Artificial Sequence
  Description of Artificial Sequence: Synthetic oligonucleotide
  Target: SCN10A; (+) strand; PAM type: YTN; PAM sequence: TTG
cctaattcttttttcctctg

SEQ ID NO: 69037 - DNA, 20 bp, Artificial Sequence
  Description of Artificial Sequence: Synthetic oligonucleotide
  Target: SCN10A; (+) strand; PAM type: YTN; PAM sequence: CTA
attcttttttcctctgggtg

SEQ ID NO: 69038 - DNA, 20 bp, Artificial Sequence
  Description of Artificial Sequence: Synthetic oligonucleotide
  Target: SCN10A; (+) strand; PAM type: YTN; PAM sequence: TTC
ttttttcctctgggtgtcta

SEQ ID NO: 69039 - DNA, 20 bp, Artificial Sequence
  Description of Artificial Sequence: Synthetic oligonucleotide
  Target: SCN10A; (+) strand; PAM type: YTN; PAM sequence: CTT
ttttcctctgggtgtctaaa

SEQ ID NO: 69040 - DNA, 20 bp, Artificial Sequence
  Description of Artificial Sequence: Synthetic oligonucleotide
  Target: SCN10A; (+) strand; PAM type: YTN; PAM sequence: TTT
tttcctctgggtgtctaaag

SEQ ID NO: 69041 - DNA, 20 bp, Artificial Sequence
  Description of Artificial Sequence: Synthetic oligonucleotide
  Target: SCN10A; (+) strand; PAM type: YTN; PAM sequence: TTT
ttcctctgggtgtctaaaga

SEQ ID NO: 69042 - DNA, 20 bp, Artificial Sequence
  Description of Artificial Sequence: Synthetic oligonucleotide
  Target: SCN10A; (+) strand; PAM type: YTN; PAM sequence: TTT
tcctctgggtgtctaaagac

SEQ ID NO: 69043 - DNA, 20 bp, Artificial Sequence
  Description of Artificial Sequence: Synthetic oligonucleotide
  Target: SCN10A; (+) strand; PAM type: YTN; PAM sequence: TTT
cctctgggtgtctaaagaca

SEQ ID NO: 69044 - DNA, 20 bp, Artificial Sequence
  Description of Artificial Sequence: Synthetic oligonucleotide
  Target: SCN10A; (+) strand; PAM type: YTN; PAM sequence: TTC
ctctgggtgtctaaagacag

SEQ ID NO: 69045 - DNA, 20 bp, Artificial Sequence
  Description of Artificial Sequence: Synthetic oligonucleotide
  Target: SCN10A; (+) strand; PAM type: YTN; PAM sequence: CTC
tgggtgtctaaagacaggat

SEQ ID NO: 69046 - DNA, 20 bp, Artificial Sequence
  Description of Artificial Sequence: Synthetic oligonucleotide
  Target: SCN10A; (+) strand; PAM type: YTN; PAM sequence: CTG
ggtgtctaaagacaggattt

SEQ ID NO: 69047 - DNA, 20 bp, Artificial Sequence
  Description of Artificial Sequence: Synthetic oligonucleotide
  Target: SCN10A; (+) strand; PAM type: YTN; PAM sequence: CTA
aagacaggattttagaccta

SEQ ID NO: 69048 - DNA, 20 bp, Artificial Sequence
  Description of Artificial Sequence: Synthetic oligonucleotide
  Target: SCN10A; (+) strand; PAM type: YTN; PAM sequence: TTT
tagacctacggaaacagtga

SEQ ID NO: 69049 - DNA, 20 bp, Artificial Sequence
  Description of Artificial Sequence: Synthetic oligonucleotide
  Target: SCN10A; (+) strand; PAM type: YTN; PAM sequence: TTT
agacctacggaaacagtgaa

SEQ ID NO: 69050 - DNA, 20 bp, Artificial Sequence
  Description of Artificial Sequence: Synthetic oligonucleotide
  Target: SCN10A; (+) strand; PAM type: YTN; PAM sequence: TTA
gacctacggaaacagtgaag

SEQ ID NO: 69051 - DNA, 20 bp, Artificial Sequence
  Description of Artificial Sequence: Synthetic oligonucleotide
  Target: SCN10A; (+) strand; PAM type: YTN; PAM sequence: CTA
cggaaacagtgaagatactg

SEQ ID NO: 69052 - DNA, 20 bp, Artificial Sequence
  Description of Artificial Sequence: Synthetic oligonucleotide
  Target: SCN10A; (+) strand; PAM type: YTN; PAM sequence: CTG
ggactgctttctcccttcct

SEQ ID NO: 69053 - DNA, 20 bp, Artificial Sequence
  Description of Artificial Sequence: Synthetic oligonucleotide
  Target: SCN10A; (+) strand; PAM type: YTN; PAM sequence: CTG
ctttctcccttcctccccat

SEQ ID NO: 69054 - DNA, 20 bp, Artificial Sequence
  Description of Artificial Sequence: Synthetic oligonucleotide
  Target: SCN10A; (+) strand; PAM type: YTN; PAM sequence: CTT
tctcccttcctccccatttc

SEQ ID NO: 69055 - DNA, 20 bp, Artificial Sequence
  Description of Artificial Sequence: Synthetic oligonucleotide
  Target: SCN10A; (+) strand; PAM type: YTN; PAM sequence: TTT
ctcccttcctccccatttcc

SEQ ID NO: 69056 - DNA, 20 bp, Artificial Sequence
  Description of Artificial Sequence: Synthetic oligonucleotide
  Target: SCN10A; (+) strand; PAM type: YTN; PAM sequence: TTC
tcccttcctccccatttcca

SEQ ID NO: 69057 - DNA, 20 bp, Artificial Sequence
  Description of Artificial Sequence: Synthetic oligonucleotide
  Target: SCN10A; (+) strand; PAM type: YTN; PAM sequence: CTC
ccttcctccccatttccaag

SEQ ID NO: 69058 - DNA, 20 bp, Artificial Sequence
  Description of Artificial Sequence: Synthetic oligonucleotide
  Target: SCN10A; (+) strand; PAM type: YTN; PAM sequence: CTT
cctccccatttccaagttta

SEQ ID NO: 69059 - DNA, 20 bp, Artificial Sequence
  Description of Artificial Sequence: Synthetic oligonucleotide
  Target: SCN10A; (+) strand; PAM type: YTN; PAM sequence: TTC
ctccccatttccaagtttaa

SEQ ID NO: 69060 - DNA, 20 bp, Artificial Sequence
  Description of Artificial Sequence: Synthetic oligonucleotide
  Target: SCN10A; (+) strand; PAM type: YTN; PAM sequence: CTC
cccatttccaagtttaatcc

SEQ ID NO: 69061 - DNA, 20 bp, Artificial Sequence
  Description of Artificial Sequence: Synthetic oligonucleotide
  Target: SCN10A; (+) strand; PAM type: YTN; PAM sequence: TTT
ccaagtttaatcctttagtt

SEQ ID NO: 69062 - DNA, 20 bp, Artificial Sequence
  Description of Artificial Sequence: Synthetic oligonucleotide
  Target: SCN10A; (+) strand; PAM type: YTN; PAM sequence: TTC
caagtttaatcctttagttt

SEQ ID NO: 69063 - DNA, 20 bp, Artificial Sequence
  Description of Artificial Sequence: Synthetic oligonucleotide
  Target: SCN10A; (+) strand; PAM type: YTN; PAM sequence: TTT
aatcctttagtttaaggtat

SEQ ID NO: 69064 - DNA, 20 bp, Artificial Sequence
  Description of Artificial Sequence: Synthetic oligonucleotide
  Target: SCN10A; (+) strand; PAM type: YTN; PAM sequence: TTA
atcctttagtttaaggtata

SEQ ID NO: 69065 - DNA, 20 bp, Artificial Sequence
  Description of Artificial Sequence: Synthetic oligonucleotide
  Target: SCN10A; (+) strand; PAM type: YTN; PAM sequence: CTT
tagtttaaggtataaataaa

SEQ ID NO: 69066 - DNA, 20 bp, Artificial Sequence
  Description of Artificial Sequence: Synthetic oligonucleotide
  Target: SCN10A; (+) strand; PAM type: YTN; PAM sequence: TTT
agtttaaggtataaataaaa

SEQ ID NO: 69067 - DNA, 20 bp, Artificial Sequence
  Description of Artificial Sequence: Synthetic oligonucleotide
  Target: SCN10A; (+) strand; PAM type: YTN; PAM sequence: TTA
gtttaaggtataaataaaaa

SEQ ID NO: 69068 - DNA, 20 bp, Artificial Sequence
  Description of Artificial Sequence: Synthetic oligonucleotide
  Target: SCN10A; (+) strand; PAM type: YTN; PAM sequence: TTT
aaggtataaataaaaattca

SEQ ID NO: 69069 - DNA, 20 bp, Artificial Sequence
  Description of Artificial Sequence: Synthetic oligonucleotide
  Target: SCN10A; (+) strand; PAM type: YTN; PAM sequence: TTA
aggtataaataaaaattcaa

SEQ ID NO: 69070 - DNA, 20 bp, Artificial Sequence
  Description of Artificial Sequence: Synthetic oligonucleotide
  Target: SCN10A; (+) strand; PAM type: YTN; PAM sequence: TTC
aactgaggggtcttgcctga

SEQ ID NO: 69071 - DNA, 20 bp, Artificial Sequence
  Description of Artificial Sequence: Synthetic oligonucleotide
  Target: SCN10A; (+) strand; PAM type: YTN; PAM sequence: CTG
aggggtcttgcctgaatccc

SEQ ID NO: 69072 - DNA, 20 bp, Artificial Sequence
  Description of Artificial Sequence: Synthetic oligonucleotide
  Target: SCN10A; (+) strand; PAM type: YTN; PAM sequence: CTT
gcctgaatcccacaaccaga

SEQ ID NO: 69073 - DNA, 20 bp, Artificial Sequence
  Description of Artificial Sequence: Synthetic oligonucleotide
  Target: SCN10A; (+) strand; PAM type: YTN; PAM sequence: TTG
cctgaatcccacaaccagaa

SEQ ID NO: 69074 - DNA, 20 bp, Artificial Sequence
  Description of Artificial Sequence: Synthetic oligonucleotide
  Target: SCN10A; (+) strand; PAM type: YTN; PAM sequence: CTG
aatcccacaaccagaacaga

SEQ ID NO: 69075 - DNA, 20 bp, Artificial Sequence
  Description of Artificial Sequence: Synthetic oligonucleotide
  Target: SCN10A; (+) strand; PAM type: YTN; PAM sequence: CTC
ctgttacgtattgattgtga

SEQ ID NO: 69076 - DNA, 20 bp, Artificial Sequence
  Description of Artificial Sequence: Synthetic oligonucleotide
  Target: SCN10A; (+) strand; PAM type: YTN; PAM sequence: CTG
ttacgtattgattgtgaggc

SEQ ID NO: 69077 - DNA, 20 bp, Artificial Sequence
  Description of Artificial Sequence: Synthetic oligonucleotide
  Target: SCN10A; (+) strand; PAM type: YTN; PAM sequence: TTA
cgtattgattgtgaggccat

SEQ ID NO: 69078 - DNA, 20 bp, Artificial Sequence
  Description of Artificial Sequence: Synthetic oligonucleotide
  Target: SCN10A; (+) strand; PAM type: YTN; PAM sequence: TTG
attgtgaggccatgtggtat

SEQ ID NO: 69079 - DNA, 20 bp, Artificial Sequence
  Description of Artificial Sequence: Synthetic oligonucleotide
  Target: SCN10A; (+) strand; PAM type: YTN; PAM sequence: TTG
tgaggccatgtggtatgtgg

SEQ ID NO: 69080 - DNA, 20 bp, Artificial Sequence
  Description of Artificial Sequence: Synthetic oligonucleotide
  Target: SCN10A; (+) strand; PAM type: YTN; PAM sequence: CTG
gcctaggagttgggacaata

SEQ ID NO: 69081 - DNA, 20 bp, Artificial Sequence
  Description of Artificial Sequence: Synthetic oligonucleotide
  Target: SCN10A; (+) strand; PAM type: YTN; PAM sequence: CTA
ggagttgggacaataggctt

SEQ ID NO: 69082 - DNA, 20 bp, Artificial Sequence
  Description of Artificial Sequence: Synthetic oligonucleotide
  Target: SCN10A; (+) strand; PAM type: YTN; PAM sequence: TTG
ggacaataggcttccaggtc

SEQ ID NO: 69083 - DNA, 20 bp, Artificial Sequence
  Description of Artificial Sequence: Synthetic oligonucleotide
  Target: SCN10A; (+) strand; PAM type: YTN; PAM sequence: CTT
ccaggtcacactgtctctta

SEQ ID NO: 69084 - DNA, 20 bp, Artificial Sequence
  Description of Artificial Sequence: Synthetic oligonucleotide
  Target: SCN10A; (+) strand; PAM type: YTN; PAM sequence: TTC
caggtcacactgtctcttac

SEQ ID NO: 69085 - DNA, 20 bp, Artificial Sequence
  Description of Artificial Sequence: Synthetic oligonucleotide
  Target: SCN10A; (+) strand; PAM type: YTN; PAM sequence: CTG
tctcttactagtgaagaggc

SEQ ID NO: 69086 - DNA, 20 bp, Artificial Sequence
  Description of Artificial Sequence: Synthetic oligonucleotide
  Target: SCN10A; (+) strand; PAM type: YTN; PAM sequence: CTC
ttactagtgaagaggccttg

SEQ ID NO: 69087 - DNA, 20 bp, Artificial Sequence
  Description of Artificial Sequence: Synthetic oligonucleotide
  Target: SCN10A; (+) strand; PAM type: YTN; PAM sequence: CTT
actagtgaagaggccttggg

SEQ ID NO: 69088 - DNA, 20 bp, Artificial Sequence
  Description of Artificial Sequence: Synthetic oligonucleotide
  Target: SCN10A; (+) strand; PAM type: YTN; PAM sequence: TTA
ctagtgaagaggccttgggt

SEQ ID NO: 69089 - DNA, 20 bp, Artificial Sequence
  Description of Artificial Sequence: Synthetic oligonucleotide
  Target: SCN10A; (+) strand; PAM type: YTN; PAM sequence: CTA
gtgaagaggccttgggttta

SEQ ID NO: 69090 - DNA, 20 bp, Artificial Sequence
  Description of Artificial Sequence: Synthetic oligonucleotide
  Target: SCN10A; (+) strand; PAM type: YTN; PAM sequence: CTT
gggtttatgtttcctatact

SEQ ID NO: 69091 - DNA, 20 bp, Artificial Sequence
  Description of Artificial Sequence: Synthetic oligonucleotide
  Target: SCN10A; (+) strand; PAM type: YTN; PAM sequence: TTG
ggtttatgtttcctatactc

SEQ ID NO: 69092 - DNA, 20 bp, Artificial Sequence
  Description of Artificial Sequence: Synthetic oligonucleotide
  Target: SCN10A; (+) strand; PAM type: YTN; PAM sequence: TTT
atgtttcctatactccaggc

SEQ ID NO: 69093 - DNA, 20 bp, Artificial Sequence
  Description of Artificial Sequence: Synthetic oligonucleotide
  Target: SCN10A; (+) strand; PAM type: YTN; PAM sequence: TTA
tgtttcctatactccaggcc

SEQ ID NO: 69094 - DNA, 20 bp, Artificial Sequence
  Description of Artificial Sequence: Synthetic oligonucleotide
  Target: SCN10A; (+) strand; PAM type: YTN; PAM sequence: TTT
cctatactccaggcctcagt

SEQ ID NO: 69095 - DNA, 20 bp, Artificial Sequence
  Description of Artificial Sequence: Synthetic oligonucleotide
  Target: SCN10A; (+) strand; PAM type: YTN; PAM sequence: TTC
ctatactccaggcctcagtt

SEQ ID NO: 69096 - DNA, 20 bp, Artificial Sequence
  Description of Artificial Sequence: Synthetic oligonucleotide
  Target: SCN10A; (+) strand; PAM type: YTN; PAM sequence: CTA
tactccaggcctcagttcct

SEQ ID NO: 69097 - DNA, 20 bp, Artificial Sequence
  Description of Artificial Sequence: Synthetic oligonucleotide
  Target: SCN10A; (+) strand; PAM type: YTN; PAM sequence: CTC
caggcctcagttcctttgtc

SEQ ID NO: 69098 - DNA, 20 bp, Artificial Sequence
  Description of Artificial Sequence: Synthetic oligonucleotide
  Target: SCN10A; (+) strand; PAM type: YTN; PAM sequence: CTC
agttcctttgtcttgtaagt

SEQ ID NO: 69099 - DNA, 20 bp, Artificial Sequence
  Description of Artificial Sequence: Synthetic oligonucleotide
  Target: SCN10A; (+) strand; PAM type: YTN; PAM sequence: TTC
ctttgtcttgtaagtgggga

SEQ ID NO: 69100 - DNA, 20 bp, Artificial Sequence
  Description of Artificial Sequence: Synthetic oligonucleotide
  Target: SCN10A; (+) strand; PAM type: YTN; PAM sequence: CTT
tgtcttgtaagtggggacaa

SEQ ID NO: 69101 - DNA, 20 bp, Artificial Sequence
  Description of Artificial Sequence: Synthetic oligonucleotide
  Target: SCN10A; (+) strand; PAM type: YTN; PAM sequence: TTT
gtcttgtaagtggggacaat

SEQ ID NO: 69102 - DNA, 20 bp, Artificial Sequence
  Description of Artificial Sequence: Synthetic oligonucleotide
  Target: SCN10A; (+) strand; PAM type: YTN; PAM sequence: TTG
tcttgtaagtggggacaata

SEQ ID NO: 69103 - DNA, 20 bp, Artificial Sequence
  Description of Artificial Sequence: Synthetic oligonucleotide
  Target: SCN10A; (+) strand; PAM type: YTN; PAM sequence: CTT
gtaagtggggacaatagtct

SEQ ID NO: 69104 - DNA, 20 bp, Artificial Sequence
  Description of Artificial Sequence: Synthetic oligonucleotide
  Target: SCN10A; (+) strand; PAM type: YTN; PAM sequence: TTG
taagtggggacaatagtctt

SEQ ID NO: 69105 - DNA, 20 bp, Artificial Sequence
  Description of Artificial Sequence: Synthetic oligonucleotide
  Target: SCN10A; (+) strand; PAM type: YTN; PAM sequence: CTT
tgccctggaaccttacaggg

SEQ ID NO: 69106 - DNA, 20 bp, Artificial Sequence
  Description of Artificial Sequence: Synthetic oligonucleotide
  Target: SCN10A; (+) strand; PAM type: YTN; PAM sequence: TTT
gccctggaaccttacagggt

SEQ ID NO: 69107 - DNA, 20 bp, Artificial Sequence
  Description of Artificial Sequence: Synthetic oligonucleotide
  Target: SCN10A; (+) strand; PAM type: YTN; PAM sequence: TTG
ccctggaaccttacagggtt

SEQ ID NO: 69108 - DNA, 20 bp, Artificial Sequence
  Description of Artificial Sequence: Synthetic oligonucleotide
  Target: SCN10A; (+) strand; PAM type: YTN; PAM sequence: CTG
gaaccttacagggttcttgt

SEQ ID NO: 69109 - DNA, 20 bp, Artificial Sequence
  Description of Artificial Sequence: Synthetic oligonucleotide
  Target: SCN10A; (+) strand; PAM type: YTN; PAM sequence: CTT
acagggttcttgtgaaaatt

SEQ ID NO: 69110 - DNA, 20 bp, Artificial Sequence
  Description of Artificial Sequence: Synthetic oligonucleotide
  Target: SCN10A; (+) strand; PAM type: YTN; PAM sequence: TTA
cagggttcttgtgaaaatta

SEQ ID NO: 69111 - DNA, 20 bp, Artificial Sequence
  Description of Artificial Sequence: Synthetic oligonucleotide
  Target: SCN10A; (+) strand; PAM type: YTN; PAM sequence: TTC
ttgtgaaaattagagaaggg

SEQ ID NO: 69112 - DNA, 20 bp, Artificial Sequence
  Description of Artificial Sequence: Synthetic oligonucleotide
  Target: SCN10A; (+) strand; PAM type: YTN; PAM sequence: CTT
gtgaaaattagagaagggag

SEQ ID NO: 69113 - DNA, 20 bp, Artificial Sequence
  Description of Artificial Sequence: Synthetic oligonucleotide
  Target: SCN10A; (+) strand; PAM type: YTN; PAM sequence: TTG
tgaaaattagagaagggagt

SEQ ID NO: 69114 - DNA, 20 bp, Artificial Sequence
  Description of Artificial Sequence: Synthetic oligonucleotide
  Target: SCN10A; (+) strand; PAM type: YTN; PAM sequence: TTA
gagaagggagttaggctgtg

SEQ ID NO: 69115 - DNA, 20 bp, Artificial Sequence
  Description of Artificial Sequence: Synthetic oligonucleotide
  Target: SCN10A; (+) strand; PAM type: YTN; PAM sequence: TTA
ggctgtgaaaaccaacatat

SEQ ID NO: 69116 - DNA, 20 bp, Artificial Sequence
  Description of Artificial Sequence: Synthetic oligonucleotide
  Target: SCN10A; (+) strand; PAM type: YTN; PAM sequence: CTG
tgaaaaccaacatatgctct

SEQ ID NO: 69117 - DNA, 20 bp, Artificial Sequence
  Description of Artificial Sequence: Synthetic oligonucleotide
  Target: SCN10A; (+) strand; PAM type: YTN; PAM sequence: CTC
tgtgaataaatgctcacctg

SEQ ID NO: 69118 - DNA, 20 bp, Artificial Sequence
  Description of Artificial Sequence: Synthetic oligonucleotide
  Target: SCN10A; (+) strand; PAM type: YTN; PAM sequence: CTG
tgaataaatgctcacctggg

SEQ ID NO: 69119 - DNA, 20 bp, Artificial Sequence
  Description of Artificial Sequence: Synthetic oligonucleotide
  Target: SCN10A; (+) strand; PAM type: YTN; PAM sequence: CTC
acctgggatcacagaaactg

SEQ ID NO: 69120 - DNA, 20 bp, Artificial Sequence
  Description of Artificial Sequence: Synthetic oligonucleotide
  Target: SCN10A; (+) strand; PAM type: YTN; PAM sequence: CTG
ggatcacagaaactgttttt

SEQ ID NO: 69121 - DNA, 20 bp, Artificial Sequence
  Description of Artificial Sequence: Synthetic oligonucleotide
  Target: SCN10A; (+) strand; PAM type: YTN; PAM sequence: CTG
tttttaatgctctaagaact

SEQ ID NO: 69122 - DNA, 20 bp, Artificial Sequence
  Description of Artificial Sequence: Synthetic oligonucleotide
  Target: SCN10A; (+) strand; PAM type: YTN; PAM sequence: TTT
ttaatgctctaagaactctg

SEQ ID NO: 69123 - DNA, 20 bp, Artificial Sequence
  Description of Artificial Sequence: Synthetic oligonucleotide
  Target: SCN10A; (+) strand; PAM type: YTN; PAM sequence: TTT
taatgctctaagaactctga

SEQ ID NO: 69124 - DNA, 20 bp, Artificial Sequence
  Description of Artificial Sequence: Synthetic oligonucleotide
  Target: SCN10A; (+) strand; PAM type: YTN; PAM sequence: TTT
aatgctctaagaactctgaa

SEQ ID NO: 69125 - DNA, 20 bp, Artificial Sequence
  Description of Artificial Sequence: Synthetic oligonucleotide
  Target: SCN10A; (+) strand; PAM type: YTN; PAM sequence: TTA
atgctctaagaactctgaat

SEQ ID NO: 69126 - DNA, 20 bp, Artificial Sequence
  Description of Artificial Sequence: Synthetic oligonucleotide
  Target: SCN10A; (+) strand; PAM type: YTN; PAM sequence: CTC
taagaactctgaatgtccgc

SEQ ID NO: 69127 - DNA, 20 bp, Artificial Sequence
  Description of Artificial Sequence: Synthetic oligonucleotide
  Target: SCN10A; (+) strand; PAM type: YTN; PAM sequence: CTA
agaactctgaatgtccgcag

SEQ ID NO: 69128 - DNA, 20 bp, Artificial Sequence
  Description of Artificial Sequence: Synthetic oligonucleotide
  Target: SCN10A; (+) strand; PAM type: YTN; PAM sequence: CTC
tgaatgtccgcaggcctgag

SEQ ID NO: 69129 - DNA, 20 bp, Artificial Sequence
  Description of Artificial Sequence: Synthetic oligonucleotide
  Target: SCN10A; (+) strand; PAM type: YTN; PAM sequence: CTG
aatgtccgcaggcctgagat

SEQ ID NO: 69130 - DNA, 20 bp, Artificial Sequence
  Description of Artificial Sequence: Synthetic oligonucleotide
  Target: SCN10A; (+) strand; PAM type: YTN; PAM sequence: CTG
agatcccacggagatctatt

SEQ ID NO: 69131 - DNA, 20 bp, Artificial Sequence
  Description of Artificial Sequence: Synthetic oligonucleotide
  Target: SCN10A; (+) strand; PAM type: YTN; PAM sequence: CTA
ttgctgtgccaacatatctg

SEQ ID NO: 69132 - DNA, 20 bp, Artificial Sequence
  Description of Artificial Sequence: Synthetic oligonucleotide
  Target: SCN10A; (+) strand; PAM type: YTN; PAM sequence: TTG
ctgtgccaacatatctgtag

SEQ ID NO: 69133 - DNA, 20 bp, Artificial Sequence
  Description of Artificial Sequence: Synthetic oligonucleotide
  Target: SCN10A; (+) strand; PAM type: YTN; PAM sequence: CTG
tgccaacatatctgtaggac

SEQ ID NO: 69134 - DNA, 20 bp, Artificial Sequence
  Description of Artificial Sequence: Synthetic oligonucleotide
  Target: SCN10A; (+) strand; PAM type: YTN; PAM sequence: CTG
taggaccagaagttagtcag

SEQ ID NO: 69135 - DNA, 20 bp, Artificial Sequence
  Description of Artificial Sequence: Synthetic oligonucleotide
  Target: SCN10A; (+) strand; PAM type: YTN; PAM sequence: TTA
gtcagcatctctgcaagcaa

SEQ ID NO: 69136 - DNA, 20 bp, Artificial Sequence
  Description of Artificial Sequence: Synthetic oligonucleotide
  Target: SCN10A; (+) strand; PAM type: YTN; PAM sequence: CTC
tgcaagcaagggtcctgggg

SEQ ID NO: 69137 - DNA, 20 bp, Artificial Sequence
  Description of Artificial Sequence: Synthetic oligonucleotide
  Target: SCN10A; (+) strand; PAM type: YTN; PAM sequence: CTG
caagcaagggtcctggggat

SEQ ID NO: 69138 - DNA, 20 bp, Artificial Sequence
  Description of Artificial Sequence: Synthetic oligonucleotide
  Target: SCN10A; (+) strand; PAM type: YTN; PAM sequence: CTG
gggatgcatgcagcataaat

SEQ ID NO: 69139 - DNA, 20 bp, Artificial Sequence
  Description of Artificial Sequence: Synthetic oligonucleotide
  Target: SCN10A; (+) strand; PAM type: YTN; PAM sequence: CTG
gggtatcattagcctagaaa

SEQ ID NO: 69140 - DNA, 20 bp, Artificial Sequence
  Description of Artificial Sequence: Synthetic oligonucleotide
  Target: SCN10A; (+) strand; PAM type: YTN; PAM sequence: TTA
gcctagaaaggatgcagaat

SEQ ID NO: 69141 - DNA, 20 bp, Artificial Sequence
  Description of Artificial Sequence: Synthetic oligonucleotide
  Target: SCN10A; (+) strand; PAM type: YTN; PAM sequence: CTA
gaaaggatgcagaatggaca

SEQ ID NO: 69142 - DNA, 20 bp, Artificial Sequence
  Description of Artificial Sequence: Synthetic oligonucleotide
  Target: SCN10A; (+) strand; PAM type: YTN; PAM sequence: CTT
agaatctagtgacactgcca

SEQ ID NO: 69143 - DNA, 20 bp, Artificial Sequence
  Description of Artificial Sequence: Synthetic oligonucleotide
  Target: SCN10A; (+) strand; PAM type: YTN; PAM sequence: TTA
gaatctagtgacactgccat

SEQ ID NO: 69144 - DNA, 20 bp, Artificial Sequence
  Description of Artificial Sequence: Synthetic oligonucleotide
  Target: SCN10A; (+) strand; PAM type: YTN; PAM sequence: CTA
gtgacactgccatctataga

SEQ ID NO: 69145 - DNA, 20 bp, Artificial Sequence
  Description of Artificial Sequence: Synthetic oligonucleotide
  Target: SCN10A; (+) strand; PAM type: YTN; PAM sequence: CTG
ccatctatagactgacactg

SEQ ID NO: 69146 - DNA, 20 bp, Artificial Sequence
  Description of Artificial Sequence: Synthetic oligonucleotide
  Target: SCN10A; (+) strand; PAM type: YTN; PAM sequence: CTA
tagactgacactgacactga

SEQ ID NO: 69147 - DNA, 20 bp, Artificial Sequence
  Description of Artificial Sequence: Synthetic oligonucleotide
  Target: SCN10A; (+) strand; PAM type: YTN; PAM sequence: CTG
acactgacactgatttcatt

SEQ ID NO: 69148 - DNA, 20 bp, Artificial Sequence
  Description of Artificial Sequence: Synthetic oligonucleotide
  Target: SCN10A; (+) strand; PAM type: YTN; PAM sequence: CTG
acactgatttcattattgca

SEQ ID NO: 69149 - DNA, 20 bp, Artificial Sequence
  Description of Artificial Sequence: Synthetic oligonucleotide
  Target: SCN10A; (+) strand; PAM type: YTN; PAM sequence: CTG
atttcattattgcaacatct

SEQ ID NO: 69150 - DNA, 20 bp, Artificial Sequence
  Description of Artificial Sequence: Synthetic oligonucleotide
  Target: SCN10A; (+) strand; PAM type: YTN; PAM sequence: TTT
cattattgcaacatctttca

SEQ ID NO: 69151 - DNA, 20 bp, Artificial Sequence
  Description of Artificial Sequence: Synthetic oligonucleotide
  Target: SCN10A; (+) strand; PAM type: YTN; PAM sequence: TTC
attattgcaacatctttcag

SEQ ID NO: 69152 - DNA, 20 bp, Artificial Sequence
  Description of Artificial Sequence: Synthetic oligonucleotide
  Target: SCN10A; (+) strand; PAM type: YTN; PAM sequence: TTA
ttgcaacatctttcagagtg

SEQ ID NO: 69153 - DNA, 20 bp, Artificial Sequence
  Description of Artificial Sequence: Synthetic oligonucleotide
  Target: SCN10A; (+) strand; PAM type: YTN; PAM sequence: TTG
caacatctttcagagtggac

SEQ ID NO: 69154 - DNA, 20 bp, Artificial Sequence
  Description of Artificial Sequence: Synthetic oligonucleotide
  Target: SCN10A; (+) strand; PAM type: YTN; PAM sequence: CTT
tcagagtggaccctttgaga

SEQ ID NO: 69155 - DNA, 20 bp, Artificial Sequence
  Description of Artificial Sequence: Synthetic oligonucleotide
  Target: SCN10A; (+) strand; PAM type: YTN; PAM sequence: TTT
cagagtggaccctttgagaa

SEQ ID NO: 69156 - DNA, 20 bp, Artificial Sequence
  Description of Artificial Sequence: Synthetic oligonucleotide
  Target: SCN10A; (+) strand; PAM type: YTN; PAM sequence: TTC
agagtggaccctttgagaag

SEQ ID NO: 69157 - DNA, 20 bp, Artificial Sequence
  Description of Artificial Sequence: Synthetic oligonucleotide
  Target: SCN10A; (+) strand; PAM type: YTN; PAM sequence: CTT
tgagaagatgcattgtgatc

SEQ ID NO: 69158 - DNA, 20 bp, Artificial Sequence
  Description of Artificial Sequence: Synthetic oligonucleotide
  Target: SCN10A; (+) strand; PAM type: YTN; PAM sequence: TTT
gagaagatgcattgtgatct

SEQ ID NO: 69159 - DNA, 20 bp, Artificial Sequence
  Description of Artificial Sequence: Synthetic oligonucleotide
  Target: SCN10A; (+) strand; PAM type: YTN; PAM sequence: TTG
agaagatgcattgtgatcta

SEQ ID NO: 69160 - DNA, 20 bp, Artificial Sequence
  Description of Artificial Sequence: Synthetic oligonucleotide
  Target: SCN10A; (+) strand; PAM type: YTN; PAM sequence: TTG
tgatctaggcaacactgcat

SEQ ID NO: 69161 - DNA, 20 bp, Artificial Sequence
  Description of Artificial Sequence: Synthetic oligonucleotide
  Target: SCN10A; (+) strand; PAM type: YTN; PAM sequence: CTA
ggcaacactgcatgtggacg

SEQ ID NO: 69162 - DNA, 20 bp, Artificial Sequence
  Description of Artificial Sequence: Synthetic oligonucleotide
  Target: SCN10A; (+) strand; PAM type: YTN; PAM sequence: CTG
catgtggacggatcttcaaa

SEQ ID NO: 69163 - DNA, 20 bp, Artificial Sequence
  Description of Artificial Sequence: Synthetic oligonucleotide
  Target: SCN10A; (+) strand; PAM type: YTN; PAM sequence: CTT
caaacacaggagtttgacca

SEQ ID NO: 69164 - DNA, 20 bp, Artificial Sequence
  Description of Artificial Sequence: Synthetic oligonucleotide
  Target: SCN10A; (+) strand; PAM type: YTN; PAM sequence: TTC
aaacacaggagtttgaccaa

SEQ ID NO: 69165 - DNA, 20 bp, Artificial Sequence
  Description of Artificial Sequence: Synthetic oligonucleotide
  Target: SCN10A; (+) strand; PAM type: YTN; PAM sequence: TTT
gaccaaccagtctcctcaga

SEQ ID NO: 69166 - DNA, 20 bp, Artificial Sequence
  Description of Artificial Sequence: Synthetic oligonucleotide
  Target: SCN10A; (+) strand; PAM type: YTN; PAM sequence: TTG
accaaccagtctcctcagac

SEQ ID NO: 69167 - DNA, 20 bp, Artificial Sequence
  Description of Artificial Sequence: Synthetic oligonucleotide
  Target: SCN10A; (+) strand; PAM type: YTN; PAM sequence: CTC
ctcagacactgatttctcag

SEQ ID NO: 69168 - DNA, 20 bp, Artificial Sequence
  Description of Artificial Sequence: Synthetic oligonucleotide
  Target: SCN10A; (+) strand; PAM type: YTN; PAM sequence: CTC
agacactgatttctcagaag

SEQ ID NO: 69169 - DNA, 20 bp, Artificial Sequence
  Description of Artificial Sequence: Synthetic oligonucleotide
  Target: SCN10A; (+) strand; PAM type: YTN; PAM sequence: CTG
atttctcagaaggagaccgc

SEQ ID NO: 69170 - DNA, 20 bp, Artificial Sequence
  Description of Artificial Sequence: Synthetic oligonucleotide
  Target: SCN10A; (+) strand; PAM type: YTN; PAM sequence: TTT
ctcagaaggagaccgccatg

SEQ ID NO: 69171 - DNA, 20 bp, Artificial Sequence
  Description of Artificial Sequence: Synthetic oligonucleotide
  Target: SCN10A; (+) strand; PAM type: YTN; PAM sequence: TTC
tcagaaggagaccgccatgt

SEQ ID NO: 69172 - DNA, 20 bp, Artificial Sequence
  Description of Artificial Sequence: Synthetic oligonucleotide
  Target: SCN10A; (+) strand; PAM type: YTN; PAM sequence: CTC
agaaggagaccgccatgtca

SEQ ID NO: 69173 - DNA, 20 bp, Artificial Sequence
  Description of Artificial Sequence: Synthetic oligonucleotide
  Target: SCN10A; (+) strand; PAM type: YTN; PAM sequence: CTG
ggccttttctgatccactgt

SEQ ID NO: 69174 - DNA, 20 bp, Artificial Sequence
  Description of Artificial Sequence: Synthetic oligonucleotide
  Target: SCN10A; (+) strand; PAM type: YTN; PAM sequence: CTT
ttctgatccactgtgacagg

SEQ ID NO: 69175 - DNA, 20 bp, Artificial Sequence
  Description of Artificial Sequence: Synthetic oligonucleotide
  Target: SCN10A; (+) strand; PAM type: YTN; PAM sequence: TTT
tctgatccactgtgacaggc

SEQ ID NO: 69176 - DNA, 20 bp, Artificial Sequence
  Description of Artificial Sequence: Synthetic oligonucleotide
  Target: SCN10A; (+) strand; PAM type: YTN; PAM sequence: TTT
ctgatccactgtgacaggct

SEQ ID NO: 69177 - DNA, 20 bp, Artificial Sequence
  Description of Artificial Sequence: Synthetic oligonucleotide
  Target: SCN10A; (+) strand; PAM type: YTN; PAM sequence: TTC
tgatccactgtgacaggcta

SEQ ID NO: 69178 - DNA, 20 bp, Artificial Sequence
  Description of Artificial Sequence: Synthetic oligonucleotide
  Target: SCN10A; (+) strand; PAM type: YTN; PAM sequence: CTG
atccactgtgacaggctaac

SEQ ID NO: 69179 - DNA, 20 bp, Artificial Sequence
  Description of Artificial Sequence: Synthetic oligonucleotide
  Target: SCN10A; (+) strand; PAM type: YTN; PAM sequence: CTG
tgacaggctaactgttatct

SEQ ID NO: 69180 - DNA, 20 bp, Artificial Sequence
  Description of Artificial Sequence: Synthetic oligonucleotide
  Target: SCN10A; (+) strand; PAM type: YTN; PAM sequence: CTA
actgttatctcagatttgag

SEQ ID NO: 69181 - DNA, 20 bp, Artificial Sequence
  Description of Artificial Sequence: Synthetic oligonucleotide
  Target: SCN10A; (+) strand; PAM type: YTN; PAM sequence: CTG
ttatctcagatttgaggtct

SEQ ID NO: 69182 - DNA, 20 bp, Artificial Sequence
  Description of Artificial Sequence: Synthetic oligonucleotide
  Target: SCN10A; (+) strand; PAM type: YTN; PAM sequence: TTA
tctcagatttgaggtctctg

SEQ ID NO: 69183 - DNA, 20 bp, Artificial Sequence
  Description of Artificial Sequence: Synthetic oligonucleotide
  Target: SCN10A; (+) strand; PAM type: YTN; PAM sequence: CTC
agatttgaggtctctgacat

SEQ ID NO: 69184 - DNA, 20 bp, Artificial Sequence
  Description of Artificial Sequence: Synthetic oligonucleotide
  Target: SCN10A; (+) strand; PAM type: YTN; PAM sequence: TTT
gaggtctctgacatctcctc

SEQ ID NO: 69185 - DNA, 20 bp, Artificial Sequence
  Description of Artificial Sequence: Synthetic oligonucleotide
  Target: SCN10A; (+) strand; PAM type: YTN; PAM sequence: TTG
aggtctctgacatctcctca

SEQ ID NO: 69186 - DNA, 20 bp, Artificial Sequence
  Description of Artificial Sequence: Synthetic oligonucleotide
  Target: SCN10A; (+) strand; PAM type: YTN; PAM sequence: CTC
tgacatctcctcatgggcat

SEQ ID NO: 69187 - DNA, 20 bp, Artificial Sequence
  Description of Artificial Sequence: Synthetic oligonucleotide
  Target: SCN10A; (+) strand; PAM type: YTN; PAM sequence: CTG
acatctcctcatgggcatgg

SEQ ID NO: 69188 - DNA, 20 bp, Artificial Sequence
  Description of Artificial Sequence: Synthetic oligonucleotide
  Target: SCN10A; (+) strand; PAM type: YTN; PAM sequence: CTC
ctcatgggcatgggactaat

SEQ ID NO: 69189 - DNA, 20 bp, Artificial Sequence
  Description of Artificial Sequence: Synthetic oligonucleotide
  Target: SCN10A; (+) strand; PAM type: YTN; PAM sequence: CTC
atgggcatgggactaatctt

SEQ ID NO: 69190 - DNA, 20 bp, Artificial Sequence
  Description of Artificial Sequence: Synthetic oligonucleotide
  Target: SCN10A; (+) strand; PAM type: YTN; PAM sequence: CTA
atcttggaaagcaacccccg

SEQ ID NO: 69191 - DNA, 20 bp, Artificial Sequence
  Description of Artificial Sequence: Synthetic oligonucleotide
  Target: SCN10A; (+) strand; PAM type: YTN; PAM sequence: CTT
ggaaagcaacccccgaagcg

SEQ ID NO: 69192 - DNA, 20 bp, Artificial Sequence
  Description of Artificial Sequence: Synthetic oligonucleotide
  Target: SCN10A; (+) strand; PAM type: YTN; PAM sequence: TTG
gaaagcaacccccgaagcgg

SEQ ID NO: 69193 - DNA, 20 bp, Artificial Sequence
  Description of Artificial Sequence: Synthetic oligonucleotide
  Target: SCN10A; (+) strand; PAM type: YTN; PAM sequence: CTC
tgtggcaagaaccccaggcc

SEQ ID NO: 69194 - DNA, 20 bp, Artificial Sequence
  Description of Artificial Sequence: Synthetic oligonucleotide
  Target: SCN10A; (+) strand; PAM type: YTN; PAM sequence: CTG
tggcaagaaccccaggccat

SEQ ID NO: 69195 - DNA, 20 bp, Artificial Sequence
  Description of Artificial Sequence: Synthetic oligonucleotide
  Target: SCN10A; (+) strand; PAM type: YTN; PAM sequence: TTC
caaatgaggaagctgaactg

SEQ ID NO: 69196 - DNA, 20 bp, Artificial Sequence
  Description of Artificial Sequence: Synthetic oligonucleotide
  Target: SCN10A; (+) strand; PAM type: YTN; PAM sequence: CTG
aactgagatgaagaaccttc

SEQ ID NO: 69197 - DNA, 20 bp, Artificial Sequence
  Description of Artificial Sequence: Synthetic oligonucleotide
  Target: SCN10A; (+) strand; PAM type: YTN; PAM sequence: CTG
agatgaagaaccttcttcag

SEQ ID NO: 69198 - DNA, 20 bp, Artificial Sequence
  Description of Artificial Sequence: Synthetic oligonucleotide
  Target: SCN10A; (+) strand; PAM type: YTN; PAM sequence: CTT
cttcagagtgtgagcctgga

SEQ ID NO: 69199 - DNA, 20 bp, Artificial Sequence
  Description of Artificial Sequence: Synthetic oligonucleotide
  Target: SCN10A; (+) strand; PAM type: YTN; PAM sequence: TTC
ttcagagtgtgagcctggat

SEQ ID NO: 69200 - DNA, 20 bp, Artificial Sequence
  Description of Artificial Sequence: Synthetic oligonucleotide
  Target: SCN10A; (+) strand; PAM type: YTN; PAM sequence: CTT
cagagtgtgagcctggatac

SEQ ID NO: 69201 - DNA, 20 bp, Artificial Sequence
  Description of Artificial Sequence: Synthetic oligonucleotide
  Target: SCN10A; (+) strand; PAM type: YTN; PAM sequence: TTC
agagtgtgagcctggataca

SEQ ID NO: 69202 - DNA, 20 bp, Artificial Sequence
  Description of Artificial Sequence: Synthetic oligonucleotide
  Target: SCN10A; (+) strand; PAM type: YTN; PAM sequence: CTG
gatacacccataagccccac

SEQ ID NO: 69203 - DNA, 20 bp, Artificial Sequence
  Description of Artificial Sequence: Synthetic oligonucleotide
  Target: SCN10A; (+) strand; PAM type: YTN; PAM sequence: CTT
tttattttattttatttcaa

SEQ ID NO: 69204 - DNA, 20 bp, Artificial Sequence
  Description of Artificial Sequence: Synthetic oligonucleotide
  Target: SCN10A; (+) strand; PAM type: YTN; PAM sequence: TTT
ttattttattttatttcaat

SEQ ID NO: 69205 - DNA, 20 bp, Artificial Sequence
  Description of Artificial Sequence: Synthetic oligonucleotide
  Target: SCN10A; (+) strand; PAM type: YTN; PAM sequence: TTT
tattttattttatttcaata

SEQ ID NO: 69206 - DNA, 20 bp, Artificial Sequence
  Description of Artificial Sequence: Synthetic oligonucleotide
  Target: SCN10A; (+) strand; PAM type: YTN; PAM sequence: TTT
attttattttatttcaatag

SEQ ID NO: 69207 - DNA, 20 bp, Artificial Sequence
  Description of Artificial Sequence: Synthetic oligonucleotide
  Target: SCN10A; (+) strand; PAM type: YTN; PAM sequence: TTA
ttttattttatttcaatagt

SEQ ID NO: 69208 - DNA, 20 bp, Artificial Sequence
  Description of Artificial Sequence: Synthetic oligonucleotide
  Target: SCN10A; (+) strand; PAM type: YTN; PAM sequence: TTT
tattttatttcaatagtttt

SEQ ID NO: 69209 - DNA, 20 bp, Artificial Sequence
  Description of Artificial Sequence: Synthetic oligonucleotide
  Target: SCN10A; (+) strand; PAM type: YTN; PAM sequence: TTT
attttatttcaatagttttg

SEQ ID NO: 69210 - DNA, 20 bp, Artificial Sequence
  Description of Artificial Sequence: Synthetic oligonucleotide
  Target: SCN10A; (+) strand; PAM type: YTN; PAM sequence: TTA
ttttatttcaatagttttga

SEQ ID NO: 69211 - DNA, 20 bp, Artificial Sequence
  Description of Artificial Sequence: Synthetic oligonucleotide
  Target: SCN10A; (+) strand; PAM type: YTN; PAM sequence: TTT
tatttcaatagttttgaggg

SEQ ID NO: 69212 - DNA, 20 bp, Artificial Sequence
  Description of Artificial Sequence: Synthetic oligonucleotide
  Target: SCN10A; (+) strand; PAM type: YTN; PAM sequence: TTT
atttcaatagttttgaggga

SEQ ID NO: 69213 - DNA, 20 bp, Artificial Sequence
  Description of Artificial Sequence: Synthetic oligonucleotide
  Target: SCN10A; (+) strand; PAM type: YTN; PAM sequence: TTA
tttcaatagttttgagggaa

SEQ ID NO: 69214 - DNA, 20 bp, Artificial Sequence
  Description of Artificial Sequence: Synthetic oligonucleotide
  Target: SCN10A; (+) strand; PAM type: YTN; PAM sequence: TTT
caatagttttgagggaacag

SEQ ID NO: 69215 - DNA, 20 bp, Artificial Sequence
  Description of Artificial Sequence: Synthetic oligonucleotide
  Target: SCN10A; (+) strand; PAM type: YTN; PAM sequence: TTC
aatagttttgagggaacagg

SEQ ID NO: 69216 - DNA, 20 bp, Artificial Sequence
  Description of Artificial Sequence: Synthetic oligonucleotide
  Target: SCN10A; (+) strand; PAM type: YTN; PAM sequence: TTT
tgagggaacaggtggttttt

SEQ ID NO: 69217 - DNA, 20 bp, Artificial Sequence
  Description of Artificial Sequence: Synthetic oligonucleotide
  Target: SCN10A; (+) strand; PAM type: YTN; PAM sequence: TTT
gagggaacaggtggtttttg

SEQ ID NO: 69218 - DNA, 20 bp, Artificial Sequence
  Description of Artificial Sequence: Synthetic oligonucleotide
  Target: SCN10A; (+) strand; PAM type: YTN; PAM sequence: TTG
agggaacaggtggtttttgg

SEQ ID NO: 69219 - DNA, 20 bp, Artificial Sequence
  Description of Artificial Sequence: Synthetic oligonucleotide
  Target: SCN10A; (+) strand; PAM type: YTN; PAM sequence: TTT
ttggttacatgaataagttc

SEQ ID NO: 69220 - DNA, 20 bp, Artificial Sequence
  Description of Artificial Sequence: Synthetic oligonucleotide
  Target: SCN10A; (+) strand; PAM type: YTN; PAM sequence: TTT
tggttacatgaataagttct

SEQ ID NO: 69221 - DNA, 20 bp, Artificial Sequence
  Description of Artificial Sequence: Synthetic oligonucleotide
  Target: SCN10A; (+) strand; PAM type: YTN; PAM sequence: TTT
ggttacatgaataagttctt

SEQ ID NO: 69222 - DNA, 20 bp, Artificial Sequence
  Description of Artificial Sequence: Synthetic oligonucleotide
  Target: SCN10A; (+) strand; PAM type: YTN; PAM sequence: TTG
gttacatgaataagttcttt

SEQ ID NO: 69223 - DNA, 20 bp, Artificial Sequence
  Description of Artificial Sequence: Synthetic oligonucleotide
  Target: SCN10A; (+) strand; PAM type: YTN; PAM sequence: TTA
catgaataagttctttattt

SEQ ID NO: 69224 - DNA, 20 bp, Artificial Sequence
  Description of Artificial Sequence: Synthetic oligonucleotide
  Target: SCN10A; (+) strand; PAM type: YTN; PAM sequence: TTC
tttatttgtatttcaatagt

SEQ ID NO: 69225 - DNA, 20 bp, Artificial Sequence
  Description of Artificial Sequence: Synthetic oligonucleotide
  Target: SCN10A; (+) strand; PAM type: YTN; PAM sequence: CTT
tatttgtatttcaatagttt

SEQ ID NO: 69226 - DNA, 20 bp, Artificial Sequence
  Description of Artificial Sequence: Synthetic oligonucleotide
  Target: SCN10A; (+) strand; PAM type: YTN; PAM sequence: TTT
atttgtatttcaatagtttt

SEQ ID NO: 69227 - DNA, 20 bp, Artificial Sequence
  Description of Artificial Sequence: Synthetic oligonucleotide
  Target: SCN10A; (+) strand; PAM type: YTN; PAM sequence: TTA
tttgtatttcaatagttttg

SEQ ID NO: 69228 - DNA, 20 bp, Artificial Sequence
  Description of Artificial Sequence: Synthetic oligonucleotide
  Target: SCN10A; (+) strand; PAM type: YTN; PAM sequence: TTT
gtatttcaatagttttggga

SEQ ID NO: 69229 - DNA, 20 bp, Artificial Sequence
  Description of Artificial Sequence: Synthetic oligonucleotide
  Target: SCN10A; (+) strand; PAM type: YTN; PAM sequence: TTG
tatttcaatagttttgggaa

SEQ ID NO: 69230 - DNA, 20 bp, Artificial Sequence
  Description of Artificial Sequence: Synthetic oligonucleotide
  Target: SCN10A; (+) strand; PAM type: YTN; PAM sequence: TTT
caatagttttgggaaacagg

SEQ ID NO: 69231 - DNA, 20 bp, Artificial Sequence
  Description of Artificial Sequence: Synthetic oligonucleotide
  Target: SCN10A; (+) strand; PAM type: YTN; PAM sequence: TTC
aatagttttgggaaacaggt

SEQ ID NO: 69232 - DNA, 20 bp, Artificial Sequence
  Description of Artificial Sequence: Synthetic oligonucleotide
  Target: SCN10A; (+) strand; PAM type: YTN; PAM sequence: TTT
tgggaaacaggtggtgttgg

SEQ ID NO: 69233 - DNA, 20 bp, Artificial Sequence
  Description of Artificial Sequence: Synthetic oligonucleotide
  Target: SCN10A; (+) strand; PAM type: YTN; PAM sequence: TTT
gggaaacaggtggtgttggg

SEQ ID NO: 69234 - DNA, 20 bp, Artificial Sequence
  Description of Artificial Sequence: Synthetic oligonucleotide
  Target: SCN10A; (+) strand; PAM type: YTN; PAM sequence: TTG
ggaaacaggtggtgttgggt

SEQ ID NO: 69235 - DNA, 20 bp, Artificial Sequence
  Description of Artificial Sequence: Synthetic oligonucleotide
  Target: SCN10A; (+) strand; PAM type: YTN; PAM sequence: TTG
ggttgcacagaaaaattctt

SEQ ID NO: 69236 - DNA, 20 bp, Artificial Sequence
  Description of Artificial Sequence: Synthetic oligonucleotide
  Target: SCN10A; (+) strand; PAM type: YTN; PAM sequence: TTG
cacagaaaaattctttaacg

SEQ ID NO: 69237 - DNA, 20 bp, Artificial Sequence
  Description of Artificial Sequence: Synthetic oligonucleotide
  Target: SCN10A; (+) strand; PAM type: YTN; PAM sequence: TTC
tttaacgctgatttctgaga

SEQ ID NO: 69238 - DNA, 20 bp, Artificial Sequence
  Description of Artificial Sequence: Synthetic oligonucleotide
  Target: SCN10A; (+) strand; PAM type: YTN; PAM sequence: CTT
taacgctgatttctgagatt

SEQ ID NO: 69239 - DNA, 20 bp, Artificial Sequence
  Description of Artificial Sequence: Synthetic oligonucleotide
  Target: SCN10A; (+) strand; PAM type: YTN; PAM sequence: TTT
aacgctgatttctgagattt

SEQ ID NO: 69240 - DNA, 20 bp, Artificial Sequence
  Description of Artificial Sequence: Synthetic oligonucleotide
  Target: SCN10A; (+) strand; PAM type: YTN; PAM sequence: TTA
acgctgatttctgagatttt

SEQ ID NO: 69241 - DNA, 20 bp, Artificial Sequence
  Description of Artificial Sequence: Synthetic oligonucleotide
  Target: SCN10A; (+) strand; PAM type: YTN; PAM sequence: CTG
atttctgagattttggtgca

SEQ ID NO: 69242 - DNA, 20 bp, Artificial Sequence
  Description of Artificial Sequence: Synthetic oligonucleotide
  Target: SCN10A; (+) strand; PAM type: YTN; PAM sequence: TTT
ctgagattttggtgcaccat

SEQ ID NO: 69243 - DNA, 20 bp, Artificial Sequence
  Description of Artificial Sequence: Synthetic oligonucleotide
  Target: SCN10A; (+) strand; PAM type: YTN; PAM sequence: TTC
tgagattttggtgcaccatc

SEQ ID NO: 69244 - DNA, 20 bp, Artificial Sequence
  Description of Artificial Sequence: Synthetic oligonucleotide
  Target: SCN10A; (+) strand; PAM type: YTN; PAM sequence: CTG
agattttggtgcaccatcac

SEQ ID NO: 69245 - DNA, 20 bp, Artificial Sequence
  Description of Artificial Sequence: Synthetic oligonucleotide
  Target: SCN10A; (+) strand; PAM type: YTN; PAM sequence: TTT
tggtgcaccatcacccgagc

SEQ ID NO: 69246 - DNA, 20 bp, Artificial Sequence
  Description of Artificial Sequence: Synthetic oligonucleotide
  Target: SCN10A; (+) strand; PAM type: YTN; PAM sequence: TTT
ggtgcaccatcacccgagca

SEQ ID NO: 69247 - DNA, 20 bp, Artificial Sequence
  Description of Artificial Sequence: Synthetic oligonucleotide
  Target: SCN10A; (+) strand; PAM type: YTN; PAM sequence: TTG
gtgcaccatcacccgagcag

SEQ ID NO: 69248 - DNA, 20 bp, Artificial Sequence
  Description of Artificial Sequence: Synthetic oligonucleotide
  Target: SCN10A; (+) strand; PAM type: YTN; PAM sequence: CTG
tacccagtgtgtagtctctt

SEQ ID NO: 69249 - DNA, 20 bp, Artificial Sequence
  Description of Artificial Sequence: Synthetic oligonucleotide
  Target: SCN10A; (+) strand; PAM type: YTN; PAM sequence: CTC
ttatcccttaccttcgtctc

SEQ ID NO: 69250 - DNA, 20 bp, Artificial Sequence
  Description of Artificial Sequence: Synthetic oligonucleotide
  Target: SCN10A; (+) strand; PAM type: YTN; PAM sequence: CTT
atcccttaccttcgtctcac

SEQ ID NO: 69251 - DNA, 20 bp, Artificial Sequence
  Description of Artificial Sequence: Synthetic oligonucleotide
  Target: SCN10A; (+) strand; PAM type: YTN; PAM sequence: TTA
tcccttaccttcgtctcacc

SEQ ID NO: 69252 - DNA, 20 bp, Artificial Sequence
  Description of Artificial Sequence: Synthetic oligonucleotide
  Target: SCN10A; (+) strand; PAM type: YTN; PAM sequence: CTT
accttcgtctcacctttcct

SEQ ID NO: 69253 - DNA, 20 bp, Artificial Sequence
  Description of Artificial Sequence: Synthetic oligonucleotide
  Target: SCN10A; (+) strand; PAM type: YTN; PAM sequence: TTA
ccttcgtctcacctttcctc

SEQ ID NO: 69254 - DNA, 20 bp, Artificial Sequence
  Description of Artificial Sequence: Synthetic oligonucleotide
  Target: SCN10A; (+) strand; PAM type: YTN; PAM sequence: CTT
cgtctcacctttcctcccaa

SEQ ID NO: 69255 - DNA, 20 bp, Artificial Sequence
  Description of Artificial Sequence: Synthetic oligonucleotide
  Target: SCN10A; (+) strand; PAM type: YTN; PAM sequence: TTC
gtctcacctttcctcccaag

SEQ ID NO: 69256 - DNA, 20 bp, Artificial Sequence
  Description of Artificial Sequence: Synthetic oligonucleotide
  Target: SCN10A; (+) strand; PAM type: YTN; PAM sequence: CTC
acctttcctcccaagtcccc

SEQ ID NO: 69257 - DNA, 20 bp, Artificial Sequence
  Description of Artificial Sequence: Synthetic oligonucleotide
  Target: SCN10A; (+) strand; PAM type: YTN; PAM sequence: CTT
tcctcccaagtccccaaagt

SEQ ID NO: 69258 - DNA, 20 bp, Artificial Sequence
  Description of Artificial Sequence: Synthetic oligonucleotide
  Target: SCN10A; (+) strand; PAM type: YTN; PAM sequence: TTT
cctcccaagtccccaaagtc

SEQ ID NO: 69259 - DNA, 20 bp, Artificial Sequence
  Description of Artificial Sequence: Synthetic oligonucleotide
  Target: SCN10A; (+) strand; PAM type: YTN; PAM sequence: TTC
ctcccaagtccccaaagtcc

SEQ ID NO: 69260 - DNA, 20 bp, Artificial Sequence
  Description of Artificial Sequence: Synthetic oligonucleotide
  Target: SCN10A; (+) strand; PAM type: YTN; PAM sequence: CTC
ccaagtccccaaagtccatt

SEQ ID NO: 69261 - DNA, 20 bp, Artificial Sequence
  Description of Artificial Sequence: Synthetic oligonucleotide
  Target: SCN10A; (+) strand; PAM type: YTN; PAM sequence: TTA
tgtcattgttatgcctttgc

SEQ ID NO: 69262 - DNA, 20 bp, Artificial Sequence
  Description of Artificial Sequence: Synthetic oligonucleotide
  Target: SCN10A; (+) strand; PAM type: YTN; PAM sequence: TTG
ttatgcctttgcatcctcac

SEQ ID NO: 69263 - DNA, 20 bp, Artificial Sequence
  Description of Artificial Sequence: Synthetic oligonucleotide
  Target: SCN10A; (+) strand; PAM type: YTN; PAM sequence: TTA
tgcctttgcatcctcacagc

SEQ ID NO: 69264 - DNA, 20 bp, Artificial Sequence
  Description of Artificial Sequence: Synthetic oligonucleotide
  Target: SCN10A; (+) strand; PAM type: YTN; PAM sequence: CTT
tgcatcctcacagcttagct

SEQ ID NO: 69265 - DNA, 20 bp, Artificial Sequence
  Description of Artificial Sequence: Synthetic oligonucleotide
  Target: SCN10A; (+) strand; PAM type: YTN; PAM sequence: TTT
gcatcctcacagcttagctc

SEQ ID NO: 69266 - DNA, 20 bp, Artificial Sequence
  Description of Artificial Sequence: Synthetic oligonucleotide
  Target: SCN10A; (+) strand; PAM type: YTN; PAM sequence: TTG
catcctcacagcttagctcc

SEQ ID NO: 69267 - DNA, 20 bp, Artificial Sequence
  Description of Artificial Sequence: Synthetic oligonucleotide
  Target: SCN10A; (+) strand; PAM type: YTN; PAM sequence: CTC
acagcttagctcctgcttgt

SEQ ID NO: 69268 - DNA, 20 bp, Artificial Sequence
  Description of Artificial Sequence: Synthetic oligonucleotide
  Target: SCN10A; (+) strand; PAM type: YTN; PAM sequence: CTT
agctcctgcttgtaattaag

SEQ ID NO: 69269 - DNA, 20 bp, Artificial Sequence
  Description of Artificial Sequence: Synthetic oligonucleotide
  Target: SCN10A; (+) strand; PAM type: YTN; PAM sequence: TTA
gctcctgcttgtaattaaga

SEQ ID NO: 69270 - DNA, 20 bp, Artificial Sequence
  Description of Artificial Sequence: Synthetic oligonucleotide
  Target: SCN10A; (+) strand; PAM type: YTN; PAM sequence: CTC
ctgcttgtaattaagaacac

SEQ ID NO: 69271 - DNA, 20 bp, Artificial Sequence
  Description of Artificial Sequence: Synthetic oligonucleotide
  Target: SCN10A; (+) strand; PAM type: YTN; PAM sequence: CTG
cttgtaattaagaacacatg

SEQ ID NO: 69272 - DNA, 20 bp, Artificial Sequence
  Description of Artificial Sequence: Synthetic oligonucleotide
  Target: SCN10A; (+) strand; PAM type: YTN; PAM sequence: CTT
gtaattaagaacacatgatg

SEQ ID NO: 69273 - DNA, 20 bp, Artificial Sequence
  Description of Artificial Sequence: Synthetic oligonucleotide
  Target: SCN10A; (+) strand; PAM type: YTN; PAM sequence: TTG
taattaagaacacatgatgc

SEQ ID NO: 69274 - DNA, 20 bp, Artificial Sequence
  Description of Artificial Sequence: Synthetic oligonucleotide
  Target: SCN10A; (+) strand; PAM type: YTN; PAM sequence: TTA
agaacacatgatgcttgact

SEQ ID NO: 69275 - DNA, 20 bp, Artificial Sequence
  Description of Artificial Sequence: Synthetic oligonucleotide
  Target: SCN10A; (+) strand; PAM type: YTN; PAM sequence: CTT
gactttctattcctgagtta

SEQ ID NO: 69276 - DNA, 20 bp, Artificial Sequence
  Description of Artificial Sequence: Synthetic oligonucleotide
  Target: SCN10A; (+) strand; PAM type: YTN; PAM sequence: TTG
actttctattcctgagttac

SEQ ID NO: 69277 - DNA, 20 bp, Artificial Sequence
  Description of Artificial Sequence: Synthetic oligonucleotide
  Target: SCN10A; (+) strand; PAM type: YTN; PAM sequence: CTT
tctattcctgagttacttca

SEQ ID NO: 69278 - DNA, 20 bp, Artificial Sequence
  Description of Artificial Sequence: Synthetic oligonucleotide
  Target: SCN10A; (+) strand; PAM type: YTN; PAM sequence: TTT
ctattcctgagttacttcat

SEQ ID NO: 69279 - DNA, 20 bp, Artificial Sequence
  Description of Artificial Sequence: Synthetic oligonucleotide
  Target: SCN10A; (+) strand; PAM type: YTN; PAM sequence: TTC
tattcctgagttacttcatt

SEQ ID NO: 69280 - DNA, 20 bp, Artificial Sequence
  Description of Artificial Sequence: Synthetic oligonucleotide
  Target: SCN10A; (+) strand; PAM type: YTN; PAM sequence: CTA
ttcctgagttacttcattta

SEQ ID NO: 69281 - DNA, 20 bp, Artificial Sequence
  Description of Artificial Sequence: Synthetic oligonucleotide
  Target: SCN10A; (+) strand; PAM type: YTN; PAM sequence: TTC
ctgagttacttcatttagaa

SEQ ID NO: 69282 - DNA, 20 bp, Artificial Sequence
  Description of Artificial Sequence: Synthetic oligonucleotide
  Target: SCN10A; (+) strand; PAM type: YTN; PAM sequence: CTG
agttacttcatttagaataa

SEQ ID NO: 69283 - DNA, 20 bp, Artificial Sequence
  Description of Artificial Sequence: Synthetic oligonucleotide
  Target: SCN10A; (+) strand; PAM type: YTN; PAM sequence: TTA
cttcatttagaataatagtc

SEQ ID NO: 69284 - DNA, 20 bp, Artificial Sequence
  Description of Artificial Sequence: Synthetic oligonucleotide
  Target: SCN10A; (+) strand; PAM type: YTN; PAM sequence: CTT
catttagaataatagtctcc

SEQ ID NO: 69285 - DNA, 20 bp, Artificial Sequence
  Description of Artificial Sequence: Synthetic oligonucleotide
  Target: SCN10A; (+) strand; PAM type: YTN; PAM sequence: TTC
atttagaataatagtctcca

SEQ ID NO: 69286 - DNA, 20 bp, Artificial Sequence
  Description of Artificial Sequence: Synthetic oligonucleotide
  Target: SCN10A; (+) strand; PAM type: YTN; PAM sequence: TTT
agaataatagtctccaactc

SEQ ID NO: 69287 - DNA, 20 bp, Artificial Sequence
  Description of Artificial Sequence: Synthetic oligonucleotide
  Target: SCN10A; (+) strand; PAM type: YTN; PAM sequence: TTA
gaataatagtctccaactcc

SEQ ID NO: 69288 - DNA, 20 bp, Artificial Sequence
  Description of Artificial Sequence: Synthetic oligonucleotide
  Target: SCN10A; (+) strand; PAM type: YTN; PAM sequence: CTC
caactccatccagcttgctg

SEQ ID NO: 69289 - DNA, 20 bp, Artificial Sequence
  Description of Artificial Sequence: Synthetic oligonucleotide
  Target: SCN10A; (+) strand; PAM type: YTN; PAM sequence: CTC
catccagcttgctgccaatg

SEQ ID NO: 69290 - DNA, 20 bp, Artificial Sequence
  Description of Artificial Sequence: Synthetic oligonucleotide
  Target: SCN10A; (+) strand; PAM type: YTN; PAM sequence: CTT
gctgccaatgccattatttc

SEQ ID NO: 69291 - DNA, 20 bp, Artificial Sequence
  Description of Artificial Sequence: Synthetic oligonucleotide
  Target: SCN10A; (+) strand; PAM type: YTN; PAM sequence: TTG
ctgccaatgccattatttca

SEQ ID NO: 69292 - DNA, 20 bp, Artificial Sequence
  Description of Artificial Sequence: Synthetic oligonucleotide
  Target: SCN10A; (+) strand; PAM type: YTN; PAM sequence: CTG
ccaatgccattatttcattc

SEQ ID NO: 69293 - DNA, 20 bp, Artificial Sequence
  Description of Artificial Sequence: Synthetic oligonucleotide
  Target: SCN10A; (+) strand; PAM type: YTN; PAM sequence: TTA
tttcattcctttttacaact

SEQ ID NO: 69294 - DNA, 20 bp, Artificial Sequence
  Description of Artificial Sequence: Synthetic oligonucleotide
  Target: SCN10A; (+) strand; PAM type: YTN; PAM sequence: TTT
cattcctttttacaactgag

SEQ ID NO: 69295 - DNA, 20 bp, Artificial Sequence
  Description of Artificial Sequence: Synthetic oligonucleotide
  Target: SCN10A; (+) strand; PAM type: YTN; PAM sequence: TTC
attcctttttacaactgagt

SEQ ID NO: 69296 - DNA, 20 bp, Artificial Sequence
  Description of Artificial Sequence: Synthetic oligonucleotide
  Target: SCN10A; (+) strand; PAM type: YTN; PAM sequence: TTC
ctttttacaactgagtagta

SEQ ID NO: 69297 - DNA, 20 bp, Artificial Sequence
  Description of Artificial Sequence: Synthetic oligonucleotide
  Target: SCN10A; (+) strand; PAM type: YTN; PAM sequence: CTT
tttacaactgagtagtattc

SEQ ID NO: 69298 - DNA, 20 bp, Artificial Sequence
  Description of Artificial Sequence: Synthetic oligonucleotide
  Target: SCN10A; (+) strand; PAM type: YTN; PAM sequence: TTT
ttacaactgagtagtattcc

SEQ ID NO: 69299 - DNA, 20 bp, Artificial Sequence
  Description of Artificial Sequence: Synthetic oligonucleotide
  Target: SCN10A; (+) strand; PAM type: YTN; PAM sequence: TTT
tacaactgagtagtattcca

SEQ ID NO: 69300 - DNA, 20 bp, Artificial Sequence
  Description of Artificial Sequence: Synthetic oligonucleotide
  Target: SCN10A; (+) strand; PAM type: YTN; PAM sequence: TTT
acaactgagtagtattccat

SEQ ID NO: 69301 - DNA, 20 bp, Artificial Sequence
  Description of Artificial Sequence: Synthetic oligonucleotide
  Target: SCN10A; (+) strand; PAM type: YTN; PAM sequence: TTA
caactgagtagtattccatg

SEQ ID NO: 69302 - DNA, 20 bp, Artificial Sequence
  Description of Artificial Sequence: Synthetic oligonucleotide
  Target: SCN10A; (+) strand; PAM type: YTN; PAM sequence: CTG
agtagtattccatggtatgc

SEQ ID NO: 69303 - DNA, 20 bp, Artificial Sequence
  Description of Artificial Sequence: Synthetic oligonucleotide
  Target: SCN10A; (+) strand; PAM type: YTN; PAM sequence: TTC
catggtatgcatacaccata

SEQ ID NO: 69304 - DNA, 20 bp, Artificial Sequence
  Description of Artificial Sequence: Synthetic oligonucleotide
  Target: SCN10A; (+) strand; PAM type: YTN; PAM sequence: TTT
tctttatgcacttgttggtt

SEQ ID NO: 69305 - DNA, 20 bp, Artificial Sequence
  Description of Artificial Sequence: Synthetic oligonucleotide
  Target: SCN10A; (+) strand; PAM type: YTN; PAM sequence: TTT
ctttatgcacttgttggttg

SEQ ID NO: 69306 - DNA, 20 bp, Artificial Sequence
  Description of Artificial Sequence: Synthetic oligonucleotide
  Target: SCN10A; (+) strand; PAM type: YTN; PAM sequence: TTC
tttatgcacttgttggttga

SEQ ID NO: 69307 - DNA, 20 bp, Artificial Sequence
  Description of Artificial Sequence: Synthetic oligonucleotide
  Target: SCN10A; (+) strand; PAM type: YTN; PAM sequence: CTT
tatgcacttgttggttgatg

SEQ ID NO: 69308 - DNA, 20 bp, Artificial Sequence
  Description of Artificial Sequence: Synthetic oligonucleotide
  Target: SCN10A; (+) strand; PAM type: YTN; PAM sequence: TTT
atgcacttgttggttgatgg

SEQ ID NO: 69309 - DNA, 20 bp, Artificial Sequence
  Description of Artificial Sequence: Synthetic oligonucleotide
  Target: SCN10A; (+) strand; PAM type: YTN; PAM sequence: TTA
tgcacttgttggttgatggg

SEQ ID NO: 69310 - DNA, 20 bp, Artificial Sequence
  Description of Artificial Sequence: Synthetic oligonucleotide
  Target: SCN10A; (+) strand; PAM type: YTN; PAM sequence: CTT
gttggttgatgggcatttag

SEQ ID NO: 69311 - DNA, 20 bp, Artificial Sequence
  Description of Artificial Sequence: Synthetic oligonucleotide
  Target: SCN10A; (+) strand; PAM type: YTN; PAM sequence: TTG
ttggttgatgggcatttagg

SEQ ID NO: 69312 - DNA, 20 bp, Artificial Sequence
  Description of Artificial Sequence: Synthetic oligonucleotide
  Target: SCN10A; (+) strand; PAM type: YTN; PAM sequence: TTG
gttgatgggcatttaggctg

SEQ ID NO: 69313 - DNA, 20 bp, Artificial Sequence
  Description of Artificial Sequence: Synthetic oligonucleotide
  Target: SCN10A; (+) strand; PAM type: YTN; PAM sequence: TTG
atgggcatttaggctggttc

SEQ ID NO: 69314 - DNA, 20 bp, Artificial Sequence
  Description of Artificial Sequence: Synthetic oligonucleotide
  Target: SCN10A; (+) strand; PAM type: YTN; PAM sequence: TTT
aggctggttccatatttttg

SEQ ID NO: 69315 - DNA, 20 bp, Artificial Sequence
  Description of Artificial Sequence: Synthetic oligonucleotide
  Target: SCN10A; (+) strand; PAM type: YTN; PAM sequence: TTA
ggctggttccatatttttgc

SEQ ID NO: 69316 - DNA, 20 bp, Artificial Sequence
  Description of Artificial Sequence: Synthetic oligonucleotide
  Target: SCN10A; (+) strand; PAM type: YTN; PAM sequence: CTG
gttccatatttttgcagttg

SEQ ID NO: 69317 - DNA, 20 bp, Artificial Sequence
  Description of Artificial Sequence: Synthetic oligonucleotide
  Target: SCN10A; (+) strand; PAM type: YTN; PAM sequence: TTC
catatttttgcagttgtaaa

SEQ ID NO: 69318 - DNA, 20 bp, Artificial Sequence
  Description of Artificial Sequence: Synthetic oligonucleotide
  Target: SCN10A; (+) strand; PAM type: YTN; PAM sequence: TTT
ttgcagttgtaaactgtgct

SEQ ID NO: 69319 - DNA, 20 bp, Artificial Sequence
  Description of Artificial Sequence: Synthetic oligonucleotide
  Target: SCN10A; (+) strand; PAM type: YTN; PAM sequence: TTT
tgcagttgtaaactgtgctg

SEQ ID NO: 69320 - DNA, 20 bp, Artificial Sequence
  Description of Artificial Sequence: Synthetic oligonucleotide
  Target: SCN10A; (+) strand; PAM type: YTN; PAM sequence: TTT
gcagttgtaaactgtgctgc

SEQ ID NO: 69321 - DNA, 20 bp, Artificial Sequence
  Description of Artificial Sequence: Synthetic oligonucleotide
  Target: SCN10A; (+) strand; PAM type: YTN; PAM sequence: TTG
cagttgtaaactgtgctgct

SEQ ID NO: 69322 - DNA, 20 bp, Artificial Sequence
  Description of Artificial Sequence: Synthetic oligonucleotide
  Target: SCN10A; (+) strand; PAM type: YTN; PAM sequence: TTG
taaactgtgctgctataagc

SEQ ID NO: 69323 - DNA, 20 bp, Artificial Sequence
  Description of Artificial Sequence: Synthetic oligonucleotide
  Target: SCN10A; (+) strand; PAM type: YTN; PAM sequence: CTG
tgctgctataagcatgcata

SEQ ID NO: 69324 - DNA, 20 bp, Artificial Sequence
  Description of Artificial Sequence: Synthetic oligonucleotide
  Target: SCN10A; (+) strand; PAM type: YTN; PAM sequence: CTG
ctataagcatgcatatgcaa

SEQ ID NO: 69325 - DNA, 20 bp, Artificial Sequence
  Description of Artificial Sequence: Synthetic oligonucleotide
  Target: SCN10A; (+) strand; PAM type: YTN; PAM sequence: CTA
taagcatgcatatgcaagtg

SEQ ID NO: 69326 - DNA, 20 bp, Artificial Sequence
  Description of Artificial Sequence: Synthetic oligonucleotide
  Target: SCN10A; (+) strand; PAM type: YTN; PAM sequence: CTT
tttaataatggcttattttc

SEQ ID NO: 69327 - DNA, 20 bp, Artificial Sequence
  Description of Artificial Sequence: Synthetic oligonucleotide
  Target: SCN10A; (+) strand; PAM type: YTN; PAM sequence: TTT
ttaataatggcttattttcc

SEQ ID NO: 69328 - DNA, 20 bp, Artificial Sequence
  Description of Artificial Sequence: Synthetic oligonucleotide
  Target: SCN10A; (+) strand; PAM type: YTN; PAM sequence: TTT
taataatggcttattttcct

SEQ ID NO: 69329 - DNA, 20 bp, Artificial Sequence
  Description of Artificial Sequence: Synthetic oligonucleotide
  Target: SCN10A; (+) strand; PAM type: YTN; PAM sequence: TTT
aataatggcttattttcctc

SEQ ID NO: 69330 - DNA, 20 bp, Artificial Sequence
  Description of Artificial Sequence: Synthetic oligonucleotide
  Target: SCN10A; (+) strand; PAM type: YTN; PAM sequence: TTA
ataatggcttattttcctct

SEQ ID NO: 69331 - DNA, 20 bp, Artificial Sequence
  Description of Artificial Sequence: Synthetic oligonucleotide
  Target: SCN10A; (+) strand; PAM type: YTN; PAM sequence: CTT
attttcctctgggtagatac

SEQ ID NO: 69332 - DNA, 20 bp, Artificial Sequence
  Description of Artificial Sequence: Synthetic oligonucleotide
  Target: SCN10A; (+) strand; PAM type: YTN; PAM sequence: TTA
ttttcctctgggtagatacc

SEQ ID NO: 69333 - DNA, 20 bp, Artificial Sequence
  Description of Artificial Sequence: Synthetic oligonucleotide
  Target: SCN10A; (+) strand; PAM type: YTN; PAM sequence: TTT
tcctctgggtagatacccag

SEQ ID NO: 69334 - DNA, 20 bp, Artificial Sequence
  Description of Artificial Sequence: Synthetic oligonucleotide
  Target: SCN10A; (+) strand; PAM type: YTN; PAM sequence: TTT
cctctgggtagatacccagt

SEQ ID NO: 69335 - DNA, 20 bp, Artificial Sequence
  Description of Artificial Sequence: Synthetic oligonucleotide
  Target: SCN10A; (+) strand; PAM type: YTN; PAM sequence: TTC
ctctgggtagatacccagta

SEQ ID NO: 69336 - DNA, 20 bp, Artificial Sequence
  Description of Artificial Sequence: Synthetic oligonucleotide
  Target: SCN10A; (+) strand; PAM type: YTN; PAM sequence: CTC
tgggtagatacccagtagtg

SEQ ID NO: 69337 - DNA, 20 bp, Artificial Sequence
  Description of Artificial Sequence: Synthetic oligonucleotide
  Target: SCN10A; (+) strand; PAM type: YTN; PAM sequence: CTG
ggtagatacccagtagtggg

SEQ ID NO: 69338 - DNA, 20 bp, Artificial Sequence
  Description of Artificial Sequence: Synthetic oligonucleotide
  Target: SCN10A; (+) strand; PAM type: YTN; PAM sequence: TTG
ctggaccaaatggtagttct

SEQ ID NO: 69339 - DNA, 20 bp, Artificial Sequence
  Description of Artificial Sequence: Synthetic oligonucleotide
  Target: SCN10A; (+) strand; PAM type: YTN; PAM sequence: CTG
gaccaaatggtagttctact

SEQ ID NO: 69340 - DNA, 20 bp, Artificial Sequence
  Description of Artificial Sequence: Synthetic oligonucleotide
  Target: SCN10A; (+) strand; PAM type: YTN; PAM sequence: TTC
tacttttagttctttaagga

SEQ ID NO: 69341 - DNA, 20 bp, Artificial Sequence
  Description of Artificial Sequence: Synthetic oligonucleotide
  Target: SCN10A; (+) strand; PAM type: YTN; PAM sequence: CTA
cttttagttctttaaggaat

SEQ ID NO: 69342 - DNA, 20 bp, Artificial Sequence
  Description of Artificial Sequence: Synthetic oligonucleotide
  Target: SCN10A; (+) strand; PAM type: YTN; PAM sequence: CTT
ttagttctttaaggaatctc

SEQ ID NO: 69343 - DNA, 20 bp, Artificial Sequence
  Description of Artificial Sequence: Synthetic oligonucleotide
  Target: SCN10A; (+) strand; PAM type: YTN; PAM sequence: TTT
tagttctttaaggaatctcc

SEQ ID NO: 69344 - DNA, 20 bp, Artificial Sequence
  Description of Artificial Sequence: Synthetic oligonucleotide
  Target: SCN10A; (+) strand; PAM type: YTN; PAM sequence: TTT
agttctttaaggaatctcca

SEQ ID NO: 69345 - DNA, 20 bp, Artificial Sequence
  Description of Artificial Sequence: Synthetic oligonucleotide
  Target: SCN10A; (+) strand; PAM type: YTN; PAM sequence: TTA
gttctttaaggaatctccat

SEQ ID NO: 69346 - DNA, 20 bp, Artificial Sequence
  Description of Artificial Sequence: Synthetic oligonucleotide
  Target: SCN10A; (+) strand; PAM type: YTN; PAM sequence: TTC
tttaaggaatctccataacg

SEQ ID NO: 69347 - DNA, 20 bp, Artificial Sequence
  Description of Artificial Sequence: Synthetic oligonucleotide
  Target: SCN10A; (+) strand; PAM type: YTN; PAM sequence: CTT
taaggaatctccataacgtt

SEQ ID NO: 69348 - DNA, 20 bp, Artificial Sequence
  Description of Artificial Sequence: Synthetic oligonucleotide
  Target: SCN10A; (+) strand; PAM type: YTN; PAM sequence: TTT
aaggaatctccataacgttt

SEQ ID NO: 69349 - DNA, 20 bp, Artificial Sequence
  Description of Artificial Sequence: Synthetic oligonucleotide
  Target: SCN10A; (+) strand; PAM type: YTN; PAM sequence: TTA
aggaatctccataacgtttt

SEQ ID NO: 69350 - DNA, 20 bp, Artificial Sequence
  Description of Artificial Sequence: Synthetic oligonucleotide
  Target: SCN10A; (+) strand; PAM type: YTN; PAM sequence: CTC
cataacgttttccttagtgg

SEQ ID NO: 69351 - DNA, 20 bp, Artificial Sequence
  Description of Artificial Sequence: Synthetic oligonucleotide
  Target: SCN10A; (+) strand; PAM type: YTN; PAM sequence: TTT
tccttagtggttgtactagt

SEQ ID NO: 69352 - DNA, 20 bp, Artificial Sequence
  Description of Artificial Sequence: Synthetic oligonucleotide
  Target: SCN10A; (+) strand; PAM type: YTN; PAM sequence: TTT
ccttagtggttgtactagtt

SEQ ID NO: 69353 - DNA, 20 bp, Artificial Sequence
  Description of Artificial Sequence: Synthetic oligonucleotide
  Target: SCN10A; (+) strand; PAM type: YTN; PAM sequence: TTC
cttagtggttgtactagttt

SEQ ID NO: 69354 - DNA, 20 bp, Artificial Sequence
  Description of Artificial Sequence: Synthetic oligonucleotide
  Target: SCN10A; (+) strand; PAM type: YTN; PAM sequence: CTT
agtggttgtactagtttaca

SEQ ID NO: 69355 - DNA, 20 bp, Artificial Sequence
  Description of Artificial Sequence: Synthetic oligonucleotide
  Target: SCN10A; (+) strand; PAM type: YTN; PAM sequence: TTA
gtggttgtactagtttacat

SEQ ID NO: 69356 - DNA, 20 bp, Artificial Sequence
  Description of Artificial Sequence: Synthetic oligonucleotide
  Target: SCN10A; (+) strand; PAM type: YTN; PAM sequence: TTG
tactagtttacattcccacc

SEQ ID NO: 69357 - DNA, 20 bp, Artificial Sequence
  Description of Artificial Sequence: Synthetic oligonucleotide
  Target: SCN10A; (+) strand; PAM type: YTN; PAM sequence: CTA
gtttacattcccaccagcag

SEQ ID NO: 69358 - DNA, 20 bp, Artificial Sequence
  Description of Artificial Sequence: Synthetic oligonucleotide
  Target: SCN10A; (+) strand; PAM type: YTN; PAM sequence: TTT
acattcccaccagcagtgta

SEQ ID NO: 69359 - DNA, 20 bp, Artificial Sequence
  Description of Artificial Sequence: Synthetic oligonucleotide
  Target: SCN10A; (+) strand; PAM type: YTN; PAM sequence: TTA
cattcccaccagcagtgtaa

SEQ ID NO: 69360 - DNA, 20 bp, Artificial Sequence
  Description of Artificial Sequence: Synthetic oligonucleotide
  Target: SCN10A; (+) strand; PAM type: YTN; PAM sequence: TTC
ccaccagcagtgtaaaattg

SEQ ID NO: 69361 - DNA, 20 bp, Artificial Sequence
  Description of Artificial Sequence: Synthetic oligonucleotide
  Target: SCN10A; (+) strand; PAM type: YTN; PAM sequence: TTG
tttccttttcattacatcca

SEQ ID NO: 69362 - DNA, 20 bp, Artificial Sequence
  Description of Artificial Sequence: Synthetic oligonucleotide
  Target: SCN10A; (+) strand; PAM type: YTN; PAM sequence: TTT
ccttttcattacatccatgc

SEQ ID NO: 69363 - DNA, 20 bp, Artificial Sequence
  Description of Artificial Sequence: Synthetic oligonucleotide
  Target: SCN10A; (+) strand; PAM type: YTN; PAM sequence: TTC
cttttcattacatccatgcc

SEQ ID NO: 69364 - DNA, 20 bp, Artificial Sequence
  Description of Artificial Sequence: Synthetic oligonucleotide
  Target: SCN10A; (+) strand; PAM type: YTN; PAM sequence: CTT
ttcattacatccatgccaac

SEQ ID NO: 69365 - DNA, 20 bp, Artificial Sequence
  Description of Artificial Sequence: Synthetic oligonucleotide
  Target: SCN10A; (+) strand; PAM type: YTN; PAM sequence: TTT
tcattacatccatgccaaca

SEQ ID NO: 69366 - DNA, 20 bp, Artificial Sequence
  Description of Artificial Sequence: Synthetic oligonucleotide
  Target: SCN10A; (+) strand; PAM type: YTN; PAM sequence: TTT
cattacatccatgccaacat

SEQ ID NO: 69367 - DNA, 20 bp, Artificial Sequence
  Description of Artificial Sequence: Synthetic oligonucleotide
  Target: SCN10A; (+) strand; PAM type: YTN; PAM sequence: TTC
attacatccatgccaacatc

SEQ ID NO: 69368 - DNA, 20 bp, Artificial Sequence
  Description of Artificial Sequence: Synthetic oligonucleotide
  Target: SCN10A; (+) strand; PAM type: YTN; PAM sequence: TTA
catccatgccaacatctatt

SEQ ID NO: 69369 - DNA, 20 bp, Artificial Sequence
  Description of Artificial Sequence: Synthetic oligonucleotide
  Target: SCN10A; (+) strand; PAM type: YTN; PAM sequence: CTA
ttattttttggttatggcca

SEQ ID NO: 69370 - DNA, 20 bp, Artificial Sequence
  Description of Artificial Sequence: Synthetic oligonucleotide
  Target: SCN10A; (+) strand; PAM type: YTN; PAM sequence: TTA
ttttttggttatggccattc

SEQ ID NO: 69371 - DNA, 20 bp, Artificial Sequence
  Description of Artificial Sequence: Synthetic oligonucleotide
  Target: SCN10A; (+) strand; PAM type: YTN; PAM sequence: TTT
tttggttatggccattcttg

SEQ ID NO: 69372 - DNA, 20 bp, Artificial Sequence
  Description of Artificial Sequence: Synthetic oligonucleotide
  Target: SCN10A; (+) strand; PAM type: YTN; PAM sequence: TTT
ttggttatggccattcttgc

SEQ ID NO: 69373 - DNA, 20 bp, Artificial Sequence
  Description of Artificial Sequence: Synthetic oligonucleotide
  Target: SCN10A; (+) strand; PAM type: YTN; PAM sequence: TTT
tggttatggccattcttgca

SEQ ID NO: 69374 - DNA, 20 bp, Artificial Sequence
  Description of Artificial Sequence: Synthetic oligonucleotide
  Target: SCN10A; (+) strand; PAM type: YTN; PAM sequence: TTT
ggttatggccattcttgcag

SEQ ID NO: 69375 - DNA, 20 bp, Artificial Sequence
  Description of Artificial Sequence: Synthetic oligonucleotide
  Target: SCN10A; (+) strand; PAM type: YTN; PAM sequence: TTG
gttatggccattcttgcagg

SEQ ID NO: 69376 - DNA, 20 bp, Artificial Sequence
  Description of Artificial Sequence: Synthetic oligonucleotide
  Target: SCN10A; (+) strand; PAM type: YTN; PAM sequence: TTA
tggccattcttgcaggagta

SEQ ID NO: 69377 - DNA, 20 bp, Artificial Sequence
  Description of Artificial Sequence: Synthetic oligonucleotide
  Target: SCN10A; (+) strand; PAM type: YTN; PAM sequence: TTC
ttgcaggagtaaggtggtat

SEQ ID NO: 69378 - DNA, 20 bp, Artificial Sequence
  Description of Artificial Sequence: Synthetic oligonucleotide
  Target: SCN10A; (+) strand; PAM type: YTN; PAM sequence: CTT
gcaggagtaaggtggtatct

SEQ ID NO: 69379 - DNA, 20 bp, Artificial Sequence
  Description of Artificial Sequence: Synthetic oligonucleotide
  Target: SCN10A; (+) strand; PAM type: YTN; PAM sequence: TTG
caggagtaaggtggtatctc

SEQ ID NO: 69380 - DNA, 20 bp, Artificial Sequence
  Description of Artificial Sequence: Synthetic oligonucleotide
  Target: SCN10A; (+) strand; PAM type: YTN; PAM sequence: CTC
attgtggttttaatttgcat

SEQ ID NO: 69381 - DNA, 20 bp, Artificial Sequence
  Description of Artificial Sequence: Synthetic oligonucleotide
  Target: SCN10A; (+) strand; PAM type: YTN; PAM sequence: TTG
tggttttaatttgcatttcc

SEQ ID NO: 69382 - DNA, 20 bp, Artificial Sequence
  Description of Artificial Sequence: Synthetic oligonucleotide
  Target: SCN10A; (+) strand; PAM type: YTN; PAM sequence: TTT
taatttgcatttccctgata

SEQ ID NO: 69383 - DNA, 20 bp, Artificial Sequence
  Description of Artificial Sequence: Synthetic oligonucleotide
  Target: SCN10A; (+) strand; PAM type: YTN; PAM sequence: TTT
aatttgcatttccctgataa

SEQ ID NO: 69384 - DNA, 20 bp, Artificial Sequence
  Description of Artificial Sequence: Synthetic oligonucleotide
  Target: SCN10A; (+) strand; PAM type: YTN; PAM sequence: TTA
atttgcatttccctgataat

SEQ ID NO: 69385 - DNA, 20 bp, Artificial Sequence
  Description of Artificial Sequence: Synthetic oligonucleotide
  Target: SCN10A; (+) strand; PAM type: YTN; PAM sequence: TTT
gcatttccctgataattaat

SEQ ID NO: 69386 - DNA, 20 bp, Artificial Sequence
  Description of Artificial Sequence: Synthetic oligonucleotide
  Target: SCN10A; (+) strand; PAM type: YTN; PAM sequence: TTG
catttccctgataattaatg

SEQ ID NO: 69387 - DNA, 20 bp, Artificial Sequence
  Description of Artificial Sequence: Synthetic oligonucleotide
  Target: SCN10A; (+) strand; PAM type: YTN; PAM sequence: TTT
ccctgataattaatgatgtt

SEQ ID NO: 69388 - DNA, 20 bp, Artificial Sequence
  Description of Artificial Sequence: Synthetic oligonucleotide
  Target: SCN10A; (+) strand; PAM type: YTN; PAM sequence: TTC
cctgataattaatgatgttg

SEQ ID NO: 69389 - DNA, 20 bp, Artificial Sequence
  Description of Artificial Sequence: Synthetic oligonucleotide
  Target: SCN10A; (+) strand; PAM type: YTN; PAM sequence: CTG
ataattaatgatgttgagca

SEQ ID NO: 69390 - DNA, 20 bp, Artificial Sequence
  Description of Artificial Sequence: Synthetic oligonucleotide
  Target: SCN10A; (+) strand; PAM type: YTN; PAM sequence: TTA
atgatgttgagcattttttt

SEQ ID NO: 69391 - DNA, 20 bp, Artificial Sequence
  Description of Artificial Sequence: Synthetic oligonucleotide
  Target: SCN10A; (+) strand; PAM type: YTN; PAM sequence: TTG
agcatttttttttcctgttc

SEQ ID NO: 69392 - DNA, 20 bp, Artificial Sequence
  Description of Artificial Sequence: Synthetic oligonucleotide
  Target: SCN10A; (+) strand; PAM type: YTN; PAM sequence: TTT
ttttttcctgttcattggcc

SEQ ID NO: 69393 - DNA, 20 bp, Artificial Sequence
  Description of Artificial Sequence: Synthetic oligonucleotide
  Target: SCN10A; (+) strand; PAM type: YTN; PAM sequence: TTT
tttttcctgttcattggcca

SEQ ID NO: 69394 - DNA, 20 bp, Artificial Sequence
  Description of Artificial Sequence: Synthetic oligonucleotide
  Target: SCN10A; (+) strand; PAM type: YTN; PAM sequence: TTT
ttttcctgttcattggccat

SEQ ID NO: 69395 - DNA, 20 bp, Artificial Sequence
  Description of Artificial Sequence: Synthetic oligonucleotide
  Target: SCN10A; (+) strand; PAM type: YTN; PAM sequence: TTT
tttcctgttcattggccatt

SEQ ID NO: 69396 - DNA, 20 bp, Artificial Sequence
  Description of Artificial Sequence: Synthetic oligonucleotide
  Target: SCN10A; (+) strand; PAM type: YTN; PAM sequence: TTT
ttcctgttcattggccattt

SEQ ID NO: 69397 - DNA, 20 bp, Artificial Sequence
  Description of Artificial Sequence: Synthetic oligonucleotide
  Target: SCN10A; (+) strand; PAM type: YTN; PAM sequence: TTT
tcctgttcattggccattta

SEQ ID NO: 69398 - DNA, 20 bp, Artificial Sequence
  Description of Artificial Sequence: Synthetic oligonucleotide
  Target: SCN10A; (+) strand; PAM type: YTN; PAM sequence: TTT
cctgttcattggccatttat

SEQ ID NO: 69399 - DNA, 20 bp, Artificial Sequence
  Description of Artificial Sequence: Synthetic oligonucleotide
  Target: SCN10A; (+) strand; PAM type: YTN; PAM sequence: TTC
ctgttcattggccatttata

SEQ ID NO: 69400 - DNA, 20 bp, Artificial Sequence
  Description of Artificial Sequence: Synthetic oligonucleotide
  Target: SCN10A; (+) strand; PAM type: YTN; PAM sequence: CTG
ttcattggccatttatatat

SEQ ID NO: 69401 - DNA, 20 bp, Artificial Sequence
  Description of Artificial Sequence: Synthetic oligonucleotide
  Target: SCN10A; (+) strand; PAM type: YTN; PAM sequence: TTC
attggccatttatatatctt

SEQ ID NO: 69402 - DNA, 20 bp, Artificial Sequence
  Description of Artificial Sequence: Synthetic oligonucleotide
  Target: SCN10A; (+) strand; PAM type: YTN; PAM sequence: TTG
gccatttatatatcttcttt

SEQ ID NO: 69403 - DNA, 20 bp, Artificial Sequence
  Description of Artificial Sequence: Synthetic oligonucleotide
  Target: SCN10A; (+) strand; PAM type: YTN; PAM sequence: TTT
atatatcttcttttgagaat

SEQ ID NO: 69404 - DNA, 20 bp, Artificial Sequence
  Description of Artificial Sequence: Synthetic oligonucleotide
  Target: SCN10A; (+) strand; PAM type: YTN; PAM sequence: TTA
tatatcttcttttgagaatt

SEQ ID NO: 69405 - DNA, 20 bp, Artificial Sequence
  Description of Artificial Sequence: Synthetic oligonucleotide
  Target: SCN10A; (+) strand; PAM type: YTN; PAM sequence: CTT
cttttgagaattgcgtattc

SEQ ID NO: 69406 - DNA, 20 bp, Artificial Sequence
  Description of Artificial Sequence: Synthetic oligonucleotide
  Target: SCN10A; (+) strand; PAM type: YTN; PAM sequence: TTC
ttttgagaattgcgtattct

SEQ ID NO: 69407 - DNA, 20 bp, Artificial Sequence
  Description of Artificial Sequence: Synthetic oligonucleotide
  Target: SCN10A; (+) strand; PAM type: YTN; PAM sequence: CTT
ttgagaattgcgtattcttg

SEQ ID NO: 69408 - DNA, 20 bp, Artificial Sequence
  Description of Artificial Sequence: Synthetic oligonucleotide
  Target: SCN10A; (+) strand; PAM type: YTN; PAM sequence: TTT
tgagaattgcgtattcttgt

SEQ ID NO: 69409 - DNA, 20 bp, Artificial Sequence
  Description of Artificial Sequence: Synthetic oligonucleotide
  Target: SCN10A; (+) strand; PAM type: YTN; PAM sequence: TTT
gagaattgcgtattcttgtc

SEQ ID NO: 69410 - DNA, 20 bp, Artificial Sequence
  Description of Artificial Sequence: Synthetic oligonucleotide
  Target: SCN10A; (+) strand; PAM type: YTN; PAM sequence: TTG
agaattgcgtattcttgtcc

SEQ ID NO: 69411 - DNA, 20 bp, Artificial Sequence
  Description of Artificial Sequence: Synthetic oligonucleotide
  Target: SCN10A; (+) strand; PAM type: YTN; PAM sequence: TTG
cgtattcttgtcctttgccc

SEQ ID NO: 69412 - DNA, 20 bp, Artificial Sequence
  Description of Artificial Sequence: Synthetic oligonucleotide
  Target: SCN10A; (+) strand; PAM type: YTN; PAM sequence: TTC
ttgtcctttgcccacttttg

SEQ ID NO: 69413 - DNA, 20 bp, Artificial Sequence
  Description of Artificial Sequence: Synthetic oligonucleotide
  Target: SCN10A; (+) strand; PAM type: YTN; PAM sequence: CTT
gtcctttgcccacttttgga

SEQ ID NO: 69414 - DNA, 20 bp, Artificial Sequence
  Description of Artificial Sequence: Synthetic oligonucleotide
  Target: SCN10A; (+) strand; PAM type: YTN; PAM sequence: TTG
tcctttgcccacttttggat

SEQ ID NO: 69415 - DNA, 20 bp, Artificial Sequence
  Description of Artificial Sequence: Synthetic oligonucleotide
  Target: SCN10A; (+) strand; PAM type: YTN; PAM sequence: CTT
tgcccacttttggatgggat

SEQ ID NO: 69416 - DNA, 20 bp, Artificial Sequence
  Description of Artificial Sequence: Synthetic oligonucleotide
  Target: SCN10A; (+) strand; PAM type: YTN; PAM sequence: TTT
gcccacttttggatgggatt

SEQ ID NO: 69417 - DNA, 20 bp, Artificial Sequence
  Description of Artificial Sequence: Synthetic oligonucleotide
  Target: SCN10A; (+) strand; PAM type: YTN; PAM sequence: TTG
cccacttttggatgggatta

SEQ ID NO: 69418 - DNA, 20 bp, Artificial Sequence
  Description of Artificial Sequence: Synthetic oligonucleotide
  Target: SCN10A; (+) strand; PAM type: YTN; PAM sequence: CTT
ttggatgggattatttgttt

SEQ ID NO: 69419 - DNA, 20 bp, Artificial Sequence
  Description of Artificial Sequence: Synthetic oligonucleotide
  Target: SCN10A; (+) strand; PAM type: YTN; PAM sequence: TTT
tggatgggattatttgtttg

SEQ ID NO: 69420 - DNA, 20 bp, Artificial Sequence
  Description of Artificial Sequence: Synthetic oligonucleotide
  Target: SCN10A; (+) strand; PAM type: YTN; PAM sequence: TTT
ggatgggattatttgtttgt

SEQ ID NO: 69421 - DNA, 20 bp, Artificial Sequence
  Description of Artificial Sequence: Synthetic oligonucleotide
  Target: SCN10A; (+) strand; PAM type: YTN; PAM sequence: TTG
gatgggattatttgtttgtt

SEQ ID NO: 69422 - DNA, 20 bp, Artificial Sequence
  Description of Artificial Sequence: Synthetic oligonucleotide
  Target: SCN10A; (+) strand; PAM type: YTN; PAM sequence: TTA
tttgtttgttttcttgctga

SEQ ID NO: 69423 - DNA, 20 bp, Artificial Sequence
  Description of Artificial Sequence: Synthetic oligonucleotide
  Target: SCN10A; (+) strand; PAM type: YTN; PAM sequence: TTT
gtttgttttcttgctgattt

SEQ ID NO: 69424 - DNA, 20 bp, Artificial Sequence
  Description of Artificial Sequence: Synthetic oligonucleotide
  Target: SCN10A; (+) strand; PAM type: YTN; PAM sequence: TTG
tttgttttcttgctgattta

SEQ ID NO: 69425 - DNA, 20 bp, Artificial Sequence
  Description of Artificial Sequence: Synthetic oligonucleotide
  Target: SCN10A; (+) strand; PAM type: YTN; PAM sequence: TTT
gttttcttgctgatttattt

SEQ ID NO: 69426 - DNA, 20 bp, Artificial Sequence
  Description of Artificial Sequence: Synthetic oligonucleotide
  Target: SCN10A; (+) strand; PAM type: YTN; PAM sequence: TTG
ttttcttgctgatttatttg

SEQ ID NO: 69427 - DNA, 20 bp, Artificial Sequence
  Description of Artificial Sequence: Synthetic oligonucleotide
  Target: SCN10A; (+) strand; PAM type: YTN; PAM sequence: TTT
tcttgctgatttatttgtgt

SEQ ID NO: 69428 - DNA, 20 bp, Artificial Sequence
  Description of Artificial Sequence: Synthetic oligonucleotide
  Target: SCN10A; (+) strand; PAM type: YTN; PAM sequence: TTT
cttgctgatttatttgtgtt

SEQ ID NO: 69429 - DNA, 20 bp, Artificial Sequence
  Description of Artificial Sequence: Synthetic oligonucleotide
  Target: SCN10A; (+) strand; PAM type: YTN; PAM sequence: TTC
ttgctgatttatttgtgttt

SEQ ID NO: 69430 - DNA, 20 bp, Artificial Sequence
  Description of Artificial Sequence: Synthetic oligonucleotide
  Target: SCN10A; (+) strand; PAM type: YTN; PAM sequence: CTT
gctgatttatttgtgtttct

SEQ ID NO: 69431 - DNA, 20 bp, Artificial Sequence
  Description of Artificial Sequence: Synthetic oligonucleotide
  Target: SCN10A; (+) strand; PAM type: YTN; PAM sequence: TTG
ctgatttatttgtgtttctt

SEQ ID NO: 69432 - DNA, 20 bp, Artificial Sequence
  Description of Artificial Sequence: Synthetic oligonucleotide
  Target: SCN10A; (+) strand; PAM type: YTN; PAM sequence: CTG
atttatttgtgtttcttata

SEQ ID NO: 69433 - DNA, 20 bp, Artificial Sequence
  Description of Artificial Sequence: Synthetic oligonucleotide
  Target: SCN10A; (+) strand; PAM type: YTN; PAM sequence: TTT
atttgtgtttcttatagatg

SEQ ID NO: 69434 - DNA, 20 bp, Artificial Sequence
  Description of Artificial Sequence: Synthetic oligonucleotide
  Target: SCN10A; (+) strand; PAM type: YTN; PAM sequence: TTA
tttgtgtttcttatagatgc

SEQ ID NO: 69435 - DNA, 20 bp, Artificial Sequence
  Description of Artificial Sequence: Synthetic oligonucleotide
  Target: SCN10A; (+) strand; PAM type: YTN; PAM sequence: TTT
gtgtttcttatagatgctgg

SEQ ID NO: 69436 - DNA, 20 bp, Artificial Sequence
  Description of Artificial Sequence: Synthetic oligonucleotide
  Target: SCN10A; (+) strand; PAM type: YTN; PAM sequence: TTG
tgtttcttatagatgctgga

SEQ ID NO: 69437 - DNA, 20 bp, Artificial Sequence
  Description of Artificial Sequence: Synthetic oligonucleotide
  Target: SCN10A; (+) strand; PAM type: YTN; PAM sequence: TTT
cttatagatgctggatatta

SEQ ID NO: 69438 - DNA, 20 bp, Artificial Sequence
  Description of Artificial Sequence: Synthetic oligonucleotide
  Target: SCN10A; (+) strand; PAM type: YTN; PAM sequence: TTC
ttatagatgctggatattag

SEQ ID NO: 69439 - DNA, 20 bp, Artificial Sequence
  Description of Artificial Sequence: Synthetic oligonucleotide
  Target: SCN10A; (+) strand; PAM type: YTN; PAM sequence: CTT
atagatgctggatattagtc

SEQ ID NO: 69440 - DNA, 20 bp, Artificial Sequence
  Description of Artificial Sequence: Synthetic oligonucleotide
  Target: SCN10A; (+) strand; PAM type: YTN; PAM sequence: TTA
tagatgctggatattagtct

SEQ ID NO: 69441 - DNA, 20 bp, Artificial Sequence
  Description of Artificial Sequence: Synthetic oligonucleotide
  Target: SCN10A; (+) strand; PAM type: YTN; PAM sequence: CTG
gatattagtcttttgctgga

SEQ ID NO: 69442 - DNA, 20 bp, Artificial Sequence
  Description of Artificial Sequence: Synthetic oligonucleotide
  Target: SCN10A; (+) strand; PAM type: YTN; PAM sequence: TTA
gtcttttgctggaagcatag

SEQ ID NO: 69443 - DNA, 20 bp, Artificial Sequence
  Description of Artificial Sequence: Synthetic oligonucleotide
  Target: SCN10A; (+) strand; PAM type: YTN; PAM sequence: CTT
ttgctggaagcatagataac

SEQ ID NO: 69444 - DNA, 20 bp, Artificial Sequence
  Description of Artificial Sequence: Synthetic oligonucleotide
  Target: SCN10A; (+) strand; PAM type: YTN; PAM sequence: TTT
tgctggaagcatagataaca

SEQ ID NO: 69445 - DNA, 20 bp, Artificial Sequence
  Description of Artificial Sequence: Synthetic oligonucleotide
  Target: SCN10A; (+) strand; PAM type: YTN; PAM sequence: TTT
gctggaagcatagataacaa

SEQ ID NO: 69446 - DNA, 20 bp, Artificial Sequence
  Description of Artificial Sequence: Synthetic oligonucleotide
  Target: SCN10A; (+) strand; PAM type: YTN; PAM sequence: TTG
ctggaagcatagataacaaa

SEQ ID NO: 69447 - DNA, 20 bp, Artificial Sequence
  Description of Artificial Sequence: Synthetic oligonucleotide
  Target: SCN10A; (+) strand; PAM type: YTN; PAM sequence: CTG
gaagcatagataacaaagat

SEQ ID NO: 69448 - DNA, 20 bp, Artificial Sequence
  Description of Artificial Sequence: Synthetic oligonucleotide
  Target: SCN10A; (+) strand; PAM type: YTN; PAM sequence: TTT
ttctctcatcctatgggttg

SEQ ID NO: 69449 - DNA, 20 bp, Artificial Sequence
  Description of Artificial Sequence: Synthetic oligonucleotide
  Target: SCN10A; (+) strand; PAM type: YTN; PAM sequence: TTT
tctctcatcctatgggttgt

SEQ ID NO: 69450 - DNA, 20 bp, Artificial Sequence
  Description of Artificial Sequence: Synthetic oligonucleotide
  Target: SCN10A; (+) strand; PAM type: YTN; PAM sequence: TTT
ctctcatcctatgggttgtc

SEQ ID NO: 69451 - DNA, 20 bp, Artificial Sequence
  Description of Artificial Sequence: Synthetic oligonucleotide
  Target: SCN10A; (+) strand; PAM type: YTN; PAM sequence: TTC
tctcatcctatgggttgtct

SEQ ID NO: 69452 - DNA, 20 bp, Artificial Sequence
  Description of Artificial Sequence: Synthetic oligonucleotide
  Target: SCN10A; (+) strand; PAM type: YTN; PAM sequence: CTC
tcatcctatgggttgtctgt

SEQ ID NO: 69453 - DNA, 20 bp, Artificial Sequence
  Description of Artificial Sequence: Synthetic oligonucleotide
  Target: SCN10A; (+) strand; PAM type: YTN; PAM sequence: CTC
atcctatgggttgtctgttt

SEQ ID NO: 69454 - DNA, 20 bp, Artificial Sequence
  Description of Artificial Sequence: Synthetic oligonucleotide
  Target: SCN10A; (+) strand; PAM type: YTN; PAM sequence: CTA
tgggttgtctgtttacttgg

SEQ ID NO: 69455 - DNA, 20 bp, Artificial Sequence
  Description of Artificial Sequence: Synthetic oligonucleotide
  Target: SCN10A; (+) strand; PAM type: YTN; PAM sequence: TTG
tctgtttacttggatgatta

SEQ ID NO: 69456 - DNA, 20 bp, Artificial Sequence
  Description of Artificial Sequence: Synthetic oligonucleotide
  Target: SCN10A; (+) strand; PAM type: YTN; PAM sequence: CTG
tttacttggatgattatttc

SEQ ID NO: 69457 - DNA, 20 bp, Artificial Sequence
  Description of Artificial Sequence: Synthetic oligonucleotide
  Target: SCN10A; (+) strand; PAM type: YTN; PAM sequence: TTT
acttggatgattatttctct

SEQ ID NO: 69458 - DNA, 20 bp, Artificial Sequence
  Description of Artificial Sequence: Synthetic oligonucleotide
  Target: SCN10A; (+) strand; PAM type: YTN; PAM sequence: TTA
cttggatgattatttctctt

SEQ ID NO: 69459 - DNA, 20 bp, Artificial Sequence
  Description of Artificial Sequence: Synthetic oligonucleotide
  Target: SCN10A; (+) strand; PAM type: YTN; PAM sequence: CTT
ggatgattatttctcttgct

SEQ ID NO: 69460 - DNA, 20 bp, Artificial Sequence
  Description of Artificial Sequence: Synthetic oligonucleotide
  Target: SCN10A; (+) strand; PAM type: YTN; PAM sequence: TTG
gatgattatttctcttgctg

SEQ ID NO: 69461 - DNA, 20 bp, Artificial Sequence
  Description of Artificial Sequence: Synthetic oligonucleotide
  Target: SCN10A; (+) strand; PAM type: YTN; PAM sequence: TTA
tttctcttgctgtgcaacag

SEQ ID NO: 69462 - DNA, 20 bp, Artificial Sequence
  Description of Artificial Sequence: Synthetic oligonucleotide
  Target: SCN10A; (+) strand; PAM type: YTN; PAM sequence: TTT
ctcttgctgtgcaacagctt

SEQ ID NO: 69463 - DNA, 20 bp, Artificial Sequence
  Description of Artificial Sequence: Synthetic oligonucleotide
  Target: SCN10A; (+) strand; PAM type: YTN; PAM sequence: TTC
tcttgctgtgcaacagcttt

SEQ ID NO: 69464 - DNA, 20 bp, Artificial Sequence
  Description of Artificial Sequence: Synthetic oligonucleotide
  Target: SCN10A; (+) strand; PAM type: YTN; PAM sequence: CTC
ttgctgtgcaacagcttttt

SEQ ID NO: 69465 - DNA, 20 bp, Artificial Sequence
  Description of Artificial Sequence: Synthetic oligonucleotide
  Target: SCN10A; (+) strand; PAM type: YTN; PAM sequence: CTT
gctgtgcaacagctttttag

SEQ ID NO: 69466 - DNA, 20 bp, Artificial Sequence
  Description of Artificial Sequence: Synthetic oligonucleotide
  Target: SCN10A; (+) strand; PAM type: YTN; PAM sequence: TTG
ctgtgcaacagctttttagt

SEQ ID NO: 69467 - DNA, 20 bp, Artificial Sequence
  Description of Artificial Sequence: Synthetic oligonucleotide
  Target: SCN10A; (+) strand; PAM type: YTN; PAM sequence: CTG
tgcaacagctttttagttta

SEQ ID NO: 69468 - DNA, 20 bp, Artificial Sequence
  Description of Artificial Sequence: Synthetic oligonucleotide
  Target: SCN10A; (+) strand; PAM type: YTN; PAM sequence: CTT
tttagtttaattagatccca

SEQ ID NO: 69469 - DNA, 20 bp, Artificial Sequence
  Description of Artificial Sequence: Synthetic oligonucleotide
  Target: SCN10A; (+) strand; PAM type: YTN; PAM sequence: TTT
ttagtttaattagatcccat

SEQ ID NO: 69470 - DNA, 20 bp, Artificial Sequence
  Description of Artificial Sequence: Synthetic oligonucleotide
  Target: SCN10A; (+) strand; PAM type: YTN; PAM sequence: TTT
tagtttaattagatcccatc

SEQ ID NO: 69471 - DNA, 20 bp, Artificial Sequence
  Description of Artificial Sequence: Synthetic oligonucleotide
  Target: SCN10A; (+) strand; PAM type: YTN; PAM sequence: TTT
agtttaattagatcccatct

SEQ ID NO: 69472 - DNA, 20 bp, Artificial Sequence
  Description of Artificial Sequence: Synthetic oligonucleotide
  Target: SCN10A; (+) strand; PAM type: YTN; PAM sequence: TTA
gtttaattagatcccatcta

SEQ ID NO: 69473 - DNA, 20 bp, Artificial Sequence
  Description of Artificial Sequence: Synthetic oligonucleotide
  Target: SCN10A; (+) strand; PAM type: YTN; PAM sequence: TTT
aattagatcccatctattta

SEQ ID NO: 69474 - DNA, 20 bp, Artificial Sequence
  Description of Artificial Sequence: Synthetic oligonucleotide
  Target: SCN10A; (+) strand; PAM type: YTN; PAM sequence: TTA
attagatcccatctatttat

SEQ ID NO: 69475 - DNA, 20 bp, Artificial Sequence
  Description of Artificial Sequence: Synthetic oligonucleotide
  Target: SCN10A; (+) strand; PAM type: YTN; PAM sequence: TTA
gatcccatctatttattttt

SEQ ID NO: 69476 - DNA, 20 bp, Artificial Sequence
  Description of Artificial Sequence: Synthetic oligonucleotide
  Target: SCN10A; (+) strand; PAM type: YTN; PAM sequence: CTA
tttatttttgtttttgttgg

SEQ ID NO: 69477 - DNA, 20 bp, Artificial Sequence
  Description of Artificial Sequence: Synthetic oligonucleotide
  Target: SCN10A; (+) strand; PAM type: YTN; PAM sequence: TTT
atttttgtttttgttggatt

SEQ ID NO: 69478 - DNA, 20 bp, Artificial Sequence
  Description of Artificial Sequence: Synthetic oligonucleotide
  Target: SCN10A; (+) strand; PAM type: YTN; PAM sequence: TTA
tttttgtttttgttggattt

SEQ ID NO: 69479 - DNA, 20 bp, Artificial Sequence
  Description of Artificial Sequence: Synthetic oligonucleotide
  Target: SCN10A; (+) strand; PAM type: YTN; PAM sequence: TTT
ttgtttttgttggatttgct

SEQ ID NO: 69480 - DNA, 20 bp, Artificial Sequence
  Description of Artificial Sequence: Synthetic oligonucleotide
  Target: SCN10A; (+) strand; PAM type: YTN; PAM sequence: TTT
tgtttttgttggatttgctt

SEQ ID NO: 69481 - DNA, 20 bp, Artificial Sequence
  Description of Artificial Sequence: Synthetic oligonucleotide
  Target: SCN10A; (+) strand; PAM type: YTN; PAM sequence: TTT
gtttttgttggatttgcttt

SEQ ID NO: 69482 - DNA, 20 bp, Artificial Sequence
  Description of Artificial Sequence: Synthetic oligonucleotide
  Target: SCN10A; (+) strand; PAM type: YTN; PAM sequence: TTG
tttttgttggatttgctttg

SEQ ID NO: 69483 - DNA, 20 bp, Artificial Sequence
  Description of Artificial Sequence: Synthetic oligonucleotide
  Target: SCN10A; (+) strand; PAM type: YTN; PAM sequence: TTT
ttgttggatttgctttgggt

SEQ ID NO: 69484 - DNA, 20 bp, Artificial Sequence
  Description of Artificial Sequence: Synthetic oligonucleotide
  Target: SCN10A; (+) strand; PAM type: YTN; PAM sequence: TTT
tgttggatttgctttgggtc

SEQ ID NO: 69485 - DNA, 20 bp, Artificial Sequence
  Description of Artificial Sequence: Synthetic oligonucleotide
  Target: SCN10A; (+) strand; PAM type: YTN; PAM sequence: TTT
gttggatttgctttgggtcc

SEQ ID NO: 69486 - DNA, 20 bp, Artificial Sequence
  Description of Artificial Sequence: Synthetic oligonucleotide
  Target: SCN10A; (+) strand; PAM type: YTN; PAM sequence: TTG
ttggatttgctttgggtcct

SEQ ID NO: 69487 - DNA, 20 bp, Artificial Sequence
  Description of Artificial Sequence: Synthetic oligonucleotide
  Target: SCN10A; (+) strand; PAM type: YTN; PAM sequence: TTG
gatttgctttgggtccttgg

SEQ ID NO: 69488 - DNA, 20 bp, Artificial Sequence
  Description of Artificial Sequence: Synthetic oligonucleotide
  Target: SCN10A; (+) strand; PAM type: YTN; PAM sequence: TTT
gctttgggtccttggtcagg

SEQ ID NO: 69489 - DNA, 20 bp, Artificial Sequence
  Description of Artificial Sequence: Synthetic oligonucleotide
  Target: SCN10A; (+) strand; PAM type: YTN; PAM sequence: TTG
ctttgggtccttggtcagga

SEQ ID NO: 69490 - DNA, 20 bp, Artificial Sequence
  Description of Artificial Sequence: Synthetic oligonucleotide
  Target: SCN10A; (+) strand; PAM type: YTN; PAM sequence: CTT
tgggtccttggtcaggaacg

SEQ ID NO: 69491 - DNA, 20 bp, Artificial Sequence
  Description of Artificial Sequence: Synthetic oligonucleotide
  Target: SCN10A; (+) strand; PAM type: YTN; PAM sequence: TTT
gggtccttggtcaggaacgt

SEQ ID NO: 69492 - DNA, 20 bp, Artificial Sequence
  Description of Artificial Sequence: Synthetic oligonucleotide
  Target: SCN10A; (+) strand; PAM type: YTN; PAM sequence: TTG
ggtccttggtcaggaacgtt

SEQ ID NO: 69493 - DNA, 20 bp, Artificial Sequence
  Description of Artificial Sequence: Synthetic oligonucleotide
  Target: SCN10A; (+) strand; PAM type: YTN; PAM sequence: CTT
ggtcaggaacgttttgccta

SEQ ID NO: 69494 - DNA, 20 bp, Artificial Sequence
  Description of Artificial Sequence: Synthetic oligonucleotide
  Target: SCN10A; (+) strand; PAM type: YTN; PAM sequence: TTG
gtcaggaacgttttgcctaa

SEQ ID NO: 69495 - DNA, 20 bp, Artificial Sequence
  Description of Artificial Sequence: Synthetic oligonucleotide
  Target: SCN10A; (+) strand; PAM type: YTN; PAM sequence: TTT
tgcctaagccaatgtctaga

SEQ ID NO: 69496 - DNA, 20 bp, Artificial Sequence
  Description of Artificial Sequence: Synthetic oligonucleotide
  Target: SCN10A; (+) strand; PAM type: YTN; PAM sequence: TTT
gcctaagccaatgtctagaa

SEQ ID NO: 69497 - DNA, 20 bp, Artificial Sequence
  Description of Artificial Sequence: Synthetic oligonucleotide
  Target: SCN10A; (+) strand; PAM type: YTN; PAM sequence: TTG
cctaagccaatgtctagaag

SEQ ID NO: 69498 - DNA, 20 bp, Artificial Sequence
  Description of Artificial Sequence: Synthetic oligonucleotide
  Target: SCN10A; (+) strand; PAM type: YTN; PAM sequence: CTA
agccaatgtctagaagagtt

SEQ ID NO: 69499 - DNA, 20 bp, Artificial Sequence
  Description of Artificial Sequence: Synthetic oligonucleotide
  Target: SCN10A; (+) strand; PAM type: YTN; PAM sequence: CTA
gaagagtttttccaatgtta

SEQ ID NO: 69500 - DNA, 20 bp, Artificial Sequence
  Description of Artificial Sequence: Synthetic oligonucleotide
  Target: SCN10A; (+) strand; PAM type: YTN; PAM sequence: TTT
ttccaatgttatcttctaga

SEQ ID NO: 69501 - DNA, 20 bp, Artificial Sequence
  Description of Artificial Sequence: Synthetic oligonucleotide
  Target: SCN10A; (+) strand; PAM type: YTN; PAM sequence: TTT
tccaatgttatcttctagaa

SEQ ID NO: 69502 - DNA, 20 bp, Artificial Sequence
  Description of Artificial Sequence: Synthetic oligonucleotide
  Target: SCN10A; (+) strand; PAM type: YTN; PAM sequence: TTT
ccaatgttatcttctagaat

SEQ ID NO: 69503 - DNA, 20 bp, Artificial Sequence
  Description of Artificial Sequence: Synthetic oligonucleotide
  Target: SCN10A; (+) strand; PAM type: YTN; PAM sequence: TTC
caatgttatcttctagaatt

SEQ ID NO: 69504 - DNA, 20 bp, Artificial Sequence
  Description of Artificial Sequence: Synthetic oligonucleotide
  Target: SCN10A; (+) strand; PAM type: YTN; PAM sequence: TTA
tcttctagaattttttataa

SEQ ID NO: 69505 - DNA, 20 bp, Artificial Sequence
  Description of Artificial Sequence: Synthetic oligonucleotide
  Target: SCN10A; (+) strand; PAM type: YTN; PAM sequence: CTT
ctagaattttttataatttc

SEQ ID NO: 69506 - DNA, 20 bp, Artificial Sequence
  Description of Artificial Sequence: Synthetic oligonucleotide
  Target: SCN10A; (+) strand; PAM type: YTN; PAM sequence: TTC
tagaattttttataatttca

SEQ ID NO: 69507 - DNA, 20 bp, Artificial Sequence
  Description of Artificial Sequence: Synthetic oligonucleotide
  Target: SCN10A; (+) strand; PAM type: YTN; PAM sequence: CTA
gaattttttataatttcagg

SEQ ID NO: 69508 - DNA, 20 bp, Artificial Sequence
  Description of Artificial Sequence: Synthetic oligonucleotide
  Target: SCN10A; (+) strand; PAM type: YTN; PAM sequence: TTT
tttataatttcaggtcttag

SEQ ID NO: 69509 - DNA, 20 bp, Artificial Sequence
  Description of Artificial Sequence: Synthetic oligonucleotide
  Target: SCN10A; (+) strand; PAM type: YTN; PAM sequence: TTT
ttataatttcaggtcttaga

SEQ ID NO: 69510 - DNA, 20 bp, Artificial Sequence
  Description of Artificial Sequence: Synthetic oligonucleotide
  Target: SCN10A; (+) strand; PAM type: YTN; PAM sequence: TTT
tataatttcaggtcttagat

SEQ ID NO: 69511 - DNA, 20 bp, Artificial Sequence
  Description of Artificial Sequence: Synthetic oligonucleotide
  Target: SCN10A; (+) strand; PAM type: YTN; PAM sequence: TTT
ataatttcaggtcttagatt

SEQ ID NO: 69512 - DNA, 20 bp, Artificial Sequence
  Description of Artificial Sequence: Synthetic oligonucleotide
  Target: SCN10A; (+) strand; PAM type: YTN; PAM sequence: TTA
taatttcaggtcttagattt

SEQ ID NO: 69513 - DNA, 20 bp, Artificial Sequence
  Description of Artificial Sequence: Synthetic oligonucleotide
  Target: SCN10A; (+) strand; PAM type: YTN; PAM sequence: TTT
caggtcttagatttaagcct

SEQ ID NO: 69514 - DNA, 20 bp, Artificial Sequence
  Description of Artificial Sequence: Synthetic oligonucleotide
  Target: SCN10A; (+) strand; PAM type: YTN; PAM sequence: TTC
aggtcttagatttaagcctt

SEQ ID NO: 69515 - DNA, 20 bp, Artificial Sequence
  Description of Artificial Sequence: Synthetic oligonucleotide
  Target: SCN10A; (+) strand; PAM type: YTN; PAM sequence: CTT
agatttaagccttttatcca

SEQ ID NO: 69516 - DNA, 20 bp, Artificial Sequence
  Description of Artificial Sequence: Synthetic oligonucleotide
  Target: SCN10A; (+) strand; PAM type: YTN; PAM sequence: TTA
gatttaagccttttatccat

SEQ ID NO: 69517 - DNA, 20 bp, Artificial Sequence
  Description of Artificial Sequence: Synthetic oligonucleotide
  Target: SCN10A; (+) strand; PAM type: YTN; PAM sequence: TTT
aagccttttatccatcttga

SEQ ID NO: 69518 - DNA, 20 bp, Artificial Sequence
  Description of Artificial Sequence: Synthetic oligonucleotide
  Target: SCN10A; (+) strand; PAM type: YTN; PAM sequence: TTA
agccttttatccatcttgaa

SEQ ID NO: 69519 - DNA, 20 bp, Artificial Sequence
  Description of Artificial Sequence: Synthetic oligonucleotide
  Target: SCN10A; (+) strand; PAM type: YTN; PAM sequence: CTT
ttatccatcttgaattgatt

SEQ ID NO: 69520 - DNA, 20 bp, Artificial Sequence
  Description of Artificial Sequence: Synthetic oligonucleotide
  Target: SCN10A; (+) strand; PAM type: YTN; PAM sequence: TTT
tatccatcttgaattgattt

SEQ ID NO: 69521 - DNA, 20 bp, Artificial Sequence
  Description of Artificial Sequence: Synthetic oligonucleotide
  Target: SCN10A; (+) strand; PAM type: YTN; PAM sequence: TTT
atccatcttgaattgatttt

SEQ ID NO: 69522 - DNA, 20 bp, Artificial Sequence
  Description of Artificial Sequence: Synthetic oligonucleotide
  Target: SCN10A; (+) strand; PAM type: YTN; PAM sequence: TTA
tccatcttgaattgattttt

SEQ ID NO: 69523 - DNA, 20 bp, Artificial Sequence
  Description of Artificial Sequence: Synthetic oligonucleotide
  Target: SCN10A; (+) strand; PAM type: YTN; PAM sequence: CTT
gaattgatttttgtataagg

SEQ ID NO: 69524 - DNA, 20 bp, Artificial Sequence
  Description of Artificial Sequence: Synthetic oligonucleotide
  Target: SCN10A; (+) strand; PAM type: YTN; PAM sequence: TTG
aattgatttttgtataaggt

SEQ ID NO: 69525 - DNA, 20 bp, Artificial Sequence
  Description of Artificial Sequence: Synthetic oligonucleotide
  Target: SCN10A; (+) strand; PAM type: YTN; PAM sequence: TTG
atttttgtataaggtgagag

SEQ ID NO: 69526 - DNA, 20 bp, Artificial Sequence
  Description of Artificial Sequence: Synthetic oligonucleotide
  Target: SCN10A; (+) strand; PAM type: YTN; PAM sequence: TTT
ttgtataaggtgagagatga

SEQ ID NO: 69527 - DNA, 20 bp, Artificial Sequence
  Description of Artificial Sequence: Synthetic oligonucleotide
  Target: SCN10A; (+) strand; PAM type: YTN; PAM sequence: TTT
tgtataaggtgagagatgaa

SEQ ID NO: 69528 - DNA, 20 bp, Artificial Sequence
  Description of Artificial Sequence: Synthetic oligonucleotide
  Target: SCN10A; (+) strand; PAM type: YTN; PAM sequence: TTT
gtataaggtgagagatgaag

SEQ ID NO: 69529 - DNA, 20 bp, Artificial Sequence
  Description of Artificial Sequence: Synthetic oligonucleotide
  Target: SCN10A; (+) strand; PAM type: YTN; PAM sequence: TTG
tataaggtgagagatgaaga

SEQ ID NO: 69530 - DNA, 20 bp, Artificial Sequence
  Description of Artificial Sequence: Synthetic oligonucleotide
  Target: SCN10A; (+) strand; PAM type: YTN; PAM sequence: TTC
agtttctttcttccacatgt

SEQ ID NO: 69531 - DNA, 20 bp, Artificial Sequence
  Description of Artificial Sequence: Synthetic oligonucleotide
  Target: SCN10A; (+) strand; PAM type: YTN; PAM sequence: TTT
ctttcttccacatgtggctt

SEQ ID NO: 69532 - DNA, 20 bp, Artificial Sequence
  Description of Artificial Sequence: Synthetic oligonucleotide
  Target: SCN10A; (+) strand; PAM type: YTN; PAM sequence: TTC
tttcttccacatgtggcttg

SEQ ID NO: 69533 - DNA, 20 bp, Artificial Sequence
  Description of Artificial Sequence: Synthetic oligonucleotide
  Target: SCN10A; (+) strand; PAM type: YTN; PAM sequence: CTT
tcttccacatgtggcttgct

SEQ ID NO: 69534 - DNA, 20 bp, Artificial Sequence
  Description of Artificial Sequence: Synthetic oligonucleotide
  Target: SCN10A; (+) strand; PAM type: YTN; PAM sequence: TTT
cttccacatgtggcttgcta

SEQ ID NO: 69535 - DNA, 20 bp, Artificial Sequence
  Description of Artificial Sequence: Synthetic oligonucleotide
  Target: SCN10A; (+) strand; PAM type: YTN; PAM sequence: TTC
ttccacatgtggcttgctaa

SEQ ID NO: 69536 - DNA, 20 bp, Artificial Sequence
  Description of Artificial Sequence: Synthetic oligonucleotide
  Target: SCN10A; (+) strand; PAM type: YTN; PAM sequence: CTT
ccacatgtggcttgctaatt

SEQ ID NO: 69537 - DNA, 20 bp, Artificial Sequence
  Description of Artificial Sequence: Synthetic oligonucleotide
  Target: SCN10A; (+) strand; PAM type: YTN; PAM sequence: TTC
cacatgtggcttgctaatta

SEQ ID NO: 69538 - DNA, 20 bp, Artificial Sequence
  Description of Artificial Sequence: Synthetic oligonucleotide
  Target: SCN10A; (+) strand; PAM type: YTN; PAM sequence: CTT
gctaattatcccagcaccat

SEQ ID NO: 69539 - DNA, 20 bp, Artificial Sequence
  Description of Artificial Sequence: Synthetic oligonucleotide
  Target: SCN10A; (+) strand; PAM type: YTN; PAM sequence: TTG
ctaattatcccagcaccatt

SEQ ID NO: 69540 - DNA, 20 bp, Artificial Sequence
  Description of Artificial Sequence: Synthetic oligonucleotide
  Target: SCN10A; (+) strand; PAM type: YTN; PAM sequence: CTA
attatcccagcaccatttgt

SEQ ID NO: 69541 - DNA, 20 bp, Artificial Sequence
  Description of Artificial Sequence: Synthetic oligonucleotide
  Target: SCN10A; (+) strand; PAM type: YTN; PAM sequence: TTA
tcccagcaccatttgttgaa

SEQ ID NO: 69542 - DNA, 20 bp, Artificial Sequence
  Description of Artificial Sequence: Synthetic oligonucleotide
  Target: SCN10A; (+) strand; PAM type: YTN; PAM sequence: TTT
gttgaatagggtgtcctttc

SEQ ID NO: 69543 - DNA, 20 bp, Artificial Sequence
  Description of Artificial Sequence: Synthetic oligonucleotide
  Target: SCN10A; (+) strand; PAM type: YTN; PAM sequence: TTG
ttgaatagggtgtcctttcc

SEQ ID NO: 69544 - DNA, 20 bp, Artificial Sequence
  Description of Artificial Sequence: Synthetic oligonucleotide
  Target: SCN10A; (+) strand; PAM type: YTN; PAM sequence: TTG
aatagggtgtcctttcccca

SEQ ID NO: 69545 - DNA, 20 bp, Artificial Sequence
  Description of Artificial Sequence: Synthetic oligonucleotide
  Target: SCN10A; (+) strand; PAM type: YTN; PAM sequence: CTT
tccccacttacgtttttgtt

SEQ ID NO: 69546 - DNA, 20 bp, Artificial Sequence
  Description of Artificial Sequence: Synthetic oligonucleotide
  Target: SCN10A; (+) strand; PAM type: YTN; PAM sequence: TTT
ccccacttacgtttttgttt

SEQ ID NO: 69547 - DNA, 20 bp, Artificial Sequence
  Description of Artificial Sequence: Synthetic oligonucleotide
  Target: SCN10A; (+) strand; PAM type: YTN; PAM sequence: TTC
cccacttacgtttttgtttg

SEQ ID NO: 69548 - DNA, 20 bp, Artificial Sequence
  Description of Artificial Sequence: Synthetic oligonucleotide
  Target: SCN10A; (+) strand; PAM type: YTN; PAM sequence: CTT
acgtttttgtttgctttttc

SEQ ID NO: 69549 - DNA, 20 bp, Artificial Sequence
  Description of Artificial Sequence: Synthetic oligonucleotide
  Target: SCN10A; (+) strand; PAM type: YTN; PAM sequence: TTA
cgtttttgtttgctttttca

SEQ ID NO: 69550 - DNA, 20 bp, Artificial Sequence
  Description of Artificial Sequence: Synthetic oligonucleotide
  Target: SCN10A; (+) strand; PAM type: YTN; PAM sequence: TTT
ttgtttgctttttcaaagat

SEQ ID NO: 69551 - DNA, 20 bp, Artificial Sequence
  Description of Artificial Sequence: Synthetic oligonucleotide
  Target: SCN10A; (+) strand; PAM type: YTN; PAM sequence: TTT
tgtttgctttttcaaagatc

SEQ ID NO: 69552 - DNA, 20 bp, Artificial Sequence
  Description of Artificial Sequence: Synthetic oligonucleotide
  Target: SCN10A; (+) strand; PAM type: YTN; PAM sequence: TTT
gtttgctttttcaaagatca

SEQ ID NO: 69553 - DNA, 20 bp, Artificial Sequence
  Description of Artificial Sequence: Synthetic oligonucleotide
  Target: SCN10A; (+) strand; PAM type: YTN; PAM sequence: TTG
tttgctttttcaaagatcag

SEQ ID NO: 69554 - DNA, 20 bp, Artificial Sequence
  Description of Artificial Sequence: Synthetic oligonucleotide
  Target: SCN10A; (+) strand; PAM type: YTN; PAM sequence: TTT
gctttttcaaagatcagttg

SEQ ID NO: 69555 - DNA, 20 bp, Artificial Sequence
  Description of Artificial Sequence: Synthetic oligonucleotide
  Target: SCN10A; (+) strand; PAM type: YTN; PAM sequence: TTG
ctttttcaaagatcagttgc

SEQ ID NO: 69556 - DNA, 20 bp, Artificial Sequence
  Description of Artificial Sequence: Synthetic oligonucleotide
  Target: SCN10A; (+) strand; PAM type: YTN; PAM sequence: CTT
tttcaaagatcagttgcttg

SEQ ID NO: 69557 - DNA, 20 bp, Artificial Sequence
  Description of Artificial Sequence: Synthetic oligonucleotide
  Target: SCN10A; (+) strand; PAM type: YTN; PAM sequence: TTT
ttcaaagatcagttgcttgt

SEQ ID NO: 69558 - DNA, 20 bp, Artificial Sequence
  Description of Artificial Sequence: Synthetic oligonucleotide
  Target: SCN10A; (+) strand; PAM type: YTN; PAM sequence: TTT
tcaaagatcagttgcttgta

SEQ ID NO: 69559 - DNA, 20 bp, Artificial Sequence
  Description of Artificial Sequence: Synthetic oligonucleotide
  Target: SCN10A; (+) strand; PAM type: YTN; PAM sequence: TTT
caaagatcagttgcttgtaa

SEQ ID NO: 69560 - DNA, 20 bp, Artificial Sequence
  Description of Artificial Sequence: Synthetic oligonucleotide
  Target: SCN10A; (+) strand; PAM type: YTN; PAM sequence: TTC
aaagatcagttgcttgtaag

SEQ ID NO: 69561 - DNA, 20 bp, Artificial Sequence
  Description of Artificial Sequence: Synthetic oligonucleotide
  Target: SCN10A; (+) strand; PAM type: YTN; PAM sequence: TTG
cttgtaagtatttggcttta

SEQ ID NO: 69562 - DNA, 20 bp, Artificial Sequence
  Description of Artificial Sequence: Synthetic oligonucleotide
  Target: SCN10A; (+) strand; PAM type: YTN; PAM sequence: CTT
gtaagtatttggctttattt

SEQ ID NO: 69563 - DNA, 20 bp, Artificial Sequence
  Description of Artificial Sequence: Synthetic oligonucleotide
  Target: SCN10A; (+) strand; PAM type: YTN; PAM sequence: TTG
taagtatttggctttatttc

SEQ ID NO: 69564 - DNA, 20 bp, Artificial Sequence
  Description of Artificial Sequence: Synthetic oligonucleotide
  Target: SCN10A; (+) strand; PAM type: YTN; PAM sequence: TTT
ggctttatttctgagttctc

SEQ ID NO: 69565 - DNA, 20 bp, Artificial Sequence
  Description of Artificial Sequence: Synthetic oligonucleotide
  Target: SCN10A; (+) strand; PAM type: YTN; PAM sequence: TTG
gctttatttctgagttctct

SEQ ID NO: 69566 - DNA, 20 bp, Artificial Sequence
  Description of Artificial Sequence: Synthetic oligonucleotide
  Target: SCN10A; (+) strand; PAM type: YTN; PAM sequence: CTT
tatttctgagttctctattc

SEQ ID NO: 69567 - DNA, 20 bp, Artificial Sequence
  Description of Artificial Sequence: Synthetic oligonucleotide
  Target: SCN10A; (+) strand; PAM type: YTN; PAM sequence: TTT
atttctgagttctctattct

SEQ ID NO: 69568 - DNA, 20 bp, Artificial Sequence
  Description of Artificial Sequence: Synthetic oligonucleotide
  Target: SCN10A; (+) strand; PAM type: YTN; PAM sequence: TTA
tttctgagttctctattctt

SEQ ID NO: 69569 - DNA, 20 bp, Artificial Sequence
  Description of Artificial Sequence: Synthetic oligonucleotide
  Target: SCN10A; (+) strand; PAM type: YTN; PAM sequence: TTT
ctgagttctctattcttttc

SEQ ID NO: 69570 - DNA, 20 bp, Artificial Sequence
  Description of Artificial Sequence: Synthetic oligonucleotide
  Target: SCN10A; (+) strand; PAM type: YTN; PAM sequence: TTC
tgagttctctattcttttcc

SEQ ID NO: 69571 - DNA, 20 bp, Artificial Sequence
  Description of Artificial Sequence: Synthetic oligonucleotide
  Target: SCN10A; (+) strand; PAM type: YTN; PAM sequence: CTG
agttctctattcttttccat

SEQ ID NO: 69572 - DNA, 20 bp, Artificial Sequence
  Description of Artificial Sequence: Synthetic oligonucleotide
  Target: SCN10A; (+) strand; PAM type: YTN; PAM sequence: TTC
tctattcttttccattggtc

SEQ ID NO: 69573 - DNA, 20 bp, Artificial Sequence
  Description of Artificial Sequence: Synthetic oligonucleotide
  Target: SCN10A; (+) strand; PAM type: YTN; PAM sequence: CTC
tattcttttccattggtcta

SEQ ID NO: 69574 - DNA, 20 bp, Artificial Sequence
  Description of Artificial Sequence: Synthetic oligonucleotide
  Target: SCN10A; (+) strand; PAM type: YTN; PAM sequence: CTA
ttcttttccattggtctatg

SEQ ID NO: 69575 - DNA, 20 bp, Artificial Sequence
  Description of Artificial Sequence: Synthetic oligonucleotide
  Target: SCN10A; (+) strand; PAM type: YTN; PAM sequence: TTC
ttttccattggtctatgtgc

SEQ ID NO: 69576 - DNA, 20 bp, Artificial Sequence
  Description of Artificial Sequence: Synthetic oligonucleotide
  Target: SCN10A; (+) strand; PAM type: YTN; PAM sequence: CTT
ttccattggtctatgtgctt

SEQ ID NO: 69577 - DNA, 20 bp, Artificial Sequence
  Description of Artificial Sequence: Synthetic oligonucleotide
  Target: SCN10A; (+) strand; PAM type: YTN; PAM sequence: TTT
tccattggtctatgtgctta

SEQ ID NO: 69578 - DNA, 20 bp, Artificial Sequence
  Description of Artificial Sequence: Synthetic oligonucleotide
  Target: SCN10A; (+) strand; PAM type: YTN; PAM sequence: TTT
ccattggtctatgtgcttat

SEQ ID NO: 69579 - DNA, 20 bp, Artificial Sequence
  Description of Artificial Sequence: Synthetic oligonucleotide
  Target: SCN10A; (+) strand; PAM type: YTN; PAM sequence: TTC
cattggtctatgtgcttatt

SEQ ID NO: 69580 - DNA, 20 bp, Artificial Sequence
  Description of Artificial Sequence: Synthetic oligonucleotide
  Target: SCN10A; (+) strand; PAM type: YTN; PAM sequence: TTG
gtctatgtgcttatttttat

SEQ ID NO: 69581 - DNA, 20 bp, Artificial Sequence
  Description of Artificial Sequence: Synthetic oligonucleotide
  Target: SCN10A; (+) strand; PAM type: YTN; PAM sequence: CTA
tgtgcttatttttataccag

SEQ ID NO: 69582 - DNA, 20 bp, Artificial Sequence
  Description of Artificial Sequence: Synthetic oligonucleotide
  Target: SCN10A; (+) strand; PAM type: YTN; PAM sequence: CTT
atttttataccagtatcatg

SEQ ID NO: 69583 - DNA, 20 bp, Artificial Sequence
  Description of Artificial Sequence: Synthetic oligonucleotide
  Target: SCN10A; (+) strand; PAM type: YTN; PAM sequence: TTA
tttttataccagtatcatgc

SEQ ID NO: 69584 - DNA, 20 bp, Artificial Sequence
  Description of Artificial Sequence: Synthetic oligonucleotide
  Target: SCN10A; (+) strand; PAM type: YTN; PAM sequence: TTT
ttataccagtatcatgctgt

SEQ ID NO: 69585 - DNA, 20 bp, Artificial Sequence
  Description of Artificial Sequence: Synthetic oligonucleotide
  Target: SCN10A; (+) strand; PAM type: YTN; PAM sequence: TTT
tataccagtatcatgctgtt

SEQ ID NO: 69586 - DNA, 20 bp, Artificial Sequence
  Description of Artificial Sequence: Synthetic oligonucleotide
  Target: SCN10A; (+) strand; PAM type: YTN; PAM sequence: TTT
ataccagtatcatgctgttt

SEQ ID NO: 69587 - DNA, 20 bp, Artificial Sequence
  Description of Artificial Sequence: Synthetic oligonucleotide
  Target: SCN10A; (+) strand; PAM type: YTN; PAM sequence: TTA
taccagtatcatgctgtttt

SEQ ID NO: 69588 - DNA, 20 bp, Artificial Sequence
  Description of Artificial Sequence: Synthetic oligonucleotide
  Target: SCN10A; (+) strand; PAM type: YTN; PAM sequence: CTG
ttttggtacaggctatacta

SEQ ID NO: 69589 - DNA, 20 bp, Artificial Sequence
  Description of Artificial Sequence: Synthetic oligonucleotide
  Target: SCN10A; (+) strand; PAM type: YTN; PAM sequence: TTT
tggtacaggctatactatag

SEQ ID NO: 69590 - DNA, 20 bp, Artificial Sequence
  Description of Artificial Sequence: Synthetic oligonucleotide
  Target: SCN10A; (+) strand; PAM type: YTN; PAM sequence: TTT
ggtacaggctatactatagc

SEQ ID NO: 69591 - DNA, 20 bp, Artificial Sequence
  Description of Artificial Sequence: Synthetic oligonucleotide
  Target: SCN10A; (+) strand; PAM type: YTN; PAM sequence: TTG
gtacaggctatactatagcc

SEQ ID NO: 69592 - DNA, 20 bp, Artificial Sequence
  Description of Artificial Sequence: Synthetic oligonucleotide
  Target: SCN10A; (+) strand; PAM type: YTN; PAM sequence: CTA
tactatagccttgtagtata

SEQ ID NO: 69593 - DNA, 20 bp, Artificial Sequence
  Description of Artificial Sequence: Synthetic oligonucleotide
  Target: SCN10A; (+) strand; PAM type: YTN; PAM sequence: CTA
tagccttgtagtatagtttg

SEQ ID NO: 69594 - DNA, 20 bp, Artificial Sequence
  Description of Artificial Sequence: Synthetic oligonucleotide
  Target: SCN10A; (+) strand; PAM type: YTN; PAM sequence: CTT
gtagtatagtttgaaatcag

SEQ ID NO: 69595 - DNA, 20 bp, Artificial Sequence
  Description of Artificial Sequence: Synthetic oligonucleotide
  Target: SCN10A; (+) strand; PAM type: YTN; PAM sequence: TTG
tagtatagtttgaaatcagc

SEQ ID NO: 69596 - DNA, 20 bp, Artificial Sequence
  Description of Artificial Sequence: Synthetic oligonucleotide
  Target: SCN10A; (+) strand; PAM type: YTN; PAM sequence: TTT
gaaatcagctaaggtgatgc

SEQ ID NO: 69597 - DNA, 20 bp, Artificial Sequence
  Description of Artificial Sequence: Synthetic oligonucleotide
  Target: SCN10A; (+) strand; PAM type: YTN; PAM sequence: TTG
aaatcagctaaggtgatgcc

SEQ ID NO: 69598 - DNA, 20 bp, Artificial Sequence
  Description of Artificial Sequence: Synthetic oligonucleotide
  Target: SCN10A; (+) strand; PAM type: YTN; PAM sequence: CTA
aggtgatgcctccagatttg

SEQ ID NO: 69599 - DNA, 20 bp, Artificial Sequence
  Description of Artificial Sequence: Synthetic oligonucleotide
  Target: SCN10A; (+) strand; PAM type: YTN; PAM sequence: CTC
cagatttgttattcttgctt

SEQ ID NO: 69600 - DNA, 20 bp, Artificial Sequence
  Description of Artificial Sequence: Synthetic oligonucleotide
  Target: SCN10A; (+) strand; PAM type: YTN; PAM sequence: TTT
gttattcttgcttagtcttg

SEQ ID NO: 69601 - DNA, 20 bp, Artificial Sequence
  Description of Artificial Sequence: Synthetic oligonucleotide
  Target: SCN10A; (+) strand; PAM type: YTN; PAM sequence: TTG
ttattcttgcttagtcttgc

SEQ ID NO: 69602 - DNA, 20 bp, Artificial Sequence
  Description of Artificial Sequence: Synthetic oligonucleotide
  Target: SCN10A; (+) strand; PAM type: YTN; PAM sequence: TTA
ttcttgcttagtcttgcttt

SEQ ID NO: 69603 - DNA, 20 bp, Artificial Sequence
  Description of Artificial Sequence: Synthetic oligonucleotide
  Target: SCN10A; (+) strand; PAM type: YTN; PAM sequence: TTC
ttgcttagtcttgctttggc

SEQ ID NO: 69604 - DNA, 20 bp, Artificial Sequence
  Description of Artificial Sequence: Synthetic oligonucleotide
  Target: SCN10A; (+) strand; PAM type: YTN; PAM sequence: CTT
gcttagtcttgctttggcta

SEQ ID NO: 69605 - DNA, 20 bp, Artificial Sequence
  Description of Artificial Sequence: Synthetic oligonucleotide
  Target: SCN10A; (+) strand; PAM type: YTN; PAM sequence: TTG
cttagtcttgctttggctat

SEQ ID NO: 69606 - DNA, 20 bp, Artificial Sequence
  Description of Artificial Sequence: Synthetic oligonucleotide
  Target: SCN10A; (+) strand; PAM type: YTN; PAM sequence: CTT
agtcttgctttggctatgtg

SEQ ID NO: 69607 - DNA, 20 bp, Artificial Sequence
  Description of Artificial Sequence: Synthetic oligonucleotide
  Target: SCN10A; (+) strand; PAM type: YTN; PAM sequence: TTA
gtcttgctttggctatgtgg

SEQ ID NO: 69608 - DNA, 20 bp, Artificial Sequence
  Description of Artificial Sequence: Synthetic oligonucleotide
  Target: SCN10A; (+) strand; PAM type: YTN; PAM sequence: CTT
gctttggctatgtggattcc

SEQ ID NO: 69609 - DNA, 20 bp, Artificial Sequence
  Description of Artificial Sequence: Synthetic oligonucleotide
  Target: SCN10A; (+) strand; PAM type: YTN; PAM sequence: TTG
ctttggctatgtggattcct

SEQ ID NO: 69610 - DNA, 20 bp, Artificial Sequence
  Description of Artificial Sequence: Synthetic oligonucleotide
  Target: SCN10A; (+) strand; PAM type: YTN; PAM sequence: CTT
tggctatgtggattcctttt

SEQ ID NO: 69611 - DNA, 20 bp, Artificial Sequence
  Description of Artificial Sequence: Synthetic oligonucleotide
  Target: SCN10A; (+) strand; PAM type: YTN; PAM sequence: TTT
ggctatgtggattccttttt

SEQ ID NO: 69612 - DNA, 20 bp, Artificial Sequence
  Description of Artificial Sequence: Synthetic oligonucleotide
  Target: SCN10A; (+) strand; PAM type: YTN; PAM sequence: TTG
gctatgtggattcctttttg

SEQ ID NO: 69613 - DNA, 20 bp, Artificial Sequence
  Description of Artificial Sequence: Synthetic oligonucleotide
  Target: SCN10A; (+) strand; PAM type: YTN; PAM sequence: CTA
tgtggattcctttttggttc

SEQ ID NO: 69614 - DNA, 20 bp, Artificial Sequence
  Description of Artificial Sequence: Synthetic oligonucleotide
  Target: SCN10A; (+) strand; PAM type: YTN; PAM sequence: TTC
ctttttggttccctatgaat

SEQ ID NO: 69615 - DNA, 20 bp, Artificial Sequence
  Description of Artificial Sequence: Synthetic oligonucleotide
  Target: SCN10A; (+) strand; PAM type: YTN; PAM sequence: CTT
tttggttccctatgaatttt

SEQ ID NO: 69616 - DNA, 20 bp, Artificial Sequence
  Description of Artificial Sequence: Synthetic oligonucleotide
  Target: SCN10A; (+) strand; PAM type: YTN; PAM sequence: TTT
ttggttccctatgaatttta

SEQ ID NO: 69617 - DNA, 20 bp, Artificial Sequence
  Description of Artificial Sequence: Synthetic oligonucleotide
  Target: SCN10A; (+) strand; PAM type: YTN; PAM sequence: TTT
tggttccctatgaattttag

SEQ ID NO: 69618 - DNA, 20 bp, Artificial Sequence
  Description of Artificial Sequence: Synthetic oligonucleotide
  Target: SCN10A; (+) strand; PAM type: YTN; PAM sequence: TTT
ggttccctatgaattttagg

SEQ ID NO: 69619 - DNA, 20 bp, Artificial Sequence
  Description of Artificial Sequence: Synthetic oligonucleotide
  Target: SCN10A; (+) strand; PAM type: YTN; PAM sequence: TTG
gttccctatgaattttaggg

SEQ ID NO: 69620 - DNA, 20 bp, Artificial Sequence
  Description of Artificial Sequence: Synthetic oligonucleotide
  Target: SCN10A; (+) strand; PAM type: YTN; PAM sequence: TTC
cctatgaattttagggttgt

SEQ ID NO: 69621 - DNA, 20 bp, Artificial Sequence
  Description of Artificial Sequence: Synthetic oligonucleotide
  Target: SCN10A; (+) strand; PAM type: YTN; PAM sequence: CTA
tgaattttagggttgttatt

SEQ ID NO: 69622 - DNA, 20 bp, Artificial Sequence
  Description of Artificial Sequence: Synthetic oligonucleotide
  Target: SCN10A; (+) strand; PAM type: YTN; PAM sequence: TTT
tagggttgttatttctattt

SEQ ID NO: 69623 - DNA, 20 bp, Artificial Sequence
  Description of Artificial Sequence: Synthetic oligonucleotide
  Target: SCN10A; (+) strand; PAM type: YTN; PAM sequence: TTT
agggttgttatttctatttc

SEQ ID NO: 69624 - DNA, 20 bp, Artificial Sequence
  Description of Artificial Sequence: Synthetic oligonucleotide
  Target: SCN10A; (+) strand; PAM type: YTN; PAM sequence: TTA
gggttgttatttctatttct

SEQ ID NO: 69625 - DNA, 20 bp, Artificial Sequence
  Description of Artificial Sequence: Synthetic oligonucleotide
  Target: SCN10A; (+) strand; PAM type: YTN; PAM sequence: TTG
ttatttctatttctgtgaag

SEQ ID NO: 69626 - DNA, 20 bp, Artificial Sequence
  Description of Artificial Sequence: Synthetic oligonucleotide
  Target: SCN10A; (+) strand; PAM type: YTN; PAM sequence: TTA
tttctatttctgtgaagaat

SEQ ID NO: 69627 - DNA, 20 bp, Artificial Sequence
  Description of Artificial Sequence: Synthetic oligonucleotide
  Target: SCN10A; (+) strand; PAM type: YTN; PAM sequence: TTT
ctatttctgtgaagaatgat

SEQ ID NO: 69628 - DNA, 20 bp, Artificial Sequence
  Description of Artificial Sequence: Synthetic oligonucleotide
  Target: SCN10A; (+) strand; PAM type: YTN; PAM sequence: TTC
tatttctgtgaagaatgatg

SEQ ID NO: 69629 - DNA, 20 bp, Artificial Sequence
  Description of Artificial Sequence: Synthetic oligonucleotide
  Target: SCN10A; (+) strand; PAM type: YTN; PAM sequence: CTA
tttctgtgaagaatgatgtg

SEQ ID NO: 69630 - DNA, 20 bp, Artificial Sequence
  Description of Artificial Sequence: Synthetic oligonucleotide
  Target: SCN10A; (+) strand; PAM type: YTN; PAM sequence: TTT
ctgtgaagaatgatgtggta

SEQ ID NO: 69631 - DNA, 20 bp, Artificial Sequence
  Description of Artificial Sequence: Synthetic oligonucleotide
  Target: SCN10A; (+) strand; PAM type: YTN; PAM sequence: TTC
tgtgaagaatgatgtggtac

SEQ ID NO: 69632 - DNA, 20 bp, Artificial Sequence
  Description of Artificial Sequence: Synthetic oligonucleotide
  Target: SCN10A; (+) strand; PAM type: YTN; PAM sequence: CTG
tgaagaatgatgtggtactt

SEQ ID NO: 69633 - DNA, 20 bp, Artificial Sequence
  Description of Artificial Sequence: Synthetic oligonucleotide
  Target: SCN10A; (+) strand; PAM type: YTN; PAM sequence: CTT
caatggaaattgtattgaat

SEQ ID NO: 69634 - DNA, 20 bp, Artificial Sequence
  Description of Artificial Sequence: Synthetic oligonucleotide
  Target: SCN10A; (+) strand; PAM type: YTN; PAM sequence: TTC
aatggaaattgtattgaatc

SEQ ID NO: 69635 - DNA, 20 bp, Artificial Sequence
  Description of Artificial Sequence: Synthetic oligonucleotide
  Target: SCN10A; (+) strand; PAM type: YTN; PAM sequence: TTG
tattgaatctgtatattgct

SEQ ID NO: 69636 - DNA, 20 bp, Artificial Sequence
  Description of Artificial Sequence: Synthetic oligonucleotide
  Target: SCN10A; (+) strand; PAM type: YTN; PAM sequence: TTG
aatctgtatattgcttttgg

SEQ ID NO: 69637 - DNA, 20 bp, Artificial Sequence
  Description of Artificial Sequence: Synthetic oligonucleotide
  Target: SCN10A; (+) strand; PAM type: YTN; PAM sequence: CTG
tatattgcttttggcagtaa

SEQ ID NO: 69638 - DNA, 20 bp, Artificial Sequence
  Description of Artificial Sequence: Synthetic oligonucleotide
  Target: SCN10A; (+) strand; PAM type: YTN; PAM sequence: TTG
cttttggcagtaaggtcatt

SEQ ID NO: 69639 - DNA, 20 bp, Artificial Sequence
  Description of Artificial Sequence: Synthetic oligonucleotide
  Target: SCN10A; (+) strand; PAM type: YTN; PAM sequence: CTT
ttggcagtaaggtcattttc

SEQ ID NO: 69640 - DNA, 20 bp, Artificial Sequence
  Description of Artificial Sequence: Synthetic oligonucleotide
  Target: SCN10A; (+) strand; PAM type: YTN; PAM sequence: TTT
tggcagtaaggtcattttca

SEQ ID NO: 69641 - DNA, 20 bp, Artificial Sequence
  Description of Artificial Sequence: Synthetic oligonucleotide
  Target: SCN10A; (+) strand; PAM type: YTN; PAM sequence: TTT
ggcagtaaggtcattttcac

SEQ ID NO: 69642 - DNA, 20 bp, Artificial Sequence
  Description of Artificial Sequence: Synthetic oligonucleotide
  Target: SCN10A; (+) strand; PAM type: YTN; PAM sequence: TTG
gcagtaaggtcattttcaca

SEQ ID NO: 69643 - DNA, 20 bp, Artificial Sequence
  Description of Artificial Sequence: Synthetic oligonucleotide
  Target: SCN10A; (+) strand; PAM type: YTN; PAM sequence: TTT
tcacaatattgattttatcc

SEQ ID NO: 69644 - DNA, 20 bp, Artificial Sequence
  Description of Artificial Sequence: Synthetic oligonucleotide
  Target: SCN10A; (+) strand; PAM type: YTN; PAM sequence: TTT
cacaatattgattttatcca

SEQ ID NO: 69645 - DNA, 20 bp, Artificial Sequence
  Description of Artificial Sequence: Synthetic oligonucleotide
  Target: SCN10A; (+) strand; PAM type: YTN; PAM sequence: TTC
acaatattgattttatccat

SEQ ID NO: 69646 - DNA, 20 bp, Artificial Sequence
  Description of Artificial Sequence: Synthetic oligonucleotide
  Target: SCN10A; (+) strand; PAM type: YTN; PAM sequence: TTG
attttatccatccatgagca

SEQ ID NO: 69647 - DNA, 20 bp, Artificial Sequence
  Description of Artificial Sequence: Synthetic oligonucleotide
  Target: SCN10A; (+) strand; PAM type: YTN; PAM sequence: TTT
tatccatccatgagcatggg

SEQ ID NO: 69648 - DNA, 20 bp, Artificial Sequence
  Description of Artificial Sequence: Synthetic oligonucleotide
  Target: SCN10A; (+) strand; PAM type: YTN; PAM sequence: TTT
atccatccatgagcatggga

SEQ ID NO: 69649 - DNA, 20 bp, Artificial Sequence
  Description of Artificial Sequence: Synthetic oligonucleotide
  Target: SCN10A; (+) strand; PAM type: YTN; PAM sequence: TTA
tccatccatgagcatgggat

SEQ ID NO: 69650 - DNA, 20 bp, Artificial Sequence
  Description of Artificial Sequence: Synthetic oligonucleotide
  Target: SCN10A; (+) strand; PAM type: YTN; PAM sequence: TTC
ccatttgtttgtgtcatctg

SEQ ID NO: 69651 - DNA, 20 bp, Artificial Sequence
  Description of Artificial Sequence: Synthetic oligonucleotide
  Target: SCN10A; (+) strand; PAM type: YTN; PAM sequence: TTT
gtttgtgtcatctgtgattt

SEQ ID NO: 69652 - DNA, 20 bp, Artificial Sequence
  Description of Artificial Sequence: Synthetic oligonucleotide
  Target: SCN10A; (+) strand; PAM type: YTN; PAM sequence: TTG
tttgtgtcatctgtgattta

SEQ ID NO: 69653 - DNA, 20 bp, Artificial Sequence
  Description of Artificial Sequence: Synthetic oligonucleotide
  Target: SCN10A; (+) strand; PAM type: YTN; PAM sequence: TTT
gtgtcatctgtgatttattt

SEQ ID NO: 69654 - DNA, 20 bp, Artificial Sequence
  Description of Artificial Sequence: Synthetic oligonucleotide
  Target: SCN10A; (+) strand; PAM type: YTN; PAM sequence: TTG
tgtcatctgtgatttatttt

SEQ ID NO: 69655 - DNA, 20 bp, Artificial Sequence
  Description of Artificial Sequence: Synthetic oligonucleotide
  Target: SCN10A; (+) strand; PAM type: YTN; PAM sequence: CTG
tgatttattttagcagtgtt

SEQ ID NO: 69656 - DNA, 20 bp, Artificial Sequence
  Description of Artificial Sequence: Synthetic oligonucleotide
  Target: SCN10A; (+) strand; PAM type: YTN; PAM sequence: TTT
attttagcagtgttttgtag

SEQ ID NO: 69657 - DNA, 20 bp, Artificial Sequence
  Description of Artificial Sequence: Synthetic oligonucleotide
  Target: SCN10A; (+) strand; PAM type: YTN; PAM sequence: TTA
ttttagcagtgttttgtagt

SEQ ID NO: 69658 - DNA, 20 bp, Artificial Sequence
  Description of Artificial Sequence: Synthetic oligonucleotide
  Target: SCN10A; (+) strand; PAM type: YTN; PAM sequence: TTT
tagcagtgttttgtagtttt

SEQ ID NO: 69659 - DNA, 20 bp, Artificial Sequence
  Description of Artificial Sequence: Synthetic oligonucleotide
  Target: SCN10A; (+) strand; PAM type: YTN; PAM sequence: TTT
agcagtgttttgtagttttc

SEQ ID NO: 69660 - DNA, 20 bp, Artificial Sequence
  Description of Artificial Sequence: Synthetic oligonucleotide
  Target: SCN10A; (+) strand; PAM type: YTN; PAM sequence: TTA
gcagtgttttgtagttttcc

SEQ ID NO: 69661 - DNA, 20 bp, Artificial Sequence
  Description of Artificial Sequence: Synthetic oligonucleotide
  Target: SCN10A; (+) strand; PAM type: YTN; PAM sequence: TTT
tgtagttttccttgtagaaa

SEQ ID NO: 69662 - DNA, 20 bp, Artificial Sequence
  Description of Artificial Sequence: Synthetic oligonucleotide
  Target: SCN10A; (+) strand; PAM type: YTN; PAM sequence: TTT
gtagttttccttgtagaaat

SEQ ID NO: 69663 - DNA, 20 bp, Artificial Sequence
  Description of Artificial Sequence: Synthetic oligonucleotide
  Target: SCN10A; (+) strand; PAM type: YTN; PAM sequence: TTG
tagttttccttgtagaaatc

SEQ ID NO: 69664 - DNA, 20 bp, Artificial Sequence
  Description of Artificial Sequence: Synthetic oligonucleotide
  Target: SCN10A; (+) strand; PAM type: YTN; PAM sequence: TTT
tccttgtagaaatctttcac

SEQ ID NO: 69665 - DNA, 20 bp, Artificial Sequence
  Description of Artificial Sequence: Synthetic oligonucleotide
  Target: SCN10A; (+) strand; PAM type: YTN; PAM sequence: TTT
ccttgtagaaatctttcacc

SEQ ID NO: 69666 - DNA, 20 bp, Artificial Sequence
  Description of Artificial Sequence: Synthetic oligonucleotide
  Target: SCN10A; (+) strand; PAM type: YTN; PAM sequence: TTC
cttgtagaaatctttcacct

SEQ ID NO: 69667 - DNA, 20 bp, Artificial Sequence
  Description of Artificial Sequence: Synthetic oligonucleotide
  Target: SCN10A; (+) strand; PAM type: YTN; PAM sequence: CTT
gtagaaatctttcacctttt

SEQ ID NO: 69668 - DNA, 20 bp, Artificial Sequence
  Description of Artificial Sequence: Synthetic oligonucleotide
  Target: SCN10A; (+) strand; PAM type: YTN; PAM sequence: TTG
tagaaatctttcaccttttt

SEQ ID NO: 69669 - DNA, 20 bp, Artificial Sequence
  Description of Artificial Sequence: Synthetic oligonucleotide
  Target: SCN10A; (+) strand; PAM type: YTN; PAM sequence: CTT
tcacctttttggttaggtat

SEQ ID NO: 69670 - DNA, 20 bp, Artificial Sequence
  Description of Artificial Sequence: Synthetic oligonucleotide
  Target: SCN10A; (+) strand; PAM type: YTN; PAM sequence: TTT
cacctttttggttaggtata

SEQ ID NO: 69671 - DNA, 20 bp, Artificial Sequence
  Description of Artificial Sequence: Synthetic oligonucleotide
  Target: SCN10A; (+) strand; PAM type: YTN; PAM sequence: TTC
acctttttggttaggtatat

SEQ ID NO: 69672 - DNA, 20 bp, Artificial Sequence
  Description of Artificial Sequence: Synthetic oligonucleotide
  Target: SCN10A; (+) strand; PAM type: YTN; PAM sequence: CTT
tttggttaggtatattccta

SEQ ID NO: 69673 - DNA, 20 bp, Artificial Sequence
  Description of Artificial Sequence: Synthetic oligonucleotide
  Target: SCN10A; (+) strand; PAM type: YTN; PAM sequence: TTT
ttggttaggtatattcctaa

SEQ ID NO: 69674 - DNA, 20 bp, Artificial Sequence
  Description of Artificial Sequence: Synthetic oligonucleotide
  Target: SCN10A; (+) strand; PAM type: YTN; PAM sequence: TTT
tggttaggtatattcctaag

SEQ ID NO: 69675 - DNA, 20 bp, Artificial Sequence
  Description of Artificial Sequence: Synthetic oligonucleotide
  Target: SCN10A; (+) strand; PAM type: YTN; PAM sequence: TTT
ggttaggtatattcctaaga

SEQ ID NO: 69676 - DNA, 20 bp, Artificial Sequence
  Description of Artificial Sequence: Synthetic oligonucleotide
  Target: SCN10A; (+) strand; PAM type: YTN; PAM sequence: TTG
gttaggtatattcctaagat

SEQ ID NO: 69677 - DNA, 20 bp, Artificial Sequence
  Description of Artificial Sequence: Synthetic oligonucleotide
  Target: SCN10A; (+) strand; PAM type: YTN; PAM sequence: TTA
ggtatattcctaagattttt

SEQ ID NO: 69678 - DNA, 20 bp, Artificial Sequence
  Description of Artificial Sequence: Synthetic oligonucleotide
  Target: SCN10A; (+) strand; PAM type: YTN; PAM sequence: TTC
ctaagatttttttgttttta

SEQ ID NO: 69679 - DNA, 20 bp, Artificial Sequence
  Description of Artificial Sequence: Synthetic oligonucleotide
  Target: SCN10A; (+) strand; PAM type: YTN; PAM sequence: CTA
agatttttttgtttttattt

SEQ ID NO: 69680 - DNA, 20 bp, Artificial Sequence
  Description of Artificial Sequence: Synthetic oligonucleotide
  Target: SCN10A; (+) strand; PAM type: YTN; PAM sequence: TTT
ttttgtttttatttttgttt

SEQ ID NO: 69681 - DNA, 20 bp, Artificial Sequence
  Description of Artificial Sequence: Synthetic oligonucleotide
  Target: SCN10A; (+) strand; PAM type: YTN; PAM sequence: TTT
tttgtttttatttttgtttt

SEQ ID NO: 69682 - DNA, 20 bp, Artificial Sequence
  Description of Artificial Sequence: Synthetic oligonucleotide
  Target: SCN10A; (+) strand; PAM type: YTN; PAM sequence: TTT
ttgtttttatttttgttttt

SEQ ID NO: 69683 - DNA, 20 bp, Artificial Sequence
  Description of Artificial Sequence: Synthetic oligonucleotide
  Target: SCN10A; (+) strand; PAM type: YTN; PAM sequence: TTT
tgtttttatttttgtttttt

SEQ ID NO: 69684 - DNA, 20 bp, Artificial Sequence
  Description of Artificial Sequence: Synthetic oligonucleotide
  Target: SCN10A; (+) strand; PAM type: YTN; PAM sequence: TTT
gtttttatttttgttttttt

SEQ ID NO: 69685 - DNA, 20 bp, Artificial Sequence
  Description of Artificial Sequence: Synthetic oligonucleotide
  Target: SCN10A; (+) strand; PAM type: YTN; PAM sequence: TTG
tttttatttttgtttttttt

SEQ ID NO: 69686 - DNA, 20 bp, Artificial Sequence
  Description of Artificial Sequence: Synthetic oligonucleotide
  Target: SCN10A; (+) strand; PAM type: YTN; PAM sequence: TTT
ttatttttgttttttttttg

SEQ ID NO: 69687 - DNA, 20 bp, Artificial Sequence
  Description of Artificial Sequence: Synthetic oligonucleotide
  Target: SCN10A; (+) strand; PAM type: YTN; PAM sequence: TTT
tatttttgttttttttttgc

SEQ ID NO: 69688 - DNA, 20 bp, Artificial Sequence
  Description of Artificial Sequence: Synthetic oligonucleotide
  Target: SCN10A; (+) strand; PAM type: YTN; PAM sequence: TTT
atttttgttttttttttgca

SEQ ID NO: 69689 - DNA, 20 bp, Artificial Sequence
  Description of Artificial Sequence: Synthetic oligonucleotide
  Target: SCN10A; (+) strand; PAM type: YTN; PAM sequence: TTA
tttttgttttttttttgcag

SEQ ID NO: 69690 - DNA, 20 bp, Artificial Sequence
  Description of Artificial Sequence: Synthetic oligonucleotide
  Target: SCN10A; (+) strand; PAM type: YTN; PAM sequence: TTT
ttgttttttttttgcagctg

SEQ ID NO: 69691 - DNA, 20 bp, Artificial Sequence
  Description of Artificial Sequence: Synthetic oligonucleotide
  Target: SCN10A; (+) strand; PAM type: YTN; PAM sequence: TTT
tgttttttttttgcagctgt

SEQ ID NO: 69692 - DNA, 20 bp, Artificial Sequence
  Description of Artificial Sequence: Synthetic oligonucleotide
  Target: SCN10A; (+) strand; PAM type: YTN; PAM sequence: TTT
gttttttttttgcagctgtt

SEQ ID NO: 69693 - DNA, 20 bp, Artificial Sequence
  Description of Artificial Sequence: Synthetic oligonucleotide
  Target: SCN10A; (+) strand; PAM type: YTN; PAM sequence: TTG
ttttttttttgcagctgttg

SEQ ID NO: 69694 - DNA, 20 bp, Artificial Sequence
  Description of Artificial Sequence: Synthetic oligonucleotide
  Target: SCN10A; (+) strand; PAM type: YTN; PAM sequence: TTT
tttttttgcagctgttgtaa

SEQ ID NO: 69695 - DNA, 20 bp, Artificial Sequence
  Description of Artificial Sequence: Synthetic oligonucleotide
  Target: SCN10A; (+) strand; PAM type: YTN; PAM sequence: TTT
ttttttgcagctgttgtaaa

SEQ ID NO: 69696 - DNA, 20 bp, Artificial Sequence
  Description of Artificial Sequence: Synthetic oligonucleotide
  Target: SCN10A; (+) strand; PAM type: YTN; PAM sequence: TTT
tttttgcagctgttgtaaaa

SEQ ID NO: 69697 - DNA, 20 bp, Artificial Sequence
  Description of Artificial Sequence: Synthetic oligonucleotide
  Target: SCN10A; (+) strand; PAM type: YTN; PAM sequence: TTT
ttttgcagctgttgtaaaag

SEQ ID NO: 69698 - DNA, 20 bp, Artificial Sequence
  Description of Artificial Sequence: Synthetic oligonucleotide
  Target: SCN10A; (+) strand; PAM type: YTN; PAM sequence: TTT
tttgcagctgttgtaaaagg

SEQ ID NO: 69699 - DNA, 20 bp, Artificial Sequence
  Description of Artificial Sequence: Synthetic oligonucleotide
  Target: SCN10A; (+) strand; PAM type: YTN; PAM sequence: TTT
ttgcagctgttgtaaaaggg

SEQ ID NO: 69700 - DNA, 20 bp, Artificial Sequence
  Description of Artificial Sequence: Synthetic oligonucleotide
  Target: SCN10A; (+) strand; PAM type: YTN; PAM sequence: TTT
tgcagctgttgtaaaaggga

SEQ ID NO: 69701 - DNA, 20 bp, Artificial Sequence
  Description of Artificial Sequence: Synthetic oligonucleotide
  Target: SCN10A; (+) strand; PAM type: YTN; PAM sequence: TTT
gcagctgttgtaaaagggat

SEQ ID NO: 69702 - DNA, 20 bp, Artificial Sequence
  Description of Artificial Sequence: Synthetic oligonucleotide
  Target: SCN10A; (+) strand; PAM type: YTN; PAM sequence: TTG
cagctgttgtaaaagggatt

SEQ ID NO: 69703 - DNA, 20 bp, Artificial Sequence
  Description of Artificial Sequence: Synthetic oligonucleotide
  Target: SCN10A; (+) strand; PAM type: YTN; PAM sequence: CTG
ttgtaaaagggattgagttc

SEQ ID NO: 69704 - DNA, 20 bp, Artificial Sequence
  Description of Artificial Sequence: Synthetic oligonucleotide
  Target: SCN10A; (+) strand; PAM type: YTN; PAM sequence: TTG
taaaagggattgagttcttg

SEQ ID NO: 69705 - DNA, 20 bp, Artificial Sequence
  Description of Artificial Sequence: Synthetic oligonucleotide
  Target: SCN10A; (+) strand; PAM type: YTN; PAM sequence: TTG
agttcttgatttgttcctca

SEQ ID NO: 69706 - DNA, 20 bp, Artificial Sequence
  Description of Artificial Sequence: Synthetic oligonucleotide
  Target: SCN10A; (+) strand; PAM type: YTN; PAM sequence: TTC
ttgatttgttcctcagcttg

SEQ ID NO: 69707 - DNA, 20 bp, Artificial Sequence
  Description of Artificial Sequence: Synthetic oligonucleotide
  Target: SCN10A; (+) strand; PAM type: YTN; PAM sequence: CTT
gatttgttcctcagcttggt

SEQ ID NO: 69708 - DNA, 20 bp, Artificial Sequence
  Description of Artificial Sequence: Synthetic oligonucleotide
  Target: SCN10A; (+) strand; PAM type: YTN; PAM sequence: TTG
atttgttcctcagcttggtt

SEQ ID NO: 69709 - DNA, 20 bp, Artificial Sequence
  Description of Artificial Sequence: Synthetic oligonucleotide
  Target: SCN10A; (+) strand; PAM type: YTN; PAM sequence: TTT
gttcctcagcttggtttctg

SEQ ID NO: 69710 - DNA, 20 bp, Artificial Sequence
  Description of Artificial Sequence: Synthetic oligonucleotide
  Target: SCN10A; (+) strand; PAM type: YTN; PAM sequence: TTG
ttcctcagcttggtttctgg

SEQ ID NO: 69711 - DNA, 20 bp, Artificial Sequence
  Description of Artificial Sequence: Synthetic oligonucleotide
  Target: SCN10A; (+) strand; PAM type: YTN; PAM sequence: TTC
ctcagcttggtttctggtgg

SEQ ID NO: 69712 - DNA, 20 bp, Artificial Sequence
  Description of Artificial Sequence: Synthetic oligonucleotide
  Target: SCN10A; (+) strand; PAM type: YTN; PAM sequence: CTC
agcttggtttctggtggtgt

SEQ ID NO: 69713 - DNA, 20 bp, Artificial Sequence
  Description of Artificial Sequence: Synthetic oligonucleotide
  Target: SCN10A; (+) strand; PAM type: YTN; PAM sequence: CTT
ggtttctggtggtgtacagt

SEQ ID NO: 69714 - DNA, 20 bp, Artificial Sequence
  Description of Artificial Sequence: Synthetic oligonucleotide
  Target: SCN10A; (+) strand; PAM type: YTN; PAM sequence: TTG
gtttctggtggtgtacagta

SEQ ID NO: 69715 - DNA, 20 bp, Artificial Sequence
  Description of Artificial Sequence: Synthetic oligonucleotide
  Target: SCN10A; (+) strand; PAM type: YTN; PAM sequence: TTT
ctggtggtgtacagtagtgc

SEQ ID NO: 69716 - DNA, 20 bp, Artificial Sequence
  Description of Artificial Sequence: Synthetic oligonucleotide
  Target: SCN10A; (+) strand; PAM type: YTN; PAM sequence: TTC
tggtggtgtacagtagtgct

SEQ ID NO: 69717 - DNA, 20 bp, Artificial Sequence
  Description of Artificial Sequence: Synthetic oligonucleotide
  Target: SCN10A; (+) strand; PAM type: YTN; PAM sequence: CTG
gtggtgtacagtagtgctgc

SEQ ID NO: 69718 - DNA, 20 bp, Artificial Sequence
  Description of Artificial Sequence: Synthetic oligonucleotide
  Target: SCN10A; (+) strand; PAM type: YTN; PAM sequence: CTG
ctgatttgtatacattgttt

SEQ ID NO: 69719 - DNA, 20 bp, Artificial Sequence
  Description of Artificial Sequence: Synthetic oligonucleotide
  Target: SCN10A; (+) strand; PAM type: YTN; PAM sequence: CTG
atttgtatacattgtttttg

SEQ ID NO: 69720 - DNA, 20 bp, Artificial Sequence
  Description of Artificial Sequence: Synthetic oligonucleotide
  Target: SCN10A; (+) strand; PAM type: YTN; PAM sequence: TTT
gtatacattgtttttgtatc

SEQ ID NO: 69721 - DNA, 20 bp, Artificial Sequence
  Description of Artificial Sequence: Synthetic oligonucleotide
  Target: SCN10A; (+) strand; PAM type: YTN; PAM sequence: TTG
tatacattgtttttgtatcc

SEQ ID NO: 69722 - DNA, 20 bp, Artificial Sequence
  Description of Artificial Sequence: Synthetic oligonucleotide
  Target: SCN10A; (+) strand; PAM type: YTN; PAM sequence: TTG
tttttgtatcctgaaacttt

SEQ ID NO: 69723 - DNA, 20 bp, Artificial Sequence
  Description of Artificial Sequence: Synthetic oligonucleotide
  Target: SCN10A; (+) strand; PAM type: YTN; PAM sequence: TTT
ttgtatcctgaaactttact

SEQ ID NO: 69724 - DNA, 20 bp, Artificial Sequence
  Description of Artificial Sequence: Synthetic oligonucleotide
  Target: SCN10A; (+) strand; PAM type: YTN; PAM sequence: TTT
tgtatcctgaaactttactg

SEQ ID NO: 69725 - DNA, 20 bp, Artificial Sequence
  Description of Artificial Sequence: Synthetic oligonucleotide
  Target: SCN10A; (+) strand; PAM type: YTN; PAM sequence: TTT
gtatcctgaaactttactga

SEQ ID NO: 69726 - DNA, 20 bp, Artificial Sequence
  Description of Artificial Sequence: Synthetic oligonucleotide
  Target: SCN10A; (+) strand; PAM type: YTN; PAM sequence: TTG
tatcctgaaactttactgaa

SEQ ID NO: 69727 - DNA, 20 bp, Artificial Sequence
  Description of Artificial Sequence: Synthetic oligonucleotide
  Target: SCN10A; (+) strand; PAM type: YTN; PAM sequence: CTG
aaactttactgaattcattt

SEQ ID NO: 69728 - DNA, 20 bp, Artificial Sequence
  Description of Artificial Sequence: Synthetic oligonucleotide
  Target: SCN10A; (+) strand; PAM type: YTN; PAM sequence: CTT
tactgaattcatttattaga

SEQ ID NO: 69729 - DNA, 20 bp, Artificial Sequence
  Description of Artificial Sequence: Synthetic oligonucleotide
  Target: SCN10A; (+) strand; PAM type: YTN; PAM sequence: TTT
actgaattcatttattagat

SEQ ID NO: 69730 - DNA, 20 bp, Artificial Sequence
  Description of Artificial Sequence: Synthetic oligonucleotide
  Target: SCN10A; (+) strand; PAM type: YTN; PAM sequence: TTA
ctgaattcatttattagatc

SEQ ID NO: 69731 - DNA, 20 bp, Artificial Sequence
  Description of Artificial Sequence: Synthetic oligonucleotide
  Target: SCN10A; (+) strand; PAM type: YTN; PAM sequence: CTG
aattcatttattagatctag

SEQ ID NO: 69732 - DNA, 20 bp, Artificial Sequence
  Description of Artificial Sequence: Synthetic oligonucleotide
  Target: SCN10A; (+) strand; PAM type: YTN; PAM sequence: TTC
atttattagatctaggagct

SEQ ID NO: 69733 - DNA, 20 bp, Artificial Sequence
  Description of Artificial Sequence: Synthetic oligonucleotide
  Target: SCN10A; (+) strand; PAM type: YTN; PAM sequence: TTT
attagatctaggagcttttt

SEQ ID NO: 69734 - DNA, 20 bp, Artificial Sequence
  Description of Artificial Sequence: Synthetic oligonucleotide
  Target: SCN10A; (+) strand; PAM type: YTN; PAM sequence: TTA
ttagatctaggagctttttg

SEQ ID NO: 69735 - DNA, 20 bp, Artificial Sequence
  Description of Artificial Sequence: Synthetic oligonucleotide
  Target: SCN10A; (+) strand; PAM type: YTN; PAM sequence: TTA
gatctaggagctttttggat

SEQ ID NO: 69736 - DNA, 20 bp, Artificial Sequence
  Description of Artificial Sequence: Synthetic oligonucleotide
  Target: SCN10A; (+) strand; PAM type: YTN; PAM sequence: CTA
ggagctttttggatgagtct

SEQ ID NO: 69737 - DNA, 20 bp, Artificial Sequence
  Description of Artificial Sequence: Synthetic oligonucleotide
  Target: SCN10A; (+) strand; PAM type: YTN; PAM sequence: CTT
tttggatgagtctttagggt

SEQ ID NO: 69738 - DNA, 20 bp, Artificial Sequence
  Description of Artificial Sequence: Synthetic oligonucleotide
  Target: SCN10A; (+) strand; PAM type: YTN; PAM sequence: TTT
ttggatgagtctttagggtt

SEQ ID NO: 69739 - DNA, 20 bp, Artificial Sequence
  Description of Artificial Sequence: Synthetic oligonucleotide
  Target: SCN10A; (+) strand; PAM type: YTN; PAM sequence: TTT
tggatgagtctttagggttt

SEQ ID NO: 69740 - DNA, 20 bp, Artificial Sequence
  Description of Artificial Sequence: Synthetic oligonucleotide
  Target: SCN10A; (+) strand; PAM type: YTN; PAM sequence: TTT
ggatgagtctttagggtttc

SEQ ID NO: 69741 - DNA, 20 bp, Artificial Sequence
  Description of Artificial Sequence: Synthetic oligonucleotide
  Target: SCN10A; (+) strand; PAM type: YTN; PAM sequence: TTG
gatgagtctttagggtttcc

SEQ ID NO: 69742 - DNA, 20 bp, Artificial Sequence
  Description of Artificial Sequence: Synthetic oligonucleotide
  Target: SCN10A; (+) strand; PAM type: YTN; PAM sequence: CTT
tagggtttcctaggcatacg

SEQ ID NO: 69743 - DNA, 20 bp, Artificial Sequence
  Description of Artificial Sequence: Synthetic oligonucleotide
  Target: SCN10A; (+) strand; PAM type: YTN; PAM sequence: TTT
agggtttcctaggcatacga

SEQ ID NO: 69744 - DNA, 20 bp, Artificial Sequence
  Description of Artificial Sequence: Synthetic oligonucleotide
  Target: SCN10A; (+) strand; PAM type: YTN; PAM sequence: TTA
gggtttcctaggcatacgat

SEQ ID NO: 69745 - DNA, 20 bp, Artificial Sequence
  Description of Artificial Sequence: Synthetic oligonucleotide
  Target: SCN10A; (+) strand; PAM type: YTN; PAM sequence: TTT
cctaggcatacgatcatatc

SEQ ID NO: 69746 - DNA, 20 bp, Artificial Sequence
  Description of Artificial Sequence: Synthetic oligonucleotide
  Target: SCN10A; (+) strand; PAM type: YTN; PAM sequence: TTC
ctaggcatacgatcatatca

SEQ ID NO: 69747 - DNA, 20 bp, Artificial Sequence
  Description of Artificial Sequence: Synthetic oligonucleotide
  Target: SCN10A; (+) strand; PAM type: YTN; PAM sequence: CTA
ggcatacgatcatatcattg

SEQ ID NO: 69748 - DNA, 20 bp, Artificial Sequence
  Description of Artificial Sequence: Synthetic oligonucleotide
  Target: SCN10A; (+) strand; PAM type: YTN; PAM sequence: TTG
gtgaacagcaacagtttgac

SEQ ID NO: 69749 - DNA, 20 bp, Artificial Sequence
  Description of Artificial Sequence: Synthetic oligonucleotide
  Target: SCN10A; (+) strand; PAM type: YTN; PAM sequence: TTT
gacttcccctttactgattt

SEQ ID NO: 69750 - DNA, 20 bp, Artificial Sequence
  Description of Artificial Sequence: Synthetic oligonucleotide
  Target: SCN10A; (+) strand; PAM type: YTN; PAM sequence: TTG
acttcccctttactgatttg

SEQ ID NO: 69751 - DNA, 20 bp, Artificial Sequence
  Description of Artificial Sequence: Synthetic oligonucleotide
  Target: SCN10A; (+) strand; PAM type: YTN; PAM sequence: CTT
cccctttactgatttggatt

SEQ ID NO: 69752 - DNA, 20 bp, Artificial Sequence
  Description of Artificial Sequence: Synthetic oligonucleotide
  Target: SCN10A; (+) strand; PAM type: YTN; PAM sequence: TTC
ccctttactgatttggattc

SEQ ID NO: 69753 - DNA, 20 bp, Artificial Sequence
  Description of Artificial Sequence: Synthetic oligonucleotide
  Target: SCN10A; (+) strand; PAM type: YTN; PAM sequence: CTT
tactgatttggattcccttt

SEQ ID NO: 69754 - DNA, 20 bp, Artificial Sequence
  Description of Artificial Sequence: Synthetic oligonucleotide
  Target: SCN10A; (+) strand; PAM type: YTN; PAM sequence: TTT
actgatttggattcccttta

SEQ ID NO: 69755 - DNA, 20 bp, Artificial Sequence
  Description of Artificial Sequence: Synthetic oligonucleotide
  Target: SCN10A; (+) strand; PAM type: YTN; PAM sequence: TTA
ctgatttggattccctttat

SEQ ID NO: 69756 - DNA, 20 bp, Artificial Sequence
  Description of Artificial Sequence: Synthetic oligonucleotide
  Target: SCN10A; (+) strand; PAM type: YTN; PAM sequence: CTG
atttggattccctttattta

SEQ ID NO: 69757 - DNA, 20 bp, Artificial Sequence
  Description of Artificial Sequence: Synthetic oligonucleotide
  Target: SCN10A; (+) strand; PAM type: YTN; PAM sequence: TTT
ggattccctttatttatttc

SEQ ID NO: 69758 - DNA, 20 bp, Artificial Sequence
  Description of Artificial Sequence: Synthetic oligonucleotide
  Target: SCN10A; (+) strand; PAM type: YTN; PAM sequence: TTG
gattccctttatttatttct

SEQ ID NO: 69759 - DNA, 20 bp, Artificial Sequence
  Description of Artificial Sequence: Synthetic oligonucleotide
  Target: SCN10A; (+) strand; PAM type: YTN; PAM sequence: TTC
cctttatttatttctcttgt

SEQ ID NO: 69760 - DNA, 20 bp, Artificial Sequence
  Description of Artificial Sequence: Synthetic oligonucleotide
  Target: SCN10A; (+) strand; PAM type: YTN; PAM sequence: CTT
tatttatttctcttgtctga

SEQ ID NO: 69761 - DNA, 20 bp, Artificial Sequence
  Description of Artificial Sequence: Synthetic oligonucleotide
  Target: SCN10A; (+) strand; PAM type: YTN; PAM sequence: TTT
atttatttctcttgtctgat

SEQ ID NO: 69762 - DNA, 20 bp, Artificial Sequence
  Description of Artificial Sequence: Synthetic oligonucleotide
  Target: SCN10A; (+) strand; PAM type: YTN; PAM sequence: TTA
tttatttctcttgtctgatt

SEQ ID NO: 69763 - DNA, 20 bp, Artificial Sequence
  Description of Artificial Sequence: Synthetic oligonucleotide
  Target: SCN10A; (+) strand; PAM type: YTN; PAM sequence: TTT
atttctcttgtctgattgct

SEQ ID NO: 69764 - DNA, 20 bp, Artificial Sequence
  Description of Artificial Sequence: Synthetic oligonucleotide
  Target: SCN10A; (+) strand; PAM type: YTN; PAM sequence: TTA
tttctcttgtctgattgctc

SEQ ID NO: 69765 - DNA, 20 bp, Artificial Sequence
  Description of Artificial Sequence: Synthetic oligonucleotide
  Target: SCN10A; (+) strand; PAM type: YTN; PAM sequence: TTT
ctcttgtctgattgctctgg

SEQ ID NO: 69766 - DNA, 20 bp, Artificial Sequence
  Description of Artificial Sequence: Synthetic oligonucleotide
  Target: SCN10A; (+) strand; PAM type: YTN; PAM sequence: TTC
tcttgtctgattgctctggc

SEQ ID NO: 69767 - DNA, 20 bp, Artificial Sequence
  Description of Artificial Sequence: Synthetic oligonucleotide
  Target: SCN10A; (+) strand; PAM type: YTN; PAM sequence: CTC
ttgtctgattgctctggcta

SEQ ID NO: 69768 - DNA, 20 bp, Artificial Sequence
  Description of Artificial Sequence: Synthetic oligonucleotide
  Target: SCN10A; (+) strand; PAM type: YTN; PAM sequence: CTT
gtctgattgctctggctagg

SEQ ID NO: 69769 - DNA, 20 bp, Artificial Sequence
  Description of Artificial Sequence: Synthetic oligonucleotide
  Target: SCN10A; (+) strand; PAM type: YTN; PAM sequence: TTG
tctgattgctctggctagga

SEQ ID NO: 69770 - DNA, 20 bp, Artificial Sequence
  Description of Artificial Sequence: Synthetic oligonucleotide
  Target: SCN10A; (+) strand; PAM type: YTN; PAM sequence: CTG
attgctctggctaggacttc

SEQ ID NO: 69771 - DNA, 20 bp, Artificial Sequence
  Description of Artificial Sequence: Synthetic oligonucleotide
  Target: SCN10A; (+) strand; PAM type: YTN; PAM sequence: TTG
ctctggctaggacttccagt

SEQ ID NO: 69772 - DNA, 20 bp, Artificial Sequence
  Description of Artificial Sequence: Synthetic oligonucleotide
  Target: SCN10A; (+) strand; PAM type: YTN; PAM sequence: CTC
tggctaggacttccagtact

SEQ ID NO: 69773 - DNA, 20 bp, Artificial Sequence
  Description of Artificial Sequence: Synthetic oligonucleotide
  Target: SCN10A; (+) strand; PAM type: YTN; PAM sequence: CTG
gctaggacttccagtactat

SEQ ID NO: 69774 - DNA, 20 bp, Artificial Sequence
  Description of Artificial Sequence: Synthetic oligonucleotide
  Target: SCN10A; (+) strand; PAM type: YTN; PAM sequence: CTA
ggacttccagtactatgttg

SEQ ID NO: 69775 - DNA, 20 bp, Artificial Sequence
  Description of Artificial Sequence: Synthetic oligonucleotide
  Target: SCN10A; (+) strand; PAM type: YTN; PAM sequence: CTT
ccagtactatgttggataga

SEQ ID NO: 69776 - DNA, 20 bp, Artificial Sequence
  Description of Artificial Sequence: Synthetic oligonucleotide
  Target: SCN10A; (+) strand; PAM type: YTN; PAM sequence: TTC
cagtactatgttggatagaa

SEQ ID NO: 69777 - DNA, 20 bp, Artificial Sequence
  Description of Artificial Sequence: Synthetic oligonucleotide
  Target: SCN10A; (+) strand; PAM type: YTN; PAM sequence: CTA
tgttggatagaaatggtgaa

SEQ ID NO: 69778 - DNA, 20 bp, Artificial Sequence
  Description of Artificial Sequence: Synthetic oligonucleotide
  Target: SCN10A; (+) strand; PAM type: YTN; PAM sequence: TTG
gatagaaatggtgaaagtgg

SEQ ID NO: 69779 - DNA, 20 bp, Artificial Sequence
  Description of Artificial Sequence: Synthetic oligonucleotide
  Target: SCN10A; (+) strand; PAM type: YTN; PAM sequence: CTT
gtcttgtttcagttctcagg

SEQ ID NO: 69780 - DNA, 20 bp, Artificial Sequence
  Description of Artificial Sequence: Synthetic oligonucleotide
  Target: SCN10A; (+) strand; PAM type: YTN; PAM sequence: TTG
tcttgtttcagttctcaggg

SEQ ID NO: 69781 - DNA, 20 bp, Artificial Sequence
  Description of Artificial Sequence: Synthetic oligonucleotide
  Target: SCN10A; (+) strand; PAM type: YTN; PAM sequence: CTT
gtttcagttctcagggggaa

SEQ ID NO: 69782 - DNA, 20 bp, Artificial Sequence
  Description of Artificial Sequence: Synthetic oligonucleotide
  Target: SCN10A; (+) strand; PAM type: YTN; PAM sequence: TTG
tttcagttctcagggggaat

SEQ ID NO: 69783 - DNA, 20 bp, Artificial Sequence
  Description of Artificial Sequence: Synthetic oligonucleotide
  Target: SCN10A; (+) strand; PAM type: YTN; PAM sequence: TTT
cagttctcagggggaatgct

SEQ ID NO: 69784 - DNA, 20 bp, Artificial Sequence
  Description of Artificial Sequence: Synthetic oligonucleotide
  Target: SCN10A; (+) strand; PAM type: YTN; PAM sequence: TTC
agttctcagggggaatgctt

SEQ ID NO: 69785 - DNA, 20 bp, Artificial Sequence
  Description of Artificial Sequence: Synthetic oligonucleotide
  Target: SCN10A; (+) strand; PAM type: YTN; PAM sequence: TTC
tcagggggaatgctttcaac

SEQ ID NO: 69786 - DNA, 20 bp, Artificial Sequence
  Description of Artificial Sequence: Synthetic oligonucleotide
  Target: SCN10A; (+) strand; PAM type: YTN; PAM sequence: CTC
agggggaatgctttcaactt

SEQ ID NO: 69787 - DNA, 20 bp, Artificial Sequence
  Description of Artificial Sequence: Synthetic oligonucleotide
  Target: SCN10A; (+) strand; PAM type: YTN; PAM sequence: CTT
tcaacttttccctgtttggt

SEQ ID NO: 69788 - DNA, 20 bp, Artificial Sequence
  Description of Artificial Sequence: Synthetic oligonucleotide
  Target: SCN10A; (+) strand; PAM type: YTN; PAM sequence: TTT
caacttttccctgtttggta

SEQ ID NO: 69789 - DNA, 20 bp, Artificial Sequence
  Description of Artificial Sequence: Synthetic oligonucleotide
  Target: SCN10A; (+) strand; PAM type: YTN; PAM sequence: TTC
aacttttccctgtttggtat

SEQ ID NO: 69790 - DNA, 20 bp, Artificial Sequence
  Description of Artificial Sequence: Synthetic oligonucleotide
  Target: SCN10A; (+) strand; PAM type: YTN; PAM sequence: CTT
ttccctgtttggtataatgt

SEQ ID NO: 69791 - DNA, 20 bp, Artificial Sequence
  Description of Artificial Sequence: Synthetic oligonucleotide
  Target: SCN10A; (+) strand; PAM type: YTN; PAM sequence: TTT
tccctgtttggtataatgtt

SEQ ID NO: 69792 - DNA, 20 bp, Artificial Sequence
  Description of Artificial Sequence: Synthetic oligonucleotide
  Target: SCN10A; (+) strand; PAM type: YTN; PAM sequence: TTT
ccctgtttggtataatgttg

SEQ ID NO: 69793 - DNA, 20 bp, Artificial Sequence
  Description of Artificial Sequence: Synthetic oligonucleotide
  Target: SCN10A; (+) strand; PAM type: YTN; PAM sequence: TTC
cctgtttggtataatgttgg

SEQ ID NO: 69794 - DNA, 20 bp, Artificial Sequence
  Description of Artificial Sequence: Synthetic oligonucleotide
  Target: SCN10A; (+) strand; PAM type: YTN; PAM sequence: CTG
tttggtataatgttggctgt

SEQ ID NO: 69795 - DNA, 20 bp, Artificial Sequence
  Description of Artificial Sequence: Synthetic oligonucleotide
  Target: SCN10A; (+) strand; PAM type: YTN; PAM sequence: TTT
ggtataatgttggctgtgga

SEQ ID NO: 69796 - DNA, 20 bp, Artificial Sequence
  Description of Artificial Sequence: Synthetic oligonucleotide
  Target: SCN10A; (+) strand; PAM type: YTN; PAM sequence: TTG
gtataatgttggctgtggat

SEQ ID NO: 69797 - DNA, 20 bp, Artificial Sequence
  Description of Artificial Sequence: Synthetic oligonucleotide
  Target: SCN10A; (+) strand; PAM type: YTN; PAM sequence: TTG
gctgtggatttgtcatagat

SEQ ID NO: 69798 - DNA, 20 bp, Artificial Sequence
  Description of Artificial Sequence: Synthetic oligonucleotide
  Target: SCN10A; (+) strand; PAM type: YTN; PAM sequence: CTG
tggatttgtcatagatggct

SEQ ID NO: 69799 - DNA, 20 bp, Artificial Sequence
  Description of Artificial Sequence: Synthetic oligonucleotide
  Target: SCN10A; (+) strand; PAM type: YTN; PAM sequence: TTT
gtcatagatggcttttatta

SEQ ID NO: 69800 - DNA, 20 bp, Artificial Sequence
  Description of Artificial Sequence: Synthetic oligonucleotide
  Target: SCN10A; (+) strand; PAM type: YTN; PAM sequence: TTG
tcatagatggcttttattac

SEQ ID NO: 69801 - DNA, 20 bp, Artificial Sequence
  Description of Artificial Sequence: Synthetic oligonucleotide
  Target: SCN10A; (+) strand; PAM type: YTN; PAM sequence: CTT
ttattaccttggagtatgtc

SEQ ID NO: 69802 - DNA, 20 bp, Artificial Sequence
  Description of Artificial Sequence: Synthetic oligonucleotide
  Target: SCN10A; (+) strand; PAM type: YTN; PAM sequence: TTT
tattaccttggagtatgtcc

SEQ ID NO: 69803 - DNA, 20 bp, Artificial Sequence
  Description of Artificial Sequence: Synthetic oligonucleotide
  Target: SCN10A; (+) strand; PAM type: YTN; PAM sequence: TTT
attaccttggagtatgtccc

SEQ ID NO: 69804 - DNA, 20 bp, Artificial Sequence
  Description of Artificial Sequence: Synthetic oligonucleotide
  Target: SCN10A; (+) strand; PAM type: YTN; PAM sequence: TTA
ttaccttggagtatgtccct

SEQ ID NO: 69805 - DNA, 20 bp, Artificial Sequence
  Description of Artificial Sequence: Synthetic oligonucleotide
  Target: SCN10A; (+) strand; PAM type: YTN; PAM sequence: TTA
ccttggagtatgtcccttct

SEQ ID NO: 69806 - DNA, 20 bp, Artificial Sequence
  Description of Artificial Sequence: Synthetic oligonucleotide
  Target: SCN10A; (+) strand; PAM type: YTN; PAM sequence: CTT
ggagtatgtcccttctatgc

SEQ ID NO: 69807 - DNA, 20 bp, Artificial Sequence
  Description of Artificial Sequence: Synthetic oligonucleotide
  Target: SCN10A; (+) strand; PAM type: YTN; PAM sequence: TTG
gagtatgtcccttctatgcc

SEQ ID NO: 69808 - DNA, 20 bp, Artificial Sequence
  Description of Artificial Sequence: Synthetic oligonucleotide
  Target: SCN10A; (+) strand; PAM type: YTN; PAM sequence: CTT
ctatgccaatttggttgagg

SEQ ID NO: 69809 - DNA, 20 bp, Artificial Sequence
  Description of Artificial Sequence: Synthetic oligonucleotide
  Target: SCN10A; (+) strand; PAM type: YTN; PAM sequence: TTC
tatgccaatttggttgaggg

SEQ ID NO: 69810 - DNA, 20 bp, Artificial Sequence
  Description of Artificial Sequence: Synthetic oligonucleotide
  Target: SCN10A; (+) strand; PAM type: YTN; PAM sequence: CTA
tgccaatttggttgagggtt

SEQ ID NO: 69811 - DNA, 20 bp, Artificial Sequence
  Description of Artificial Sequence: Synthetic oligonucleotide
  Target: SCN10A; (+) strand; PAM type: YTN; PAM sequence: TTT
ggttgagggttttaatcata

SEQ ID NO: 69812 - DNA, 20 bp, Artificial Sequence
  Description of Artificial Sequence: Synthetic oligonucleotide
  Target: SCN10A; (+) strand; PAM type: YTN; PAM sequence: TTG
gttgagggttttaatcataa

SEQ ID NO: 69813 - DNA, 20 bp, Artificial Sequence
  Description of Artificial Sequence: Synthetic oligonucleotide
  Target: SCN10A; (+) strand; PAM type: YTN; PAM sequence: TTG
agggttttaatcataatggg

SEQ ID NO: 69814 - DNA, 20 bp, Artificial Sequence
  Description of Artificial Sequence: Synthetic oligonucleotide
  Target: SCN10A; (+) strand; PAM type: YTN; PAM sequence: TTT
taatcataatgggatgctgg

SEQ ID NO: 69815 - DNA, 20 bp, Artificial Sequence
  Description of Artificial Sequence: Synthetic oligonucleotide
  Target: SCN10A; (+) strand; PAM type: YTN; PAM sequence: TTT
aatcataatgggatgctgga

SEQ ID NO: 69816 - DNA, 20 bp, Artificial Sequence
  Description of Artificial Sequence: Synthetic oligonucleotide
  Target: SCN10A; (+) strand; PAM type: YTN; PAM sequence: TTA
atcataatgggatgctggat

SEQ ID NO: 69817 - DNA, 20 bp, Artificial Sequence
  Description of Artificial Sequence: Synthetic oligonucleotide
  Target: SCN10A; (+) strand; PAM type: YTN; PAM sequence: CTG
gattttgtcaaatgcttttc

SEQ ID NO: 69818 - DNA, 20 bp, Artificial Sequence
  Description of Artificial Sequence: Synthetic oligonucleotide
  Target: SCN10A; (+) strand; PAM type: YTN; PAM sequence: TTT
tgtcaaatgcttttcctgca

SEQ ID NO: 69819 - DNA, 20 bp, Artificial Sequence
  Description of Artificial Sequence: Synthetic oligonucleotide
  Target: SCN10A; (+) strand; PAM type: YTN; PAM sequence: TTT
gtcaaatgcttttcctgcac

SEQ ID NO: 69820 - DNA, 20 bp, Artificial Sequence
  Description of Artificial Sequence: Synthetic oligonucleotide
  Target: SCN10A; (+) strand; PAM type: YTN; PAM sequence: TTG
tcaaatgcttttcctgcacc

SEQ ID NO: 69821 - DNA, 20 bp, Artificial Sequence
  Description of Artificial Sequence: Synthetic oligonucleotide
  Target: SCN10A; (+) strand; PAM type: YTN; PAM sequence: CTT
ttcctgcacctattgagatg

SEQ ID NO: 69822 - DNA, 20 bp, Artificial Sequence
  Description of Artificial Sequence: Synthetic oligonucleotide
  Target: SCN10A; (+) strand; PAM type: YTN; PAM sequence: TTT
tcctgcacctattgagatga

SEQ ID NO: 69823 - DNA, 20 bp, Artificial Sequence
  Description of Artificial Sequence: Synthetic oligonucleotide
  Target: SCN10A; (+) strand; PAM type: YTN; PAM sequence: TTT
cctgcacctattgagatgat

SEQ ID NO: 69824 - DNA, 20 bp, Artificial Sequence
  Description of Artificial Sequence: Synthetic oligonucleotide
  Target: SCN10A; (+) strand; PAM type: YTN; PAM sequence: TTC
ctgcacctattgagatgatc

SEQ ID NO: 69825 - DNA, 20 bp, Artificial Sequence
  Description of Artificial Sequence: Synthetic oligonucleotide
  Target: SCN10A; (+) strand; PAM type: YTN; PAM sequence: CTG
cacctattgagatgatcata

SEQ ID NO: 69826 - DNA, 20 bp, Artificial Sequence
  Description of Artificial Sequence: Synthetic oligonucleotide
  Target: SCN10A; (+) strand; PAM type: YTN; PAM sequence: CTA
ttgagatgatcatatgattt

SEQ ID NO: 69827 - DNA, 20 bp, Artificial Sequence
  Description of Artificial Sequence: Synthetic oligonucleotide
  Target: SCN10A; (+) strand; PAM type: YTN; PAM sequence: TTG
agatgatcatatgatttttg

SEQ ID NO: 69828 - DNA, 20 bp, Artificial Sequence
  Description of Artificial Sequence: Synthetic oligonucleotide
  Target: SCN10A; (+) strand; PAM type: YTN; PAM sequence: TTT
ttgtttttaattctgtttat

SEQ ID NO: 69829 - DNA, 20 bp, Artificial Sequence
  Description of Artificial Sequence: Synthetic oligonucleotide
  Target: SCN10A; (+) strand; PAM type: YTN; PAM sequence: TTT
tgtttttaattctgtttatg

SEQ ID NO: 69830 - DNA, 20 bp, Artificial Sequence
  Description of Artificial Sequence: Synthetic oligonucleotide
  Target: SCN10A; (+) strand; PAM type: YTN; PAM sequence: TTT
gtttttaattctgtttatgt

SEQ ID NO: 69831 - DNA, 20 bp, Artificial Sequence
  Description of Artificial Sequence: Synthetic oligonucleotide
  Target: SCN10A; (+) strand; PAM type: YTN; PAM sequence: TTG
tttttaattctgtttatgtg

SEQ ID NO: 69832 - DNA, 20 bp, Artificial Sequence
  Description of Artificial Sequence: Synthetic oligonucleotide
  Target: SCN10A; (+) strand; PAM type: YTN; PAM sequence: TTT
ttaattctgtttatgtgacg

SEQ ID NO: 69833 - DNA, 20 bp, Artificial Sequence
  Description of Artificial Sequence: Synthetic oligonucleotide
  Target: SCN10A; (+) strand; PAM type: YTN; PAM sequence: TTT
taattctgtttatgtgacgt

SEQ ID NO: 69834 - DNA, 20 bp, Artificial Sequence
  Description of Artificial Sequence: Synthetic oligonucleotide
  Target: SCN10A; (+) strand; PAM type: YTN; PAM sequence: TTT
aattctgtttatgtgacgtg

SEQ ID NO: 69835 - DNA, 20 bp, Artificial Sequence
  Description of Artificial Sequence: Synthetic oligonucleotide
  Target: SCN10A; (+) strand; PAM type: YTN; PAM sequence: TTA
attctgtttatgtgacgtgc

SEQ ID NO: 69836 - DNA, 20 bp, Artificial Sequence
  Description of Artificial Sequence: Synthetic oligonucleotide
  Target: SCN10A; (+) strand; PAM type: YTN; PAM sequence: TTC
tgtttatgtgacgtgcagca

SEQ ID NO: 69837 - DNA, 20 bp, Artificial Sequence
  Description of Artificial Sequence: Synthetic oligonucleotide
  Target: SCN10A; (+) strand; PAM type: YTN; PAM sequence: CTG
tttatgtgacgtgcagcatt

SEQ ID NO: 69838 - DNA, 20 bp, Artificial Sequence
  Description of Artificial Sequence: Synthetic oligonucleotide
  Target: SCN10A; (+) strand; PAM type: YTN; PAM sequence: TTT
atgtgacgtgcagcatttat

SEQ ID NO: 69839 - DNA, 20 bp, Artificial Sequence
  Description of Artificial Sequence: Synthetic oligonucleotide
  Target: SCN10A; (+) strand; PAM type: YTN; PAM sequence: TTA
tgtgacgtgcagcatttatt

SEQ ID NO: 69840 - DNA, 20 bp, Artificial Sequence
  Description of Artificial Sequence: Synthetic oligonucleotide
  Target: SCN10A; (+) strand; PAM type: YTN; PAM sequence: TTT
attgacttgtgtatgttaaa

SEQ ID NO: 69841 - DNA, 20 bp, Artificial Sequence
  Description of Artificial Sequence: Synthetic oligonucleotide
  Target: SCN10A; (+) strand; PAM type: YTN; PAM sequence: TTA
ttgacttgtgtatgttaaat

SEQ ID NO: 69842 - DNA, 20 bp, Artificial Sequence
  Description of Artificial Sequence: Synthetic oligonucleotide
  Target: SCN10A; (+) strand; PAM type: YTN; PAM sequence: TTG
acttgtgtatgttaaatcat

SEQ ID NO: 69843 - DNA, 20 bp, Artificial Sequence
  Description of Artificial Sequence: Synthetic oligonucleotide
  Target: SCN10A; (+) strand; PAM type: YTN; PAM sequence: CTT
gtgtatgttaaatcatccct

SEQ ID NO: 69844 - DNA, 20 bp, Artificial Sequence
  Description of Artificial Sequence: Synthetic oligonucleotide
  Target: SCN10A; (+) strand; PAM type: YTN; PAM sequence: TTG
tgtatgttaaatcatcccta

SEQ ID NO: 69845 - DNA, 20 bp, Artificial Sequence
  Description of Artificial Sequence: Synthetic oligonucleotide
  Target: SCN10A; (+) strand; PAM type: YTN; PAM sequence: TTA
aatcatccctacctccctgg

SEQ ID NO: 69846 - DNA, 20 bp, Artificial Sequence
  Description of Artificial Sequence: Synthetic oligonucleotide
  Target: SCN10A; (+) strand; PAM type: YTN; PAM sequence: CTA
cctccctggtatgaaacccc

SEQ ID NO: 69847 - DNA, 20 bp, Artificial Sequence
  Description of Artificial Sequence: Synthetic oligonucleotide
  Target: SCN10A; (+) strand; PAM type: YTN; PAM sequence: CTC
cctggtatgaaacccccttg

SEQ ID NO: 69848 - DNA, 20 bp, Artificial Sequence
  Description of Artificial Sequence: Synthetic oligonucleotide
  Target: SCN10A; (+) strand; PAM type: YTN; PAM sequence: CTG
gtatgaaacccccttgatca

SEQ ID NO: 69849 - DNA, 20 bp, Artificial Sequence
  Description of Artificial Sequence: Synthetic oligonucleotide
  Target: SCN10A; (+) strand; PAM type: YTN; PAM sequence: CTT
gatcatggtgtgttatcttt

SEQ ID NO: 69850 - DNA, 20 bp, Artificial Sequence
  Description of Artificial Sequence: Synthetic oligonucleotide
  Target: SCN10A; (+) strand; PAM type: YTN; PAM sequence: TTG
atcatggtgtgttatctttt

SEQ ID NO: 69851 - DNA, 20 bp, Artificial Sequence
  Description of Artificial Sequence: Synthetic oligonucleotide
  Target: SCN10A; (+) strand; PAM type: YTN; PAM sequence: TTA
tcttttggatatgtgttgga

SEQ ID NO: 69852 - DNA, 20 bp, Artificial Sequence
  Description of Artificial Sequence: Synthetic oligonucleotide
  Target: SCN10A; (+) strand; PAM type: YTN; PAM sequence: CTT
ttggatatgtgttggattca

SEQ ID NO: 69853 - DNA, 20 bp, Artificial Sequence
  Description of Artificial Sequence: Synthetic oligonucleotide
  Target: SCN10A; (+) strand; PAM type: YTN; PAM sequence: TTT
tggatatgtgttggattcaa

SEQ ID NO: 69854 - DNA, 20 bp, Artificial Sequence
  Description of Artificial Sequence: Synthetic oligonucleotide
  Target: SCN10A; (+) strand; PAM type: YTN; PAM sequence: TTT
ggatatgtgttggattcaat

SEQ ID NO: 69855 - DNA, 20 bp, Artificial Sequence
  Description of Artificial Sequence: Synthetic oligonucleotide
  Target: SCN10A; (+) strand; PAM type: YTN; PAM sequence: TTG
gatatgtgttggattcaatt

SEQ ID NO: 69856 - DNA, 20 bp, Artificial Sequence
  Description of Artificial Sequence: Synthetic oligonucleotide
  Target: SCN10A; (+) strand; PAM type: YTN; PAM sequence: TTG
gattcaattagctagcattt

SEQ ID NO: 69857 - DNA, 20 bp, Artificial Sequence
  Description of Artificial Sequence: Synthetic oligonucleotide
  Target: SCN10A; (+) strand; PAM type: YTN; PAM sequence: TTC
aattagctagcattttgttg

SEQ ID NO: 69858 - DNA, 20 bp, Artificial Sequence
  Description of Artificial Sequence: Synthetic oligonucleotide
  Target: SCN10A; (+) strand; PAM type: YTN; PAM sequence: TTA
gctagcattttgttgaggat

SEQ ID NO: 69859 - DNA, 20 bp, Artificial Sequence
  Description of Artificial Sequence: Synthetic oligonucleotide
  Target: SCN10A; (+) strand; PAM type: YTN; PAM sequence: CTA
gcattttgttgaggattttt

SEQ ID NO: 69860 - DNA, 20 bp, Artificial Sequence
  Description of Artificial Sequence: Synthetic oligonucleotide
  Target: SCN10A; (+) strand; PAM type: YTN; PAM sequence: TTT
tgttgaggatttttgcatct

SEQ ID NO: 69861 - DNA, 20 bp, Artificial Sequence
  Description of Artificial Sequence: Synthetic oligonucleotide
  Target: SCN10A; (+) strand; PAM type: YTN; PAM sequence: TTT
gttgaggatttttgcatcta

SEQ ID NO: 69862 - DNA, 20 bp, Artificial Sequence
  Description of Artificial Sequence: Synthetic oligonucleotide
  Target: SCN10A; (+) strand; PAM type: YTN; PAM sequence: TTG
ttgaggatttttgcatctat

SEQ ID NO: 69863 - DNA, 20 bp, Artificial Sequence
  Description of Artificial Sequence: Synthetic oligonucleotide
  Target: SCN10A; (+) strand; PAM type: YTN; PAM sequence: TTG
aggatttttgcatctatgtt

SEQ ID NO: 69864 - DNA, 20 bp, Artificial Sequence
  Description of Artificial Sequence: Synthetic oligonucleotide
  Target: SCN10A; (+) strand; PAM type: YTN; PAM sequence: TTT
ttgcatctatgttcatcagg

SEQ ID NO: 69865 - DNA, 20 bp, Artificial Sequence
  Description of Artificial Sequence: Synthetic oligonucleotide
  Target: SCN10A; (+) strand; PAM type: YTN; PAM sequence: TTT
tgcatctatgttcatcaggg

SEQ ID NO: 69866 - DNA, 20 bp, Artificial Sequence
  Description of Artificial Sequence: Synthetic oligonucleotide
  Target: SCN10A; (+) strand; PAM type: YTN; PAM sequence: TTT
gcatctatgttcatcaggga

SEQ ID NO: 69867 - DNA, 20 bp, Artificial Sequence
  Description of Artificial Sequence: Synthetic oligonucleotide
  Target: SCN10A; (+) strand; PAM type: YTN; PAM sequence: TTG
catctatgttcatcagggat

SEQ ID NO: 69868 - DNA, 20 bp, Artificial Sequence
  Description of Artificial Sequence: Synthetic oligonucleotide
  Target: SCN10A; (+) strand; PAM type: YTN; PAM sequence: CTA
tgttcatcagggatattgtc

SEQ ID NO: 69869 - DNA, 20 bp, Artificial Sequence
  Description of Artificial Sequence: Synthetic oligonucleotide
  Target: SCN10A; (+) strand; PAM type: YTN; PAM sequence: TTC
atcagggatattgtctgtag

SEQ ID NO: 69870 - DNA, 20 bp, Artificial Sequence
  Description of Artificial Sequence: Synthetic oligonucleotide
  Target: SCN10A; (+) strand; PAM type: YTN; PAM sequence: TTG
tctgtagttcttttttaaaa

SEQ ID NO: 69871 - DNA, 20 bp, Artificial Sequence
  Description of Artificial Sequence: Synthetic oligonucleotide
  Target: SCN10A; (+) strand; PAM type: YTN; PAM sequence: CTG
tagttcttttttaaaagtcc

SEQ ID NO: 69872 - DNA, 20 bp, Artificial Sequence
  Description of Artificial Sequence: Synthetic oligonucleotide
  Target: SCN10A; (+) strand; PAM type: YTN; PAM sequence: TTC
ttttttaaaagtccttttct

SEQ ID NO: 69873 - DNA, 20 bp, Artificial Sequence
  Description of Artificial Sequence: Synthetic oligonucleotide
  Target: SCN10A; (+) strand; PAM type: YTN; PAM sequence: CTT
ttttaaaagtccttttctgg

SEQ ID NO: 69874 - DNA, 20 bp, Artificial Sequence
  Description of Artificial Sequence: Synthetic oligonucleotide
  Target: SCN10A; (+) strand; PAM type: YTN; PAM sequence: TTT
tttaaaagtccttttctggt

SEQ ID NO: 69875 - DNA, 20 bp, Artificial Sequence
  Description of Artificial Sequence: Synthetic oligonucleotide
  Target: SCN10A; (+) strand; PAM type: YTN; PAM sequence: TTT
ttaaaagtccttttctggtt

SEQ ID NO: 69876 - DNA, 20 bp, Artificial Sequence
  Description of Artificial Sequence: Synthetic oligonucleotide
  Target: SCN10A; (+) strand; PAM type: YTN; PAM sequence: TTT
taaaagtccttttctggttt

SEQ ID NO: 69877 - DNA, 20 bp, Artificial Sequence
  Description of Artificial Sequence: Synthetic oligonucleotide
  Target: SCN10A; (+) strand; PAM type: YTN; PAM sequence: TTT
aaaagtccttttctggtttt

SEQ ID NO: 69878 - DNA, 20 bp, Artificial Sequence
  Description of Artificial Sequence: Synthetic oligonucleotide
  Target: SCN10A; (+) strand; PAM type: YTN; PAM sequence: TTA
aaagtccttttctggttttg

SEQ ID NO: 69879 - DNA, 20 bp, Artificial Sequence
  Description of Artificial Sequence: Synthetic oligonucleotide
  Target: SCN10A; (+) strand; PAM type: YTN; PAM sequence: CTT
ttctggttttggtattaggg

SEQ ID NO: 69880 - DNA, 20 bp, Artificial Sequence
  Description of Artificial Sequence: Synthetic oligonucleotide
  Target: SCN10A; (+) strand; PAM type: YTN; PAM sequence: TTT
tctggttttggtattagggt

SEQ ID NO: 69881 - DNA, 20 bp, Artificial Sequence
  Description of Artificial Sequence: Synthetic oligonucleotide
  Target: SCN10A; (+) strand; PAM type: YTN; PAM sequence: TTT
ctggttttggtattagggtg

SEQ ID NO: 69882 - DNA, 20 bp, Artificial Sequence
  Description of Artificial Sequence: Synthetic oligonucleotide
  Target: SCN10A; (+) strand; PAM type: YTN; PAM sequence: TTC
tggttttggtattagggtga

SEQ ID NO: 69883 - DNA, 20 bp, Artificial Sequence
  Description of Artificial Sequence: Synthetic oligonucleotide
  Target: SCN10A; (+) strand; PAM type: YTN; PAM sequence: CTG
gttttggtattagggtgata

SEQ ID NO: 69884 - DNA, 20 bp, Artificial Sequence
  Description of Artificial Sequence: Synthetic oligonucleotide
  Target: SCN10A; (+) strand; PAM type: YTN; PAM sequence: TTT
tggtattagggtgatactgg

SEQ ID NO: 69885 - DNA, 20 bp, Artificial Sequence
  Description of Artificial Sequence: Synthetic oligonucleotide
  Target: SCN10A; (+) strand; PAM type: YTN; PAM sequence: TTT
ggtattagggtgatactggc

SEQ ID NO: 69886 - DNA, 20 bp, Artificial Sequence
  Description of Artificial Sequence: Synthetic oligonucleotide
  Target: SCN10A; (+) strand; PAM type: YTN; PAM sequence: TTG
gtattagggtgatactggct

SEQ ID NO: 69887 - DNA, 20 bp, Artificial Sequence
  Description of Artificial Sequence: Synthetic oligonucleotide
  Target: SCN10A; (+) strand; PAM type: YTN; PAM sequence: TTA
gggtgatactggcttcataa

SEQ ID NO: 69888 - DNA, 20 bp, Artificial Sequence
  Description of Artificial Sequence: Synthetic oligonucleotide
  Target: SCN10A; (+) strand; PAM type: YTN; PAM sequence: CTG
gcttcataaaatgatttagg

SEQ ID NO: 69889 - DNA, 20 bp, Artificial Sequence
  Description of Artificial Sequence: Synthetic oligonucleotide
  Target: SCN10A; (+) strand; PAM type: YTN; PAM sequence: CTT
cataaaatgatttaggagga

SEQ ID NO: 69890 - DNA, 20 bp, Artificial Sequence
  Description of Artificial Sequence: Synthetic oligonucleotide
  Target: SCN10A; (+) strand; PAM type: YTN; PAM sequence: TTC
ataaaatgatttaggaggat

SEQ ID NO: 69891 - DNA, 20 bp, Artificial Sequence
  Description of Artificial Sequence: Synthetic oligonucleotide
  Target: SCN10A; (+) strand; PAM type: YTN; PAM sequence: TTT
aggaggattccctctttctg

SEQ ID NO: 69892 - DNA, 20 bp, Artificial Sequence
  Description of Artificial Sequence: Synthetic oligonucleotide
  Target: SCN10A; (+) strand; PAM type: YTN; PAM sequence: TTA
ggaggattccctctttctgc

SEQ ID NO: 69893 - DNA, 20 bp, Artificial Sequence
  Description of Artificial Sequence: Synthetic oligonucleotide
  Target: SCN10A; (+) strand; PAM type: YTN; PAM sequence: TTC
cctctttctgcatcttttgg

SEQ ID NO: 69894 - DNA, 20 bp, Artificial Sequence
  Description of Artificial Sequence: Synthetic oligonucleotide
  Target: SCN10A; (+) strand; PAM type: YTN; PAM sequence: CTC
tttctgcatcttttggaata

SEQ ID NO: 69895 - DNA, 20 bp, Artificial Sequence
  Description of Artificial Sequence: Synthetic oligonucleotide
  Target: SCN10A; (+) strand; PAM type: YTN; PAM sequence: CTT
tctgcatcttttggaatagt

SEQ ID NO: 69896 - DNA, 20 bp, Artificial Sequence
  Description of Artificial Sequence: Synthetic oligonucleotide
  Target: SCN10A; (+) strand; PAM type: YTN; PAM sequence: TTT
ctgcatcttttggaatagtt

SEQ ID NO: 69897 - DNA, 20 bp, Artificial Sequence
  Description of Artificial Sequence: Synthetic oligonucleotide
  Target: SCN10A; (+) strand; PAM type: YTN; PAM sequence: TTC
tgcatcttttggaatagttt

SEQ ID NO: 69898 - DNA, 20 bp, Artificial Sequence
  Description of Artificial Sequence: Synthetic oligonucleotide
  Target: SCN10A; (+) strand; PAM type: YTN; PAM sequence: CTG
catcttttggaatagtttca

SEQ ID NO: 69899 - DNA, 20 bp, Artificial Sequence
  Description of Artificial Sequence: Synthetic oligonucleotide
  Target: SCN10A; (+) strand; PAM type: YTN; PAM sequence: CTT
ttggaatagtttcaataaaa

SEQ ID NO: 69900 - DNA, 20 bp, Artificial Sequence
  Description of Artificial Sequence: Synthetic oligonucleotide
  Target: SCN10A; (+) strand; PAM type: YTN; PAM sequence: TTT
tggaatagtttcaataaaat

SEQ ID NO: 69901 - DNA, 20 bp, Artificial Sequence
  Description of Artificial Sequence: Synthetic oligonucleotide
  Target: SCN10A; (+) strand; PAM type: YTN; PAM sequence: TTT
ggaatagtttcaataaaatt

SEQ ID NO: 69902 - DNA, 20 bp, Artificial Sequence
  Description of Artificial Sequence: Synthetic oligonucleotide
  Target: SCN10A; (+) strand; PAM type: YTN; PAM sequence: TTG
gaatagtttcaataaaattg

SEQ ID NO: 69903 - DNA, 20 bp, Artificial Sequence
  Description of Artificial Sequence: Synthetic oligonucleotide
  Target: SCN10A; (+) strand; PAM type: YTN; PAM sequence: TTT
caataaaattggtaccaatt

SEQ ID NO: 69904 - DNA, 20 bp, Artificial Sequence
  Description of Artificial Sequence: Synthetic oligonucleotide
  Target: SCN10A; (+) strand; PAM type: YTN; PAM sequence: TTC
aataaaattggtaccaattc

SEQ ID NO: 69905 - DNA, 20 bp, Artificial Sequence
  Description of Artificial Sequence: Synthetic oligonucleotide
  Target: SCN10A; (+) strand; PAM type: YTN; PAM sequence: TTG
gtaccaattcttctttgaat

SEQ ID NO: 69906 - DNA, 20 bp, Artificial Sequence
  Description of Artificial Sequence: Synthetic oligonucleotide
  Target: SCN10A; (+) strand; PAM type: YTN; PAM sequence: TTC
ttctttgaatgtctgataga

SEQ ID NO: 69907 - DNA, 20 bp, Artificial Sequence
  Description of Artificial Sequence: Synthetic oligonucleotide
  Target: SCN10A; (+) strand; PAM type: YTN; PAM sequence: CTT
ctttgaatgtctgatagaat

SEQ ID NO: 69908 - DNA, 20 bp, Artificial Sequence
  Description of Artificial Sequence: Synthetic oligonucleotide
  Target: SCN10A; (+) strand; PAM type: YTN; PAM sequence: TTC
tttgaatgtctgatagaatt

SEQ ID NO: 69909 - DNA, 20 bp, Artificial Sequence
  Description of Artificial Sequence: Synthetic oligonucleotide
  Target: SCN10A; (+) strand; PAM type: YTN; PAM sequence: CTT
tgaatgtctgatagaattca

SEQ ID NO: 69910 - DNA, 20 bp, Artificial Sequence
  Description of Artificial Sequence: Synthetic oligonucleotide
  Target: SCN10A; (+) strand; PAM type: YTN; PAM sequence: TTT
gaatgtctgatagaattcag

SEQ ID NO: 69911 - DNA, 20 bp, Artificial Sequence
  Description of Artificial Sequence: Synthetic oligonucleotide
  Target: SCN10A; (+) strand; PAM type: YTN; PAM sequence: TTG
aatgtctgatagaattcagc

SEQ ID NO: 69912 - DNA, 20 bp, Artificial Sequence
  Description of Artificial Sequence: Synthetic oligonucleotide
  Target: SCN10A; (+) strand; PAM type: YTN; PAM sequence: CTG
atagaattcagctgtgaatc

SEQ ID NO: 69913 - DNA, 20 bp, Artificial Sequence
  Description of Artificial Sequence: Synthetic oligonucleotide
  Target: SCN10A; (+) strand; PAM type: YTN; PAM sequence: TTC
agctgtgaatccagtctgct

SEQ ID NO: 69914 - DNA, 20 bp, Artificial Sequence
  Description of Artificial Sequence: Synthetic oligonucleotide
  Target: SCN10A; (+) strand; PAM type: YTN; PAM sequence: CTG
tgaatccagtctgctcctgg

SEQ ID NO: 69915 - DNA, 20 bp, Artificial Sequence
  Description of Artificial Sequence: Synthetic oligonucleotide
  Target: SCN10A; (+) strand; PAM type: YTN; PAM sequence: CTG
ctcctggactttttttcctt

SEQ ID NO: 69916 - DNA, 20 bp, Artificial Sequence
  Description of Artificial Sequence: Synthetic oligonucleotide
  Target: SCN10A; (+) strand; PAM type: YTN; PAM sequence: CTC
ctggactttttttccttggc

SEQ ID NO: 69917 - DNA, 20 bp, Artificial Sequence
  Description of Artificial Sequence: Synthetic oligonucleotide
  Target: SCN10A; (+) strand; PAM type: YTN; PAM sequence: CTG
gactttttttccttggcaat

SEQ ID NO: 69918 - DNA, 20 bp, Artificial Sequence
  Description of Artificial Sequence: Synthetic oligonucleotide
  Target: SCN10A; (+) strand; PAM type: YTN; PAM sequence: CTT
tttttccttggcaatttttg

SEQ ID NO: 69919 - DNA, 20 bp, Artificial Sequence
  Description of Artificial Sequence: Synthetic oligonucleotide
  Target: SCN10A; (+) strand; PAM type: YTN; PAM sequence: TTT
ttttccttggcaatttttga

SEQ ID NO: 69920 - DNA, 20 bp, Artificial Sequence
  Description of Artificial Sequence: Synthetic oligonucleotide
  Target: SCN10A; (+) strand; PAM type: YTN; PAM sequence: TTT
tttccttggcaatttttgaa

SEQ ID NO: 69921 - DNA, 20 bp, Artificial Sequence
  Description of Artificial Sequence: Synthetic oligonucleotide
  Target: SCN10A; (+) strand; PAM type: YTN; PAM sequence: TTT
ttccttggcaatttttgaat

SEQ ID NO: 69922 - DNA, 20 bp, Artificial Sequence
  Description of Artificial Sequence: Synthetic oligonucleotide
  Target: SCN10A; (+) strand; PAM type: YTN; PAM sequence: TTT
tccttggcaatttttgaatt

SEQ ID NO: 69923 - DNA, 20 bp, Artificial Sequence
  Description of Artificial Sequence: Synthetic oligonucleotide
  Target: SCN10A; (+) strand; PAM type: YTN; PAM sequence: TTT
ccttggcaatttttgaatta

SEQ ID NO: 69924 - DNA, 20 bp, Artificial Sequence
  Description of Artificial Sequence: Synthetic oligonucleotide
  Target: SCN10A; (+) strand; PAM type: YTN; PAM sequence: TTC
cttggcaatttttgaattac

SEQ ID NO: 69925 - DNA, 20 bp, Artificial Sequence
  Description of Artificial Sequence: Synthetic oligonucleotide
  Target: SCN10A; (+) strand; PAM type: YTN; PAM sequence: CTT
ggcaatttttgaattactgt

SEQ ID NO: 69926 - DNA, 20 bp, Artificial Sequence
  Description of Artificial Sequence: Synthetic oligonucleotide
  Target: SCN10A; (+) strand; PAM type: YTN; PAM sequence: TTG
gcaatttttgaattactgtt

SEQ ID NO: 69927 - DNA, 20 bp, Artificial Sequence
  Description of Artificial Sequence: Synthetic oligonucleotide
  Target: SCN10A; (+) strand; PAM type: YTN; PAM sequence: TTT
ttgaattactgtttcaatct

SEQ ID NO: 69928 - DNA, 20 bp, Artificial Sequence
  Description of Artificial Sequence: Synthetic oligonucleotide
  Target: SCN10A; (+) strand; PAM type: YTN; PAM sequence: TTT
tgaattactgtttcaatctc

SEQ ID NO: 69929 - DNA, 20 bp, Artificial Sequence
  Description of Artificial Sequence: Synthetic oligonucleotide
  Target: SCN10A; (+) strand; PAM type: YTN; PAM sequence: TTT
gaattactgtttcaatctcg

SEQ ID NO: 69930 - DNA, 20 bp, Artificial Sequence
  Description of Artificial Sequence: Synthetic oligonucleotide
  Target: SCN10A; (+) strand; PAM type: YTN; PAM sequence: TTG
aattactgtttcaatctcgc

SEQ ID NO: 69931 - DNA, 20 bp, Artificial Sequence
  Description of Artificial Sequence: Synthetic oligonucleotide
  Target: SCN10A; (+) strand; PAM type: YTN; PAM sequence: TTA
ctgtttcaatctcgctactt

SEQ ID NO: 69932 - DNA, 20 bp, Artificial Sequence
  Description of Artificial Sequence: Synthetic oligonucleotide
  Target: SCN10A; (+) strand; PAM type: YTN; PAM sequence: CTG
tttcaatctcgctacttgtt

SEQ ID NO: 69933 - DNA, 20 bp, Artificial Sequence
  Description of Artificial Sequence: Synthetic oligonucleotide
  Target: SCN10A; (+) strand; PAM type: YTN; PAM sequence: TTT
caatctcgctacttgttatt

SEQ ID NO: 69934 - DNA, 20 bp, Artificial Sequence
  Description of Artificial Sequence: Synthetic oligonucleotide
  Target: SCN10A; (+) strand; PAM type: YTN; PAM sequence: TTC
aatctcgctacttgttattg

SEQ ID NO: 69935 - DNA, 20 bp, Artificial Sequence
  Description of Artificial Sequence: Synthetic oligonucleotide
  Target: SCN10A; (+) strand; PAM type: YTN; PAM sequence: CTC
gctacttgttattggtctgt

SEQ ID NO: 69936 - DNA, 20 bp, Artificial Sequence
  Description of Artificial Sequence: Synthetic oligonucleotide
  Target: SCN10A; (+) strand; PAM type: YTN; PAM sequence: CTA
cttgttattggtctgtttag

SEQ ID NO: 69937 - DNA, 20 bp, Artificial Sequence
  Description of Artificial Sequence: Synthetic oligonucleotide
  Target: SCN10A; (+) strand; PAM type: YTN; PAM sequence: CTT
gttattggtctgtttagagt

SEQ ID NO: 69938 - DNA, 20 bp, Artificial Sequence
  Description of Artificial Sequence: Synthetic oligonucleotide
  Target: SCN10A; (+) strand; PAM type: YTN; PAM sequence: TTG
ttattggtctgtttagagtt

SEQ ID NO: 69939 - DNA, 20 bp, Artificial Sequence
  Description of Artificial Sequence: Synthetic oligonucleotide
  Target: SCN10A; (+) strand; PAM type: YTN; PAM sequence: TTA
ttggtctgtttagagtttct

SEQ ID NO: 69940 - DNA, 20 bp, Artificial Sequence
  Description of Artificial Sequence: Synthetic oligonucleotide
  Target: SCN10A; (+) strand; PAM type: YTN; PAM sequence: TTG
gtctgtttagagtttctatt

SEQ ID NO: 69941 - DNA, 20 bp, Artificial Sequence
  Description of Artificial Sequence: Synthetic oligonucleotide
  Target: SCN10A; (+) strand; PAM type: YTN; PAM sequence: CTG
tttagagtttctattacttt

SEQ ID NO: 69942 - DNA, 20 bp, Artificial Sequence
  Description of Artificial Sequence: Synthetic oligonucleotide
  Target: SCN10A; (+) strand; PAM type: YTN; PAM sequence: TTT
agagtttctattactttctg

SEQ ID NO: 69943 - DNA, 20 bp, Artificial Sequence
  Description of Artificial Sequence: Synthetic oligonucleotide
  Target: SCN10A; (+) strand; PAM type: YTN; PAM sequence: TTA
gagtttctattactttctga

SEQ ID NO: 69944 - DNA, 20 bp, Artificial Sequence
  Description of Artificial Sequence: Synthetic oligonucleotide
  Target: SCN10A; (+) strand; PAM type: YTN; PAM sequence: TTT
ctattactttctgatttaat

SEQ ID NO: 69945 - DNA, 20 bp, Artificial Sequence
  Description of Artificial Sequence: Synthetic oligonucleotide
  Target: SCN10A; (+) strand; PAM type: YTN; PAM sequence: TTC
tattactttctgatttaatc

SEQ ID NO: 69946 - DNA, 20 bp, Artificial Sequence
  Description of Artificial Sequence: Synthetic oligonucleotide
  Target: SCN10A; (+) strand; PAM type: YTN; PAM sequence: CTA
ttactttctgatttaatcta

SEQ ID NO: 69947 - DNA, 20 bp, Artificial Sequence
  Description of Artificial Sequence: Synthetic oligonucleotide
  Target: SCN10A; (+) strand; PAM type: YTN; PAM sequence: TTA
ctttctgatttaatctaaga

SEQ ID NO: 69948 - DNA, 20 bp, Artificial Sequence
  Description of Artificial Sequence: Synthetic oligonucleotide
  Target: SCN10A; (+) strand; PAM type: YTN; PAM sequence: CTT
tctgatttaatctaagacag

SEQ ID NO: 69949 - DNA, 20 bp, Artificial Sequence
  Description of Artificial Sequence: Synthetic oligonucleotide
  Target: SCN10A; (+) strand; PAM type: YTN; PAM sequence: TTT
ctgatttaatctaagacagt

SEQ ID NO: 69950 - DNA, 20 bp, Artificial Sequence
  Description of Artificial Sequence: Synthetic oligonucleotide
  Target: SCN10A; (+) strand; PAM type: YTN; PAM sequence: TTC
tgatttaatctaagacagtt

SEQ ID NO: 69951 - DNA, 20 bp, Artificial Sequence
  Description of Artificial Sequence: Synthetic oligonucleotide
  Target: SCN10A; (+) strand; PAM type: YTN; PAM sequence: CTG
atttaatctaagacagttgt

SEQ ID NO: 69952 - DNA, 20 bp, Artificial Sequence
  Description of Artificial Sequence: Synthetic oligonucleotide
  Target: SCN10A; (+) strand; PAM type: YTN; PAM sequence: TTT
aatctaagacagttgtatat

SEQ ID NO: 69953 - DNA, 20 bp, Artificial Sequence
  Description of Artificial Sequence: Synthetic oligonucleotide
  Target: SCN10A; (+) strand; PAM type: YTN; PAM sequence: TTA
atctaagacagttgtatatt

SEQ ID NO: 69954 - DNA, 20 bp, Artificial Sequence
  Description of Artificial Sequence: Synthetic oligonucleotide
  Target: SCN10A; (+) strand; PAM type: YTN; PAM sequence: CTA
agacagttgtatatttccag

SEQ ID NO: 69955 - DNA, 20 bp, Artificial Sequence
  Description of Artificial Sequence: Synthetic oligonucleotide
  Target: SCN10A; (+) strand; PAM type: YTN; PAM sequence: TTG
tatatttccaggaatttatt

SEQ ID NO: 69956 - DNA, 20 bp, Artificial Sequence
  Description of Artificial Sequence: Synthetic oligonucleotide
  Target: SCN10A; (+) strand; PAM type: YTN; PAM sequence: TTT
ccaggaatttattcatctcc

SEQ ID NO: 69957 - DNA, 20 bp, Artificial Sequence
  Description of Artificial Sequence: Synthetic oligonucleotide
  Target: SCN10A; (+) strand; PAM type: YTN; PAM sequence: TTC
caggaatttattcatctcct

SEQ ID NO: 69958 - DNA, 20 bp, Artificial Sequence
  Description of Artificial Sequence: Synthetic oligonucleotide
  Target: SCN10A; (+) strand; PAM type: YTN; PAM sequence: TTT
attcatctcctctaaatttt

SEQ ID NO: 69959 - DNA, 20 bp, Artificial Sequence
  Description of Artificial Sequence: Synthetic oligonucleotide
  Target: SCN10A; (+) strand; PAM type: YTN; PAM sequence: TTA
ttcatctcctctaaattttc

SEQ ID NO: 69960 - DNA, 20 bp, Artificial Sequence
  Description of Artificial Sequence: Synthetic oligonucleotide
  Target: SCN10A; (+) strand; PAM type: YTN; PAM sequence: TTC
atctcctctaaattttctag

SEQ ID NO: 69961 - DNA, 20 bp, Artificial Sequence
  Description of Artificial Sequence: Synthetic oligonucleotide
  Target: SCN10A; (+) strand; PAM type: YTN; PAM sequence: CTC
ctctaaattttctagtttgt

SEQ ID NO: 69962 - DNA, 20 bp, Artificial Sequence
  Description of Artificial Sequence: Synthetic oligonucleotide
  Target: SCN10A; (+) strand; PAM type: YTN; PAM sequence: CTC
taaattttctagtttgtgca

SEQ ID NO: 69963 - DNA, 20 bp, Artificial Sequence
  Description of Artificial Sequence: Synthetic oligonucleotide
  Target: SCN10A; (+) strand; PAM type: YTN; PAM sequence: CTA
aattttctagtttgtgcaaa

SEQ ID NO: 69964 - DNA, 20 bp, Artificial Sequence
  Description of Artificial Sequence: Synthetic oligonucleotide
  Target: SCN10A; (+) strand; PAM type: YTN; PAM sequence: TTT
tctagtttgtgcaaataaag

SEQ ID NO: 69965 - DNA, 20 bp, Artificial Sequence
  Description of Artificial Sequence: Synthetic oligonucleotide
  Target: SCN10A; (+) strand; PAM type: YTN; PAM sequence: TTT
ctagtttgtgcaaataaagg

SEQ ID NO: 69966 - DNA, 20 bp, Artificial Sequence
  Description of Artificial Sequence: Synthetic oligonucleotide
  Target: SCN10A; (+) strand; PAM type: YTN; PAM sequence: TTC
tagtttgtgcaaataaaggt

SEQ ID NO: 69967 - DNA, 20 bp, Artificial Sequence
  Description of Artificial Sequence: Synthetic oligonucleotide
  Target: SCN10A; (+) strand; PAM type: YTN; PAM sequence: CTA
gtttgtgcaaataaaggtgt

SEQ ID NO: 69968 - DNA, 20 bp, Artificial Sequence
  Description of Artificial Sequence: Synthetic oligonucleotide
  Target: SCN10A; (+) strand; PAM type: YTN; PAM sequence: TTT
gtgcaaataaaggtgttcat

SEQ ID NO: 69969 - DNA, 20 bp, Artificial Sequence
  Description of Artificial Sequence: Synthetic oligonucleotide
  Target: SCN10A; (+) strand; PAM type: YTN; PAM sequence: TTG
tgcaaataaaggtgttcata

SEQ ID NO: 69970 - DNA, 20 bp, Artificial Sequence
  Description of Artificial Sequence: Synthetic oligonucleotide
  Target: SCN10A; (+) strand; PAM type: YTN; PAM sequence: TTC
atagtagccttgaatgattt

SEQ ID NO: 69971 - DNA, 20 bp, Artificial Sequence
  Description of Artificial Sequence: Synthetic oligonucleotide
  Target: SCN10A; (+) strand; PAM type: YTN; PAM sequence: CTT
gaatgattttttttttgtat

SEQ ID NO: 69972 - DNA, 20 bp, Artificial Sequence
  Description of Artificial Sequence: Synthetic oligonucleotide
  Target: SCN10A; (+) strand; PAM type: YTN; PAM sequence: TTG
aatgattttttttttgtatt

SEQ ID NO: 69973 - DNA, 20 bp, Artificial Sequence
  Description of Artificial Sequence: Synthetic oligonucleotide
  Target: SCN10A; (+) strand; PAM type: YTN; PAM sequence: TTT
tttttttgtatttctgtggt

SEQ ID NO: 69974 - DNA, 20 bp, Artificial Sequence
  Description of Artificial Sequence: Synthetic oligonucleotide
  Target: SCN10A; (+) strand; PAM type: YTN; PAM sequence: TTT
ttttttgtatttctgtggta

SEQ ID NO: 69975 - DNA, 20 bp, Artificial Sequence
  Description of Artificial Sequence: Synthetic oligonucleotide
  Target: SCN10A; (+) strand; PAM type: YTN; PAM sequence: TTT
tttttgtatttctgtggtat

SEQ ID NO: 69976 - DNA, 20 bp, Artificial Sequence
  Description of Artificial Sequence: Synthetic oligonucleotide
  Target: SCN10A; (+) strand; PAM type: YTN; PAM sequence: TTT
ttttgtatttctgtggtatc

SEQ ID NO: 69977 - DNA, 20 bp, Artificial Sequence
  Description of Artificial Sequence: Synthetic oligonucleotide
  Target: SCN10A; (+) strand; PAM type: YTN; PAM sequence: TTT
tttgtatttctgtggtatca

SEQ ID NO: 69978 - DNA, 20 bp, Artificial Sequence
  Description of Artificial Sequence: Synthetic oligonucleotide
  Target: SCN10A; (+) strand; PAM type: YTN; PAM sequence: TTT
ttgtatttctgtggtatcag

SEQ ID NO: 69979 - DNA, 20 bp, Artificial Sequence
  Description of Artificial Sequence: Synthetic oligonucleotide
  Target: SCN10A; (+) strand; PAM type: YTN; PAM sequence: TTT
tgtatttctgtggtatcagt

SEQ ID NO: 69980 - DNA, 20 bp, Artificial Sequence
  Description of Artificial Sequence: Synthetic oligonucleotide
  Target: SCN10A; (+) strand; PAM type: YTN; PAM sequence: TTT
gtatttctgtggtatcagtt

SEQ ID NO: 69981 - DNA, 20 bp, Artificial Sequence
  Description of Artificial Sequence: Synthetic oligonucleotide
  Target: SCN10A; (+) strand; PAM type: YTN; PAM sequence: TTG
tatttctgtggtatcagttg

SEQ ID NO: 69982 - DNA, 20 bp, Artificial Sequence
  Description of Artificial Sequence: Synthetic oligonucleotide
  Target: SCN10A; (+) strand; PAM type: YTN; PAM sequence: TTT
ctgtggtatcagttgtaata

SEQ ID NO: 69983 - DNA, 20 bp, Artificial Sequence
  Description of Artificial Sequence: Synthetic oligonucleotide
  Target: SCN10A; (+) strand; PAM type: YTN; PAM sequence: TTC
tgtggtatcagttgtaatat

SEQ ID NO: 69984 - DNA, 20 bp, Artificial Sequence
  Description of Artificial Sequence: Synthetic oligonucleotide
  Target: SCN10A; (+) strand; PAM type: YTN; PAM sequence: CTG
tggtatcagttgtaatatct

SEQ ID NO: 69985 - DNA, 20 bp, Artificial Sequence
  Description of Artificial Sequence: Synthetic oligonucleotide
  Target: SCN10A; (+) strand; PAM type: YTN; PAM sequence: TTG
taatatctcccattttattt

SEQ ID NO: 69986 - DNA, 20 bp, Artificial Sequence
  Description of Artificial Sequence: Synthetic oligonucleotide
  Target: SCN10A; (+) strand; PAM type: YTN; PAM sequence: CTC
ccattttatttctaattgag

SEQ ID NO: 69987 - DNA, 20 bp, Artificial Sequence
  Description of Artificial Sequence: Synthetic oligonucleotide
  Target: SCN10A; (+) strand; PAM type: YTN; PAM sequence: TTT
tatttctaattgagcttatt

SEQ ID NO: 69988 - DNA, 20 bp, Artificial Sequence
  Description of Artificial Sequence: Synthetic oligonucleotide
  Target: SCN10A; (+) strand; PAM type: YTN; PAM sequence: TTT
atttctaattgagcttattt

SEQ ID NO: 69989 - DNA, 20 bp, Artificial Sequence
  Description of Artificial Sequence: Synthetic oligonucleotide
  Target: SCN10A; (+) strand; PAM type: YTN; PAM sequence: TTA
tttctaattgagcttatttg

SEQ ID NO: 69990 - DNA, 20 bp, Artificial Sequence
  Description of Artificial Sequence: Synthetic oligonucleotide
  Target: SCN10A; (+) strand; PAM type: YTN; PAM sequence: TTT
ctaattgagcttatttggat

SEQ ID NO: 69991 - DNA, 20 bp, Artificial Sequence
  Description of Artificial Sequence: Synthetic oligonucleotide
  Target: SCN10A; (+) strand; PAM type: YTN; PAM sequence: TTC
taattgagcttatttggatc

SEQ ID NO: 69992 - DNA, 20 bp, Artificial Sequence
  Description of Artificial Sequence: Synthetic oligonucleotide
  Target: SCN10A; (+) strand; PAM type: YTN; PAM sequence: CTA
attgagcttatttggatctt

SEQ ID NO: 69993 - DNA, 20 bp, Artificial Sequence
  Description of Artificial Sequence: Synthetic oligonucleotide
  Target: SCN10A; (+) strand; PAM type: YTN; PAM sequence: TTG
agcttatttggatcttctct

SEQ ID NO: 69994 - DNA, 20 bp, Artificial Sequence
  Description of Artificial Sequence: Synthetic oligonucleotide
  Target: SCN10A; (+) strand; PAM type: YTN; PAM sequence: CTT
atttggatcttctctcttct

SEQ ID NO: 69995 - DNA, 20 bp, Artificial Sequence
  Description of Artificial Sequence: Synthetic oligonucleotide
  Target: SCN10A; (+) strand; PAM type: YTN; PAM sequence: TTA
tttggatcttctctcttctt

SEQ ID NO: 69996 - DNA, 20 bp, Artificial Sequence
  Description of Artificial Sequence: Synthetic oligonucleotide
  Target: SCN10A; (+) strand; PAM type: YTN; PAM sequence: TTT
ggatcttctctcttcttttc

SEQ ID NO: 69997 - DNA, 20 bp, Artificial Sequence
  Description of Artificial Sequence: Synthetic oligonucleotide
  Target: SCN10A; (+) strand; PAM type: YTN; PAM sequence: TTG
gatcttctctcttcttttct

SEQ ID NO: 69998 - DNA, 20 bp, Artificial Sequence
  Description of Artificial Sequence: Synthetic oligonucleotide
  Target: SCN10A; (+) strand; PAM type: YTN; PAM sequence: CTT
ctctcttcttttcttggtta

SEQ ID NO: 69999 - DNA, 20 bp, Artificial Sequence
  Description of Artificial Sequence: Synthetic oligonucleotide
  Target: SCN10A; (+) strand; PAM type: YTN; PAM sequence: TTC
tctcttcttttcttggttaa

SEQ ID NO: 70000 - DNA, 20 bp, Artificial Sequence
  Description of Artificial Sequence: Synthetic oligonucleotide
  Target: SCN10A; (+) strand; PAM type: YTN; PAM sequence: CTC
tcttcttttcttggttaatc

SEQ ID NO: 70001 - DNA, 20 bp, Artificial Sequence
  Description of Artificial Sequence: Synthetic oligonucleotide
  Target: SCN10A; (+) strand; PAM type: YTN; PAM sequence: CTC
ttcttttcttggttaatctt

SEQ ID NO: 70002 - DNA, 20 bp, Artificial Sequence
  Description of Artificial Sequence: Synthetic oligonucleotide
  Target: SCN10A; (+) strand; PAM type: YTN; PAM sequence: CTT
cttttcttggttaatcttgc

SEQ ID NO: 70003 - DNA, 20 bp, Artificial Sequence
  Description of Artificial Sequence: Synthetic oligonucleotide
  Target: SCN10A; (+) strand; PAM type: YTN; PAM sequence: TTC
ttttcttggttaatcttgcc

SEQ ID NO: 70004 - DNA, 20 bp, Artificial Sequence
  Description of Artificial Sequence: Synthetic oligonucleotide
  Target: SCN10A; (+) strand; PAM type: YTN; PAM sequence: CTT
ttcttggttaatcttgccaa

SEQ ID NO: 70005 - DNA, 20 bp, Artificial Sequence
  Description of Artificial Sequence: Synthetic oligonucleotide
  Target: SCN10A; (+) strand; PAM type: YTN; PAM sequence: TTT
tcttggttaatcttgccaat

SEQ ID NO: 70006 - DNA, 20 bp, Artificial Sequence
  Description of Artificial Sequence: Synthetic oligonucleotide
  Target: SCN10A; (+) strand; PAM type: YTN; PAM sequence: TTT
cttggttaatcttgccaatg

SEQ ID NO: 70007 - DNA, 20 bp, Artificial Sequence
  Description of Artificial Sequence: Synthetic oligonucleotide
  Target: SCN10A; (+) strand; PAM type: YTN; PAM sequence: TTC
ttggttaatcttgccaatgg

SEQ ID NO: 70008 - DNA, 20 bp, Artificial Sequence
  Description of Artificial Sequence: Synthetic oligonucleotide
  Target: SCN10A; (+) strand; PAM type: YTN; PAM sequence: CTT
ggttaatcttgccaatggtc

SEQ ID NO: 70009 - DNA, 20 bp, Artificial Sequence
  Description of Artificial Sequence: Synthetic oligonucleotide
  Target: SCN10A; (+) strand; PAM type: YTN; PAM sequence: TTG
gttaatcttgccaatggtca

SEQ ID NO: 70010 - DNA, 20 bp, Artificial Sequence
  Description of Artificial Sequence: Synthetic oligonucleotide
  Target: SCN10A; (+) strand; PAM type: YTN; PAM sequence: TTA
atcttgccaatggtcaatca

SEQ ID NO: 70011 - DNA, 20 bp, Artificial Sequence
  Description of Artificial Sequence: Synthetic oligonucleotide
  Target: SCN10A; (+) strand; PAM type: YTN; PAM sequence: CTT
gccaatggtcaatcaatttt

SEQ ID NO: 70012 - DNA, 20 bp, Artificial Sequence
  Description of Artificial Sequence: Synthetic oligonucleotide
  Target: SCN10A; (+) strand; PAM type: YTN; PAM sequence: TTG
ccaatggtcaatcaattttc

SEQ ID NO: 70013 - DNA, 20 bp, Artificial Sequence
  Description of Artificial Sequence: Synthetic oligonucleotide
  Target: SCN10A; (+) strand; PAM type: YTN; PAM sequence: TTT
tctatatctttttaaagaac

SEQ ID NO: 70014 - DNA, 20 bp, Artificial Sequence
  Description of Artificial Sequence: Synthetic oligonucleotide
  Target: SCN10A; (+) strand; PAM type: YTN; PAM sequence: TTT
ctatatctttttaaagaacc

SEQ ID NO: 70015 - DNA, 20 bp, Artificial Sequence
  Description of Artificial Sequence: Synthetic oligonucleotide
  Target: SCN10A; (+) strand; PAM type: YTN; PAM sequence: TTC
tatatctttttaaagaaccc

SEQ ID NO: 70016 - DNA, 20 bp, Artificial Sequence
  Description of Artificial Sequence: Synthetic oligonucleotide
  Target: SCN10A; (+) strand; PAM type: YTN; PAM sequence: CTA
tatctttttaaagaacccgc

SEQ ID NO: 70017 - DNA, 20 bp, Artificial Sequence
  Description of Artificial Sequence: Synthetic oligonucleotide
  Target: SCN10A; (+) strand; PAM type: YTN; PAM sequence: CTT
tttaaagaacccgctttttg

SEQ ID NO: 70018 - DNA, 20 bp, Artificial Sequence
  Description of Artificial Sequence: Synthetic oligonucleotide
  Target: SCN10A; (+) strand; PAM type: YTN; PAM sequence: TTT
ttaaagaacccgctttttgt

SEQ ID NO: 70019 - DNA, 20 bp, Artificial Sequence
  Description of Artificial Sequence: Synthetic oligonucleotide
  Target: SCN10A; (+) strand; PAM type: YTN; PAM sequence: TTT
taaagaacccgctttttgtt

SEQ ID NO: 70020 - DNA, 20 bp, Artificial Sequence
  Description of Artificial Sequence: Synthetic oligonucleotide
  Target: SCN10A; (+) strand; PAM type: YTN; PAM sequence: TTT
aaagaacccgctttttgttt

SEQ ID NO: 70021 - DNA, 20 bp, Artificial Sequence
  Description of Artificial Sequence: Synthetic oligonucleotide
  Target: SCN10A; (+) strand; PAM type: YTN; PAM sequence: TTA
aagaacccgctttttgtttc

SEQ ID NO: 70022 - DNA, 20 bp, Artificial Sequence
  Description of Artificial Sequence: Synthetic oligonucleotide
  Target: SCN10A; (+) strand; PAM type: YTN; PAM sequence: CTT
tttgtttcacttatcttttg

SEQ ID NO: 70023 - DNA, 20 bp, Artificial Sequence
  Description of Artificial Sequence: Synthetic oligonucleotide
  Target: SCN10A; (+) strand; PAM type: YTN; PAM sequence: TTT
ttgtttcacttatcttttgt

SEQ ID NO: 70024 - DNA, 20 bp, Artificial Sequence
  Description of Artificial Sequence: Synthetic oligonucleotide
  Target: SCN10A; (+) strand; PAM type: YTN; PAM sequence: TTT
tgtttcacttatcttttgta

SEQ ID NO: 70025 - DNA, 20 bp, Artificial Sequence
  Description of Artificial Sequence: Synthetic oligonucleotide
  Target: SCN10A; (+) strand; PAM type: YTN; PAM sequence: TTT
gtttcacttatcttttgtat

SEQ ID NO: 70026 - DNA, 20 bp, Artificial Sequence
  Description of Artificial Sequence: Synthetic oligonucleotide
  Target: SCN10A; (+) strand; PAM type: YTN; PAM sequence: TTG
tttcacttatcttttgtatt

SEQ ID NO: 70027 - DNA, 20 bp, Artificial Sequence
  Description of Artificial Sequence: Synthetic oligonucleotide
  Target: SCN10A; (+) strand; PAM type: YTN; PAM sequence: TTT
cacttatcttttgtattatt

SEQ ID NO: 70028 - DNA, 20 bp, Artificial Sequence
  Description of Artificial Sequence: Synthetic oligonucleotide
  Target: SCN10A; (+) strand; PAM type: YTN; PAM sequence: TTC
acttatcttttgtattatta

SEQ ID NO: 70029 - DNA, 20 bp, Artificial Sequence
  Description of Artificial Sequence: Synthetic oligonucleotide
  Target: SCN10A; (+) strand; PAM type: YTN; PAM sequence: CTT
atcttttgtattattattat

SEQ ID NO: 70030 - DNA, 20 bp, Artificial Sequence
  Description of Artificial Sequence: Synthetic oligonucleotide
  Target: SCN10A; (+) strand; PAM type: YTN; PAM sequence: TTA
tcttttgtattattattatt

SEQ ID NO: 70031 - DNA, 20 bp, Artificial Sequence
  Description of Artificial Sequence: Synthetic oligonucleotide
  Target: SCN10A; (+) strand; PAM type: YTN; PAM sequence: CTT
ttgtattattattattttta

SEQ ID NO: 70032 - DNA, 20 bp, Artificial Sequence
  Description of Artificial Sequence: Synthetic oligonucleotide
  Target: SCN10A; (+) strand; PAM type: YTN; PAM sequence: TTT
tgtattattattatttttat

SEQ ID NO: 70033 - DNA, 20 bp, Artificial Sequence
  Description of Artificial Sequence: Synthetic oligonucleotide
  Target: SCN10A; (+) strand; PAM type: YTN; PAM sequence: TTT
gtattattattatttttatt

SEQ ID NO: 70034 - DNA, 20 bp, Artificial Sequence
  Description of Artificial Sequence: Synthetic oligonucleotide
  Target: SCN10A; (+) strand; PAM type: YTN; PAM sequence: TTG
tattattattatttttattt

SEQ ID NO: 70035 - DNA, 20 bp, Artificial Sequence
  Description of Artificial Sequence: Synthetic oligonucleotide
  Target: SCN10A; (+) strand; PAM type: YTN; PAM sequence: TTA
ttattatttttatttgaatt

SEQ ID NO: 70036 - DNA, 20 bp, Artificial Sequence
  Description of Artificial Sequence: Synthetic oligonucleotide
  Target: SCN10A; (+) strand; PAM type: YTN; PAM sequence: TTA
ttatttttatttgaatttca

SEQ ID NO: 70037 - DNA, 20 bp, Artificial Sequence
  Description of Artificial Sequence: Synthetic oligonucleotide
  Target: SCN10A; (+) strand; PAM type: YTN; PAM sequence: TTA
tttttatttgaatttcattt

SEQ ID NO: 70038 - DNA, 20 bp, Artificial Sequence
  Description of Artificial Sequence: Synthetic oligonucleotide
  Target: SCN10A; (+) strand; PAM type: YTN; PAM sequence: TTT
ttatttgaatttcatttagt

SEQ ID NO: 70039 - DNA, 20 bp, Artificial Sequence
  Description of Artificial Sequence: Synthetic oligonucleotide
  Target: SCN10A; (+) strand; PAM type: YTN; PAM sequence: TTT
tatttgaatttcatttagta

SEQ ID NO: 70040 - DNA, 20 bp, Artificial Sequence
  Description of Artificial Sequence: Synthetic oligonucleotide
  Target: SCN10A; (+) strand; PAM type: YTN; PAM sequence: TTT
atttgaatttcatttagtac

SEQ ID NO: 70041 - DNA, 20 bp, Artificial Sequence
  Description of Artificial Sequence: Synthetic oligonucleotide
  Target: SCN10A; (+) strand; PAM type: YTN; PAM sequence: TTA
tttgaatttcatttagtact

SEQ ID NO: 70042 - DNA, 20 bp, Artificial Sequence
  Description of Artificial Sequence: Synthetic oligonucleotide
  Target: SCN10A; (+) strand; PAM type: YTN; PAM sequence: TTT
gaatttcatttagtactgcc

SEQ ID NO: 70043 - DNA, 20 bp, Artificial Sequence
  Description of Artificial Sequence: Synthetic oligonucleotide
  Target: SCN10A; (+) strand; PAM type: YTN; PAM sequence: TTG
aatttcatttagtactgccc

SEQ ID NO: 70044 - DNA, 20 bp, Artificial Sequence
  Description of Artificial Sequence: Synthetic oligonucleotide
  Target: SCN10A; (+) strand; PAM type: YTN; PAM sequence: TTT
catttagtactgccctgatc

SEQ ID NO: 70045 - DNA, 20 bp, Artificial Sequence
  Description of Artificial Sequence: Synthetic oligonucleotide
  Target: SCN10A; (+) strand; PAM type: YTN; PAM sequence: TTC
atttagtactgccctgatct

SEQ ID NO: 70046 - DNA, 20 bp, Artificial Sequence
  Description of Artificial Sequence: Synthetic oligonucleotide
  Target: SCN10A; (+) strand; PAM type: YTN; PAM sequence: TTT
agtactgccctgatctttgt

SEQ ID NO: 70047 - DNA, 20 bp, Artificial Sequence
  Description of Artificial Sequence: Synthetic oligonucleotide
  Target: SCN10A; (+) strand; PAM type: YTN; PAM sequence: TTA
gtactgccctgatctttgtt

SEQ ID NO: 70048 - DNA, 20 bp, Artificial Sequence
  Description of Artificial Sequence: Synthetic oligonucleotide
  Target: SCN10A; (+) strand; PAM type: YTN; PAM sequence: CTG
ccctgatctttgttattcct

SEQ ID NO: 70049 - DNA, 20 bp, Artificial Sequence
  Description of Artificial Sequence: Synthetic oligonucleotide
  Target: SCN10A; (+) strand; PAM type: YTN; PAM sequence: CTG
atctttgttattccttttct

SEQ ID NO: 70050 - DNA, 20 bp, Artificial Sequence
  Description of Artificial Sequence: Synthetic oligonucleotide
  Target: SCN10A; (+) strand; PAM type: YTN; PAM sequence: CTT
tgttattccttttcttctgc

SEQ ID NO: 70051 - DNA, 20 bp, Artificial Sequence
  Description of Artificial Sequence: Synthetic oligonucleotide
  Target: SCN10A; (+) strand; PAM type: YTN; PAM sequence: TTT
gttattccttttcttctgct

SEQ ID NO: 70052 - DNA, 20 bp, Artificial Sequence
  Description of Artificial Sequence: Synthetic oligonucleotide
  Target: SCN10A; (+) strand; PAM type: YTN; PAM sequence: TTG
ttattccttttcttctgctt

SEQ ID NO: 70053 - DNA, 20 bp, Artificial Sequence
  Description of Artificial Sequence: Synthetic oligonucleotide
  Target: SCN10A; (+) strand; PAM type: YTN; PAM sequence: TTA
ttccttttcttctgcttggt

SEQ ID NO: 70054 - DNA, 20 bp, Artificial Sequence
  Description of Artificial Sequence: Synthetic oligonucleotide
  Target: SCN10A; (+) strand; PAM type: YTN; PAM sequence: TTC
cttttcttctgcttggtttg

SEQ ID NO: 70055 - DNA, 20 bp, Artificial Sequence
  Description of Artificial Sequence: Synthetic oligonucleotide
  Target: SCN10A; (+) strand; PAM type: YTN; PAM sequence: CTT
ttcttctgcttggtttgggt

SEQ ID NO: 70056 - DNA, 20 bp, Artificial Sequence
  Description of Artificial Sequence: Synthetic oligonucleotide
  Target: SCN10A; (+) strand; PAM type: YTN; PAM sequence: TTT
tcttctgcttggtttgggtc

SEQ ID NO: 70057 - DNA, 20 bp, Artificial Sequence
  Description of Artificial Sequence: Synthetic oligonucleotide
  Target: SCN10A; (+) strand; PAM type: YTN; PAM sequence: TTT
cttctgcttggtttgggtct

SEQ ID NO: 70058 - DNA, 20 bp, Artificial Sequence
  Description of Artificial Sequence: Synthetic oligonucleotide
  Target: SCN10A; (+) strand; PAM type: YTN; PAM sequence: TTC
ttctgcttggtttgggtctg

SEQ ID NO: 70059 - DNA, 20 bp, Artificial Sequence
  Description of Artificial Sequence: Synthetic oligonucleotide
  Target: SCN10A; (+) strand; PAM type: YTN; PAM sequence: CTT
ctgcttggtttgggtctgtt

SEQ ID NO: 70060 - DNA, 20 bp, Artificial Sequence
  Description of Artificial Sequence: Synthetic oligonucleotide
  Target: SCN10A; (+) strand; PAM type: YTN; PAM sequence: TTC
tgcttggtttgggtctgttt

SEQ ID NO: 70061 - DNA, 20 bp, Artificial Sequence
  Description of Artificial Sequence: Synthetic oligonucleotide
  Target: SCN10A; (+) strand; PAM type: YTN; PAM sequence: CTG
cttggtttgggtctgttttg

SEQ ID NO: 70062 - DNA, 20 bp, Artificial Sequence
  Description of Artificial Sequence: Synthetic oligonucleotide
  Target: SCN10A; (+) strand; PAM type: YTN; PAM sequence: CTT
ggtttgggtctgttttgttc

SEQ ID NO: 70063 - DNA, 20 bp, Artificial Sequence
  Description of Artificial Sequence: Synthetic oligonucleotide
  Target: SCN10A; (+) strand; PAM type: YTN; PAM sequence: TTG
gtttgggtctgttttgttct

SEQ ID NO: 70064 - DNA, 20 bp, Artificial Sequence
  Description of Artificial Sequence: Synthetic oligonucleotide
  Target: SCN10A; (+) strand; PAM type: YTN; PAM sequence: TTT
gggtctgttttgttcttgtt

SEQ ID NO: 70065 - DNA, 20 bp, Artificial Sequence
  Description of Artificial Sequence: Synthetic oligonucleotide
  Target: SCN10A; (+) strand; PAM type: YTN; PAM sequence: TTG
ggtctgttttgttcttgttt

SEQ ID NO: 70066 - DNA, 20 bp, Artificial Sequence
  Description of Artificial Sequence: Synthetic oligonucleotide
  Target: SCN10A; (+) strand; PAM type: YTN; PAM sequence: CTG
ttttgttcttgtttctctaa

SEQ ID NO: 70067 - DNA, 20 bp, Artificial Sequence
  Description of Artificial Sequence: Synthetic oligonucleotide
  Target: SCN10A; (+) strand; PAM type: YTN; PAM sequence: TTT
tgttcttgtttctctaattc

SEQ ID NO: 70068 - DNA, 20 bp, Artificial Sequence
  Description of Artificial Sequence: Synthetic oligonucleotide
  Target: SCN10A; (+) strand; PAM type: YTN; PAM sequence: TTT
gttcttgtttctctaattcc

SEQ ID NO: 70069 - DNA, 20 bp, Artificial Sequence
  Description of Artificial Sequence: Synthetic oligonucleotide
  Target: SCN10A; (+) strand; PAM type: YTN; PAM sequence: TTG
ttcttgtttctctaattcct

SEQ ID NO: 70070 - DNA, 20 bp, Artificial Sequence
  Description of Artificial Sequence: Synthetic oligonucleotide
  Target: SCN10A; (+) strand; PAM type: YTN; PAM sequence: TTC
ttgtttctctaattccttga

SEQ ID NO: 70071 - DNA, 20 bp, Artificial Sequence
  Description of Artificial Sequence: Synthetic oligonucleotide
  Target: SCN10A; (+) strand; PAM type: YTN; PAM sequence: CTT
gtttctctaattccttgagg

SEQ ID NO: 70072 - DNA, 20 bp, Artificial Sequence
  Description of Artificial Sequence: Synthetic oligonucleotide
  Target: SCN10A; (+) strand; PAM type: YTN; PAM sequence: TTG
tttctctaattccttgaggt

SEQ ID NO: 70073 - DNA, 20 bp, Artificial Sequence
  Description of Artificial Sequence: Synthetic oligonucleotide
  Target: SCN10A; (+) strand; PAM type: YTN; PAM sequence: TTT
ctctaattccttgaggtgtg

SEQ ID NO: 70074 - DNA, 20 bp, Artificial Sequence
  Description of Artificial Sequence: Synthetic oligonucleotide
  Target: SCN10A; (+) strand; PAM type: YTN; PAM sequence: TTC
tctaattccttgaggtgtga

SEQ ID NO: 70075 - DNA, 20 bp, Artificial Sequence
  Description of Artificial Sequence: Synthetic oligonucleotide
  Target: SCN10A; (+) strand; PAM type: YTN; PAM sequence: CTC
taattccttgaggtgtgacc

SEQ ID NO: 70076 - DNA, 20 bp, Artificial Sequence
  Description of Artificial Sequence: Synthetic oligonucleotide
  Target: SCN10A; (+) strand; PAM type: YTN; PAM sequence: CTA
attccttgaggtgtgacctt

SEQ ID NO: 70077 - DNA, 20 bp, Artificial Sequence
  Description of Artificial Sequence: Synthetic oligonucleotide
  Target: SCN10A; (+) strand; PAM type: YTN; PAM sequence: TTC
cttgaggtgtgaccttagat

SEQ ID NO: 70078 - DNA, 20 bp, Artificial Sequence
  Description of Artificial Sequence: Synthetic oligonucleotide
  Target: SCN10A; (+) strand; PAM type: YTN; PAM sequence: CTT
gaggtgtgaccttagattat

SEQ ID NO: 70079 - DNA, 20 bp, Artificial Sequence
  Description of Artificial Sequence: Synthetic oligonucleotide
  Target: SCN10A; (+) strand; PAM type: YTN; PAM sequence: TTG
aggtgtgaccttagattatc

SEQ ID NO: 70080 - DNA, 20 bp, Artificial Sequence
  Description of Artificial Sequence: Synthetic oligonucleotide
  Target: SCN10A; (+) strand; PAM type: YTN; PAM sequence: CTT
agattatctatttgtcctct

SEQ ID NO: 70081 - DNA, 20 bp, Artificial Sequence
  Description of Artificial Sequence: Synthetic oligonucleotide
  Target: SCN10A; (+) strand; PAM type: YTN; PAM sequence: TTA
gattatctatttgtcctctt

SEQ ID NO: 70082 - DNA, 20 bp, Artificial Sequence
  Description of Artificial Sequence: Synthetic oligonucleotide
  Target: SCN10A; (+) strand; PAM type: YTN; PAM sequence: TTA
tctatttgtcctctttcata

SEQ ID NO: 70083 - DNA, 20 bp, Artificial Sequence
  Description of Artificial Sequence: Synthetic oligonucleotide
  Target: SCN10A; (+) strand; PAM type: YTN; PAM sequence: CTA
tttgtcctctttcatacttt

SEQ ID NO: 70084 - DNA, 20 bp, Artificial Sequence
  Description of Artificial Sequence: Synthetic oligonucleotide
  Target: SCN10A; (+) strand; PAM type: YTN; PAM sequence: TTT
gtcctctttcatactttttg

SEQ ID NO: 70085 - DNA, 20 bp, Artificial Sequence
  Description of Artificial Sequence: Synthetic oligonucleotide
  Target: SCN10A; (+) strand; PAM type: YTN; PAM sequence: TTG
tcctctttcatactttttga

SEQ ID NO: 70086 - DNA, 20 bp, Artificial Sequence
  Description of Artificial Sequence: Synthetic oligonucleotide
  Target: SCN10A; (+) strand; PAM type: YTN; PAM sequence: CTC
tttcatactttttgatgtag

SEQ ID NO: 70087 - DNA, 20 bp, Artificial Sequence
  Description of Artificial Sequence: Synthetic oligonucleotide
  Target: SCN10A; (+) strand; PAM type: YTN; PAM sequence: CTT
tcatactttttgatgtaggt

SEQ ID NO: 70088 - DNA, 20 bp, Artificial Sequence
  Description of Artificial Sequence: Synthetic oligonucleotide
  Target: SCN10A; (+) strand; PAM type: YTN; PAM sequence: TTT
catactttttgatgtaggta

SEQ ID NO: 70089 - DNA, 20 bp, Artificial Sequence
  Description of Artificial Sequence: Synthetic oligonucleotide
  Target: SCN10A; (+) strand; PAM type: YTN; PAM sequence: TTC
atactttttgatgtaggtat

SEQ ID NO: 70090 - DNA, 20 bp, Artificial Sequence
  Description of Artificial Sequence: Synthetic oligonucleotide
  Target: SCN10A; (+) strand; PAM type: YTN; PAM sequence: CTT
tttgatgtaggtatttaatg

SEQ ID NO: 70091 - DNA, 20 bp, Artificial Sequence
  Description of Artificial Sequence: Synthetic oligonucleotide
  Target: SCN10A; (+) strand; PAM type: YTN; PAM sequence: TTT
ttgatgtaggtatttaatgc

SEQ ID NO: 70092 - DNA, 20 bp, Artificial Sequence
  Description of Artificial Sequence: Synthetic oligonucleotide
  Target: SCN10A; (+) strand; PAM type: YTN; PAM sequence: TTT
tgatgtaggtatttaatgct

SEQ ID NO: 70093 - DNA, 20 bp, Artificial Sequence
  Description of Artificial Sequence: Synthetic oligonucleotide
  Target: SCN10A; (+) strand; PAM type: YTN; PAM sequence: TTT
gatgtaggtatttaatgcta

SEQ ID NO: 70094 - DNA, 20 bp, Artificial Sequence
  Description of Artificial Sequence: Synthetic oligonucleotide
  Target: SCN10A; (+) strand; PAM type: YTN; PAM sequence: TTG
atgtaggtatttaatgctat

SEQ ID NO: 70095 - DNA, 20 bp, Artificial Sequence
  Description of Artificial Sequence: Synthetic oligonucleotide
  Target: SCN10A; (+) strand; PAM type: YTN; PAM sequence: TTT
aatgctatgagctttcctct

SEQ ID NO: 70096 - DNA, 20 bp, Artificial Sequence
  Description of Artificial Sequence: Synthetic oligonucleotide
  Target: SCN10A; (+) strand; PAM type: YTN; PAM sequence: TTA
atgctatgagctttcctctt

SEQ ID NO: 70097 - DNA, 20 bp, Artificial Sequence
  Description of Artificial Sequence: Synthetic oligonucleotide
  Target: SCN10A; (+) strand; PAM type: YTN; PAM sequence: CTA
tgagctttcctcttagcact

SEQ ID NO: 70098 - DNA, 20 bp, Artificial Sequence
  Description of Artificial Sequence: Synthetic oligonucleotide
  Target: SCN10A; (+) strand; PAM type: YTN; PAM sequence: CTT
tcctcttagcactgctttag

SEQ ID NO: 70099 - DNA, 20 bp, Artificial Sequence
  Description of Artificial Sequence: Synthetic oligonucleotide
  Target: SCN10A; (+) strand; PAM type: YTN; PAM sequence: TTT
cctcttagcactgctttagc

SEQ ID NO: 70100 - DNA, 20 bp, Artificial Sequence
  Description of Artificial Sequence: Synthetic oligonucleotide
  Target: SCN10A; (+) strand; PAM type: YTN; PAM sequence: TTC
ctcttagcactgctttagct

SEQ ID NO: 70101 - DNA, 20 bp, Artificial Sequence
  Description of Artificial Sequence: Synthetic oligonucleotide
  Target: SCN10A; (+) strand; PAM type: YTN; PAM sequence: CTC
ttagcactgctttagctgta

SEQ ID NO: 70102 - DNA, 20 bp, Artificial Sequence
  Description of Artificial Sequence: Synthetic oligonucleotide
  Target: SCN10A; (+) strand; PAM type: YTN; PAM sequence: CTT
agcactgctttagctgtatc

SEQ ID NO: 70103 - DNA, 20 bp, Artificial Sequence
  Description of Artificial Sequence: Synthetic oligonucleotide
  Target: SCN10A; (+) strand; PAM type: YTN; PAM sequence: TTA
gcactgctttagctgtatcc

SEQ ID NO: 70104 - DNA, 20 bp, Artificial Sequence
  Description of Artificial Sequence: Synthetic oligonucleotide
  Target: SCN10A; (+) strand; PAM type: YTN; PAM sequence: CTG
ctttagctgtatcccagagg

SEQ ID NO: 70105 - DNA, 20 bp, Artificial Sequence
  Description of Artificial Sequence: Synthetic oligonucleotide
  Target: SCN10A; (+) strand; PAM type: YTN; PAM sequence: CTT
tagctgtatcccagaggttt

SEQ ID NO: 70106 - DNA, 20 bp, Artificial Sequence
  Description of Artificial Sequence: Synthetic oligonucleotide
  Target: SCN10A; (+) strand; PAM type: YTN; PAM sequence: TTT
agctgtatcccagaggtttt

SEQ ID NO: 70107 - DNA, 20 bp, Artificial Sequence
  Description of Artificial Sequence: Synthetic oligonucleotide
  Target: SCN10A; (+) strand; PAM type: YTN; PAM sequence: TTA
gctgtatcccagaggttttg

SEQ ID NO: 70108 - DNA, 20 bp, Artificial Sequence
  Description of Artificial Sequence: Synthetic oligonucleotide
  Target: SCN10A; (+) strand; PAM type: YTN; PAM sequence: CTG
tatcccagaggttttgataa

SEQ ID NO: 70109 - DNA, 20 bp, Artificial Sequence
  Description of Artificial Sequence: Synthetic oligonucleotide
  Target: SCN10A; (+) strand; PAM type: YTN; PAM sequence: TTT
tgataagttgtgtgactatt

SEQ ID NO: 70110 - DNA, 20 bp, Artificial Sequence
  Description of Artificial Sequence: Synthetic oligonucleotide
  Target: SCN10A; (+) strand; PAM type: YTN; PAM sequence: TTT
gataagttgtgtgactatta

SEQ ID NO: 70111 - DNA, 20 bp, Artificial Sequence
  Description of Artificial Sequence: Synthetic oligonucleotide
  Target: SCN10A; (+) strand; PAM type: YTN; PAM sequence: TTG
ataagttgtgtgactattat

SEQ ID NO: 70112 - DNA, 20 bp, Artificial Sequence
  Description of Artificial Sequence: Synthetic oligonucleotide
  Target: SCN10A; (+) strand; PAM type: YTN; PAM sequence: TTG
tgtgactattatcattcagt

SEQ ID NO: 70113 - DNA, 20 bp, Artificial Sequence
  Description of Artificial Sequence: Synthetic oligonucleotide
  Target: SCN10A; (+) strand; PAM type: YTN; PAM sequence: CTA
ttatcattcagttcaaaaaa

SEQ ID NO: 70114 - DNA, 20 bp, Artificial Sequence
  Description of Artificial Sequence: Synthetic oligonucleotide
  Target: SCN10A; (+) strand; PAM type: YTN; PAM sequence: TTA
tcattcagttcaaaaaattt

SEQ ID NO: 70115 - DNA, 20 bp, Artificial Sequence
  Description of Artificial Sequence: Synthetic oligonucleotide
  Target: SCN10A; (+) strand; PAM type: YTN; PAM sequence: TTC
agttcaaaaaatttttaaac

SEQ ID NO: 70116 - DNA, 20 bp, Artificial Sequence
  Description of Artificial Sequence: Synthetic oligonucleotide
  Target: SCN10A; (+) strand; PAM type: YTN; PAM sequence: TTC
aaaaaatttttaaacttcca

SEQ ID NO: 70117 - DNA, 20 bp, Artificial Sequence
  Description of Artificial Sequence: Synthetic oligonucleotide
  Target: SCN10A; (+) strand; PAM type: YTN; PAM sequence: TTT
ttaaacttccatcttgattt

SEQ ID NO: 70118 - DNA, 20 bp, Artificial Sequence
  Description of Artificial Sequence: Synthetic oligonucleotide
  Target: SCN10A; (+) strand; PAM type: YTN; PAM sequence: TTT
taaacttccatcttgatttc

SEQ ID NO: 70119 - DNA, 20 bp, Artificial Sequence
  Description of Artificial Sequence: Synthetic oligonucleotide
  Target: SCN10A; (+) strand; PAM type: YTN; PAM sequence: TTT
aaacttccatcttgatttca

SEQ ID NO: 70120 - DNA, 20 bp, Artificial Sequence
  Description of Artificial Sequence: Synthetic oligonucleotide
  Target: SCN10A; (+) strand; PAM type: YTN; PAM sequence: TTA
aacttccatcttgatttcat

SEQ ID NO: 70121 - DNA, 20 bp, Artificial Sequence
  Description of Artificial Sequence: Synthetic oligonucleotide
  Target: SCN10A; (+) strand; PAM type: YTN; PAM sequence: CTT
ccatcttgatttcattgttg

SEQ ID NO: 70122 - DNA, 20 bp, Artificial Sequence
  Description of Artificial Sequence: Synthetic oligonucleotide
  Target: SCN10A; (+) strand; PAM type: YTN; PAM sequence: TTC
catcttgatttcattgttga

SEQ ID NO: 70123 - DNA, 20 bp, Artificial Sequence
  Description of Artificial Sequence: Synthetic oligonucleotide
  Target: SCN10A; (+) strand; PAM type: YTN; PAM sequence: CTT
gatttcattgttgacccaaa

SEQ ID NO: 70124 - DNA, 20 bp, Artificial Sequence
  Description of Artificial Sequence: Synthetic oligonucleotide
  Target: SCN10A; (+) strand; PAM type: YTN; PAM sequence: TTG
atttcattgttgacccaaag

SEQ ID NO: 70125 - DNA, 20 bp, Artificial Sequence
  Description of Artificial Sequence: Synthetic oligonucleotide
  Target: SCN10A; (+) strand; PAM type: YTN; PAM sequence: TTT
cattgttgacccaaagatca

SEQ ID NO: 70126 - DNA, 20 bp, Artificial Sequence
  Description of Artificial Sequence: Synthetic oligonucleotide
  Target: SCN10A; (+) strand; PAM type: YTN; PAM sequence: TTC
attgttgacccaaagatcat

SEQ ID NO: 70127 - DNA, 20 bp, Artificial Sequence
  Description of Artificial Sequence: Synthetic oligonucleotide
  Target: SCN10A; (+) strand; PAM type: YTN; PAM sequence: TTG
ttgacccaaagatcattcaa

SEQ ID NO: 70128 - DNA, 20 bp, Artificial Sequence
  Description of Artificial Sequence: Synthetic oligonucleotide
  Target: SCN10A; (+) strand; PAM type: YTN; PAM sequence: TTG
acccaaagatcattcaagag

SEQ ID NO: 70129 - DNA, 20 bp, Artificial Sequence
  Description of Artificial Sequence: Synthetic oligonucleotide
  Target: SCN10A; (+) strand; PAM type: YTN; PAM sequence: TTC
aagagcagattgtttagttt

SEQ ID NO: 70130 - DNA, 20 bp, Artificial Sequence
  Description of Artificial Sequence: Synthetic oligonucleotide
  Target: SCN10A; (+) strand; PAM type: YTN; PAM sequence: TTG
tttagttttcatgtatttgt

SEQ ID NO: 70131 - DNA, 20 bp, Artificial Sequence
  Description of Artificial Sequence: Synthetic oligonucleotide
  Target: SCN10A; (+) strand; PAM type: YTN; PAM sequence: TTT
agttttcatgtatttgtata

SEQ ID NO: 70132 - DNA, 20 bp, Artificial Sequence
  Description of Artificial Sequence: Synthetic oligonucleotide
  Target: SCN10A; (+) strand; PAM type: YTN; PAM sequence: TTA
gttttcatgtatttgtatag

SEQ ID NO: 70133 - DNA, 20 bp, Artificial Sequence
  Description of Artificial Sequence: Synthetic oligonucleotide
  Target: SCN10A; (+) strand; PAM type: YTN; PAM sequence: TTT
tcatgtatttgtatagtttt

SEQ ID NO: 70134 - DNA, 20 bp, Artificial Sequence
  Description of Artificial Sequence: Synthetic oligonucleotide
  Target: SCN10A; (+) strand; PAM type: YTN; PAM sequence: TTT
catgtatttgtatagttttg

SEQ ID NO: 70135 - DNA, 20 bp, Artificial Sequence
  Description of Artificial Sequence: Synthetic oligonucleotide
  Target: SCN10A; (+) strand; PAM type: YTN; PAM sequence: TTC
atgtatttgtatagttttga

SEQ ID NO: 70136 - DNA, 20 bp, Artificial Sequence
  Description of Artificial Sequence: Synthetic oligonucleotide
  Target: SCN10A; (+) strand; PAM type: YTN; PAM sequence: TTT
gtatagttttgagggtttct

SEQ ID NO: 70137 - DNA, 20 bp, Artificial Sequence
  Description of Artificial Sequence: Synthetic oligonucleotide
  Target: SCN10A; (+) strand; PAM type: YTN; PAM sequence: TTG
tatagttttgagggtttctt

SEQ ID NO: 70138 - DNA, 20 bp, Artificial Sequence
  Description of Artificial Sequence: Synthetic oligonucleotide
  Target: SCN10A; (+) strand; PAM type: YTN; PAM sequence: TTT
tgagggtttcttttggagtt

SEQ ID NO: 70139 - DNA, 20 bp, Artificial Sequence
  Description of Artificial Sequence: Synthetic oligonucleotide
  Target: SCN10A; (+) strand; PAM type: YTN; PAM sequence: TTT
gagggtttcttttggagtta

SEQ ID NO: 70140 - DNA, 20 bp, Artificial Sequence
  Description of Artificial Sequence: Synthetic oligonucleotide
  Target: SCN10A; (+) strand; PAM type: YTN; PAM sequence: TTG
agggtttcttttggagttaa

SEQ ID NO: 70141 - DNA, 20 bp, Artificial Sequence
  Description of Artificial Sequence: Synthetic oligonucleotide
  Target: SCN10A; (+) strand; PAM type: YTN; PAM sequence: TTT
cttttggagttaactccgag

SEQ ID NO: 70142 - DNA, 20 bp, Artificial Sequence
  Description of Artificial Sequence: Synthetic oligonucleotide
  Target: SCN10A; (+) strand; PAM type: YTN; PAM sequence: TTC
ttttggagttaactccgagg

SEQ ID NO: 70143 - DNA, 20 bp, Artificial Sequence
  Description of Artificial Sequence: Synthetic oligonucleotide
  Target: SCN10A; (+) strand; PAM type: YTN; PAM sequence: CTT
ttggagttaactccgaggtt

SEQ ID NO: 70144 - DNA, 20 bp, Artificial Sequence
  Description of Artificial Sequence: Synthetic oligonucleotide
  Target: SCN10A; (+) strand; PAM type: YTN; PAM sequence: TTT
tggagttaactccgaggttt

SEQ ID NO: 70145 - DNA, 20 bp, Artificial Sequence
  Description of Artificial Sequence: Synthetic oligonucleotide
  Target: SCN10A; (+) strand; PAM type: YTN; PAM sequence: TTT
ggagttaactccgaggttta

SEQ ID NO: 70146 - DNA, 20 bp, Artificial Sequence
  Description of Artificial Sequence: Synthetic oligonucleotide
  Target: SCN10A; (+) strand; PAM type: YTN; PAM sequence: TTG
gagttaactccgaggtttat

SEQ ID NO: 70147 - DNA, 20 bp, Artificial Sequence
  Description of Artificial Sequence: Synthetic oligonucleotide
  Target: SCN10A; (+) strand; PAM type: YTN; PAM sequence: TTA
actccgaggtttattcgact

SEQ ID NO: 70148 - DNA, 20 bp, Artificial Sequence
  Description of Artificial Sequence: Synthetic oligonucleotide
  Target: SCN10A; (+) strand; PAM type: YTN; PAM sequence: CTC
cgaggtttattcgactgtgc

SEQ ID NO: 70149 - DNA, 20 bp, Artificial Sequence
  Description of Artificial Sequence: Synthetic oligonucleotide
  Target: SCN10A; (+) strand; PAM type: YTN; PAM sequence: TTT
attcgactgtgctctgagag

SEQ ID NO: 70150 - DNA, 20 bp, Artificial Sequence
  Description of Artificial Sequence: Synthetic oligonucleotide
  Target: SCN10A; (+) strand; PAM type: YTN; PAM sequence: TTA
ttcgactgtgctctgagagg

SEQ ID NO: 70151 - DNA, 20 bp, Artificial Sequence
  Description of Artificial Sequence: Synthetic oligonucleotide
  Target: SCN10A; (+) strand; PAM type: YTN; PAM sequence: TTC
gactgtgctctgagaggata

SEQ ID NO: 70152 - DNA, 20 bp, Artificial Sequence
  Description of Artificial Sequence: Synthetic oligonucleotide
  Target: SCN10A; (+) strand; PAM type: YTN; PAM sequence: CTG
tgctctgagaggatacctga

SEQ ID NO: 70153 - DNA, 20 bp, Artificial Sequence
  Description of Artificial Sequence: Synthetic oligonucleotide
  Target: SCN10A; (+) strand; PAM type: YTN; PAM sequence: CTC
tgagaggatacctgacataa

SEQ ID NO: 70154 - DNA, 20 bp, Artificial Sequence
  Description of Artificial Sequence: Synthetic oligonucleotide
  Target: SCN10A; (+) strand; PAM type: YTN; PAM sequence: CTG
agaggatacctgacataatt

SEQ ID NO: 70155 - DNA, 20 bp, Artificial Sequence
  Description of Artificial Sequence: Synthetic oligonucleotide
  Target: SCN10A; (+) strand; PAM type: YTN; PAM sequence: CTG
acataatttctattttctta

SEQ ID NO: 70156 - DNA, 20 bp, Artificial Sequence
  Description of Artificial Sequence: Synthetic oligonucleotide
  Target: SCN10A; (+) strand; PAM type: YTN; PAM sequence: TTT
ctattttcttaaatttattg

SEQ ID NO: 70157 - DNA, 20 bp, Artificial Sequence
  Description of Artificial Sequence: Synthetic oligonucleotide
  Target: SCN10A; (+) strand; PAM type: YTN; PAM sequence: TTC
tattttcttaaatttattga

SEQ ID NO: 70158 - DNA, 20 bp, Artificial Sequence
  Description of Artificial Sequence: Synthetic oligonucleotide
  Target: SCN10A; (+) strand; PAM type: YTN; PAM sequence: CTA
ttttcttaaatttattgaga

SEQ ID NO: 70159 - DNA, 20 bp, Artificial Sequence
  Description of Artificial Sequence: Synthetic oligonucleotide
  Target: SCN10A; (+) strand; PAM type: YTN; PAM sequence: TTT
tcttaaatttattgagattt

SEQ ID NO: 70160 - DNA, 20 bp, Artificial Sequence
  Description of Artificial Sequence: Synthetic oligonucleotide
  Target: SCN10A; (+) strand; PAM type: YTN; PAM sequence: TTT
cttaaatttattgagatttg

SEQ ID NO: 70161 - DNA, 20 bp, Artificial Sequence
  Description of Artificial Sequence: Synthetic oligonucleotide
  Target: SCN10A; (+) strand; PAM type: YTN; PAM sequence: TTC
ttaaatttattgagatttgt

SEQ ID NO: 70162 - DNA, 20 bp, Artificial Sequence
  Description of Artificial Sequence: Synthetic oligonucleotide
  Target: SCN10A; (+) strand; PAM type: YTN; PAM sequence: CTT
aaatttattgagatttgtta

SEQ ID NO: 70163 - DNA, 20 bp, Artificial Sequence
  Description of Artificial Sequence: Synthetic oligonucleotide
  Target: SCN10A; (+) strand; PAM type: YTN; PAM sequence: TTA
aatttattgagatttgttat

SEQ ID NO: 70164 - DNA, 20 bp, Artificial Sequence
  Description of Artificial Sequence: Synthetic oligonucleotide
  Target: SCN10A; (+) strand; PAM type: YTN; PAM sequence: TTT
attgagatttgttatgttat

SEQ ID NO: 70165 - DNA, 20 bp, Artificial Sequence
  Description of Artificial Sequence: Synthetic oligonucleotide
  Target: SCN10A; (+) strand; PAM type: YTN; PAM sequence: TTA
ttgagatttgttatgttatc

SEQ ID NO: 70166 - DNA, 20 bp, Artificial Sequence
  Description of Artificial Sequence: Synthetic oligonucleotide
  Target: SCN10A; (+) strand; PAM type: YTN; PAM sequence: TTG
agatttgttatgttatctat

SEQ ID NO: 70167 - DNA, 20 bp, Artificial Sequence
  Description of Artificial Sequence: Synthetic oligonucleotide
  Target: SCN10A; (+) strand; PAM type: YTN; PAM sequence: TTT
gttatgttatctatcacgtg

SEQ ID NO: 70168 - DNA, 20 bp, Artificial Sequence
  Description of Artificial Sequence: Synthetic oligonucleotide
  Target: SCN10A; (+) strand; PAM type: YTN; PAM sequence: TTG
ttatgttatctatcacgtgg

SEQ ID NO: 70169 - DNA, 20 bp, Artificial Sequence
  Description of Artificial Sequence: Synthetic oligonucleotide
  Target: SCN10A; (+) strand; PAM type: YTN; PAM sequence: TTA
tgttatctatcacgtggtct

SEQ ID NO: 70170 - DNA, 20 bp, Artificial Sequence
  Description of Artificial Sequence: Synthetic oligonucleotide
  Target: SCN10A; (+) strand; PAM type: YTN; PAM sequence: TTA
tctatcacgtggtctatctt

SEQ ID NO: 70171 - DNA, 20 bp, Artificial Sequence
  Description of Artificial Sequence: Synthetic oligonucleotide
  Target: SCN10A; (+) strand; PAM type: YTN; PAM sequence: CTA
tcacgtggtctatcttagag

SEQ ID NO: 70172 - DNA, 20 bp, Artificial Sequence
  Description of Artificial Sequence: Synthetic oligonucleotide
  Target: SCN10A; (+) strand; PAM type: YTN; PAM sequence: CTA
tcttagagaatattccatgt

SEQ ID NO: 70173 - DNA, 20 bp, Artificial Sequence
  Description of Artificial Sequence: Synthetic oligonucleotide
  Target: SCN10A; (+) strand; PAM type: YTN; PAM sequence: CTT
agagaatattccatgtgctg

SEQ ID NO: 70174 - DNA, 20 bp, Artificial Sequence
  Description of Artificial Sequence: Synthetic oligonucleotide
  Target: SCN10A; (+) strand; PAM type: YTN; PAM sequence: TTA
gagaatattccatgtgctga

SEQ ID NO: 70175 - DNA, 20 bp, Artificial Sequence
  Description of Artificial Sequence: Synthetic oligonucleotide
  Target: SCN10A; (+) strand; PAM type: YTN; PAM sequence: TTC
catgtgctgatgaaaagaat

SEQ ID NO: 70176 - DNA, 20 bp, Artificial Sequence
  Description of Artificial Sequence: Synthetic oligonucleotide
  Target: SCN10A; (+) strand; PAM type: YTN; PAM sequence: CTG
atgaaaagaatgtatattct

SEQ ID NO: 70177 - DNA, 20 bp, Artificial Sequence
  Description of Artificial Sequence: Synthetic oligonucleotide
  Target: SCN10A; (+) strand; PAM type: YTN; PAM sequence: TTC
tgcagttgtttggtagaatg

SEQ ID NO: 70178 - DNA, 20 bp, Artificial Sequence
  Description of Artificial Sequence: Synthetic oligonucleotide
  Target: SCN10A; (+) strand; PAM type: YTN; PAM sequence: CTG
cagttgtttggtagaatgtt

SEQ ID NO: 70179 - DNA, 20 bp, Artificial Sequence
  Description of Artificial Sequence: Synthetic oligonucleotide
  Target: SCN10A; (+) strand; PAM type: YTN; PAM sequence: TTG
tttggtagaatgttttttaa

SEQ ID NO: 70180 - DNA, 20 bp, Artificial Sequence
  Description of Artificial Sequence: Synthetic oligonucleotide
  Target: SCN10A; (+) strand; PAM type: YTN; PAM sequence: TTT
ggtagaatgttttttaaata

SEQ ID NO: 70181 - DNA, 20 bp, Artificial Sequence
  Description of Artificial Sequence: Synthetic oligonucleotide
  Target: SCN10A; (+) strand; PAM type: YTN; PAM sequence: TTG
gtagaatgttttttaaatat

SEQ ID NO: 70182 - DNA, 20 bp, Artificial Sequence
  Description of Artificial Sequence: Synthetic oligonucleotide
  Target: SCN10A; (+) strand; PAM type: YTN; PAM sequence: TTT
tttaaatatctgttaagtcc

SEQ ID NO: 70183 - DNA, 20 bp, Artificial Sequence
  Description of Artificial Sequence: Synthetic oligonucleotide
  Target: SCN10A; (+) strand; PAM type: YTN; PAM sequence: TTT
ttaaatatctgttaagtcca

SEQ ID NO: 70184 - DNA, 20 bp, Artificial Sequence
  Description of Artificial Sequence: Synthetic oligonucleotide
  Target: SCN10A; (+) strand; PAM type: YTN; PAM sequence: TTT
taaatatctgttaagtccat

SEQ ID NO: 70185 - DNA, 20 bp, Artificial Sequence
  Description of Artificial Sequence: Synthetic oligonucleotide
  Target: SCN10A; (+) strand; PAM type: YTN; PAM sequence: TTT
aaatatctgttaagtccatt

SEQ ID NO: 70186 - DNA, 20 bp, Artificial Sequence
  Description of Artificial Sequence: Synthetic oligonucleotide
  Target: SCN10A; (+) strand; PAM type: YTN; PAM sequence: TTA
aatatctgttaagtccattt

SEQ ID NO: 70187 - DNA, 20 bp, Artificial Sequence
  Description of Artificial Sequence: Synthetic oligonucleotide
  Target: SCN10A; (+) strand; PAM type: YTN; PAM sequence: CTG
ttaagtccatttgttctagg

SEQ ID NO: 70188 - DNA, 20 bp, Artificial Sequence
  Description of Artificial Sequence: Synthetic oligonucleotide
  Target: SCN10A; (+) strand; PAM type: YTN; PAM sequence: TTA
agtccatttgttctaggtta

SEQ ID NO: 70189 - DNA, 20 bp, Artificial Sequence
  Description of Artificial Sequence: Synthetic oligonucleotide
  Target: SCN10A; (+) strand; PAM type: YTN; PAM sequence: TTT
gttctaggttacagtttaag

SEQ ID NO: 70190 - DNA, 20 bp, Artificial Sequence
  Description of Artificial Sequence: Synthetic oligonucleotide
  Target: SCN10A; (+) strand; PAM type: YTN; PAM sequence: TTG
ttctaggttacagtttaagt

SEQ ID NO: 70191 - DNA, 20 bp, Artificial Sequence
  Description of Artificial Sequence: Synthetic oligonucleotide
  Target: SCN10A; (+) strand; PAM type: YTN; PAM sequence: TTC
taggttacagtttaagttca

SEQ ID NO: 70192 - DNA, 20 bp, Artificial Sequence
  Description of Artificial Sequence: Synthetic oligonucleotide
  Target: SCN10A; (+) strand; PAM type: YTN; PAM sequence: CTA
ggttacagtttaagttcatt

SEQ ID NO: 70193 - DNA, 20 bp, Artificial Sequence
  Description of Artificial Sequence: Synthetic oligonucleotide
  Target: SCN10A; (+) strand; PAM type: YTN; PAM sequence: TTA
cagtttaagttcattgtttc

SEQ ID NO: 70194 - DNA, 20 bp, Artificial Sequence
  Description of Artificial Sequence: Synthetic oligonucleotide
  Target: SCN10A; (+) strand; PAM type: YTN; PAM sequence: TTT
aagttcattgtttctttgtt

SEQ ID NO: 70195 - DNA, 20 bp, Artificial Sequence
  Description of Artificial Sequence: Synthetic oligonucleotide
  Target: SCN10A; (+) strand; PAM type: YTN; PAM sequence: TTA
agttcattgtttctttgttg

SEQ ID NO: 70196 - DNA, 20 bp, Artificial Sequence
  Description of Artificial Sequence: Synthetic oligonucleotide
  Target: SCN10A; (+) strand; PAM type: YTN; PAM sequence: TTC
attgtttctttgttgacttt

SEQ ID NO: 70197 - DNA, 20 bp, Artificial Sequence
  Description of Artificial Sequence: Synthetic oligonucleotide
  Target: SCN10A; (+) strand; PAM type: YTN; PAM sequence: TTG
tttctttgttgactttctgt

SEQ ID NO: 70198 - DNA, 20 bp, Artificial Sequence
  Description of Artificial Sequence: Synthetic oligonucleotide
  Target: SCN10A; (+) strand; PAM type: YTN; PAM sequence: TTT
ctttgttgactttctgtctt

SEQ ID NO: 70199 - DNA, 20 bp, Artificial Sequence
  Description of Artificial Sequence: Synthetic oligonucleotide
  Target: SCN10A; (+) strand; PAM type: YTN; PAM sequence: TTC
tttgttgactttctgtcttg

SEQ ID NO: 70200 - DNA, 20 bp, Artificial Sequence
  Description of Artificial Sequence: Synthetic oligonucleotide
  Target: SCN10A; (+) strand; PAM type: YTN; PAM sequence: CTT
tgttgactttctgtcttgat

SEQ ID NO: 70201 - DNA, 20 bp, Artificial Sequence
  Description of Artificial Sequence: Synthetic oligonucleotide
  Target: SCN10A; (+) strand; PAM type: YTN; PAM sequence: TTT
gttgactttctgtcttgatg

SEQ ID NO: 70202 - DNA, 20 bp, Artificial Sequence
  Description of Artificial Sequence: Synthetic oligonucleotide
  Target: SCN10A; (+) strand; PAM type: YTN; PAM sequence: TTG
ttgactttctgtcttgatga

SEQ ID NO: 70203 - DNA, 20 bp, Artificial Sequence
  Description of Artificial Sequence: Synthetic oligonucleotide
  Target: SCN10A; (+) strand; PAM type: YTN; PAM sequence: TTG
actttctgtcttgatgacct

SEQ ID NO: 70204 - DNA, 20 bp, Artificial Sequence
  Description of Artificial Sequence: Synthetic oligonucleotide
  Target: SCN10A; (+) strand; PAM type: YTN; PAM sequence: CTT
tctgtcttgatgacctgtct

SEQ ID NO: 70205 - DNA, 20 bp, Artificial Sequence
  Description of Artificial Sequence: Synthetic oligonucleotide
  Target: SCN10A; (+) strand; PAM type: YTN; PAM sequence: TTT
ctgtcttgatgacctgtcta

SEQ ID NO: 70206 - DNA, 20 bp, Artificial Sequence
  Description of Artificial Sequence: Synthetic oligonucleotide
  Target: SCN10A; (+) strand; PAM type: YTN; PAM sequence: TTC
tgtcttgatgacctgtctag

SEQ ID NO: 70207 - DNA, 20 bp, Artificial Sequence
  Description of Artificial Sequence: Synthetic oligonucleotide
  Target: SCN10A; (+) strand; PAM type: YTN; PAM sequence: CTG
tcttgatgacctgtctagtg

SEQ ID NO: 70208 - DNA, 20 bp, Artificial Sequence
  Description of Artificial Sequence: Synthetic oligonucleotide
  Target: SCN10A; (+) strand; PAM type: YTN; PAM sequence: CTT
gatgacctgtctagtgctgt

SEQ ID NO: 70209 - DNA, 20 bp, Artificial Sequence
  Description of Artificial Sequence: Synthetic oligonucleotide
  Target: SCN10A; (+) strand; PAM type: YTN; PAM sequence: TTG
atgacctgtctagtgctgtc

SEQ ID NO: 70210 - DNA, 20 bp, Artificial Sequence
  Description of Artificial Sequence: Synthetic oligonucleotide
  Target: SCN10A; (+) strand; PAM type: YTN; PAM sequence: CTG
tctagtgctgtcagtggaat

SEQ ID NO: 70211 - DNA, 20 bp, Artificial Sequence
  Description of Artificial Sequence: Synthetic oligonucleotide
  Target: SCN10A; (+) strand; PAM type: YTN; PAM sequence: CTA
gtgctgtcagtggaatattg

SEQ ID NO: 70212 - DNA, 20 bp, Artificial Sequence
  Description of Artificial Sequence: Synthetic oligonucleotide
  Target: SCN10A; (+) strand; PAM type: YTN; PAM sequence: CTG
tcagtggaatattgatcccc

SEQ ID NO: 70213 - DNA, 20 bp, Artificial Sequence
  Description of Artificial Sequence: Synthetic oligonucleotide
  Target: SCN10A; (+) strand; PAM type: YTN; PAM sequence: TTG
atcccccactattattatat

SEQ ID NO: 70214 - DNA, 20 bp, Artificial Sequence
  Description of Artificial Sequence: Synthetic oligonucleotide
  Target: SCN10A; (+) strand; PAM type: YTN; PAM sequence: CTA
ttattatattgctgtctatt

SEQ ID NO: 70215 - DNA, 20 bp, Artificial Sequence
  Description of Artificial Sequence: Synthetic oligonucleotide
  Target: SCN10A; (+) strand; PAM type: YTN; PAM sequence: TTA
ttatattgctgtctatttca

SEQ ID NO: 70216 - DNA, 20 bp, Artificial Sequence
  Description of Artificial Sequence: Synthetic oligonucleotide
  Target: SCN10A; (+) strand; PAM type: YTN; PAM sequence: TTA
tattgctgtctatttcattt

SEQ ID NO: 70217 - DNA, 20 bp, Artificial Sequence
  Description of Artificial Sequence: Synthetic oligonucleotide
  Target: SCN10A; (+) strand; PAM type: YTN; PAM sequence: TTG
ctgtctatttcatttcttag

SEQ ID NO: 70218 - DNA, 20 bp, Artificial Sequence
  Description of Artificial Sequence: Synthetic oligonucleotide
  Target: SCN10A; (+) strand; PAM type: YTN; PAM sequence: CTG
tctatttcatttcttaggtc

SEQ ID NO: 70219 - DNA, 20 bp, Artificial Sequence
  Description of Artificial Sequence: Synthetic oligonucleotide
  Target: SCN10A; (+) strand; PAM type: YTN; PAM sequence: CTA
tttcatttcttaggtctagt

SEQ ID NO: 70220 - DNA, 20 bp, Artificial Sequence
  Description of Artificial Sequence: Synthetic oligonucleotide
  Target: SCN10A; (+) strand; PAM type: YTN; PAM sequence: TTT
catttcttaggtctagtagt

SEQ ID NO: 70221 - DNA, 20 bp, Artificial Sequence
  Description of Artificial Sequence: Synthetic oligonucleotide
  Target: SCN10A; (+) strand; PAM type: YTN; PAM sequence: TTC
atttcttaggtctagtagta

SEQ ID NO: 70222 - DNA, 20 bp, Artificial Sequence
  Description of Artificial Sequence: Synthetic oligonucleotide
  Target: SCN10A; (+) strand; PAM type: YTN; PAM sequence: TTT
cttaggtctagtagtaattg

SEQ ID NO: 70223 - DNA, 20 bp, Artificial Sequence
  Description of Artificial Sequence: Synthetic oligonucleotide
  Target: SCN10A; (+) strand; PAM type: YTN; PAM sequence: TTC
ttaggtctagtagtaattgt

SEQ ID NO: 70224 - DNA, 20 bp, Artificial Sequence
  Description of Artificial Sequence: Synthetic oligonucleotide
  Target: SCN10A; (+) strand; PAM type: YTN; PAM sequence: CTT
aggtctagtagtaattgttt

SEQ ID NO: 70225 - DNA, 20 bp, Artificial Sequence
  Description of Artificial Sequence: Synthetic oligonucleotide
  Target: SCN10A; (+) strand; PAM type: YTN; PAM sequence: TTA
ggtctagtagtaattgtttt

SEQ ID NO: 70226 - DNA, 20 bp, Artificial Sequence
  Description of Artificial Sequence: Synthetic oligonucleotide
  Target: SCN10A; (+) strand; PAM type: YTN; PAM sequence: CTA
gtagtaattgttttataaat

SEQ ID NO: 70227 - DNA, 20 bp, Artificial Sequence
  Description of Artificial Sequence: Synthetic oligonucleotide
  Target: SCN10A; (+) strand; PAM type: YTN; PAM sequence: TTG
ttttataaatttgggagctc

SEQ ID NO: 70228 - DNA, 20 bp, Artificial Sequence
  Description of Artificial Sequence: Synthetic oligonucleotide
  Target: SCN10A; (+) strand; PAM type: YTN; PAM sequence: TTT
tataaatttgggagctccag

SEQ ID NO: 70229 - DNA, 20 bp, Artificial Sequence
  Description of Artificial Sequence: Synthetic oligonucleotide
  Target: SCN10A; (+) strand; PAM type: YTN; PAM sequence: TTT
ataaatttgggagctccagt

SEQ ID NO: 70230 - DNA, 20 bp, Artificial Sequence
  Description of Artificial Sequence: Synthetic oligonucleotide
  Target: SCN10A; (+) strand; PAM type: YTN; PAM sequence: TTA
taaatttgggagctccagtg

SEQ ID NO: 70231 - DNA, 20 bp, Artificial Sequence
  Description of Artificial Sequence: Synthetic oligonucleotide
  Target: SCN10A; (+) strand; PAM type: YTN; PAM sequence: TTT
gggagctccagtgttaggtg

SEQ ID NO: 70232 - DNA, 20 bp, Artificial Sequence
  Description of Artificial Sequence: Synthetic oligonucleotide
  Target: SCN10A; (+) strand; PAM type: YTN; PAM sequence: TTG
ggagctccagtgttaggtgc

SEQ ID NO: 70233 - DNA, 20 bp, Artificial Sequence
  Description of Artificial Sequence: Synthetic oligonucleotide
  Target: SCN10A; (+) strand; PAM type: YTN; PAM sequence: CTC
cagtgttaggtgcatatgta

SEQ ID NO: 70234 - DNA, 20 bp, Artificial Sequence
  Description of Artificial Sequence: Synthetic oligonucleotide
  Target: SCN10A; (+) strand; PAM type: YTN; PAM sequence: TTA
ggtgcatatgtatttaggat

SEQ ID NO: 70235 - DNA, 20 bp, Artificial Sequence
  Description of Artificial Sequence: Synthetic oligonucleotide
  Target: SCN10A; (+) strand; PAM type: YTN; PAM sequence: TTT
aggattatgatatttttcca

SEQ ID NO: 70236 - DNA, 20 bp, Artificial Sequence
  Description of Artificial Sequence: Synthetic oligonucleotide
  Target: SCN10A; (+) strand; PAM type: YTN; PAM sequence: TTA
ggattatgatatttttccat

SEQ ID NO: 70237 - DNA, 20 bp, Artificial Sequence
  Description of Artificial Sequence: Synthetic oligonucleotide
  Target: SCN10A; (+) strand; PAM type: YTN; PAM sequence: TTA
tgatatttttccattagacc

SEQ ID NO: 70238 - DNA, 20 bp, Artificial Sequence
  Description of Artificial Sequence: Synthetic oligonucleotide
  Target: SCN10A; (+) strand; PAM type: YTN; PAM sequence: TTT
ttccattagaccaattattt

SEQ ID NO: 70239 - DNA, 20 bp, Artificial Sequence
  Description of Artificial Sequence: Synthetic oligonucleotide
  Target: SCN10A; (+) strand; PAM type: YTN; PAM sequence: TTT
tccattagaccaattatttt

SEQ ID NO: 70240 - DNA, 20 bp, Artificial Sequence
  Description of Artificial Sequence: Synthetic oligonucleotide
  Target: SCN10A; (+) strand; PAM type: YTN; PAM sequence: TTT
ccattagaccaattatttta

SEQ ID NO: 70241 - DNA, 20 bp, Artificial Sequence
  Description of Artificial Sequence: Synthetic oligonucleotide
  Target: SCN10A; (+) strand; PAM type: YTN; PAM sequence: TTC
cattagaccaattattttat

SEQ ID NO: 70242 - DNA, 20 bp, Artificial Sequence
  Description of Artificial Sequence: Synthetic oligonucleotide
  Target: SCN10A; (+) strand; PAM type: YTN; PAM sequence: TTA
gaccaattattttatcatta

SEQ ID NO: 70243 - DNA, 20 bp, Artificial Sequence
  Description of Artificial Sequence: Synthetic oligonucleotide
  Target: SCN10A; (+) strand; PAM type: YTN; PAM sequence: TTA
ttttatcattatatatgtcc

SEQ ID NO: 70244 - DNA, 20 bp, Artificial Sequence
  Description of Artificial Sequence: Synthetic oligonucleotide
  Target: SCN10A; (+) strand; PAM type: YTN; PAM sequence: TTT
tatcattatatatgtccctc

SEQ ID NO: 70245 - DNA, 20 bp, Artificial Sequence
  Description of Artificial Sequence: Synthetic oligonucleotide
  Target: SCN10A; (+) strand; PAM type: YTN; PAM sequence: TTT
atcattatatatgtccctct

SEQ ID NO: 70246 - DNA, 20 bp, Artificial Sequence
  Description of Artificial Sequence: Synthetic oligonucleotide
  Target: SCN10A; (+) strand; PAM type: YTN; PAM sequence: TTA
tcattatatatgtccctctt

SEQ ID NO: 70247 - DNA, 20 bp, Artificial Sequence
  Description of Artificial Sequence: Synthetic oligonucleotide
  Target: SCN10A; (+) strand; PAM type: YTN; PAM sequence: TTA
tatatgtccctctttgtctt

SEQ ID NO: 70248 - DNA, 20 bp, Artificial Sequence
  Description of Artificial Sequence: Synthetic oligonucleotide
  Target: SCN10A; (+) strand; PAM type: YTN; PAM sequence: CTC
tttgtctttttttaactgtt

SEQ ID NO: 70249 - DNA, 20 bp, Artificial Sequence
  Description of Artificial Sequence: Synthetic oligonucleotide
  Target: SCN10A; (+) strand; PAM type: YTN; PAM sequence: CTT
tgtctttttttaactgttgt

SEQ ID NO: 70250 - DNA, 20 bp, Artificial Sequence
  Description of Artificial Sequence: Synthetic oligonucleotide
  Target: SCN10A; (+) strand; PAM type: YTN; PAM sequence: TTT
gtctttttttaactgttgtt

SEQ ID NO: 70251 - DNA, 20 bp, Artificial Sequence
  Description of Artificial Sequence: Synthetic oligonucleotide
  Target: SCN10A; (+) strand; PAM type: YTN; PAM sequence: TTG
tctttttttaactgttgttg

SEQ ID NO: 70252 - DNA, 20 bp, Artificial Sequence
  Description of Artificial Sequence: Synthetic oligonucleotide
  Target: SCN10A; (+) strand; PAM type: YTN; PAM sequence: CTT
tttttaactgttgttgcttt

SEQ ID NO: 70253 - DNA, 20 bp, Artificial Sequence
  Description of Artificial Sequence: Synthetic oligonucleotide
  Target: SCN10A; (+) strand; PAM type: YTN; PAM sequence: TTT
ttttaactgttgttgcttta

SEQ ID NO: 70254 - DNA, 20 bp, Artificial Sequence
  Description of Artificial Sequence: Synthetic oligonucleotide
  Target: SCN10A; (+) strand; PAM type: YTN; PAM sequence: TTT
tttaactgttgttgctttaa

SEQ ID NO: 70255 - DNA, 20 bp, Artificial Sequence
  Description of Artificial Sequence: Synthetic oligonucleotide
  Target: SCN10A; (+) strand; PAM type: YTN; PAM sequence: TTT
ttaactgttgttgctttaag

SEQ ID NO: 70256 - DNA, 20 bp, Artificial Sequence
  Description of Artificial Sequence: Synthetic oligonucleotide
  Target: SCN10A; (+) strand; PAM type: YTN; PAM sequence: TTT
taactgttgttgctttaagg

SEQ ID NO: 70257 - DNA, 20 bp, Artificial Sequence
  Description of Artificial Sequence: Synthetic oligonucleotide
  Target: SCN10A; (+) strand; PAM type: YTN; PAM sequence: TTT
aactgttgttgctttaaggt

SEQ ID NO: 70258 - DNA, 20 bp, Artificial Sequence
  Description of Artificial Sequence: Synthetic oligonucleotide
  Target: SCN10A; (+) strand; PAM type: YTN; PAM sequence: TTA
actgttgttgctttaaggtc

SEQ ID NO: 70259 - DNA, 20 bp, Artificial Sequence
  Description of Artificial Sequence: Synthetic oligonucleotide
  Target: SCN10A; (+) strand; PAM type: YTN; PAM sequence: CTG
ttgttgctttaaggtctgtt

SEQ ID NO: 70260 - DNA, 20 bp, Artificial Sequence
  Description of Artificial Sequence: Synthetic oligonucleotide
  Target: SCN10A; (+) strand; PAM type: YTN; PAM sequence: TTG
ttgctttaaggtctgttttc

SEQ ID NO: 70261 - DNA, 20 bp, Artificial Sequence
  Description of Artificial Sequence: Synthetic oligonucleotide
  Target: SCN10A; (+) strand; PAM type: YTN; PAM sequence: TTG
ctttaaggtctgttttctct

SEQ ID NO: 70262 - DNA, 20 bp, Artificial Sequence
  Description of Artificial Sequence: Synthetic oligonucleotide
  Target: SCN10A; (+) strand; PAM type: YTN; PAM sequence: CTT
taaggtctgttttctctgat

SEQ ID NO: 70263 - DNA, 20 bp, Artificial Sequence
  Description of Artificial Sequence: Synthetic oligonucleotide
  Target: SCN10A; (+) strand; PAM type: YTN; PAM sequence: TTT
aaggtctgttttctctgata

SEQ ID NO: 70264 - DNA, 20 bp, Artificial Sequence
  Description of Artificial Sequence: Synthetic oligonucleotide
  Target: SCN10A; (+) strand; PAM type: YTN; PAM sequence: TTA
aggtctgttttctctgatat

SEQ ID NO: 70265 - DNA, 20 bp, Artificial Sequence
  Description of Artificial Sequence: Synthetic oligonucleotide
  Target: SCN10A; (+) strand; PAM type: YTN; PAM sequence: CTG
ttttctctgatataagaata

SEQ ID NO: 70266 - DNA, 20 bp, Artificial Sequence
  Description of Artificial Sequence: Synthetic oligonucleotide
  Target: SCN10A; (+) strand; PAM type: YTN; PAM sequence: TTT
tctctgatataagaatagct

SEQ ID NO: 70267 - DNA, 20 bp, Artificial Sequence
  Description of Artificial Sequence: Synthetic oligonucleotide
  Target: SCN10A; (+) strand; PAM type: YTN; PAM sequence: TTT
ctctgatataagaatagcta

SEQ ID NO: 70268 - DNA, 20 bp, Artificial Sequence
  Description of Artificial Sequence: Synthetic oligonucleotide
  Target: SCN10A; (+) strand; PAM type: YTN; PAM sequence: TTC
tctgatataagaatagctac

SEQ ID NO: 70269 - DNA, 20 bp, Artificial Sequence
  Description of Artificial Sequence: Synthetic oligonucleotide
  Target: SCN10A; (+) strand; PAM type: YTN; PAM sequence: CTC
tgatataagaatagctactc

SEQ ID NO: 70270 - DNA, 20 bp, Artificial Sequence
  Description of Artificial Sequence: Synthetic oligonucleotide
  Target: SCN10A; (+) strand; PAM type: YTN; PAM sequence: CTG
atataagaatagctactcct

SEQ ID NO: 70271 - DNA, 20 bp, Artificial Sequence
  Description of Artificial Sequence: Synthetic oligonucleotide
  Target: SCN10A; (+) strand; PAM type: YTN; PAM sequence: CTA
ctcctgcttgcttttggttt

SEQ ID NO: 70272 - DNA, 20 bp, Artificial Sequence
  Description of Artificial Sequence: Synthetic oligonucleotide
  Target: SCN10A; (+) strand; PAM type: YTN; PAM sequence: CTC
ctgcttgcttttggtttcca

SEQ ID NO: 70273 - DNA, 20 bp, Artificial Sequence
  Description of Artificial Sequence: Synthetic oligonucleotide
  Target: SCN10A; (+) strand; PAM type: YTN; PAM sequence: CTG
cttgcttttggtttccattt

SEQ ID NO: 70274 - DNA, 20 bp, Artificial Sequence
  Description of Artificial Sequence: Synthetic oligonucleotide
  Target: SCN10A; (+) strand; PAM type: YTN; PAM sequence: CTT
gcttttggtttccatttgca

SEQ ID NO: 70275 - DNA, 20 bp, Artificial Sequence
  Description of Artificial Sequence: Synthetic oligonucleotide
  Target: SCN10A; (+) strand; PAM type: YTN; PAM sequence: TTG
cttttggtttccatttgcat

SEQ ID NO: 70276 - DNA, 20 bp, Artificial Sequence
  Description of Artificial Sequence: Synthetic oligonucleotide
  Target: SCN10A; (+) strand; PAM type: YTN; PAM sequence: CTT
ttggtttccatttgcatgga

SEQ ID NO: 70277 - DNA, 20 bp, Artificial Sequence
  Description of Artificial Sequence: Synthetic oligonucleotide
  Target: SCN10A; (+) strand; PAM type: YTN; PAM sequence: TTT
tggtttccatttgcatggaa

SEQ ID NO: 70278 - DNA, 20 bp, Artificial Sequence
  Description of Artificial Sequence: Synthetic oligonucleotide
  Target: SCN10A; (+) strand; PAM type: YTN; PAM sequence: TTT
ggtttccatttgcatggaat

SEQ ID NO: 70279 - DNA, 20 bp, Artificial Sequence
  Description of Artificial Sequence: Synthetic oligonucleotide
  Target: SCN10A; (+) strand; PAM type: YTN; PAM sequence: TTG
gtttccatttgcatggaata

SEQ ID NO: 70280 - DNA, 20 bp, Artificial Sequence
  Description of Artificial Sequence: Synthetic oligonucleotide
  Target: SCN10A; (+) strand; PAM type: YTN; PAM sequence: TTT
ccatttgcatggaatatctt

SEQ ID NO: 70281 - DNA, 20 bp, Artificial Sequence
  Description of Artificial Sequence: Synthetic oligonucleotide
  Target: SCN10A; (+) strand; PAM type: YTN; PAM sequence: TTC
catttgcatggaatatcttt

SEQ ID NO: 70282 - DNA, 20 bp, Artificial Sequence
  Description of Artificial Sequence: Synthetic oligonucleotide
  Target: SCN10A; (+) strand; PAM type: YTN; PAM sequence: TTT
gcatggaatatcttttccca

SEQ ID NO: 70283 - DNA, 20 bp, Artificial Sequence
  Description of Artificial Sequence: Synthetic oligonucleotide
  Target: SCN10A; (+) strand; PAM type: YTN; PAM sequence: TTG
catggaatatcttttcccat

SEQ ID NO: 70284 - DNA, 20 bp, Artificial Sequence
  Description of Artificial Sequence: Synthetic oligonucleotide
  Target: SCN10A; (+) strand; PAM type: YTN; PAM sequence: CTT
ttcccatctctttaccttaa

SEQ ID NO: 70285 - DNA, 20 bp, Artificial Sequence
  Description of Artificial Sequence: Synthetic oligonucleotide
  Target: SCN10A; (+) strand; PAM type: YTN; PAM sequence: TTT
tcccatctctttaccttaag

SEQ ID NO: 70286 - DNA, 20 bp, Artificial Sequence
  Description of Artificial Sequence: Synthetic oligonucleotide
  Target: SCN10A; (+) strand; PAM type: YTN; PAM sequence: TTT
cccatctctttaccttaagt

SEQ ID NO: 70287 - DNA, 20 bp, Artificial Sequence
  Description of Artificial Sequence: Synthetic oligonucleotide
  Target: SCN10A; (+) strand; PAM type: YTN; PAM sequence: TTC
ccatctctttaccttaagtt

SEQ ID NO: 70288 - DNA, 20 bp, Artificial Sequence
  Description of Artificial Sequence: Synthetic oligonucleotide
  Target: SCN10A; (+) strand; PAM type: YTN; PAM sequence: CTC
tttaccttaagtttatgtgg

SEQ ID NO: 70289 - DNA, 20 bp, Artificial Sequence
  Description of Artificial Sequence: Synthetic oligonucleotide
  Target: SCN10A; (+) strand; PAM type: YTN; PAM sequence: CTT
taccttaagtttatgtggct

SEQ ID NO: 70290 - DNA, 20 bp, Artificial Sequence
  Description of Artificial Sequence: Synthetic oligonucleotide
  Target: SCN10A; (+) strand; PAM type: YTN; PAM sequence: TTT
accttaagtttatgtggctc

SEQ ID NO: 70291 - DNA, 20 bp, Artificial Sequence
  Description of Artificial Sequence: Synthetic oligonucleotide
  Target: SCN10A; (+) strand; PAM type: YTN; PAM sequence: TTA
ccttaagtttatgtggctcc

SEQ ID NO: 70292 - DNA, 20 bp, Artificial Sequence
  Description of Artificial Sequence: Synthetic oligonucleotide
  Target: SCN10A; (+) strand; PAM type: YTN; PAM sequence: CTT
aagtttatgtggctccttat

SEQ ID NO: 70293 - DNA, 20 bp, Artificial Sequence
  Description of Artificial Sequence: Synthetic oligonucleotide
  Target: SCN10A; (+) strand; PAM type: YTN; PAM sequence: TTA
agtttatgtggctccttatg

SEQ ID NO: 70294 - DNA, 20 bp, Artificial Sequence
  Description of Artificial Sequence: Synthetic oligonucleotide
  Target: SCN10A; (+) strand; PAM type: YTN; PAM sequence: TTT
atgtggctccttatgtgtta

SEQ ID NO: 70295 - DNA, 20 bp, Artificial Sequence
  Description of Artificial Sequence: Synthetic oligonucleotide
  Target: SCN10A; (+) strand; PAM type: YTN; PAM sequence: TTA
tgtggctccttatgtgttag

SEQ ID NO: 70296 - DNA, 20 bp, Artificial Sequence
  Description of Artificial Sequence: Synthetic oligonucleotide
  Target: SCN10A; (+) strand; PAM type: YTN; PAM sequence: CTC
cttatgtgttaggtgagtct

SEQ ID NO: 70297 - DNA, 20 bp, Artificial Sequence
  Description of Artificial Sequence: Synthetic oligonucleotide
  Target: SCN10A; (+) strand; PAM type: YTN; PAM sequence: CTT
atgtgttaggtgagtctctt

SEQ ID NO: 70298 - DNA, 20 bp, Artificial Sequence
  Description of Artificial Sequence: Synthetic oligonucleotide
  Target: SCN10A; (+) strand; PAM type: YTN; PAM sequence: TTA
tgtgttaggtgagtctcttg

SEQ ID NO: 70299 - DNA, 20 bp, Artificial Sequence
  Description of Artificial Sequence: Synthetic oligonucleotide
  Target: SCN10A; (+) strand; PAM type: YTN; PAM sequence: TTA
ggtgagtctcttgaagacag

SEQ ID NO: 70300 - DNA, 20 bp, Artificial Sequence
  Description of Artificial Sequence: Synthetic oligonucleotide
  Target: SCN10A; (+) strand; PAM type: YTN; PAM sequence: CTC
ttgaagacagtagatacttg

SEQ ID NO: 70301 - DNA, 20 bp, Artificial Sequence
  Description of Artificial Sequence: Synthetic oligonucleotide
  Target: SCN10A; (+) strand; PAM type: YTN; PAM sequence: CTT
gaagacagtagatacttggt

SEQ ID NO: 70302 - DNA, 20 bp, Artificial Sequence
  Description of Artificial Sequence: Synthetic oligonucleotide
  Target: SCN10A; (+) strand; PAM type: YTN; PAM sequence: TTG
aagacagtagatacttggtt

SEQ ID NO: 70303 - DNA, 20 bp, Artificial Sequence
  Description of Artificial Sequence: Synthetic oligonucleotide
  Target: SCN10A; (+) strand; PAM type: YTN; PAM sequence: CTT
ggttggtggatttttttttt

SEQ ID NO: 70304 - DNA, 20 bp, Artificial Sequence
  Description of Artificial Sequence: Synthetic oligonucleotide
  Target: SCN10A; (+) strand; PAM type: YTN; PAM sequence: TTG
gttggtggattttttttttc

SEQ ID NO: 70305 - DNA, 20 bp, Artificial Sequence
  Description of Artificial Sequence: Synthetic oligonucleotide
  Target: SCN10A; (+) strand; PAM type: YTN; PAM sequence: TTG
gtggattttttttttccttt

SEQ ID NO: 70306 - DNA, 20 bp, Artificial Sequence
  Description of Artificial Sequence: Synthetic oligonucleotide
  Target: SCN10A; (+) strand; PAM type: YTN; PAM sequence: TTT
tttttttcctttctgccctt

SEQ ID NO: 70307 - DNA, 20 bp, Artificial Sequence
  Description of Artificial Sequence: Synthetic oligonucleotide
  Target: SCN10A; (+) strand; PAM type: YTN; PAM sequence: TTT
ttttttcctttctgcccttc

SEQ ID NO: 70308 - DNA, 20 bp, Artificial Sequence
  Description of Artificial Sequence: Synthetic oligonucleotide
  Target: SCN10A; (+) strand; PAM type: YTN; PAM sequence: TTT
tttttcctttctgcccttct

SEQ ID NO: 70309 - DNA, 20 bp, Artificial Sequence
  Description of Artificial Sequence: Synthetic oligonucleotide
  Target: SCN10A; (+) strand; PAM type: YTN; PAM sequence: TTT
ttttcctttctgcccttctg

SEQ ID NO: 70310 - DNA, 20 bp, Artificial Sequence
  Description of Artificial Sequence: Synthetic oligonucleotide
  Target: SCN10A; (+) strand; PAM type: YTN; PAM sequence: TTT
tttcctttctgcccttctgt

SEQ ID NO: 70311 - DNA, 20 bp, Artificial Sequence
  Description of Artificial Sequence: Synthetic oligonucleotide
  Target: SCN10A; (+) strand; PAM type: YTN; PAM sequence: TTT
ttcctttctgcccttctgta

SEQ ID NO: 70312 - DNA, 20 bp, Artificial Sequence
  Description of Artificial Sequence: Synthetic oligonucleotide
  Target: SCN10A; (+) strand; PAM type: YTN; PAM sequence: TTT
tcctttctgcccttctgtat

SEQ ID NO: 70313 - DNA, 20 bp, Artificial Sequence
  Description of Artificial Sequence: Synthetic oligonucleotide
  Target: SCN10A; (+) strand; PAM type: YTN; PAM sequence: TTT
cctttctgcccttctgtata

SEQ ID NO: 70314 - DNA, 20 bp, Artificial Sequence
  Description of Artificial Sequence: Synthetic oligonucleotide
  Target: SCN10A; (+) strand; PAM type: YTN; PAM sequence: TTC
ctttctgcccttctgtatat

SEQ ID NO: 70315 - DNA, 20 bp, Artificial Sequence
  Description of Artificial Sequence: Synthetic oligonucleotide
  Target: SCN10A; (+) strand; PAM type: YTN; PAM sequence: CTT
tctgcccttctgtatatttt

SEQ ID NO: 70316 - DNA, 20 bp, Artificial Sequence
  Description of Artificial Sequence: Synthetic oligonucleotide
  Target: SCN10A; (+) strand; PAM type: YTN; PAM sequence: TTT
ctgcccttctgtatatttta

SEQ ID NO: 70317 - DNA, 20 bp, Artificial Sequence
  Description of Artificial Sequence: Synthetic oligonucleotide
  Target: SCN10A; (+) strand; PAM type: YTN; PAM sequence: TTC
tgcccttctgtatattttaa

SEQ ID NO: 70318 - DNA, 20 bp, Artificial Sequence
  Description of Artificial Sequence: Synthetic oligonucleotide
  Target: SCN10A; (+) strand; PAM type: YTN; PAM sequence: CTG
cccttctgtatattttaagt

SEQ ID NO: 70319 - DNA, 20 bp, Artificial Sequence
  Description of Artificial Sequence: Synthetic oligonucleotide
  Target: SCN10A; (+) strand; PAM type: YTN; PAM sequence: CTT
ctgtatattttaagtggatc

SEQ ID NO: 70320 - DNA, 20 bp, Artificial Sequence
  Description of Artificial Sequence: Synthetic oligonucleotide
  Target: SCN10A; (+) strand; PAM type: YTN; PAM sequence: TTC
tgtatattttaagtggatca

SEQ ID NO: 70321 - DNA, 20 bp, Artificial Sequence
  Description of Artificial Sequence: Synthetic oligonucleotide
  Target: SCN10A; (+) strand; PAM type: YTN; PAM sequence: CTG
tatattttaagtggatcatt

SEQ ID NO: 70322 - DNA, 20 bp, Artificial Sequence
  Description of Artificial Sequence: Synthetic oligonucleotide
  Target: SCN10A; (+) strand; PAM type: YTN; PAM sequence: TTT
taagtggatcatttagggca

SEQ ID NO: 70323 - DNA, 20 bp, Artificial Sequence
  Description of Artificial Sequence: Synthetic oligonucleotide
  Target: SCN10A; (+) strand; PAM type: YTN; PAM sequence: TTT
aagtggatcatttagggcat

SEQ ID NO: 70324 - DNA, 20 bp, Artificial Sequence
  Description of Artificial Sequence: Synthetic oligonucleotide
  Target: SCN10A; (+) strand; PAM type: YTN; PAM sequence: TTA
agtggatcatttagggcatt

SEQ ID NO: 70325 - DNA, 20 bp, Artificial Sequence
  Description of Artificial Sequence: Synthetic oligonucleotide
  Target: SCN10A; (+) strand; PAM type: YTN; PAM sequence: TTT
agggcatttacactcaacat

SEQ ID NO: 70326 - DNA, 20 bp, Artificial Sequence
  Description of Artificial Sequence: Synthetic oligonucleotide
  Target: SCN10A; (+) strand; PAM type: YTN; PAM sequence: TTA
gggcatttacactcaacatc

SEQ ID NO: 70327 - DNA, 20 bp, Artificial Sequence
  Description of Artificial Sequence: Synthetic oligonucleotide
  Target: SCN10A; (+) strand; PAM type: YTN; PAM sequence: TTT
acactcaacatcagtattga

SEQ ID NO: 70328 - DNA, 20 bp, Artificial Sequence
  Description of Artificial Sequence: Synthetic oligonucleotide
  Target: SCN10A; (+) strand; PAM type: YTN; PAM sequence: TTA
cactcaacatcagtattgag

SEQ ID NO: 70329 - DNA, 20 bp, Artificial Sequence
  Description of Artificial Sequence: Synthetic oligonucleotide
  Target: SCN10A; (+) strand; PAM type: YTN; PAM sequence: CTC
aacatcagtattgagatgtg

SEQ ID NO: 70330 - DNA, 20 bp, Artificial Sequence
  Description of Artificial Sequence: Synthetic oligonucleotide
  Target: SCN10A; (+) strand; PAM type: YTN; PAM sequence: TTG
agatgtgaggtactcttcta

SEQ ID NO: 70331 - DNA, 20 bp, Artificial Sequence
  Description of Artificial Sequence: Synthetic oligonucleotide
  Target: SCN10A; (+) strand; PAM type: YTN; PAM sequence: CTC
ttctattcattatgctagtt

SEQ ID NO: 70332 - DNA, 20 bp, Artificial Sequence
  Description of Artificial Sequence: Synthetic oligonucleotide
  Target: SCN10A; (+) strand; PAM type: YTN; PAM sequence: CTT
ctattcattatgctagttat

SEQ ID NO: 70333 - DNA, 20 bp, Artificial Sequence
  Description of Artificial Sequence: Synthetic oligonucleotide
  Target: SCN10A; (+) strand; PAM type: YTN; PAM sequence: TTC
tattcattatgctagttatt

SEQ ID NO: 70334 - DNA, 20 bp, Artificial Sequence
  Description of Artificial Sequence: Synthetic oligonucleotide
  Target: SCN10A; (+) strand; PAM type: YTN; PAM sequence: CTA
ttcattatgctagttattgc

SEQ ID NO: 70335 - DNA, 20 bp, Artificial Sequence
  Description of Artificial Sequence: Synthetic oligonucleotide
  Target: SCN10A; (+) strand; PAM type: YTN; PAM sequence: TTC
attatgctagttattgcctt

SEQ ID NO: 70336 - DNA, 20 bp, Artificial Sequence
  Description of Artificial Sequence: Synthetic oligonucleotide
  Target: SCN10A; (+) strand; PAM type: YTN; PAM sequence: TTA
tgctagttattgccttaatt

SEQ ID NO: 70337 - DNA, 20 bp, Artificial Sequence
  Description of Artificial Sequence: Synthetic oligonucleotide
  Target: SCN10A; (+) strand; PAM type: YTN; PAM sequence: CTA
gttattgccttaattccttt

SEQ ID NO: 70338 - DNA, 20 bp, Artificial Sequence
  Description of Artificial Sequence: Synthetic oligonucleotide
  Target: SCN10A; (+) strand; PAM type: YTN; PAM sequence: TTA
ttgccttaattccttttttt

SEQ ID NO: 70339 - DNA, 20 bp, Artificial Sequence
  Description of Artificial Sequence: Synthetic oligonucleotide
  Target: SCN10A; (+) strand; PAM type: YTN; PAM sequence: TTG
ccttaattcctttttttatt

SEQ ID NO: 70340 - DNA, 20 bp, Artificial Sequence
  Description of Artificial Sequence: Synthetic oligonucleotide
  Target: SCN10A; (+) strand; PAM type: YTN; PAM sequence: CTT
aattcctttttttattgtgt

SEQ ID NO: 70341 - DNA, 20 bp, Artificial Sequence
  Description of Artificial Sequence: Synthetic oligonucleotide
  Target: SCN10A; (+) strand; PAM type: YTN; PAM sequence: TTA
attcctttttttattgtgtt

SEQ ID NO: 70342 - DNA, 20 bp, Artificial Sequence
  Description of Artificial Sequence: Synthetic oligonucleotide
  Target: SCN10A; (+) strand; PAM type: YTN; PAM sequence: TTC
ctttttttattgtgttattg

SEQ ID NO: 70343 - DNA, 20 bp, Artificial Sequence
  Description of Artificial Sequence: Synthetic oligonucleotide
  Target: SCN10A; (+) strand; PAM type: YTN; PAM sequence: CTT
tttttattgtgttattgttt

SEQ ID NO: 70344 - DNA, 20 bp, Artificial Sequence
  Description of Artificial Sequence: Synthetic oligonucleotide
  Target: SCN10A; (+) strand; PAM type: YTN; PAM sequence: TTT
ttttattgtgttattgtttt

SEQ ID NO: 70345 - DNA, 20 bp, Artificial Sequence
  Description of Artificial Sequence: Synthetic oligonucleotide
  Target: SCN10A; (+) strand; PAM type: YTN; PAM sequence: TTT
tttattgtgttattgtttta

SEQ ID NO: 70346 - DNA, 20 bp, Artificial Sequence
  Description of Artificial Sequence: Synthetic oligonucleotide
  Target: SCN10A; (+) strand; PAM type: YTN; PAM sequence: TTT
ttattgtgttattgttttat

SEQ ID NO: 70347 - DNA, 20 bp, Artificial Sequence
  Description of Artificial Sequence: Synthetic oligonucleotide
  Target: SCN10A; (+) strand; PAM type: YTN; PAM sequence: TTT
tattgtgttattgttttata

SEQ ID NO: 70348 - DNA, 20 bp, Artificial Sequence
  Description of Artificial Sequence: Synthetic oligonucleotide
  Target: SCN10A; (+) strand; PAM type: YTN; PAM sequence: TTT
attgtgttattgttttatag

SEQ ID NO: 70349 - DNA, 20 bp, Artificial Sequence
  Description of Artificial Sequence: Synthetic oligonucleotide
  Target: SCN10A; (+) strand; PAM type: YTN; PAM sequence: TTA
ttgtgttattgttttatagg

SEQ ID NO: 70350 - DNA, 20 bp, Artificial Sequence
  Description of Artificial Sequence: Synthetic oligonucleotide
  Target: SCN10A; (+) strand; PAM type: YTN; PAM sequence: TTG
tgttattgttttataggtcc

SEQ ID NO: 70351 - DNA, 20 bp, Artificial Sequence
  Description of Artificial Sequence: Synthetic oligonucleotide
  Target: SCN10A; (+) strand; PAM type: YTN; PAM sequence: TTA
ttgttttataggtcctttga

SEQ ID NO: 70352 - DNA, 20 bp, Artificial Sequence
  Description of Artificial Sequence: Synthetic oligonucleotide
  Target: SCN10A; (+) strand; PAM type: YTN; PAM sequence: TTG
ttttataggtcctttgatat

SEQ ID NO: 70353 - DNA, 20 bp, Artificial Sequence
  Description of Artificial Sequence: Synthetic oligonucleotide
  Target: SCN10A; (+) strand; PAM type: YTN; PAM sequence: TTT
tataggtcctttgatattta

SEQ ID NO: 70354 - DNA, 20 bp, Artificial Sequence
  Description of Artificial Sequence: Synthetic oligonucleotide
  Target: SCN10A; (+) strand; PAM type: YTN; PAM sequence: TTT
ataggtcctttgatatttat

SEQ ID NO: 70355 - DNA, 20 bp, Artificial Sequence
  Description of Artificial Sequence: Synthetic oligonucleotide
  Target: SCN10A; (+) strand; PAM type: YTN; PAM sequence: TTA
taggtcctttgatatttatg

SEQ ID NO: 70356 - DNA, 20 bp, Artificial Sequence
  Description of Artificial Sequence: Synthetic oligonucleotide
  Target: SCN10A; (+) strand; PAM type: YTN; PAM sequence: CTT
tgatatttatgctttaagga

SEQ ID NO: 70357 - DNA, 20 bp, Artificial Sequence
  Description of Artificial Sequence: Synthetic oligonucleotide
  Target: SCN10A; (+) strand; PAM type: YTN; PAM sequence: TTT
gatatttatgctttaaggag

SEQ ID NO: 70358 - DNA, 20 bp, Artificial Sequence
  Description of Artificial Sequence: Synthetic oligonucleotide
  Target: SCN10A; (+) strand; PAM type: YTN; PAM sequence: TTG
atatttatgctttaaggagg

SEQ ID NO: 70359 - DNA, 20 bp, Artificial Sequence
  Description of Artificial Sequence: Synthetic oligonucleotide
  Target: SCN10A; (+) strand; PAM type: YTN; PAM sequence: TTT
atgctttaaggaggttctat

SEQ ID NO: 70360 - DNA, 20 bp, Artificial Sequence
  Description of Artificial Sequence: Synthetic oligonucleotide
  Target: SCN10A; (+) strand; PAM type: YTN; PAM sequence: TTA
tgctttaaggaggttctatt

SEQ ID NO: 70361 - DNA, 20 bp, Artificial Sequence
  Description of Artificial Sequence: Synthetic oligonucleotide
  Target: SCN10A; (+) strand; PAM type: YTN; PAM sequence: CTT
taaggaggttctattttggt

SEQ ID NO: 70362 - DNA, 20 bp, Artificial Sequence
  Description of Artificial Sequence: Synthetic oligonucleotide
  Target: SCN10A; (+) strand; PAM type: YTN; PAM sequence: TTT
aaggaggttctattttggtg

SEQ ID NO: 70363 - DNA, 20 bp, Artificial Sequence
  Description of Artificial Sequence: Synthetic oligonucleotide
  Target: SCN10A; (+) strand; PAM type: YTN; PAM sequence: TTA
aggaggttctattttggtgt

SEQ ID NO: 70364 - DNA, 20 bp, Artificial Sequence
  Description of Artificial Sequence: Synthetic oligonucleotide
  Target: SCN10A; (+) strand; PAM type: YTN; PAM sequence: TTC
tattttggtgtattttaagg

SEQ ID NO: 70365 - DNA, 20 bp, Artificial Sequence
  Description of Artificial Sequence: Synthetic oligonucleotide
  Target: SCN10A; (+) strand; PAM type: YTN; PAM sequence: CTA
ttttggtgtattttaaggtt

SEQ ID NO: 70366 - DNA, 20 bp, Artificial Sequence
  Description of Artificial Sequence: Synthetic oligonucleotide
  Target: SCN10A; (+) strand; PAM type: YTN; PAM sequence: TTT
tggtgtattttaaggtttta

SEQ ID NO: 70367 - DNA, 20 bp, Artificial Sequence
  Description of Artificial Sequence: Synthetic oligonucleotide
  Target: SCN10A; (+) strand; PAM type: YTN; PAM sequence: TTT
ggtgtattttaaggttttat

SEQ ID NO: 70368 - DNA, 20 bp, Artificial Sequence
  Description of Artificial Sequence: Synthetic oligonucleotide
  Target: SCN10A; (+) strand; PAM type: YTN; PAM sequence: TTG
gtgtattttaaggttttatt

SEQ ID NO: 70369 - DNA, 20 bp, Artificial Sequence
  Description of Artificial Sequence: Synthetic oligonucleotide
  Target: SCN10A; (+) strand; PAM type: YTN; PAM sequence: TTT
taaggttttatttcaagatt

SEQ ID NO: 70370 - DNA, 20 bp, Artificial Sequence
  Description of Artificial Sequence: Synthetic oligonucleotide
  Target: SCN10A; (+) strand; PAM type: YTN; PAM sequence: TTT
aaggttttatttcaagattt

SEQ ID NO: 70371 - DNA, 20 bp, Artificial Sequence
  Description of Artificial Sequence: Synthetic oligonucleotide
  Target: SCN10A; (+) strand; PAM type: YTN; PAM sequence: TTA
aggttttatttcaagattta

SEQ ID NO: 70372 - DNA, 20 bp, Artificial Sequence
  Description of Artificial Sequence: Synthetic oligonucleotide
  Target: SCN10A; (+) strand; PAM type: YTN; PAM sequence: TTT
tatttcaagatttagaattc

SEQ ID NO: 70373 - DNA, 20 bp, Artificial Sequence
  Description of Artificial Sequence: Synthetic oligonucleotide
  Target: SCN10A; (+) strand; PAM type: YTN; PAM sequence: TTT
atttcaagatttagaattcc

SEQ ID NO: 70374 - DNA, 20 bp, Artificial Sequence
  Description of Artificial Sequence: Synthetic oligonucleotide
  Target: SCN10A; (+) strand; PAM type: YTN; PAM sequence: TTA
tttcaagatttagaattcct

SEQ ID NO: 70375 - DNA, 20 bp, Artificial Sequence
  Description of Artificial Sequence: Synthetic oligonucleotide
  Target: SCN10A; (+) strand; PAM type: YTN; PAM sequence: TTT
caagatttagaattcctttt

SEQ ID NO: 70376 - DNA, 20 bp, Artificial Sequence
  Description of Artificial Sequence: Synthetic oligonucleotide
  Target: SCN10A; (+) strand; PAM type: YTN; PAM sequence: TTC
aagatttagaattcctttta

SEQ ID NO: 70377 - DNA, 20 bp, Artificial Sequence
  Description of Artificial Sequence: Synthetic oligonucleotide
  Target: SCN10A; (+) strand; PAM type: YTN; PAM sequence: TTT
agaattccttttagcatttc

SEQ ID NO: 70378 - DNA, 20 bp, Artificial Sequence
  Description of Artificial Sequence: Synthetic oligonucleotide
  Target: SCN10A; (+) strand; PAM type: YTN; PAM sequence: TTA
gaattccttttagcatttct

SEQ ID NO: 70379 - DNA, 20 bp, Artificial Sequence
  Description of Artificial Sequence: Synthetic oligonucleotide
  Target: SCN10A; (+) strand; PAM type: YTN; PAM sequence: TTC
cttttagcatttcttgtagt

SEQ ID NO: 70380 - DNA, 20 bp, Artificial Sequence
  Description of Artificial Sequence: Synthetic oligonucleotide
  Target: SCN10A; (+) strand; PAM type: YTN; PAM sequence: CTT
ttagcatttcttgtagtgct

SEQ ID NO: 70381 - DNA, 20 bp, Artificial Sequence
  Description of Artificial Sequence: Synthetic oligonucleotide
  Target: SCN10A; (+) strand; PAM type: YTN; PAM sequence: TTT
tagcatttcttgtagtgctg

SEQ ID NO: 70382 - DNA, 20 bp, Artificial Sequence
  Description of Artificial Sequence: Synthetic oligonucleotide
  Target: SCN10A; (+) strand; PAM type: YTN; PAM sequence: TTT
agcatttcttgtagtgctgg

SEQ ID NO: 70383 - DNA, 20 bp, Artificial Sequence
  Description of Artificial Sequence: Synthetic oligonucleotide
  Target: SCN10A; (+) strand; PAM type: YTN; PAM sequence: TTA
gcatttcttgtagtgctggc

SEQ ID NO: 70384 - DNA, 20 bp, Artificial Sequence
  Description of Artificial Sequence: Synthetic oligonucleotide
  Target: SCN10A; (+) strand; PAM type: YTN; PAM sequence: TTT
cttgtagtgctggcttggta

SEQ ID NO: 70385 - DNA, 20 bp, Artificial Sequence
  Description of Artificial Sequence: Synthetic oligonucleotide
  Target: SCN10A; (+) strand; PAM type: YTN; PAM sequence: TTC
ttgtagtgctggcttggtag

SEQ ID NO: 70386 - DNA, 20 bp, Artificial Sequence
  Description of Artificial Sequence: Synthetic oligonucleotide
  Target: SCN10A; (+) strand; PAM type: YTN; PAM sequence: CTT
gtagtgctggcttggtagtg

SEQ ID NO: 70387 - DNA, 20 bp, Artificial Sequence
  Description of Artificial Sequence: Synthetic oligonucleotide
  Target: SCN10A; (+) strand; PAM type: YTN; PAM sequence: TTG
tagtgctggcttggtagtgg

SEQ ID NO: 70388 - DNA, 20 bp, Artificial Sequence
  Description of Artificial Sequence: Synthetic oligonucleotide
  Target: SCN10A; (+) strand; PAM type: YTN; PAM sequence: CTG
gcttggtagtggaaaattct

SEQ ID NO: 70389 - DNA, 20 bp, Artificial Sequence
  Description of Artificial Sequence: Synthetic oligonucleotide
  Target: SCN10A; (+) strand; PAM type: YTN; PAM sequence: CTT
ggtagtggaaaattctctca

SEQ ID NO: 70390 - DNA, 20 bp, Artificial Sequence
  Description of Artificial Sequence: Synthetic oligonucleotide
  Target: SCN10A; (+) strand; PAM type: YTN; PAM sequence: TTG
gtagtggaaaattctctcac

SEQ ID NO: 70391 - DNA, 20 bp, Artificial Sequence
  Description of Artificial Sequence: Synthetic oligonucleotide
  Target: SCN10A; (+) strand; PAM type: YTN; PAM sequence: TTC
tctcaccatttgtttgtctg

SEQ ID NO: 70392 - DNA, 20 bp, Artificial Sequence
  Description of Artificial Sequence: Synthetic oligonucleotide
  Target: SCN10A; (+) strand; PAM type: YTN; PAM sequence: CTC
tcaccatttgtttgtctgaa

SEQ ID NO: 70393 - DNA, 20 bp, Artificial Sequence
  Description of Artificial Sequence: Synthetic oligonucleotide
  Target: SCN10A; (+) strand; PAM type: YTN; PAM sequence: CTC
accatttgtttgtctgaaaa

SEQ ID NO: 70394 - DNA, 20 bp, Artificial Sequence
  Description of Artificial Sequence: Synthetic oligonucleotide
  Target: SCN10A; (+) strand; PAM type: YTN; PAM sequence: TTT
gtttgtctgaaaaaaacttt

SEQ ID NO: 70395 - DNA, 20 bp, Artificial Sequence
  Description of Artificial Sequence: Synthetic oligonucleotide
  Target: SCN10A; (+) strand; PAM type: YTN; PAM sequence: TTG
tttgtctgaaaaaaacttta

SEQ ID NO: 70396 - DNA, 20 bp, Artificial Sequence
  Description of Artificial Sequence: Synthetic oligonucleotide
  Target: SCN10A; (+) strand; PAM type: YTN; PAM sequence: TTT
gtctgaaaaaaactttatct

SEQ ID NO: 70397 - DNA, 20 bp, Artificial Sequence
  Description of Artificial Sequence: Synthetic oligonucleotide
  Target: SCN10A; (+) strand; PAM type: YTN; PAM sequence: TTG
tctgaaaaaaactttatctt

SEQ ID NO: 70398 - DNA, 20 bp, Artificial Sequence
  Description of Artificial Sequence: Synthetic oligonucleotide
  Target: SCN10A; (+) strand; PAM type: YTN; PAM sequence: CTG
aaaaaaactttatcttgtct

SEQ ID NO: 70399 - DNA, 20 bp, Artificial Sequence
  Description of Artificial Sequence: Synthetic oligonucleotide
  Target: SCN10A; (+) strand; PAM type: YTN; PAM sequence: CTT
tatcttgtcttcacttatga

SEQ ID NO: 70400 - DNA, 20 bp, Artificial Sequence
  Description of Artificial Sequence: Synthetic oligonucleotide
  Target: SCN10A; (+) strand; PAM type: YTN; PAM sequence: TTT
atcttgtcttcacttatgaa

SEQ ID NO: 70401 - DNA, 20 bp, Artificial Sequence
  Description of Artificial Sequence: Synthetic oligonucleotide
  Target: SCN10A; (+) strand; PAM type: YTN; PAM sequence: TTA
tcttgtcttcacttatgaag

SEQ ID NO: 70402 - DNA, 20 bp, Artificial Sequence
  Description of Artificial Sequence: Synthetic oligonucleotide
  Target: SCN10A; (+) strand; PAM type: YTN; PAM sequence: CTT
gtcttcacttatgaagctta

SEQ ID NO: 70403 - DNA, 20 bp, Artificial Sequence
  Description of Artificial Sequence: Synthetic oligonucleotide
  Target: SCN10A; (+) strand; PAM type: YTN; PAM sequence: TTG
tcttcacttatgaagcttag

SEQ ID NO: 70404 - DNA, 20 bp, Artificial Sequence
  Description of Artificial Sequence: Synthetic oligonucleotide
  Target: SCN10A; (+) strand; PAM type: YTN; PAM sequence: CTT
cacttatgaagcttagtttc

SEQ ID NO: 70405 - DNA, 20 bp, Artificial Sequence
  Description of Artificial Sequence: Synthetic oligonucleotide
  Target: SCN10A; (+) strand; PAM type: YTN; PAM sequence: TTC
acttatgaagcttagtttct

SEQ ID NO: 70406 - DNA, 20 bp, Artificial Sequence
  Description of Artificial Sequence: Synthetic oligonucleotide
  Target: SCN10A; (+) strand; PAM type: YTN; PAM sequence: CTT
atgaagcttagtttctcttc

SEQ ID NO: 70407 - DNA, 20 bp, Artificial Sequence
  Description of Artificial Sequence: Synthetic oligonucleotide
  Target: SCN10A; (+) strand; PAM type: YTN; PAM sequence: TTA
tgaagcttagtttctcttca

SEQ ID NO: 70408 - DNA, 20 bp, Artificial Sequence
  Description of Artificial Sequence: Synthetic oligonucleotide
  Target: SCN10A; (+) strand; PAM type: YTN; PAM sequence: CTT
agtttctcttcatacaatat

SEQ ID NO: 70409 - DNA, 20 bp, Artificial Sequence
  Description of Artificial Sequence: Synthetic oligonucleotide
  Target: SCN10A; (+) strand; PAM type: YTN; PAM sequence: TTA
gtttctcttcatacaatatt

SEQ ID NO: 70410 - DNA, 20 bp, Artificial Sequence
  Description of Artificial Sequence: Synthetic oligonucleotide
  Target: SCN10A; (+) strand; PAM type: YTN; PAM sequence: TTT
ctcttcatacaatattcttg

SEQ ID NO: 70411 - DNA, 20 bp, Artificial Sequence
  Description of Artificial Sequence: Synthetic oligonucleotide
  Target: SCN10A; (+) strand; PAM type: YTN; PAM sequence: TTC
tcttcatacaatattcttgg

SEQ ID NO: 70412 - DNA, 20 bp, Artificial Sequence
  Description of Artificial Sequence: Synthetic oligonucleotide
  Target: SCN10A; (+) strand; PAM type: YTN; PAM sequence: CTC
ttcatacaatattcttggct

SEQ ID NO: 70413 - DNA, 20 bp, Artificial Sequence
  Description of Artificial Sequence: Synthetic oligonucleotide
  Target: SCN10A; (+) strand; PAM type: YTN; PAM sequence: CTT
catacaatattcttggctgg

SEQ ID NO: 70414 - DNA, 20 bp, Artificial Sequence
  Description of Artificial Sequence: Synthetic oligonucleotide
  Target: SCN10A; (+) strand; PAM type: YTN; PAM sequence: TTC
atacaatattcttggctggc

SEQ ID NO: 70415 - DNA, 20 bp, Artificial Sequence
  Description of Artificial Sequence: Synthetic oligonucleotide
  Target: SCN10A; (+) strand; PAM type: YTN; PAM sequence: TTC
ttggctggcaattattttgt

SEQ ID NO: 70416 - DNA, 20 bp, Artificial Sequence
  Description of Artificial Sequence: Synthetic oligonucleotide
  Target: SCN10A; (+) strand; PAM type: YTN; PAM sequence: CTT
ggctggcaattattttgttt

SEQ ID NO: 70417 - DNA, 20 bp, Artificial Sequence
  Description of Artificial Sequence: Synthetic oligonucleotide
  Target: SCN10A; (+) strand; PAM type: YTN; PAM sequence: TTG
gctggcaattattttgtttc

SEQ ID NO: 70418 - DNA, 20 bp, Artificial Sequence
  Description of Artificial Sequence: Synthetic oligonucleotide
  Target: SCN10A; (+) strand; PAM type: YTN; PAM sequence: CTG
gcaattattttgtttcagga

SEQ ID NO: 70419 - DNA, 20 bp, Artificial Sequence
  Description of Artificial Sequence: Synthetic oligonucleotide
  Target: SCN10A; (+) strand; PAM type: YTN; PAM sequence: TTA
ttttgtttcaggaggctaaa

SEQ ID NO: 70420 - DNA, 20 bp, Artificial Sequence
  Description of Artificial Sequence: Synthetic oligonucleotide
  Target: SCN10A; (+) strand; PAM type: YTN; PAM sequence: TTT
tgtttcaggaggctaaagat

SEQ ID NO: 70421 - DNA, 20 bp, Artificial Sequence
  Description of Artificial Sequence: Synthetic oligonucleotide
  Target: SCN10A; (+) strand; PAM type: YTN; PAM sequence: TTT
gtttcaggaggctaaagatg

SEQ ID NO: 70422 - DNA, 20 bp, Artificial Sequence
  Description of Artificial Sequence: Synthetic oligonucleotide
  Target: SCN10A; (+) strand; PAM type: YTN; PAM sequence: TTG
tttcaggaggctaaagatgg

SEQ ID NO: 70423 - DNA, 20 bp, Artificial Sequence
  Description of Artificial Sequence: Synthetic oligonucleotide
  Target: SCN10A; (+) strand; PAM type: YTN; PAM sequence: TTT
caggaggctaaagatgggac

SEQ ID NO: 70424 - DNA, 20 bp, Artificial Sequence
  Description of Artificial Sequence: Synthetic oligonucleotide
  Target: SCN10A; (+) strand; PAM type: YTN; PAM sequence: TTC
aggaggctaaagatgggacc

SEQ ID NO: 70425 - DNA, 20 bp, Artificial Sequence
  Description of Artificial Sequence: Synthetic oligonucleotide
  Target: SCN10A; (+) strand; PAM type: YTN; PAM sequence: CTA
aagatgggaccctaatccct

SEQ ID NO: 70426 - DNA, 20 bp, Artificial Sequence
  Description of Artificial Sequence: Synthetic oligonucleotide
  Target: SCN10A; (+) strand; PAM type: YTN; PAM sequence: CTA
atcccttctggcttgcaagg

SEQ ID NO: 70427 - DNA, 20 bp, Artificial Sequence
  Description of Artificial Sequence: Synthetic oligonucleotide
  Target: SCN10A; (+) strand; PAM type: YTN; PAM sequence: CTT
ctggcttgcaaggtttcagt

SEQ ID NO: 70428 - DNA, 20 bp, Artificial Sequence
  Description of Artificial Sequence: Synthetic oligonucleotide
  Target: SCN10A; (+) strand; PAM type: YTN; PAM sequence: TTC
tggcttgcaaggtttcagtt

SEQ ID NO: 70429 - DNA, 20 bp, Artificial Sequence
  Description of Artificial Sequence: Synthetic oligonucleotide
  Target: SCN10A; (+) strand; PAM type: YTN; PAM sequence: CTG
gcttgcaaggtttcagttga

SEQ ID NO: 70430 - DNA, 20 bp, Artificial Sequence
  Description of Artificial Sequence: Synthetic oligonucleotide
  Target: SCN10A; (+) strand; PAM type: YTN; PAM sequence: CTT
gcaaggtttcagttgagaaa

SEQ ID NO: 70431 - DNA, 20 bp, Artificial Sequence
  Description of Artificial Sequence: Synthetic oligonucleotide
  Target: SCN10A; (+) strand; PAM type: YTN; PAM sequence: TTG
caaggtttcagttgagaaat

SEQ ID NO: 70432 - DNA, 20 bp, Artificial Sequence
  Description of Artificial Sequence: Synthetic oligonucleotide
  Target: SCN10A; (+) strand; PAM type: YTN; PAM sequence: TTT
cagttgagaaatctgctgtt

SEQ ID NO: 70433 - DNA, 20 bp, Artificial Sequence
  Description of Artificial Sequence: Synthetic oligonucleotide
  Target: SCN10A; (+) strand; PAM type: YTN; PAM sequence: TTC
agttgagaaatctgctgtta

SEQ ID NO: 70434 - DNA, 20 bp, Artificial Sequence
  Description of Artificial Sequence: Synthetic oligonucleotide
  Target: SCN10A; (+) strand; PAM type: YTN; PAM sequence: TTG
agaaatctgctgttaatctt

SEQ ID NO: 70435 - DNA, 20 bp, Artificial Sequence
  Description of Artificial Sequence: Synthetic oligonucleotide
  Target: SCN10A; (+) strand; PAM type: YTN; PAM sequence: CTG
ctgttaatcttatgtaaatc

SEQ ID NO: 70436 - DNA, 20 bp, Artificial Sequence
  Description of Artificial Sequence: Synthetic oligonucleotide
  Target: SCN10A; (+) strand; PAM type: YTN; PAM sequence: CTG
ttaatcttatgtaaatcaga

SEQ ID NO: 70437 - DNA, 20 bp, Artificial Sequence
  Description of Artificial Sequence: Synthetic oligonucleotide
  Target: SCN10A; (+) strand; PAM type: YTN; PAM sequence: TTA
atcttatgtaaatcagataa

SEQ ID NO: 70438 - DNA, 20 bp, Artificial Sequence
  Description of Artificial Sequence: Synthetic oligonucleotide
  Target: SCN10A; (+) strand; PAM type: YTN; PAM sequence: CTT
atgtaaatcagataaccttt

SEQ ID NO: 70439 - DNA, 20 bp, Artificial Sequence
  Description of Artificial Sequence: Synthetic oligonucleotide
  Target: SCN10A; (+) strand; PAM type: YTN; PAM sequence: TTA
tgtaaatcagataacctttc

SEQ ID NO: 70440 - DNA, 20 bp, Artificial Sequence
  Description of Artificial Sequence: Synthetic oligonucleotide
  Target: SCN10A; (+) strand; PAM type: YTN; PAM sequence: CTT
tcctttataggttatctgag

SEQ ID NO: 70441 - DNA, 20 bp, Artificial Sequence
  Description of Artificial Sequence: Synthetic oligonucleotide
  Target: SCN10A; (+) strand; PAM type: YTN; PAM sequence: TTT
cctttataggttatctgagg

SEQ ID NO: 70442 - DNA, 20 bp, Artificial Sequence
  Description of Artificial Sequence: Synthetic oligonucleotide
  Target: SCN10A; (+) strand; PAM type: YTN; PAM sequence: TTC
ctttataggttatctgaggc

SEQ ID NO: 70443 - DNA, 20 bp, Artificial Sequence
  Description of Artificial Sequence: Synthetic oligonucleotide
  Target: SCN10A; (+) strand; PAM type: YTN; PAM sequence: CTT
tataggttatctgaggcttt

SEQ ID NO: 70444 - DNA, 20 bp, Artificial Sequence
  Description of Artificial Sequence: Synthetic oligonucleotide
  Target: SCN10A; (+) strand; PAM type: YTN; PAM sequence: TTT
ataggttatctgaggctttt

SEQ ID NO: 70445 - DNA, 20 bp, Artificial Sequence
  Description of Artificial Sequence: Synthetic oligonucleotide
  Target: SCN10A; (+) strand; PAM type: YTN; PAM sequence: TTA
taggttatctgaggcttttg

SEQ ID NO: 70446 - DNA, 20 bp, Artificial Sequence
  Description of Artificial Sequence: Synthetic oligonucleotide
  Target: SCN10A; (+) strand; PAM type: YTN; PAM sequence: TTA
tctgaggcttttgtctcaca

SEQ ID NO: 70447 - DNA, 20 bp, Artificial Sequence
  Description of Artificial Sequence: Synthetic oligonucleotide
  Target: SCN10A; (+) strand; PAM type: YTN; PAM sequence: CTG
aggcttttgtctcacagctc

SEQ ID NO: 70448 - DNA, 20 bp, Artificial Sequence
  Description of Artificial Sequence: Synthetic oligonucleotide
  Target: SCN10A; (+) strand; PAM type: YTN; PAM sequence: CTT
ttgtctcacagctcttaaga

SEQ ID NO: 70449 - DNA, 20 bp, Artificial Sequence
  Description of Artificial Sequence: Synthetic oligonucleotide
  Target: SCN10A; (+) strand; PAM type: YTN; PAM sequence: TTT
tgtctcacagctcttaagat

SEQ ID NO: 70450 - DNA, 20 bp, Artificial Sequence
  Description of Artificial Sequence: Synthetic oligonucleotide
  Target: SCN10A; (+) strand; PAM type: YTN; PAM sequence: TTT
gtctcacagctcttaagatt

SEQ ID NO: 70451 - DNA, 20 bp, Artificial Sequence
  Description of Artificial Sequence: Synthetic oligonucleotide
  Target: SCN10A; (+) strand; PAM type: YTN; PAM sequence: TTG
tctcacagctcttaagattc

SEQ ID NO: 70452 - DNA, 20 bp, Artificial Sequence
  Description of Artificial Sequence: Synthetic oligonucleotide
  Target: SCN10A; (+) strand; PAM type: YTN; PAM sequence: CTC
acagctcttaagattctttt

SEQ ID NO: 70453 - DNA, 20 bp, Artificial Sequence
  Description of Artificial Sequence: Synthetic oligonucleotide
  Target: SCN10A; (+) strand; PAM type: YTN; PAM sequence: CTC
ttaagattcttttctttgtc

SEQ ID NO: 70454 - DNA, 20 bp, Artificial Sequence
  Description of Artificial Sequence: Synthetic oligonucleotide
  Target: SCN10A; (+) strand; PAM type: YTN; PAM sequence: CTT
aagattcttttctttgtctt

SEQ ID NO: 70455 - DNA, 20 bp, Artificial Sequence
  Description of Artificial Sequence: Synthetic oligonucleotide
  Target: SCN10A; (+) strand; PAM type: YTN; PAM sequence: TTA
agattcttttctttgtcttg

SEQ ID NO: 70456 - DNA, 20 bp, Artificial Sequence
  Description of Artificial Sequence: Synthetic oligonucleotide
  Target: SCN10A; (+) strand; PAM type: YTN; PAM sequence: TTC
ttttctttgtcttgacttta

SEQ ID NO: 70457 - DNA, 20 bp, Artificial Sequence
  Description of Artificial Sequence: Synthetic oligonucleotide
  Target: SCN10A; (+) strand; PAM type: YTN; PAM sequence: CTT
ttctttgtcttgactttaga

SEQ ID NO: 70458 - DNA, 20 bp, Artificial Sequence
  Description of Artificial Sequence: Synthetic oligonucleotide
  Target: SCN10A; (+) strand; PAM type: YTN; PAM sequence: TTT
tctttgtcttgactttagat

SEQ ID NO: 70459 - DNA, 20 bp, Artificial Sequence
  Description of Artificial Sequence: Synthetic oligonucleotide
  Target: SCN10A; (+) strand; PAM type: YTN; PAM sequence: TTT
ctttgtcttgactttagata

SEQ ID NO: 70460 - DNA, 20 bp, Artificial Sequence
  Description of Artificial Sequence: Synthetic oligonucleotide
  Target: SCN10A; (+) strand; PAM type: YTN; PAM sequence: TTC
tttgtcttgactttagataa

SEQ ID NO: 70461 - DNA, 20 bp, Artificial Sequence
  Description of Artificial Sequence: Synthetic oligonucleotide
  Target: SCN10A; (+) strand; PAM type: YTN; PAM sequence: CTT
tgtcttgactttagataacc

SEQ ID NO: 70462 - DNA, 20 bp, Artificial Sequence
  Description of Artificial Sequence: Synthetic oligonucleotide
  Target: SCN10A; (+) strand; PAM type: YTN; PAM sequence: TTT
gtcttgactttagataacct

SEQ ID NO: 70463 - DNA, 20 bp, Artificial Sequence
  Description of Artificial Sequence: Synthetic oligonucleotide
  Target: SCN10A; (+) strand; PAM type: YTN; PAM sequence: TTG
tcttgactttagataacctg

SEQ ID NO: 70464 - DNA, 20 bp, Artificial Sequence
  Description of Artificial Sequence: Synthetic oligonucleotide
  Target: SCN10A; (+) strand; PAM type: YTN; PAM sequence: CTT
gactttagataacctgatgt

SEQ ID NO: 70465 - DNA, 20 bp, Artificial Sequence
  Description of Artificial Sequence: Synthetic oligonucleotide
  Target: SCN10A; (+) strand; PAM type: YTN; PAM sequence: TTG
actttagataacctgatgtc

SEQ ID NO: 70466 - DNA, 20 bp, Artificial Sequence
  Description of Artificial Sequence: Synthetic oligonucleotide
  Target: SCN10A; (+) strand; PAM type: YTN; PAM sequence: CTT
tagataacctgatgtctatt

SEQ ID NO: 70467 - DNA, 20 bp, Artificial Sequence
  Description of Artificial Sequence: Synthetic oligonucleotide
  Target: SCN10A; (+) strand; PAM type: YTN; PAM sequence: TTT
agataacctgatgtctattt

SEQ ID NO: 70468 - DNA, 20 bp, Artificial Sequence
  Description of Artificial Sequence: Synthetic oligonucleotide
  Target: SCN10A; (+) strand; PAM type: YTN; PAM sequence: TTA
gataacctgatgtctatttg

SEQ ID NO: 70469 - DNA, 20 bp, Artificial Sequence
  Description of Artificial Sequence: Synthetic oligonucleotide
  Target: SCN10A; (+) strand; PAM type: YTN; PAM sequence: CTG
atgtctatttgcctaggtga

SEQ ID NO: 70470 - DNA, 20 bp, Artificial Sequence
  Description of Artificial Sequence: Synthetic oligonucleotide
  Target: SCN10A; (+) strand; PAM type: YTN; PAM sequence: CTA
tttgcctaggtgatgatctt

SEQ ID NO: 70471 - DNA, 20 bp, Artificial Sequence
  Description of Artificial Sequence: Synthetic oligonucleotide
  Target: SCN10A; (+) strand; PAM type: YTN; PAM sequence: TTT
gcctaggtgatgatcttttt

SEQ ID NO: 70472 - DNA, 20 bp, Artificial Sequence
  Description of Artificial Sequence: Synthetic oligonucleotide
  Target: SCN10A; (+) strand; PAM type: YTN; PAM sequence: TTG
cctaggtgatgatctttttt

SEQ ID NO: 70473 - DNA, 20 bp, Artificial Sequence
  Description of Artificial Sequence: Synthetic oligonucleotide
  Target: SCN10A; (+) strand; PAM type: YTN; PAM sequence: CTA
ggtgatgatcttttttgtga

SEQ ID NO: 70474 - DNA, 20 bp, Artificial Sequence
  Description of Artificial Sequence: Synthetic oligonucleotide
  Target: SCN10A; (+) strand; PAM type: YTN; PAM sequence: CTT
ttttgtgacacatttcagag

SEQ ID NO: 70475 - DNA, 20 bp, Artificial Sequence
  Description of Artificial Sequence: Synthetic oligonucleotide
  Target: SCN10A; (+) strand; PAM type: YTN; PAM sequence: TTT
tttgtgacacatttcagagg

SEQ ID NO: 70476 - DNA, 20 bp, Artificial Sequence
  Description of Artificial Sequence: Synthetic oligonucleotide
  Target: SCN10A; (+) strand; PAM type: YTN; PAM sequence: TTT
ttgtgacacatttcagaggt

SEQ ID NO: 70477 - DNA, 20 bp, Artificial Sequence
  Description of Artificial Sequence: Synthetic oligonucleotide
  Target: SCN10A; (+) strand; PAM type: YTN; PAM sequence: TTT
tgtgacacatttcagaggta

SEQ ID NO: 70478 - DNA, 20 bp, Artificial Sequence
  Description of Artificial Sequence: Synthetic oligonucleotide
  Target: SCN10A; (+) strand; PAM type: YTN; PAM sequence: TTT
gtgacacatttcagaggtat

SEQ ID NO: 70479 - DNA, 20 bp, Artificial Sequence
  Description of Artificial Sequence: Synthetic oligonucleotide
  Target: SCN10A; (+) strand; PAM type: YTN; PAM sequence: TTG
tgacacatttcagaggtatt

SEQ ID NO: 70480 - DNA, 20 bp, Artificial Sequence
  Description of Artificial Sequence: Synthetic oligonucleotide
  Target: SCN10A; (+) strand; PAM type: YTN; PAM sequence: TTT
cagaggtattctttgagctt

SEQ ID NO: 70481 - DNA, 20 bp, Artificial Sequence
  Description of Artificial Sequence: Synthetic oligonucleotide
  Target: SCN10A; (+) strand; PAM type: YTN; PAM sequence: TTC
agaggtattctttgagcttc

SEQ ID NO: 70482 - DNA, 20 bp, Artificial Sequence
  Description of Artificial Sequence: Synthetic oligonucleotide
  Target: SCN10A; (+) strand; PAM type: YTN; PAM sequence: TTC
tttgagcttcttgtatttgg

SEQ ID NO: 70483 - DNA, 20 bp, Artificial Sequence
  Description of Artificial Sequence: Synthetic oligonucleotide
  Target: SCN10A; (+) strand; PAM type: YTN; PAM sequence: CTT
tgagcttcttgtatttggat

SEQ ID NO: 70484 - DNA, 20 bp, Artificial Sequence
  Description of Artificial Sequence: Synthetic oligonucleotide
  Target: SCN10A; (+) strand; PAM type: YTN; PAM sequence: TTT
gagcttcttgtatttggata

SEQ ID NO: 70485 - DNA, 20 bp, Artificial Sequence
  Description of Artificial Sequence: Synthetic oligonucleotide
  Target: SCN10A; (+) strand; PAM type: YTN; PAM sequence: TTG
agcttcttgtatttggatat

SEQ ID NO: 70486 - DNA, 20 bp, Artificial Sequence
  Description of Artificial Sequence: Synthetic oligonucleotide
  Target: SCN10A; (+) strand; PAM type: YTN; PAM sequence: CTT
cttgtatttggatatctata

SEQ ID NO: 70487 - DNA, 20 bp, Artificial Sequence
  Description of Artificial Sequence: Synthetic oligonucleotide
  Target: SCN10A; (+) strand; PAM type: YTN; PAM sequence: TTC
ttgtatttggatatctatat

SEQ ID NO: 70488 - DNA, 20 bp, Artificial Sequence
  Description of Artificial Sequence: Synthetic oligonucleotide
  Target: SCN10A; (+) strand; PAM type: YTN; PAM sequence: CTT
gtatttggatatctatattt

SEQ ID NO: 70489 - DNA, 20 bp, Artificial Sequence
  Description of Artificial Sequence: Synthetic oligonucleotide
  Target: SCN10A; (+) strand; PAM type: YTN; PAM sequence: TTG
tatttggatatctatatttc

SEQ ID NO: 70490 - DNA, 20 bp, Artificial Sequence
  Description of Artificial Sequence: Synthetic oligonucleotide
  Target: SCN10A; (+) strand; PAM type: YTN; PAM sequence: TTT
ggatatctatatttctaaca

SEQ ID NO: 70491 - DNA, 20 bp, Artificial Sequence
  Description of Artificial Sequence: Synthetic oligonucleotide
  Target: SCN10A; (+) strand; PAM type: YTN; PAM sequence: TTG
gatatctatatttctaacaa

SEQ ID NO: 70492 - DNA, 20 bp, Artificial Sequence
  Description of Artificial Sequence: Synthetic oligonucleotide
  Target: SCN10A; (+) strand; PAM type: YTN; PAM sequence: CTA
tatttctaacaaggccaggg

SEQ ID NO: 70493 - DNA, 20 bp, Artificial Sequence
  Description of Artificial Sequence: Synthetic oligonucleotide
  Target: SCN10A; (+) strand; PAM type: YTN; PAM sequence: TTT
ctaacaaggccagggaagtt

SEQ ID NO: 70494 - DNA, 20 bp, Artificial Sequence
  Description of Artificial Sequence: Synthetic oligonucleotide
  Target: SCN10A; (+) strand; PAM type: YTN; PAM sequence: TTC
taacaaggccagggaagttt

SEQ ID NO: 70495 - DNA, 20 bp, Artificial Sequence
  Description of Artificial Sequence: Synthetic oligonucleotide
  Target: SCN10A; (+) strand; PAM type: YTN; PAM sequence: CTA
acaaggccagggaagttttc

SEQ ID NO: 70496 - DNA, 20 bp, Artificial Sequence
  Description of Artificial Sequence: Synthetic oligonucleotide
  Target: SCN10A; (+) strand; PAM type: YTN; PAM sequence: TTT
tcctcaattattccctcaaa

SEQ ID NO: 70497 - DNA, 20 bp, Artificial Sequence
  Description of Artificial Sequence: Synthetic oligonucleotide
  Target: SCN10A; (+) strand; PAM type: YTN; PAM sequence: TTT
cctcaattattccctcaaat

SEQ ID NO: 70498 - DNA, 20 bp, Artificial Sequence
  Description of Artificial Sequence: Synthetic oligonucleotide
  Target: SCN10A; (+) strand; PAM type: YTN; PAM sequence: TTC
ctcaattattccctcaaata

SEQ ID NO: 70499 - DNA, 20 bp, Artificial Sequence
  Description of Artificial Sequence: Synthetic oligonucleotide
  Target: SCN10A; (+) strand; PAM type: YTN; PAM sequence: CTC
aattattccctcaaataagt

SEQ ID NO: 70500 - DNA, 20 bp, Artificial Sequence
  Description of Artificial Sequence: Synthetic oligonucleotide
  Target: SCN10A; (+) strand; PAM type: YTN; PAM sequence: TTA
ttccctcaaataagttttcc

SEQ ID NO: 70501 - DNA, 20 bp, Artificial Sequence
  Description of Artificial Sequence: Synthetic oligonucleotide
  Target: SCN10A; (+) strand; PAM type: YTN; PAM sequence: TTC
cctcaaataagttttccaaa

SEQ ID NO: 70502 - DNA, 20 bp, Artificial Sequence
  Description of Artificial Sequence: Synthetic oligonucleotide
  Target: SCN10A; (+) strand; PAM type: YTN; PAM sequence: CTC
aaataagttttccaaacttt

SEQ ID NO: 70503 - DNA, 20 bp, Artificial Sequence
  Description of Artificial Sequence: Synthetic oligonucleotide
  Target: SCN10A; (+) strand; PAM type: YTN; PAM sequence: TTT
tccaaacttttagatttcta

SEQ ID NO: 70504 - DNA, 20 bp, Artificial Sequence
  Description of Artificial Sequence: Synthetic oligonucleotide
  Target: SCN10A; (+) strand; PAM type: YTN; PAM sequence: TTT
ccaaacttttagatttctat

SEQ ID NO: 70505 - DNA, 20 bp, Artificial Sequence
  Description of Artificial Sequence: Synthetic oligonucleotide
  Target: SCN10A; (+) strand; PAM type: YTN; PAM sequence: TTC
caaacttttagatttctatt

SEQ ID NO: 70506 - DNA, 20 bp, Artificial Sequence
  Description of Artificial Sequence: Synthetic oligonucleotide
  Target: SCN10A; (+) strand; PAM type: YTN; PAM sequence: CTT
ttagatttctattcttcctt

SEQ ID NO: 70507 - DNA, 20 bp, Artificial Sequence
  Description of Artificial Sequence: Synthetic oligonucleotide
  Target: SCN10A; (+) strand; PAM type: YTN; PAM sequence: TTT
tagatttctattcttccttg

SEQ ID NO: 70508 - DNA, 20 bp, Artificial Sequence
  Description of Artificial Sequence: Synthetic oligonucleotide
  Target: SCN10A; (+) strand; PAM type: YTN; PAM sequence: TTT
agatttctattcttccttgg

SEQ ID NO: 70509 - DNA, 20 bp, Artificial Sequence
  Description of Artificial Sequence: Synthetic oligonucleotide
  Target: SCN10A; (+) strand; PAM type: YTN; PAM sequence: TTA
gatttctattcttccttggg

SEQ ID NO: 70510 - DNA, 20 bp, Artificial Sequence
  Description of Artificial Sequence: Synthetic oligonucleotide
  Target: SCN10A; (+) strand; PAM type: YTN; PAM sequence: TTT
ctattcttccttgggaacac

SEQ ID NO: 70511 - DNA, 20 bp, Artificial Sequence
  Description of Artificial Sequence: Synthetic oligonucleotide
  Target: SCN10A; (+) strand; PAM type: YTN; PAM sequence: TTC
tattcttccttgggaacacc

SEQ ID NO: 70512 - DNA, 20 bp, Artificial Sequence
  Description of Artificial Sequence: Synthetic oligonucleotide
  Target: SCN10A; (+) strand; PAM type: YTN; PAM sequence: CTA
ttcttccttgggaacaccca

SEQ ID NO: 70513 - DNA, 20 bp, Artificial Sequence
  Description of Artificial Sequence: Synthetic oligonucleotide
  Target: SCN10A; (+) strand; PAM type: YTN; PAM sequence: TTC
ttccttgggaacacccatta

SEQ ID NO: 70514 - DNA, 20 bp, Artificial Sequence
  Description of Artificial Sequence: Synthetic oligonucleotide
  Target: SCN10A; (+) strand; PAM type: YTN; PAM sequence: CTT
ccttgggaacacccattatt

SEQ ID NO: 70515 - DNA, 20 bp, Artificial Sequence
  Description of Artificial Sequence: Synthetic oligonucleotide
  Target: SCN10A; (+) strand; PAM type: YTN; PAM sequence: TTC
cttgggaacacccattattc

SEQ ID NO: 70516 - DNA, 20 bp, Artificial Sequence
  Description of Artificial Sequence: Synthetic oligonucleotide
  Target: SCN10A; (+) strand; PAM type: YTN; PAM sequence: CTT
gggaacacccattattctta

SEQ ID NO: 70517 - DNA, 20 bp, Artificial Sequence
  Description of Artificial Sequence: Synthetic oligonucleotide
  Target: SCN10A; (+) strand; PAM type: YTN; PAM sequence: TTG
ggaacacccattattcttag

SEQ ID NO: 70518 - DNA, 20 bp, Artificial Sequence
  Description of Artificial Sequence: Synthetic oligonucleotide
  Target: SCN10A; (+) strand; PAM type: YTN; PAM sequence: TTA
ttcttaggtttggttgtttc

SEQ ID NO: 70519 - DNA, 20 bp, Artificial Sequence
  Description of Artificial Sequence: Synthetic oligonucleotide
  Target: SCN10A; (+) strand; PAM type: YTN; PAM sequence: TTC
ttaggtttggttgtttcaca

SEQ ID NO: 70520 - DNA, 20 bp, Artificial Sequence
  Description of Artificial Sequence: Synthetic oligonucleotide
  Target: SCN10A; (+) strand; PAM type: YTN; PAM sequence: CTT
aggtttggttgtttcacatg

SEQ ID NO: 70521 - DNA, 20 bp, Artificial Sequence
  Description of Artificial Sequence: Synthetic oligonucleotide
  Target: SCN10A; (+) strand; PAM type: YTN; PAM sequence: TTA
ggtttggttgtttcacatga

SEQ ID NO: 70522 - DNA, 20 bp, Artificial Sequence
  Description of Artificial Sequence: Synthetic oligonucleotide
  Target: SCN10A; (+) strand; PAM type: YTN; PAM sequence: TTT
ggttgtttcacatgattcca

SEQ ID NO: 70523 - DNA, 20 bp, Artificial Sequence
  Description of Artificial Sequence: Synthetic oligonucleotide
  Target: SCN10A; (+) strand; PAM type: YTN; PAM sequence: TTG
gttgtttcacatgattccaa

SEQ ID NO: 70524 - DNA, 20 bp, Artificial Sequence
  Description of Artificial Sequence: Synthetic oligonucleotide
  Target: SCN10A; (+) strand; PAM type: YTN; PAM sequence: TTG
tttcacatgattccaaattt

SEQ ID NO: 70525 - DNA, 20 bp, Artificial Sequence
  Description of Artificial Sequence: Synthetic oligonucleotide
  Target: SCN10A; (+) strand; PAM type: YTN; PAM sequence: TTT
cacatgattccaaatttatt

SEQ ID NO: 70526 - DNA, 20 bp, Artificial Sequence
  Description of Artificial Sequence: Synthetic oligonucleotide
  Target: SCN10A; (+) strand; PAM type: YTN; PAM sequence: TTC
acatgattccaaatttattg

SEQ ID NO: 70527 - DNA, 20 bp, Artificial Sequence
  Description of Artificial Sequence: Synthetic oligonucleotide
  Target: SCN10A; (+) strand; PAM type: YTN; PAM sequence: TTC
caaatttattggccgatttg

SEQ ID NO: 70528 - DNA, 20 bp, Artificial Sequence
  Description of Artificial Sequence: Synthetic oligonucleotide
  Target: SCN10A; (+) strand; PAM type: YTN; PAM sequence: TTT
attggccgatttgtcatttt

SEQ ID NO: 70529 - DNA, 20 bp, Artificial Sequence
  Description of Artificial Sequence: Synthetic oligonucleotide
  Target: SCN10A; (+) strand; PAM type: YTN; PAM sequence: TTA
ttggccgatttgtcattttt

SEQ ID NO: 70530 - DNA, 20 bp, Artificial Sequence
  Description of Artificial Sequence: Synthetic oligonucleotide
  Target: SCN10A; (+) strand; PAM type: YTN; PAM sequence: TTG
gccgatttgtcattttttta

SEQ ID NO: 70531 - DNA, 20 bp, Artificial Sequence
  Description of Artificial Sequence: Synthetic oligonucleotide
  Target: SCN10A; (+) strand; PAM type: YTN; PAM sequence: TTT
gtcatttttttaaaaattct

SEQ ID NO: 70532 - DNA, 20 bp, Artificial Sequence
  Description of Artificial Sequence: Synthetic oligonucleotide
  Target: SCN10A; (+) strand; PAM type: YTN; PAM sequence: TTG
tcatttttttaaaaattctt

SEQ ID NO: 70533 - DNA, 20 bp, Artificial Sequence
  Description of Artificial Sequence: Synthetic oligonucleotide
  Target: SCN10A; (+) strand; PAM type: YTN; PAM sequence: TTT
ttttaaaaattctttctttt

SEQ ID NO: 70534 - DNA, 20 bp, Artificial Sequence
  Description of Artificial Sequence: Synthetic oligonucleotide
  Target: SCN10A; (+) strand; PAM type: YTN; PAM sequence: TTT
tttaaaaattctttcttttt

SEQ ID NO: 70535 - DNA, 20 bp, Artificial Sequence
  Description of Artificial Sequence: Synthetic oligonucleotide
  Target: SCN10A; (+) strand; PAM type: YTN; PAM sequence: TTT
ttaaaaattctttctttttg

SEQ ID NO: 70536 - DNA, 20 bp, Artificial Sequence
  Description of Artificial Sequence: Synthetic oligonucleotide
  Target: SCN10A; (+) strand; PAM type: YTN; PAM sequence: TTT
taaaaattctttctttttgt

SEQ ID NO: 70537 - DNA, 20 bp, Artificial Sequence
  Description of Artificial Sequence: Synthetic oligonucleotide
  Target: SCN10A; (+) strand; PAM type: YTN; PAM sequence: TTT
aaaaattctttctttttgtg

SEQ ID NO: 70538 - DNA, 20 bp, Artificial Sequence
  Description of Artificial Sequence: Synthetic oligonucleotide
  Target: SCN10A; (+) strand; PAM type: YTN; PAM sequence: TTA
aaaattctttctttttgtgt

SEQ ID NO: 70539 - DNA, 20 bp, Artificial Sequence
  Description of Artificial Sequence: Synthetic oligonucleotide
  Target: SCN10A; (+) strand; PAM type: YTN; PAM sequence: TTC
tttctttttgtgtgtcttag

SEQ ID NO: 70540 - DNA, 20 bp, Artificial Sequence
  Description of Artificial Sequence: Synthetic oligonucleotide
  Target: SCN10A; (+) strand; PAM type: YTN; PAM sequence: CTT
tctttttgtgtgtcttagtt

SEQ ID NO: 70541 - DNA, 20 bp, Artificial Sequence
  Description of Artificial Sequence: Synthetic oligonucleotide
  Target: SCN10A; (+) strand; PAM type: YTN; PAM sequence: TTT
ctttttgtgtgtcttagttt

SEQ ID NO: 70542 - DNA, 20 bp, Artificial Sequence
  Description of Artificial Sequence: Synthetic oligonucleotide
  Target: SCN10A; (+) strand; PAM type: YTN; PAM sequence: TTC
tttttgtgtgtcttagtttg

SEQ ID NO: 70543 - DNA, 20 bp, Artificial Sequence
  Description of Artificial Sequence: Synthetic oligonucleotide
  Target: SCN10A; (+) strand; PAM type: YTN; PAM sequence: CTT
tttgtgtgtcttagtttggg

SEQ ID NO: 70544 - DNA, 20 bp, Artificial Sequence
  Description of Artificial Sequence: Synthetic oligonucleotide
  Target: SCN10A; (+) strand; PAM type: YTN; PAM sequence: TTT
ttgtgtgtcttagtttgggt

SEQ ID NO: 70545 - DNA, 20 bp, Artificial Sequence
  Description of Artificial Sequence: Synthetic oligonucleotide
  Target: SCN10A; (+) strand; PAM type: YTN; PAM sequence: TTT
tgtgtgtcttagtttgggtc

SEQ ID NO: 70546 - DNA, 20 bp, Artificial Sequence
  Description of Artificial Sequence: Synthetic oligonucleotide
  Target: SCN10A; (+) strand; PAM type: YTN; PAM sequence: TTT
gtgtgtcttagtttgggtct

SEQ ID NO: 70547 - DNA, 20 bp, Artificial Sequence
  Description of Artificial Sequence: Synthetic oligonucleotide
  Target: SCN10A; (+) strand; PAM type: YTN; PAM sequence: TTG
tgtgtcttagtttgggtcta

SEQ ID NO: 70548 - DNA, 20 bp, Artificial Sequence
  Description of Artificial Sequence: Synthetic oligonucleotide
  Target: SCN10A; (+) strand; PAM type: YTN; PAM sequence: CTT
agtttgggtctattaaaagc

SEQ ID NO: 70549 - DNA, 20 bp, Artificial Sequence
  Description of Artificial Sequence: Synthetic oligonucleotide
  Target: SCN10A; (+) strand; PAM type: YTN; PAM sequence: TTA
gtttgggtctattaaaagct

SEQ ID NO: 70550 - DNA, 20 bp, Artificial Sequence
  Description of Artificial Sequence: Synthetic oligonucleotide
  Target: SCN10A; (+) strand; PAM type: YTN; PAM sequence: TTT
gggtctattaaaagctttgt

SEQ ID NO: 70551 - DNA, 20 bp, Artificial Sequence
  Description of Artificial Sequence: Synthetic oligonucleotide
  Target: SCN10A; (+) strand; PAM type: YTN; PAM sequence: TTG
ggtctattaaaagctttgtc

SEQ ID NO: 70552 - DNA, 20 bp, Artificial Sequence
  Description of Artificial Sequence: Synthetic oligonucleotide
  Target: SCN10A; (+) strand; PAM type: YTN; PAM sequence: CTA
ttaaaagctttgtcttcgag

SEQ ID NO: 70553 - DNA, 20 bp, Artificial Sequence
  Description of Artificial Sequence: Synthetic oligonucleotide
  Target: SCN10A; (+) strand; PAM type: YTN; PAM sequence: TTA
aaagctttgtcttcgagctc

SEQ ID NO: 70554 - DNA, 20 bp, Artificial Sequence
  Description of Artificial Sequence: Synthetic oligonucleotide
  Target: SCN10A; (+) strand; PAM type: YTN; PAM sequence: CTT
tgtcttcgagctctgaagtt

SEQ ID NO: 70555 - DNA, 20 bp, Artificial Sequence
  Description of Artificial Sequence: Synthetic oligonucleotide
  Target: SCN10A; (+) strand; PAM type: YTN; PAM sequence: TTT
gtcttcgagctctgaagttc

SEQ ID NO: 70556 - DNA, 20 bp, Artificial Sequence
  Description of Artificial Sequence: Synthetic oligonucleotide
  Target: SCN10A; (+) strand; PAM type: YTN; PAM sequence: TTG
tcttcgagctctgaagttct

SEQ ID NO: 70557 - DNA, 20 bp, Artificial Sequence
  Description of Artificial Sequence: Synthetic oligonucleotide
  Target: SCN10A; (+) strand; PAM type: YTN; PAM sequence: CTT
cgagctctgaagttctttct

SEQ ID NO: 70558 - DNA, 20 bp, Artificial Sequence
  Description of Artificial Sequence: Synthetic oligonucleotide
  Target: SCN10A; (+) strand; PAM type: YTN; PAM sequence: TTC
gagctctgaagttctttctt

SEQ ID NO: 70559 - DNA, 20 bp, Artificial Sequence
  Description of Artificial Sequence: Synthetic oligonucleotide
  Target: SCN10A; (+) strand; PAM type: YTN; PAM sequence: CTC
tgaagttctttcttctactt

SEQ ID NO: 70560 - DNA, 20 bp, Artificial Sequence
  Description of Artificial Sequence: Synthetic oligonucleotide
  Target: SCN10A; (+) strand; PAM type: YTN; PAM sequence: CTG
aagttctttcttctacttgt

SEQ ID NO: 70561 - DNA, 20 bp, Artificial Sequence
  Description of Artificial Sequence: Synthetic oligonucleotide
  Target: SCN10A; (+) strand; PAM type: YTN; PAM sequence: TTC
tttcttctacttgttctagt

SEQ ID NO: 70562 - DNA, 20 bp, Artificial Sequence
  Description of Artificial Sequence: Synthetic oligonucleotide
  Target: SCN10A; (+) strand; PAM type: YTN; PAM sequence: CTT
tcttctacttgttctagtct

SEQ ID NO: 70563 - DNA, 20 bp, Artificial Sequence
  Description of Artificial Sequence: Synthetic oligonucleotide
  Target: SCN10A; (+) strand; PAM type: YTN; PAM sequence: TTT
cttctacttgttctagtcta

SEQ ID NO: 70564 - DNA, 20 bp, Artificial Sequence
  Description of Artificial Sequence: Synthetic oligonucleotide
  Target: SCN10A; (+) strand; PAM type: YTN; PAM sequence: TTC
ttctacttgttctagtctat

SEQ ID NO: 70565 - DNA, 20 bp, Artificial Sequence
  Description of Artificial Sequence: Synthetic oligonucleotide
  Target: SCN10A; (+) strand; PAM type: YTN; PAM sequence: CTT
ctacttgttctagtctattg

SEQ ID NO: 70566 - DNA, 20 bp, Artificial Sequence
  Description of Artificial Sequence: Synthetic oligonucleotide
  Target: SCN10A; (+) strand; PAM type: YTN; PAM sequence: TTC
tacttgttctagtctattgt

SEQ ID NO: 70567 - DNA, 20 bp, Artificial Sequence
  Description of Artificial Sequence: Synthetic oligonucleotide
  Target: SCN10A; (+) strand; PAM type: YTN; PAM sequence: CTA
cttgttctagtctattgttg

SEQ ID NO: 70568 - DNA, 20 bp, Artificial Sequence
  Description of Artificial Sequence: Synthetic oligonucleotide
  Target: SCN10A; (+) strand; PAM type: YTN; PAM sequence: CTT
gttctagtctattgttgaaa

SEQ ID NO: 70569 - DNA, 20 bp, Artificial Sequence
  Description of Artificial Sequence: Synthetic oligonucleotide
  Target: SCN10A; (+) strand; PAM type: YTN; PAM sequence: TTG
ttctagtctattgttgaaac

SEQ ID NO: 70570 - DNA, 20 bp, Artificial Sequence
  Description of Artificial Sequence: Synthetic oligonucleotide
  Target: SCN10A; (+) strand; PAM type: YTN; PAM sequence: TTC
tagtctattgttgaaacttt

SEQ ID NO: 70571 - DNA, 20 bp, Artificial Sequence
  Description of Artificial Sequence: Synthetic oligonucleotide
  Target: SCN10A; (+) strand; PAM type: YTN; PAM sequence: CTA
gtctattgttgaaactttcc

SEQ ID NO: 70572 - DNA, 20 bp, Artificial Sequence
  Description of Artificial Sequence: Synthetic oligonucleotide
  Target: SCN10A; (+) strand; PAM type: YTN; PAM sequence: CTA
ttgttgaaactttccactgc

SEQ ID NO: 70573 - DNA, 20 bp, Artificial Sequence
  Description of Artificial Sequence: Synthetic oligonucleotide
  Target: SCN10A; (+) strand; PAM type: YTN; PAM sequence: TTG
ttgaaactttccactgcatt

SEQ ID NO: 70574 - DNA, 20 bp, Artificial Sequence
  Description of Artificial Sequence: Synthetic oligonucleotide
  Target: SCN10A; (+) strand; PAM type: YTN; PAM sequence: TTG
aaactttccactgcattttg

SEQ ID NO: 70575 - DNA, 20 bp, Artificial Sequence
  Description of Artificial Sequence: Synthetic oligonucleotide
  Target: SCN10A; (+) strand; PAM type: YTN; PAM sequence: CTT
tccactgcattttgtatttc

SEQ ID NO: 70576 - DNA, 20 bp, Artificial Sequence
  Description of Artificial Sequence: Synthetic oligonucleotide
  Target: SCN10A; (+) strand; PAM type: YTN; PAM sequence: TTT
ccactgcattttgtatttct

SEQ ID NO: 70577 - DNA, 20 bp, Artificial Sequence
  Description of Artificial Sequence: Synthetic oligonucleotide
  Target: SCN10A; (+) strand; PAM type: YTN; PAM sequence: TTC
cactgcattttgtatttctc

SEQ ID NO: 70578 - DNA, 20 bp, Artificial Sequence
  Description of Artificial Sequence: Synthetic oligonucleotide
  Target: SCN10A; (+) strand; PAM type: YTN; PAM sequence: CTG
cattttgtatttctctaagt

SEQ ID NO: 70579 - DNA, 20 bp, Artificial Sequence
  Description of Artificial Sequence: Synthetic oligonucleotide
  Target: SCN10A; (+) strand; PAM type: YTN; PAM sequence: TTT
tgtatttctctaagtgagtc

SEQ ID NO: 70580 - DNA, 20 bp, Artificial Sequence
  Description of Artificial Sequence: Synthetic oligonucleotide
  Target: SCN10A; (+) strand; PAM type: YTN; PAM sequence: TTT
gtatttctctaagtgagtct

SEQ ID NO: 70581 - DNA, 20 bp, Artificial Sequence
  Description of Artificial Sequence: Synthetic oligonucleotide
  Target: SCN10A; (+) strand; PAM type: YTN; PAM sequence: TTG
tatttctctaagtgagtctt

SEQ ID NO: 70582 - DNA, 20 bp, Artificial Sequence
  Description of Artificial Sequence: Synthetic oligonucleotide
  Target: SCN10A; (+) strand; PAM type: YTN; PAM sequence: TTT
ctctaagtgagtcttccatt

SEQ ID NO: 70583 - DNA, 20 bp, Artificial Sequence
  Description of Artificial Sequence: Synthetic oligonucleotide
  Target: SCN10A; (+) strand; PAM type: YTN; PAM sequence: TTC
tctaagtgagtcttccattt

SEQ ID NO: 70584 - DNA, 20 bp, Artificial Sequence
  Description of Artificial Sequence: Synthetic oligonucleotide
  Target: SCN10A; (+) strand; PAM type: YTN; PAM sequence: CTC
taagtgagtcttccatttcc

SEQ ID NO: 70585 - DNA, 20 bp, Artificial Sequence
  Description of Artificial Sequence: Synthetic oligonucleotide
  Target: SCN10A; (+) strand; PAM type: YTN; PAM sequence: CTA
agtgagtcttccatttccag

SEQ ID NO: 70586 - DNA, 20 bp, Artificial Sequence
  Description of Artificial Sequence: Synthetic oligonucleotide
  Target: SCN10A; (+) strand; PAM type: YTN; PAM sequence: CTT
ccatttccagaagttgtgat

SEQ ID NO: 70587 - DNA, 20 bp, Artificial Sequence
  Description of Artificial Sequence: Synthetic oligonucleotide
  Target: SCN10A; (+) strand; PAM type: YTN; PAM sequence: TTC
catttccagaagttgtgatt

SEQ ID NO: 70588 - DNA, 20 bp, Artificial Sequence
  Description of Artificial Sequence: Synthetic oligonucleotide
  Target: SCN10A; (+) strand; PAM type: YTN; PAM sequence: TTT
ccagaagttgtgattgtttt

SEQ ID NO: 70589 - DNA, 20 bp, Artificial Sequence
  Description of Artificial Sequence: Synthetic oligonucleotide
  Target: SCN10A; (+) strand; PAM type: YTN; PAM sequence: TTC
cagaagttgtgattgttttt

SEQ ID NO: 70590 - DNA, 20 bp, Artificial Sequence
  Description of Artificial Sequence: Synthetic oligonucleotide
  Target: SCN10A; (+) strand; PAM type: YTN; PAM sequence: TTG
tgattgttttttctttatat

SEQ ID NO: 70591 - DNA, 20 bp, Artificial Sequence
  Description of Artificial Sequence: Synthetic oligonucleotide
  Target: SCN10A; (+) strand; PAM type: YTN; PAM sequence: TTG
ttttttctttatatctattt

SEQ ID NO: 70592 - DNA, 20 bp, Artificial Sequence
  Description of Artificial Sequence: Synthetic oligonucleotide
  Target: SCN10A; (+) strand; PAM type: YTN; PAM sequence: TTT
tttctttatatctatttctc

SEQ ID NO: 70593 - DNA, 20 bp, Artificial Sequence
  Description of Artificial Sequence: Synthetic oligonucleotide
  Target: SCN10A; (+) strand; PAM type: YTN; PAM sequence: TTT
ttctttatatctatttctct

SEQ ID NO: 70594 - DNA, 20 bp, Artificial Sequence
  Description of Artificial Sequence: Synthetic oligonucleotide
  Target: SCN10A; (+) strand; PAM type: YTN; PAM sequence: TTT
tctttatatctatttctctg

SEQ ID NO: 70595 - DNA, 20 bp, Artificial Sequence
  Description of Artificial Sequence: Synthetic oligonucleotide
  Target: SCN10A; (+) strand; PAM type: YTN; PAM sequence: TTT
ctttatatctatttctctgg

SEQ ID NO: 70596 - DNA, 20 bp, Artificial Sequence
  Description of Artificial Sequence: Synthetic oligonucleotide
  Target: SCN10A; (+) strand; PAM type: YTN; PAM sequence: TTC
tttatatctatttctctgga

SEQ ID NO: 70597 - DNA, 20 bp, Artificial Sequence
  Description of Artificial Sequence: Synthetic oligonucleotide
  Target: SCN10A; (+) strand; PAM type: YTN; PAM sequence: CTT
tatatctatttctctggaga

SEQ ID NO: 70598 - DNA, 20 bp, Artificial Sequence
  Description of Artificial Sequence: Synthetic oligonucleotide
  Target: SCN10A; (+) strand; PAM type: YTN; PAM sequence: TTT
atatctatttctctggagaa

SEQ ID NO: 70599 - DNA, 20 bp, Artificial Sequence
  Description of Artificial Sequence: Synthetic oligonucleotide
  Target: SCN10A; (+) strand; PAM type: YTN; PAM sequence: TTA
tatctatttctctggagaat

SEQ ID NO: 70600 - DNA, 20 bp, Artificial Sequence
  Description of Artificial Sequence: Synthetic oligonucleotide
  Target: SCN10A; (+) strand; PAM type: YTN; PAM sequence: CTA
tttctctggagaattttcca

SEQ ID NO: 70601 - DNA, 20 bp, Artificial Sequence
  Description of Artificial Sequence: Synthetic oligonucleotide
  Target: SCN10A; (+) strand; PAM type: YTN; PAM sequence: TTT
ctctggagaattttccatcc

SEQ ID NO: 70602 - DNA, 20 bp, Artificial Sequence
  Description of Artificial Sequence: Synthetic oligonucleotide
  Target: SCN10A; (+) strand; PAM type: YTN; PAM sequence: TTC
tctggagaattttccatcca

SEQ ID NO: 70603 - DNA, 20 bp, Artificial Sequence
  Description of Artificial Sequence: Synthetic oligonucleotide
  Target: SCN10A; (+) strand; PAM type: YTN; PAM sequence: CTC
tggagaattttccatccata

SEQ ID NO: 70604 - DNA, 20 bp, Artificial Sequence
  Description of Artificial Sequence: Synthetic oligonucleotide
  Target: SCN10A; (+) strand; PAM type: YTN; PAM sequence: CTG
gagaattttccatccatatc

SEQ ID NO: 70605 - DNA, 20 bp, Artificial Sequence
  Description of Artificial Sequence: Synthetic oligonucleotide
  Target: SCN10A; (+) strand; PAM type: YTN; PAM sequence: TTT
tccatccatatcttgttgtt

SEQ ID NO: 70606 - DNA, 20 bp, Artificial Sequence
  Description of Artificial Sequence: Synthetic oligonucleotide
  Target: SCN10A; (+) strand; PAM type: YTN; PAM sequence: TTT
ccatccatatcttgttgttt

SEQ ID NO: 70607 - DNA, 20 bp, Artificial Sequence
  Description of Artificial Sequence: Synthetic oligonucleotide
  Target: SCN10A; (+) strand; PAM type: YTN; PAM sequence: TTC
catccatatcttgttgtttt

SEQ ID NO: 70608 - DNA, 20 bp, Artificial Sequence
  Description of Artificial Sequence: Synthetic oligonucleotide
  Target: SCN10A; (+) strand; PAM type: YTN; PAM sequence: CTT
gttgttttaaaaatttcttt

SEQ ID NO: 70609 - DNA, 20 bp, Artificial Sequence
  Description of Artificial Sequence: Synthetic oligonucleotide
  Target: SCN10A; (+) strand; PAM type: YTN; PAM sequence: TTG
ttgttttaaaaatttcttta

SEQ ID NO: 70610 - DNA, 20 bp, Artificial Sequence
  Description of Artificial Sequence: Synthetic oligonucleotide
  Target: SCN10A; (+) strand; PAM type: YTN; PAM sequence: TTG
ttttaaaaatttctttaagt

SEQ ID NO: 70611 - DNA, 20 bp, Artificial Sequence
  Description of Artificial Sequence: Synthetic oligonucleotide
  Target: SCN10A; (+) strand; PAM type: YTN; PAM sequence: TTT
taaaaatttctttaagttgg

SEQ ID NO: 70612 - DNA, 20 bp, Artificial Sequence
  Description of Artificial Sequence: Synthetic oligonucleotide
  Target: SCN10A; (+) strand; PAM type: YTN; PAM sequence: TTT
aaaaatttctttaagttggt

SEQ ID NO: 70613 - DNA, 20 bp, Artificial Sequence
  Description of Artificial Sequence: Synthetic oligonucleotide
  Target: SCN10A; (+) strand; PAM type: YTN; PAM sequence: TTA
aaaatttctttaagttggtt

SEQ ID NO: 70614 - DNA, 20 bp, Artificial Sequence
  Description of Artificial Sequence: Synthetic oligonucleotide
  Target: SCN10A; (+) strand; PAM type: YTN; PAM sequence: TTT
ctttaagttggtttttatct

SEQ ID NO: 70615 - DNA, 20 bp, Artificial Sequence
  Description of Artificial Sequence: Synthetic oligonucleotide
  Target: SCN10A; (+) strand; PAM type: YTN; PAM sequence: TTC
tttaagttggtttttatctt

SEQ ID NO: 70616 - DNA, 20 bp, Artificial Sequence
  Description of Artificial Sequence: Synthetic oligonucleotide
  Target: SCN10A; (+) strand; PAM type: YTN; PAM sequence: CTT
taagttggtttttatctttc

SEQ ID NO: 70617 - DNA, 20 bp, Artificial Sequence
  Description of Artificial Sequence: Synthetic oligonucleotide
  Target: SCN10A; (+) strand; PAM type: YTN; PAM sequence: TTT
aagttggtttttatctttct

SEQ ID NO: 70618 - DNA, 20 bp, Artificial Sequence
  Description of Artificial Sequence: Synthetic oligonucleotide
  Target: SCN10A; (+) strand; PAM type: YTN; PAM sequence: TTA
agttggtttttatctttctc

SEQ ID NO: 70619 - DNA, 20 bp, Artificial Sequence
  Description of Artificial Sequence: Synthetic oligonucleotide
  Target: SCN10A; (+) strand; PAM type: YTN; PAM sequence: TTG
gtttttatctttctctggtg

SEQ ID NO: 70620 - DNA, 20 bp, Artificial Sequence
  Description of Artificial Sequence: Synthetic oligonucleotide
  Target: SCN10A; (+) strand; PAM type: YTN; PAM sequence: TTT
ttatctttctctggtgtctc

SEQ ID NO: 70621 - DNA, 20 bp, Artificial Sequence
  Description of Artificial Sequence: Synthetic oligonucleotide
  Target: SCN10A; (+) strand; PAM type: YTN; PAM sequence: TTT
tatctttctctggtgtctcc

SEQ ID NO: 70622 - DNA, 20 bp, Artificial Sequence
  Description of Artificial Sequence: Synthetic oligonucleotide
  Target: SCN10A; (+) strand; PAM type: YTN; PAM sequence: TTT
atctttctctggtgtctcct

SEQ ID NO: 70623 - DNA, 20 bp, Artificial Sequence
  Description of Artificial Sequence: Synthetic oligonucleotide
  Target: SCN10A; (+) strand; PAM type: YTN; PAM sequence: TTA
tctttctctggtgtctcctt

SEQ ID NO: 70624 - DNA, 20 bp, Artificial Sequence
  Description of Artificial Sequence: Synthetic oligonucleotide
  Target: SCN10A; (+) strand; PAM type: YTN; PAM sequence: CTT
tctctggtgtctccttgaat

SEQ ID NO: 70625 - DNA, 20 bp, Artificial Sequence
  Description of Artificial Sequence: Synthetic oligonucleotide
  Target: SCN10A; (+) strand; PAM type: YTN; PAM sequence: TTT
ctctggtgtctccttgaatc

SEQ ID NO: 70626 - DNA, 20 bp, Artificial Sequence
  Description of Artificial Sequence: Synthetic oligonucleotide
  Target: SCN10A; (+) strand; PAM type: YTN; PAM sequence: TTC
tctggtgtctccttgaatca

SEQ ID NO: 70627 - DNA, 20 bp, Artificial Sequence
  Description of Artificial Sequence: Synthetic oligonucleotide
  Target: SCN10A; (+) strand; PAM type: YTN; PAM sequence: CTC
tggtgtctccttgaatcact

SEQ ID NO: 70628 - DNA, 20 bp, Artificial Sequence
  Description of Artificial Sequence: Synthetic oligonucleotide
  Target: SCN10A; (+) strand; PAM type: YTN; PAM sequence: CTG
gtgtctccttgaatcactta

SEQ ID NO: 70629 - DNA, 20 bp, Artificial Sequence
  Description of Artificial Sequence: Synthetic oligonucleotide
  Target: SCN10A; (+) strand; PAM type: YTN; PAM sequence: CTC
cttgaatcacttaataatca

SEQ ID NO: 70630 - DNA, 20 bp, Artificial Sequence
  Description of Artificial Sequence: Synthetic oligonucleotide
  Target: SCN10A; (+) strand; PAM type: YTN; PAM sequence: CTT
gaatcacttaataatcagcc

SEQ ID NO: 70631 - DNA, 20 bp, Artificial Sequence
  Description of Artificial Sequence: Synthetic oligonucleotide
  Target: SCN10A; (+) strand; PAM type: YTN; PAM sequence: TTG
aatcacttaataatcagcct

SEQ ID NO: 70632 - DNA, 20 bp, Artificial Sequence
  Description of Artificial Sequence: Synthetic oligonucleotide
  Target: SCN10A; (+) strand; PAM type: YTN; PAM sequence: CTT
aataatcagccttctgaatt

SEQ ID NO: 70633 - DNA, 20 bp, Artificial Sequence
  Description of Artificial Sequence: Synthetic oligonucleotide
  Target: SCN10A; (+) strand; PAM type: YTN; PAM sequence: TTA
ataatcagccttctgaattc

SEQ ID NO: 70634 - DNA, 20 bp, Artificial Sequence
  Description of Artificial Sequence: Synthetic oligonucleotide
  Target: SCN10A; (+) strand; PAM type: YTN; PAM sequence: CTT
ctgaattctttttttttttt

SEQ ID NO: 70635 - DNA, 20 bp, Artificial Sequence
  Description of Artificial Sequence: Synthetic oligonucleotide
  Target: SCN10A; (+) strand; PAM type: YTN; PAM sequence: TTC
tgaattcttttttttttttt

SEQ ID NO: 70636 - DNA, 20 bp, Artificial Sequence
  Description of Artificial Sequence: Synthetic oligonucleotide
  Target: SCN10A; (+) strand; PAM type: YTN; PAM sequence: CTG
aattcttttttttttttttt

SEQ ID NO: 70637 - DNA, 20 bp, Artificial Sequence
  Description of Artificial Sequence: Synthetic oligonucleotide
  Target: SCN10A; (+) strand; PAM type: YTN; PAM sequence: TTC
ttttttttttttttttgaga

SEQ ID NO: 70638 - DNA, 20 bp, Artificial Sequence
  Description of Artificial Sequence: Synthetic oligonucleotide
  Target: SCN10A; (+) strand; PAM type: YTN; PAM sequence: CTT
ttttttttttttttgagatg

SEQ ID NO: 70639 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttgagatgg

SEQ ID NO: 70640 - DNA, 20 bp, Artificial Sequence
  Description of Artificial Sequence: Synthetic oligonucleotide
  Target: SCN10A; (+) strand; PAM type: YTN; PAM sequence: TTT
ttttttttttttgagatgga

SEQ ID NO: 70641 - DNA, 20 bp, Artificial Sequence
  Description of Artificial Sequence: Synthetic oligonucleotide
  Target: SCN10A; (+) strand; PAM type: YTN; PAM sequence: TTT
tttttttttttgagatggat

SEQ ID NO: 70642 - DNA, 20 bp, Artificial Sequence
  Description of Artificial Sequence: Synthetic oligonucleotide
  Target: SCN10A; (+) strand; PAM type: YTN; PAM sequence: TTT
ttttttttttgagatggatt

SEQ ID NO: 70643 - DNA, 20 bp, Artificial Sequence
  Description of Artificial Sequence: Synthetic oligonucleotide
  Target: SCN10A; (+) strand; PAM type: YTN; PAM sequence: TTT
tttttttttgagatggattt

SEQ ID NO: 70644 - DNA, 20 bp, Artificial Sequence
  Description of Artificial Sequence: Synthetic oligonucleotide
  Target: SCN10A; (+) strand; PAM type: YTN; PAM sequence: TTT
ttttttttgagatggatttt

SEQ ID NO: 70645 - DNA, 20 bp, Artificial Sequence
  Description of Artificial Sequence: Synthetic oligonucleotide
  Target: SCN10A; (+) strand; PAM type: YTN; PAM sequence: TTT
tttttttgagatggattttc

SEQ ID NO: 70646 - DNA, 20 bp, Artificial Sequence
  Description of Artificial Sequence: Synthetic oligonucleotide
  Target: SCN10A; (+) strand; PAM type: YTN; PAM sequence: TTT
ttttttgagatggattttca

SEQ ID NO: 70647 - DNA, 20 bp, Artificial Sequence
  Description of Artificial Sequence: Synthetic oligonucleotide
  Target: SCN10A; (+) strand; PAM type: YTN; PAM sequence: TTT
tttttgagatggattttcac

SEQ ID NO: 70648 - DNA, 20 bp, Artificial Sequence
  Description of Artificial Sequence: Synthetic oligonucleotide
  Target: SCN10A; (+) strand; PAM type: YTN; PAM sequence: TTT
ttttgagatggattttcact

SEQ ID NO: 70649 - DNA, 20 bp, Artificial Sequence
  Description of Artificial Sequence: Synthetic oligonucleotide
  Target: SCN10A; (+) strand; PAM type: YTN; PAM sequence: TTT
tttgagatggattttcactc

SEQ ID NO: 70650 - DNA, 20 bp, Artificial Sequence
  Description of Artificial Sequence: Synthetic oligonucleotide
  Target: SCN10A; (+) strand; PAM type: YTN; PAM sequence: TTT
ttgagatggattttcactct

SEQ ID NO: 70651 - DNA, 20 bp, Artificial Sequence
  Description of Artificial Sequence: Synthetic oligonucleotide
  Target: SCN10A; (+) strand; PAM type: YTN; PAM sequence: TTT
tgagatggattttcactctt

SEQ ID NO: 70652 - DNA, 20 bp, Artificial Sequence
  Description of Artificial Sequence: Synthetic oligonucleotide
  Target: SCN10A; (+) strand; PAM type: YTN; PAM sequence: TTT
gagatggattttcactcttg

SEQ ID NO: 70653 - DNA, 20 bp, Artificial Sequence
  Description of Artificial Sequence: Synthetic oligonucleotide
  Target: SCN10A; (+) strand; PAM type: YTN; PAM sequence: TTG
agatggattttcactcttgt

SEQ ID NO: 70654 - DNA, 20 bp, Artificial Sequence
  Description of Artificial Sequence: Synthetic oligonucleotide
  Target: SCN10A; (+) strand; PAM type: YTN; PAM sequence: TTT
tcactcttgttgcccaggct

SEQ ID NO: 70655 - DNA, 20 bp, Artificial Sequence
  Description of Artificial Sequence: Synthetic oligonucleotide
  Target: SCN10A; (+) strand; PAM type: YTN; PAM sequence: TTT
cactcttgttgcccaggctg

SEQ ID NO: 70656 - DNA, 20 bp, Artificial Sequence
  Description of Artificial Sequence: Synthetic oligonucleotide
  Target: SCN10A; (+) strand; PAM type: YTN; PAM sequence: TTC
actcttgttgcccaggctgg

SEQ ID NO: 70657 - DNA, 20 bp, Artificial Sequence
  Description of Artificial Sequence: Synthetic oligonucleotide
  Target: SCN10A; (+) strand; PAM type: YTN; PAM sequence: CTC
ttgttgcccaggctggagtg

SEQ ID NO: 70658 - DNA, 20 bp, Artificial Sequence
  Description of Artificial Sequence: Synthetic oligonucleotide
  Target: SCN10A; (+) strand; PAM type: YTN; PAM sequence: CTT
gttgcccaggctggagtgca

SEQ ID NO: 70659 - DNA, 20 bp, Artificial Sequence
  Description of Artificial Sequence: Synthetic oligonucleotide
  Target: SCN10A; (+) strand; PAM type: YTN; PAM sequence: TTG
ttgcccaggctggagtgcaa

SEQ ID NO: 70660 - DNA, 20 bp, Artificial Sequence
  Description of Artificial Sequence: Synthetic oligonucleotide
  Target: SCN10A; (+) strand; PAM type: YTN; PAM sequence: TTG
cccaggctggagtgcaatgg

SEQ ID NO: 70661 - DNA, 20 bp, Artificial Sequence
  Description of Artificial Sequence: Synthetic oligonucleotide
  Target: SCN10A; (+) strand; PAM type: YTN; PAM sequence: CTG
gagtgcaatggcgcgatctc

SEQ ID NO: 70662 - DNA, 20 bp, Artificial Sequence
  Description of Artificial Sequence: Synthetic oligonucleotide
  Target: SCN10A; (+) strand; PAM type: YTN; PAM sequence: CTC
agctcaccgcaacctctgcc

SEQ ID NO: 70663 - DNA, 20 bp, Artificial Sequence
  Description of Artificial Sequence: Synthetic oligonucleotide
  Target: SCN10A; (+) strand; PAM type: YTN; PAM sequence: CTC
accgcaacctctgcctccca

SEQ ID NO: 70664 - DNA, 20 bp, Artificial Sequence
  Description of Artificial Sequence: Synthetic oligonucleotide
  Target: SCN10A; (+) strand; PAM type: YTN; PAM sequence: CTC
tgcctcccaggttcaagcaa

SEQ ID NO: 70665 - DNA, 20 bp, Artificial Sequence
  Description of Artificial Sequence: Synthetic oligonucleotide
  Target: SCN10A; (+) strand; PAM type: YTN; PAM sequence: CTG
cctcccaggttcaagcaatt

SEQ ID NO: 70666 - DNA, 20 bp, Artificial Sequence
  Description of Artificial Sequence: Synthetic oligonucleotide
  Target: SCN10A; (+) strand; PAM type: YTN; PAM sequence: CTC
ccaggttcaagcaattctcc

SEQ ID NO: 70667 - DNA, 20 bp, Artificial Sequence
  Description of Artificial Sequence: Synthetic oligonucleotide
  Target: SCN10A; (+) strand; PAM type: YTN; PAM sequence: TTC
aagcaattctcctgcctcag

SEQ ID NO: 70668 - DNA, 20 bp, Artificial Sequence
  Description of Artificial Sequence: Synthetic oligonucleotide
  Target: SCN10A; (+) strand; PAM type: YTN; PAM sequence: TTC
tcctgcctcagtctcctgag

SEQ ID NO: 70669 - DNA, 20 bp, Artificial Sequence
  Description of Artificial Sequence: Synthetic oligonucleotide
  Target: SCN10A; (+) strand; PAM type: YTN; PAM sequence: CTC
ctgcctcagtctcctgagta

SEQ ID NO: 70670 - DNA, 20 bp, Artificial Sequence
  Description of Artificial Sequence: Synthetic oligonucleotide
  Target: SCN10A; (+) strand; PAM type: YTN; PAM sequence: CTG
cctcagtctcctgagtagct

SEQ ID NO: 70671 - DNA, 20 bp, Artificial Sequence
  Description of Artificial Sequence: Synthetic oligonucleotide
  Target: SCN10A; (+) strand; PAM type: YTN; PAM sequence: CTC
agtctcctgagtagctggga

SEQ ID NO: 70672 - DNA, 20 bp, Artificial Sequence
  Description of Artificial Sequence: Synthetic oligonucleotide
  Target: SCN10A; (+) strand; PAM type: YTN; PAM sequence: CTC
ctgagtagctgggattacag

SEQ ID NO: 70673 - DNA, 20 bp, Artificial Sequence
  Description of Artificial Sequence: Synthetic oligonucleotide
  Target: SCN10A; (+) strand; PAM type: YTN; PAM sequence: CTG
agtagctgggattacaggca

SEQ ID NO: 70674 - DNA, 20 bp, Artificial Sequence
  Description of Artificial Sequence: Synthetic oligonucleotide
  Target: SCN10A; (+) strand; PAM type: YTN; PAM sequence: CTG
ggattacaggcatgcaccac

SEQ ID NO: 70675 - DNA, 20 bp, Artificial Sequence
  Description of Artificial Sequence: Synthetic oligonucleotide
  Target: SCN10A; (+) strand; PAM type: YTN; PAM sequence: TTA
caggcatgcaccaccacatc

SEQ ID NO: 70676 - DNA, 20 bp, Artificial Sequence
  Description of Artificial Sequence: Synthetic oligonucleotide
  Target: SCN10A; (+) strand; PAM type: YTN; PAM sequence: CTA
gctaattttgtattttttag

SEQ ID NO: 70677 - DNA, 20 bp, Artificial Sequence
  Description of Artificial Sequence: Synthetic oligonucleotide
  Target: SCN10A; (+) strand; PAM type: YTN; PAM sequence: CTA
attttgtattttttagtaga

SEQ ID NO: 70678 - DNA, 20 bp, Artificial Sequence
  Description of Artificial Sequence: Synthetic oligonucleotide
  Target: SCN10A; (+) strand; PAM type: YTN; PAM sequence: TTT
tgtattttttagtagagacg

SEQ ID NO: 70679 - DNA, 20 bp, Artificial Sequence
  Description of Artificial Sequence: Synthetic oligonucleotide
  Target: SCN10A; (+) strand; PAM type: YTN; PAM sequence: TTT
gtattttttagtagagacgg

SEQ ID NO: 70680 - DNA, 20 bp, Artificial Sequence
  Description of Artificial Sequence: Synthetic oligonucleotide
  Target: SCN10A; (+) strand; PAM type: YTN; PAM sequence: TTG
tattttttagtagagacggg

SEQ ID NO: 70681 - DNA, 20 bp, Artificial Sequence
  Description of Artificial Sequence: Synthetic oligonucleotide
  Target: SCN10A; (+) strand; PAM type: YTN; PAM sequence: TTT
tttagtagagacggggtttc

SEQ ID NO: 70682 - DNA, 20 bp, Artificial Sequence
  Description of Artificial Sequence: Synthetic oligonucleotide
  Target: SCN10A; (+) strand; PAM type: YTN; PAM sequence: TTT
ttagtagagacggggtttct

SEQ ID NO: 70683 - DNA, 20 bp, Artificial Sequence
  Description of Artificial Sequence: Synthetic oligonucleotide
  Target: SCN10A; (+) strand; PAM type: YTN; PAM sequence: TTT
tagtagagacggggtttctc

SEQ ID NO: 70684 - DNA, 20 bp, Artificial Sequence
  Description of Artificial Sequence: Synthetic oligonucleotide
  Target: SCN10A; (+) strand; PAM type: YTN; PAM sequence: TTT
agtagagacggggtttctcc

SEQ ID NO: 70685 - DNA, 20 bp, Artificial Sequence
  Description of Artificial Sequence: Synthetic oligonucleotide
  Target: SCN10A; (+) strand; PAM type: YTN; PAM sequence: TTA
gtagagacggggtttctcca

SEQ ID NO: 70686 - DNA, 20 bp, Artificial Sequence
  Description of Artificial Sequence: Synthetic oligonucleotide
  Target: SCN10A; (+) strand; PAM type: YTN; PAM sequence: TTT
ctccatgttggcttcaggct

SEQ ID NO: 70687 - DNA, 20 bp, Artificial Sequence
  Description of Artificial Sequence: Synthetic oligonucleotide
  Target: SCN10A; (+) strand; PAM type: YTN; PAM sequence: TTC
tccatgttggcttcaggctg

SEQ ID NO: 70688 - DNA, 20 bp, Artificial Sequence
  Description of Artificial Sequence: Synthetic oligonucleotide
  Target: SCN10A; (+) strand; PAM type: YTN; PAM sequence: CTC
catgttggcttcaggctggt

SEQ ID NO: 70689 - DNA, 20 bp, Artificial Sequence
  Description of Artificial Sequence: Synthetic oligonucleotide
  Target: SCN10A; (+) strand; PAM type: YTN; PAM sequence: TTG
gcttcaggctggtcttgaac

SEQ ID NO: 70690 - DNA, 20 bp, Artificial Sequence
  Description of Artificial Sequence: Synthetic oligonucleotide
  Target: SCN10A; (+) strand; PAM type: YTN; PAM sequence: CTT
caggctggtcttgaacttct

SEQ ID NO: 70691 - DNA, 20 bp, Artificial Sequence
  Description of Artificial Sequence: Synthetic oligonucleotide
  Target: SCN10A; (+) strand; PAM type: YTN; PAM sequence: TTC
aggctggtcttgaacttctg

SEQ ID NO: 70692 - DNA, 20 bp, Artificial Sequence
  Description of Artificial Sequence: Synthetic oligonucleotide
  Target: SCN10A; (+) strand; PAM type: YTN; PAM sequence: CTG
gtcttgaacttctgacctca

SEQ ID NO: 70693 - DNA, 20 bp, Artificial Sequence
  Description of Artificial Sequence: Synthetic oligonucleotide
  Target: SCN10A; (+) strand; PAM type: YTN; PAM sequence: CTT
gaacttctgacctcaggtga

SEQ ID NO: 70694 - DNA, 20 bp, Artificial Sequence
  Description of Artificial Sequence: Synthetic oligonucleotide
  Target: SCN10A; (+) strand; PAM type: YTN; PAM sequence: TTG
aacttctgacctcaggtgat

SEQ ID NO: 70695 - DNA, 20 bp, Artificial Sequence
  Description of Artificial Sequence: Synthetic oligonucleotide
  Target: SCN10A; (+) strand; PAM type: YTN; PAM sequence: CTT
ctgacctcaggtgatctgcc

SEQ ID NO: 70696 - DNA, 20 bp, Artificial Sequence
  Description of Artificial Sequence: Synthetic oligonucleotide
  Target: SCN10A; (+) strand; PAM type: YTN; PAM sequence: TTC
tgacctcaggtgatctgccc

SEQ ID NO: 70697 - DNA, 20 bp, Artificial Sequence
  Description of Artificial Sequence: Synthetic oligonucleotide
  Target: SCN10A; (+) strand; PAM type: YTN; PAM sequence: CTG
acctcaggtgatctgcccac

SEQ ID NO: 70698 - DNA, 20 bp, Artificial Sequence
  Description of Artificial Sequence: Synthetic oligonucleotide
  Target: SCN10A; (+) strand; PAM type: YTN; PAM sequence: CTC
aggtgatctgcccaccttgg

SEQ ID NO: 70699 - DNA, 20 bp, Artificial Sequence
  Description of Artificial Sequence: Synthetic oligonucleotide
  Target: SCN10A; (+) strand; PAM type: YTN; PAM sequence: CTG
cccaccttggcctcccaaag

SEQ ID NO: 70700 - DNA, 20 bp, Artificial Sequence
  Description of Artificial Sequence: Synthetic oligonucleotide
  Target: SCN10A; (+) strand; PAM type: YTN; PAM sequence: CTT
ggcctcccaaagtgctgaga

SEQ ID NO: 70701 - DNA, 20 bp, Artificial Sequence
  Description of Artificial Sequence: Synthetic oligonucleotide
  Target: SCN10A; (+) strand; PAM type: YTN; PAM sequence: TTG
gcctcccaaagtgctgagat

SEQ ID NO: 70702 - DNA, 20 bp, Artificial Sequence
  Description of Artificial Sequence: Synthetic oligonucleotide
  Target: SCN10A; (+) strand; PAM type: YTN; PAM sequence: CTC
ccaaagtgctgagattacag

SEQ ID NO: 70703 - DNA, 20 bp, Artificial Sequence
  Description of Artificial Sequence: Synthetic oligonucleotide
  Target: SCN10A; (+) strand; PAM type: YTN; PAM sequence: CTG
agattacaggcgtgagctac

SEQ ID NO: 70704 - DNA, 20 bp, Artificial Sequence
  Description of Artificial Sequence: Synthetic oligonucleotide
  Target: SCN10A; (+) strand; PAM type: YTN; PAM sequence: TTA
caggcgtgagctactgtgcc

SEQ ID NO: 70705 - DNA, 20 bp, Artificial Sequence
  Description of Artificial Sequence: Synthetic oligonucleotide
  Target: SCN10A; (+) strand; PAM type: YTN; PAM sequence: CTA
ctgtgcccagccctgaattc

SEQ ID NO: 70706 - DNA, 20 bp, Artificial Sequence
  Description of Artificial Sequence: Synthetic oligonucleotide
  Target: SCN10A; (+) strand; PAM type: YTN; PAM sequence: CTG
tgcccagccctgaattcttt

SEQ ID NO: 70707 - DNA, 20 bp, Artificial Sequence
  Description of Artificial Sequence: Synthetic oligonucleotide
  Target: SCN10A; (+) strand; PAM type: YTN; PAM sequence: CTG
aattctttatctggcaattc

SEQ ID NO: 70708 - DNA, 20 bp, Artificial Sequence
  Description of Artificial Sequence: Synthetic oligonucleotide
  Target: SCN10A; (+) strand; PAM type: YTN; PAM sequence: TTC
tttatctggcaattcagaga

SEQ ID NO: 70709 - DNA, 20 bp, Artificial Sequence
  Description of Artificial Sequence: Synthetic oligonucleotide
  Target: SCN10A; (+) strand; PAM type: YTN; PAM sequence: CTT
tatctggcaattcagagatt

SEQ ID NO: 70710 - DNA, 20 bp, Artificial Sequence
  Description of Artificial Sequence: Synthetic oligonucleotide
  Target: SCN10A; (+) strand; PAM type: YTN; PAM sequence: TTT
atctggcaattcagagattt

SEQ ID NO: 70711 - DNA, 20 bp, Artificial Sequence
  Description of Artificial Sequence: Synthetic oligonucleotide
  Target: SCN10A; (+) strand; PAM type: YTN; PAM sequence: TTA
tctggcaattcagagatttc

SEQ ID NO: 70712 - DNA, 20 bp, Artificial Sequence
  Description of Artificial Sequence: Synthetic oligonucleotide
  Target: SCN10A; (+) strand; PAM type: YTN; PAM sequence: CTG
gcaattcagagatttcttct

SEQ ID NO: 70713 - DNA, 20 bp, Artificial Sequence
  Description of Artificial Sequence: Synthetic oligonucleotide
  Target: SCN10A; (+) strand; PAM type: YTN; PAM sequence: TTC
agagatttcttcttagtttg

SEQ ID NO: 70714 - DNA, 20 bp, Artificial Sequence
  Description of Artificial Sequence: Synthetic oligonucleotide
  Target: SCN10A; (+) strand; PAM type: YTN; PAM sequence: TTT
cttcttagtttggatccatt

SEQ ID NO: 70715 - DNA, 20 bp, Artificial Sequence
  Description of Artificial Sequence: Synthetic oligonucleotide
  Target: SCN10A; (+) strand; PAM type: YTN; PAM sequence: TTC
ttcttagtttggatccattg

SEQ ID NO: 70716 - DNA, 20 bp, Artificial Sequence
  Description of Artificial Sequence: Synthetic oligonucleotide
  Target: SCN10A; (+) strand; PAM type: YTN; PAM sequence: CTT
cttagtttggatccattgtt

SEQ ID NO: 70717 - DNA, 20 bp, Artificial Sequence
  Description of Artificial Sequence: Synthetic oligonucleotide
  Target: SCN10A; (+) strand; PAM type: YTN; PAM sequence: TTC
ttagtttggatccattgttg

SEQ ID NO: 70718 - DNA, 20 bp, Artificial Sequence
  Description of Artificial Sequence: Synthetic oligonucleotide
  Target: SCN10A; (+) strand; PAM type: YTN; PAM sequence: CTT
agtttggatccattgttggg

SEQ ID NO: 70719 - DNA, 20 bp, Artificial Sequence
  Description of Artificial Sequence: Synthetic oligonucleotide
  Target: SCN10A; (+) strand; PAM type: YTN; PAM sequence: TTA
gtttggatccattgttgggg

SEQ ID NO: 70720 - DNA, 20 bp, Artificial Sequence
  Description of Artificial Sequence: Synthetic oligonucleotide
  Target: SCN10A; (+) strand; PAM type: YTN; PAM sequence: TTT
ggatccattgttggggagct

SEQ ID NO: 70721 - DNA, 20 bp, Artificial Sequence
  Description of Artificial Sequence: Synthetic oligonucleotide
  Target: SCN10A; (+) strand; PAM type: YTN; PAM sequence: TTG
gatccattgttggggagcta

SEQ ID NO: 70722 - DNA, 20 bp, Artificial Sequence
  Description of Artificial Sequence: Synthetic oligonucleotide
  Target: SCN10A; (+) strand; PAM type: YTN; PAM sequence: TTG
ttggggagctagtttgatct

SEQ ID NO: 70723 - DNA, 20 bp, Artificial Sequence
  Description of Artificial Sequence: Synthetic oligonucleotide
  Target: SCN10A; (+) strand; PAM type: YTN; PAM sequence: TTG
gggagctagtttgatctttt

SEQ ID NO: 70724 - DNA, 20 bp, Artificial Sequence
  Description of Artificial Sequence: Synthetic oligonucleotide
  Target: SCN10A; (+) strand; PAM type: YTN; PAM sequence: CTA
gtttgatcttttgaggggtg

SEQ ID NO: 70725 - DNA, 20 bp, Artificial Sequence
  Description of Artificial Sequence: Synthetic oligonucleotide
  Target: SCN10A; (+) strand; PAM type: YTN; PAM sequence: TTT
gatcttttgaggggtgttat

SEQ ID NO: 70726 - DNA, 20 bp, Artificial Sequence
  Description of Artificial Sequence: Synthetic oligonucleotide
  Target: SCN10A; (+) strand; PAM type: YTN; PAM sequence: TTG
atcttttgaggggtgttatt

SEQ ID NO: 70727 - DNA, 20 bp, Artificial Sequence
  Description of Artificial Sequence: Synthetic oligonucleotide
  Target: SCN10A; (+) strand; PAM type: YTN; PAM sequence: CTT
ttgaggggtgttattgaacc

SEQ ID NO: 70728 - DNA, 20 bp, Artificial Sequence
  Description of Artificial Sequence: Synthetic oligonucleotide
  Target: SCN10A; (+) strand; PAM type: YTN; PAM sequence: TTT
tgaggggtgttattgaaccc

SEQ ID NO: 70729 - DNA, 20 bp, Artificial Sequence
  Description of Artificial Sequence: Synthetic oligonucleotide
  Target: SCN10A; (+) strand; PAM type: YTN; PAM sequence: TTT
gaggggtgttattgaaccct

SEQ ID NO: 70730 - DNA, 20 bp, Artificial Sequence
  Description of Artificial Sequence: Synthetic oligonucleotide
  Target: SCN10A; (+) strand; PAM type: YTN; PAM sequence: TTG
aggggtgttattgaaccctc

SEQ ID NO: 70731 - DNA, 20 bp, Artificial Sequence
  Description of Artificial Sequence: Synthetic oligonucleotide
  Target: SCN10A; (+) strand; PAM type: YTN; PAM sequence: TTA
ttgaaccctcttttgtcata

SEQ ID NO: 70732 - DNA, 20 bp, Artificial Sequence
  Description of Artificial Sequence: Synthetic oligonucleotide
  Target: SCN10A; (+) strand; PAM type: YTN; PAM sequence: TTG
aaccctcttttgtcatatta

SEQ ID NO: 70733 - DNA, 20 bp, Artificial Sequence
  Description of Artificial Sequence: Synthetic oligonucleotide
  Target: SCN10A; (+) strand; PAM type: YTN; PAM sequence: CTC
ttttgtcatattaccagaat

SEQ ID NO: 70734 - DNA, 20 bp, Artificial Sequence
  Description of Artificial Sequence: Synthetic oligonucleotide
  Target: SCN10A; (+) strand; PAM type: YTN; PAM sequence: CTT
ttgtcatattaccagaattg

SEQ ID NO: 70735 - DNA, 20 bp, Artificial Sequence
  Description of Artificial Sequence: Synthetic oligonucleotide
  Target: SCN10A; (+) strand; PAM type: YTN; PAM sequence: TTT
tgtcatattaccagaattgc

SEQ ID NO: 70736 - DNA, 20 bp, Artificial Sequence
  Description of Artificial Sequence: Synthetic oligonucleotide
  Target: SCN10A; (+) strand; PAM type: YTN; PAM sequence: TTT
gtcatattaccagaattgct

SEQ ID NO: 70737 - DNA, 20 bp, Artificial Sequence
  Description of Artificial Sequence: Synthetic oligonucleotide
  Target: SCN10A; (+) strand; PAM type: YTN; PAM sequence: TTG
tcatattaccagaattgctt

SEQ ID NO: 70738 - DNA, 20 bp, Artificial Sequence
  Description of Artificial Sequence: Synthetic oligonucleotide
  Target: SCN10A; (+) strand; PAM type: YTN; PAM sequence: TTA
ccagaattgcttttctggtt

SEQ ID NO: 70739 - DNA, 20 bp, Artificial Sequence
  Description of Artificial Sequence: Synthetic oligonucleotide
  Target: SCN10A; (+) strand; PAM type: YTN; PAM sequence: TTG
cttttctggttccttctcat

SEQ ID NO: 70740 - DNA, 20 bp, Artificial Sequence
  Description of Artificial Sequence: Synthetic oligonucleotide
  Target: SCN10A; (+) strand; PAM type: YTN; PAM sequence: CTT
ttctggttccttctcatttg

SEQ ID NO: 70741 - DNA, 20 bp, Artificial Sequence
  Description of Artificial Sequence: Synthetic oligonucleotide
  Target: SCN10A; (+) strand; PAM type: YTN; PAM sequence: TTT
tctggttccttctcatttga

SEQ ID NO: 70742 - DNA, 20 bp, Artificial Sequence
  Description of Artificial Sequence: Synthetic oligonucleotide
  Target: SCN10A; (+) strand; PAM type: YTN; PAM sequence: TTT
ctggttccttctcatttgag

SEQ ID NO: 70743 - DNA, 20 bp, Artificial Sequence
  Description of Artificial Sequence: Synthetic oligonucleotide
  Target: SCN10A; (+) strand; PAM type: YTN; PAM sequence: TTC
tggttccttctcatttgagt

SEQ ID NO: 70744 - DNA, 20 bp, Artificial Sequence
  Description of Artificial Sequence: Synthetic oligonucleotide
  Target: SCN10A; (+) strand; PAM type: YTN; PAM sequence: CTG
gttccttctcatttgagtag

SEQ ID NO: 70745 - DNA, 20 bp, Artificial Sequence
  Description of Artificial Sequence: Synthetic oligonucleotide
  Target: SCN10A; (+) strand; PAM type: YTN; PAM sequence: TTC
cttctcatttgagtagacta

SEQ ID NO: 70746 - DNA, 20 bp, Artificial Sequence
  Description of Artificial Sequence: Synthetic oligonucleotide
  Target: SCN10A; (+) strand; PAM type: YTN; PAM sequence: CTT
ctcatttgagtagactattt

SEQ ID NO: 70747 - DNA, 20 bp, Artificial Sequence
  Description of Artificial Sequence: Synthetic oligonucleotide
  Target: SCN10A; (+) strand; PAM type: YTN; PAM sequence: TTC
tcatttgagtagactatttc

SEQ ID NO: 70748 - DNA, 20 bp, Artificial Sequence
  Description of Artificial Sequence: Synthetic oligonucleotide
  Target: SCN10A; (+) strand; PAM type: YTN; PAM sequence: CTC
atttgagtagactatttcag

SEQ ID NO: 70749 - DNA, 20 bp, Artificial Sequence
  Description of Artificial Sequence: Synthetic oligonucleotide
  Target: SCN10A; (+) strand; PAM type: YTN; PAM sequence: TTT
gagtagactatttcagagaa

SEQ ID NO: 70750 - DNA, 20 bp, Artificial Sequence
  Description of Artificial Sequence: Synthetic oligonucleotide
  Target: SCN10A; (+) strand; PAM type: YTN; PAM sequence: TTG
agtagactatttcagagaaa

SEQ ID NO: 70751 - DNA, 20 bp, Artificial Sequence
  Description of Artificial Sequence: Synthetic oligonucleotide
  Target: SCN10A; (+) strand; PAM type: YTN; PAM sequence: CTA
tttcagagaaaagatctgga

SEQ ID NO: 70752 - DNA, 20 bp, Artificial Sequence
  Description of Artificial Sequence: Synthetic oligonucleotide
  Target: SCN10A; (+) strand; PAM type: YTN; PAM sequence: TTT
cagagaaaagatctggaact

SEQ ID NO: 70753 - DNA, 20 bp, Artificial Sequence
  Description of Artificial Sequence: Synthetic oligonucleotide
  Target: SCN10A; (+) strand; PAM type: YTN; PAM sequence: TTC
agagaaaagatctggaactg

SEQ ID NO: 70754 - DNA, 20 bp, Artificial Sequence
  Description of Artificial Sequence: Synthetic oligonucleotide
  Target: SCN10A; (+) strand; PAM type: YTN; PAM sequence: CTG
gaactgaatggctgttgtgc

SEQ ID NO: 70755 - DNA, 20 bp, Artificial Sequence
  Description of Artificial Sequence: Synthetic oligonucleotide
  Target: SCN10A; (+) strand; PAM type: YTN; PAM sequence: CTG
aatggctgttgtgcagattc

SEQ ID NO: 70756 - DNA, 20 bp, Artificial Sequence
  Description of Artificial Sequence: Synthetic oligonucleotide
  Target: SCN10A; (+) strand; PAM type: YTN; PAM sequence: CTG
ttgtgcagattcttttgttt

SEQ ID NO: 70757 - DNA, 20 bp, Artificial Sequence
  Description of Artificial Sequence: Synthetic oligonucleotide
  Target: SCN10A; (+) strand; PAM type: YTN; PAM sequence: TTG
tgcagattcttttgtttcat

SEQ ID NO: 70758 - DNA, 20 bp, Artificial Sequence
  Description of Artificial Sequence: Synthetic oligonucleotide
  Target: SCN10A; (+) strand; PAM type: YTN; PAM sequence: TTC
ttttgtttcatgggtgatct

SEQ ID NO: 70759 - DNA, 20 bp, Artificial Sequence
  Description of Artificial Sequence: Synthetic oligonucleotide
  Target: SCN10A; (+) strand; PAM type: YTN; PAM sequence: CTT
ttgtttcatgggtgatctct

SEQ ID NO: 70760 - DNA, 20 bp, Artificial Sequence
  Description of Artificial Sequence: Synthetic oligonucleotide
  Target: SCN10A; (+) strand; PAM type: YTN; PAM sequence: TTT
tgtttcatgggtgatctctt

SEQ ID NO: 70761 - DNA, 20 bp, Artificial Sequence
  Description of Artificial Sequence: Synthetic oligonucleotide
  Target: SCN10A; (+) strand; PAM type: YTN; PAM sequence: TTT
gtttcatgggtgatctcttg

SEQ ID NO: 70762 - DNA, 20 bp, Artificial Sequence
  Description of Artificial Sequence: Synthetic oligonucleotide
  Target: SCN10A; (+) strand; PAM type: YTN; PAM sequence: TTG
tttcatgggtgatctcttga

SEQ ID NO: 70763 - DNA, 20 bp, Artificial Sequence
  Description of Artificial Sequence: Synthetic oligonucleotide
  Target: SCN10A; (+) strand; PAM type: YTN; PAM sequence: TTT
catgggtgatctcttgatgt

SEQ ID NO: 70764 - DNA, 20 bp, Artificial Sequence
  Description of Artificial Sequence: Synthetic oligonucleotide
  Target: SCN10A; (+) strand; PAM type: YTN; PAM sequence: TTC
atgggtgatctcttgatgtg

SEQ ID NO: 70765 - DNA, 20 bp, Artificial Sequence
  Description of Artificial Sequence: Synthetic oligonucleotide
  Target: SCN10A; (+) strand; PAM type: YTN; PAM sequence: CTC
ttgatgtggtgctctcccca

SEQ ID NO: 70766 - DNA, 20 bp, Artificial Sequence
  Description of Artificial Sequence: Synthetic oligonucleotide
  Target: SCN10A; (+) strand; PAM type: YTN; PAM sequence: CTT
gatgtggtgctctccccaat

SEQ ID NO: 70767 - DNA, 20 bp, Artificial Sequence
  Description of Artificial Sequence: Synthetic oligonucleotide
  Target: SCN10A; (+) strand; PAM type: YTN; PAM sequence: TTG
atgtggtgctctccccaatc

SEQ ID NO: 70768 - DNA, 20 bp, Artificial Sequence
  Description of Artificial Sequence: Synthetic oligonucleotide
  Target: SCN10A; (+) strand; PAM type: YTN; PAM sequence: CTC
tccccaatcccctggggatg

SEQ ID NO: 70769 - DNA, 20 bp, Artificial Sequence
  Description of Artificial Sequence: Synthetic oligonucleotide
  Target: SCN10A; (+) strand; PAM type: YTN; PAM sequence: CTC
cccaatcccctggggatggg

SEQ ID NO: 70770 - DNA, 20 bp, Artificial Sequence
  Description of Artificial Sequence: Synthetic oligonucleotide
  Target: SCN10A; (+) strand; PAM type: YTN; PAM sequence: CTG
gggatggggcttcctgagag

SEQ ID NO: 70771 - DNA, 20 bp, Artificial Sequence
  Description of Artificial Sequence: Synthetic oligonucleotide
  Target: SCN10A; (+) strand; PAM type: YTN; PAM sequence: CTT
cctgagagctggactgcagt

SEQ ID NO: 70772 - DNA, 20 bp, Artificial Sequence
  Description of Artificial Sequence: Synthetic oligonucleotide
  Target: SCN10A; (+) strand; PAM type: YTN; PAM sequence: TTC
ctgagagctggactgcagtg

SEQ ID NO: 70773 - DNA, 20 bp, Artificial Sequence
  Description of Artificial Sequence: Synthetic oligonucleotide
  Target: SCN10A; (+) strand; PAM type: YTN; PAM sequence: CTG
agagctggactgcagtgatc

SEQ ID NO: 70774 - DNA, 20 bp, Artificial Sequence
  Description of Artificial Sequence: Synthetic oligonucleotide
  Target: SCN10A; (+) strand; PAM type: YTN; PAM sequence: CTG
gactgcagtgatcgttattg

SEQ ID NO: 70775 - DNA, 20 bp, Artificial Sequence
  Description of Artificial Sequence: Synthetic oligonucleotide
  Target: SCN10A; (+) strand; PAM type: YTN; PAM sequence: CTG
cagtgatcgttattgttctt

SEQ ID NO: 70776 - DNA, 20 bp, Artificial Sequence
  Description of Artificial Sequence: Synthetic oligonucleotide
  Target: SCN10A; (+) strand; PAM type: YTN; PAM sequence: TTA
ttgttcttctgggcctagcc

SEQ ID NO: 70777 - DNA, 20 bp, Artificial Sequence
  Description of Artificial Sequence: Synthetic oligonucleotide
  Target: SCN10A; (+) strand; PAM type: YTN; PAM sequence: TTG
ttcttctgggcctagccaca

SEQ ID NO: 70778 - DNA, 20 bp, Artificial Sequence
  Description of Artificial Sequence: Synthetic oligonucleotide
  Target: SCN10A; (+) strand; PAM type: YTN; PAM sequence: TTC
ttctgggcctagccacacag

SEQ ID NO: 70779 - DNA, 20 bp, Artificial Sequence
  Description of Artificial Sequence: Synthetic oligonucleotide
  Target: SCN10A; (+) strand; PAM type: YTN; PAM sequence: CTT
ctgggcctagccacacagag

SEQ ID NO: 70780 - DNA, 20 bp, Artificial Sequence
  Description of Artificial Sequence: Synthetic oligonucleotide
  Target: SCN10A; (+) strand; PAM type: YTN; PAM sequence: TTC
tgggcctagccacacagagg

SEQ ID NO: 70781 - DNA, 20 bp, Artificial Sequence
  Description of Artificial Sequence: Synthetic oligonucleotide
  Target: SCN10A; (+) strand; PAM type: YTN; PAM sequence: CTG
ggcctagccacacagagggg

SEQ ID NO: 70782 - DNA, 20 bp, Artificial Sequence
  Description of Artificial Sequence: Synthetic oligonucleotide
  Target: SCN10A; (+) strand; PAM type: YTN; PAM sequence: CTA
gccacacagaggggctacca

SEQ ID NO: 70783 - DNA, 20 bp, Artificial Sequence
  Description of Artificial Sequence: Synthetic oligonucleotide
  Target: SCN10A; (+) strand; PAM type: YTN; PAM sequence: CTA
ccaggctctggggtagtact

SEQ ID NO: 70784 - DNA, 20 bp, Artificial Sequence
  Description of Artificial Sequence: Synthetic oligonucleotide
  Target: SCN10A; (+) strand; PAM type: YTN; PAM sequence: CTC
tggggtagtactgggaaatg

SEQ ID NO: 70785 - DNA, 20 bp, Artificial Sequence
  Description of Artificial Sequence: Synthetic oligonucleotide
  Target: SCN10A; (+) strand; PAM type: YTN; PAM sequence: CTG
gggtagtactgggaaatgcc

SEQ ID NO: 70786 - DNA, 20 bp, Artificial Sequence
  Description of Artificial Sequence: Synthetic oligonucleotide
  Target: SCN10A; (+) strand; PAM type: YTN; PAM sequence: CTG
ggaaatgcctgcaagagtcc

SEQ ID NO: 70787 - DNA, 20 bp, Artificial Sequence
  Description of Artificial Sequence: Synthetic oligonucleotide
  Target: SCN10A; (+) strand; PAM type: YTN; PAM sequence: CTG
caagagtcctgtgatgtgat

SEQ ID NO: 70788 - DNA, 20 bp, Artificial Sequence
  Description of Artificial Sequence: Synthetic oligonucleotide
  Target: SCN10A; (+) strand; PAM type: YTN; PAM sequence: CTG
tgatgtgattgatcttgaag

SEQ ID NO: 70789 - DNA, 20 bp, Artificial Sequence
  Description of Artificial Sequence: Synthetic oligonucleotide
  Target: SCN10A; (+) strand; PAM type: YTN; PAM sequence: TTG
atcttgaagtctcccagcca

SEQ ID NO: 70790 - DNA, 20 bp, Artificial Sequence
  Description of Artificial Sequence: Synthetic oligonucleotide
  Target: SCN10A; (+) strand; PAM type: YTN; PAM sequence: CTT
gaagtctcccagccatggat

SEQ ID NO: 70791 - DNA, 20 bp, Artificial Sequence
  Description of Artificial Sequence: Synthetic oligonucleotide
  Target: SCN10A; (+) strand; PAM type: YTN; PAM sequence: TTG
aagtctcccagccatggata

SEQ ID NO: 70792 - DNA, 20 bp, Artificial Sequence
  Description of Artificial Sequence: Synthetic oligonucleotide
  Target: SCN10A; (+) strand; PAM type: YTN; PAM sequence: CTC
ccagccatggatatcagcat

SEQ ID NO: 70793 - DNA, 20 bp, Artificial Sequence
  Description of Artificial Sequence: Synthetic oligonucleotide
  Target: SCN10A; (+) strand; PAM type: YTN; PAM sequence: CTG
ttctggtgaaggtggcagag

SEQ ID NO: 70794 - DNA, 20 bp, Artificial Sequence
  Description of Artificial Sequence: Synthetic oligonucleotide
  Target: SCN10A; (+) strand; PAM type: YTN; PAM sequence: TTC
tggtgaaggtggcagaggaa

SEQ ID NO: 70795 - DNA, 20 bp, Artificial Sequence
  Description of Artificial Sequence: Synthetic oligonucleotide
  Target: SCN10A; (+) strand; PAM type: YTN; PAM sequence: CTG
gtgaaggtggcagaggaatg

SEQ ID NO: 70796 - DNA, 20 bp, Artificial Sequence
  Description of Artificial Sequence: Synthetic oligonucleotide
  Target: SCN10A; (+) strand; PAM type: YTN; PAM sequence: CTG
tgagagtcctaggctgtaga

SEQ ID NO: 70797 - DNA, 20 bp, Artificial Sequence
  Description of Artificial Sequence: Synthetic oligonucleotide
  Target: SCN10A; (+) strand; PAM type: YTN; PAM sequence: CTA
ggctgtagatagatttagtg

SEQ ID NO: 70798 - DNA, 20 bp, Artificial Sequence
  Description of Artificial Sequence: Synthetic oligonucleotide
  Target: SCN10A; (+) strand; PAM type: YTN; PAM sequence: CTG
tagatagatttagtgtgctg

SEQ ID NO: 70799 - DNA, 20 bp, Artificial Sequence
  Description of Artificial Sequence: Synthetic oligonucleotide
  Target: SCN10A; (+) strand; PAM type: YTN; PAM sequence: TTT
agtgtgctggctttcttgaa

SEQ ID NO: 70800 - DNA, 20 bp, Artificial Sequence
  Description of Artificial Sequence: Synthetic oligonucleotide
  Target: SCN10A; (+) strand; PAM type: YTN; PAM sequence: TTA
gtgtgctggctttcttgaat

SEQ ID NO: 70801 - DNA, 20 bp, Artificial Sequence
  Description of Artificial Sequence: Synthetic oligonucleotide
  Target: SCN10A; (+) strand; PAM type: YTN; PAM sequence: CTG
gctttcttgaatgctagtta

SEQ ID NO: 70802 - DNA, 20 bp, Artificial Sequence
  Description of Artificial Sequence: Synthetic oligonucleotide
  Target: SCN10A; (+) strand; PAM type: YTN; PAM sequence: CTT
tcttgaatgctagttatgtt

SEQ ID NO: 70803 - DNA, 20 bp, Artificial Sequence
  Description of Artificial Sequence: Synthetic oligonucleotide
  Target: SCN10A; (+) strand; PAM type: YTN; PAM sequence: TTT
cttgaatgctagttatgtta

SEQ ID NO: 70804 - DNA, 20 bp, Artificial Sequence
  Description of Artificial Sequence: Synthetic oligonucleotide
  Target: SCN10A; (+) strand; PAM type: YTN; PAM sequence: TTC
ttgaatgctagttatgttag

SEQ ID NO: 70805 - DNA, 20 bp, Artificial Sequence
  Description of Artificial Sequence: Synthetic oligonucleotide
  Target: SCN10A; (+) strand; PAM type: YTN; PAM sequence: CTT
gaatgctagttatgttagca

SEQ ID NO: 70806 - DNA, 20 bp, Artificial Sequence
  Description of Artificial Sequence: Synthetic oligonucleotide
  Target: SCN10A; (+) strand; PAM type: YTN; PAM sequence: TTG
aatgctagttatgttagcag

SEQ ID NO: 70807 - DNA, 20 bp, Artificial Sequence
  Description of Artificial Sequence: Synthetic oligonucleotide
  Target: SCN10A; (+) strand; PAM type: YTN; PAM sequence: CTA
gttatgttagcagtgaagtt

SEQ ID NO: 70808 - DNA, 20 bp, Artificial Sequence
  Description of Artificial Sequence: Synthetic oligonucleotide
  Target: SCN10A; (+) strand; PAM type: YTN; PAM sequence: TTA
tgttagcagtgaagttgtca

SEQ ID NO: 70809 - DNA, 20 bp, Artificial Sequence
  Description of Artificial Sequence: Synthetic oligonucleotide
  Target: SCN10A; (+) strand; PAM type: YTN; PAM sequence: TTA
gcagtgaagttgtcatatgg

SEQ ID NO: 70810 - DNA, 20 bp, Artificial Sequence
  Description of Artificial Sequence: Synthetic oligonucleotide
  Target: SCN10A; (+) strand; PAM type: YTN; PAM sequence: TTG
tcatatggacagactcagga

SEQ ID NO: 70811 - DNA, 20 bp, Artificial Sequence
  Description of Artificial Sequence: Synthetic oligonucleotide
  Target: SCN10A; (+) strand; PAM type: YTN; PAM sequence: CTC
aggacgtctggttagccagg

SEQ ID NO: 70812 - DNA, 20 bp, Artificial Sequence
  Description of Artificial Sequence: Synthetic oligonucleotide
  Target: SCN10A; (+) strand; PAM type: YTN; PAM sequence: CTG
gttagccaggatgttgcagg

SEQ ID NO: 70813 - DNA, 20 bp, Artificial Sequence
  Description of Artificial Sequence: Synthetic oligonucleotide
  Target: SCN10A; (+) strand; PAM type: YTN; PAM sequence: TTA
gccaggatgttgcaggcagt

SEQ ID NO: 70814 - DNA, 20 bp, Artificial Sequence
  Description of Artificial Sequence: Synthetic oligonucleotide
  Target: SCN10A; (+) strand; PAM type: YTN; PAM sequence: TTG
caggcagtgcaactggttgt

SEQ ID NO: 70815 - DNA, 20 bp, Artificial Sequence
  Description of Artificial Sequence: Synthetic oligonucleotide
  Target: SCN10A; (+) strand; PAM type: YTN; PAM sequence: CTG
gttgttgttttctttttcct

SEQ ID NO: 70816 - DNA, 20 bp, Artificial Sequence
  Description of Artificial Sequence: Synthetic oligonucleotide
  Target: SCN10A; (+) strand; PAM type: YTN; PAM sequence: TTG
ttgttttctttttcctggga

SEQ ID NO: 70817 - DNA, 20 bp, Artificial Sequence
  Description of Artificial Sequence: Synthetic oligonucleotide
  Target: SCN10A; (+) strand; PAM type: YTN; PAM sequence: TTG
ttttctttttcctgggatca

SEQ ID NO: 70818 - DNA, 20 bp, Artificial Sequence
  Description of Artificial Sequence: Synthetic oligonucleotide
  Target: SCN10A; (+) strand; PAM type: YTN; PAM sequence: TTT
tctttttcctgggatcaaag

SEQ ID NO: 70819 - DNA, 20 bp, Artificial Sequence
  Description of Artificial Sequence: Synthetic oligonucleotide
  Target: SCN10A; (+) strand; PAM type: YTN; PAM sequence: TTT
ctttttcctgggatcaaagt

SEQ ID NO: 70820 - DNA, 20 bp, Artificial Sequence
  Description of Artificial Sequence: Synthetic oligonucleotide
  Target: SCN10A; (+) strand; PAM type: YTN; PAM sequence: TTC
tttttcctgggatcaaagtt

SEQ ID NO: 70821 - DNA, 20 bp, Artificial Sequence
  Description of Artificial Sequence: Synthetic oligonucleotide
  Target: SCN10A; (+) strand; PAM type: YTN; PAM sequence: CTT
tttcctgggatcaaagttat

SEQ ID NO: 70822 - DNA, 20 bp, Artificial Sequence
  Description of Artificial Sequence: Synthetic oligonucleotide
  Target: SCN10A; (+) strand; PAM type: YTN; PAM sequence: TTT
ttcctgggatcaaagttatt

SEQ ID NO: 70823 - DNA, 20 bp, Artificial Sequence
  Description of Artificial Sequence: Synthetic oligonucleotide
  Target: SCN10A; (+) strand; PAM type: YTN; PAM sequence: TTT
tcctgggatcaaagttattc

SEQ ID NO: 70824 - DNA, 20 bp, Artificial Sequence
  Description of Artificial Sequence: Synthetic oligonucleotide
  Target: SCN10A; (+) strand; PAM type: YTN; PAM sequence: TTT
cctgggatcaaagttattct

SEQ ID NO: 70825 - DNA, 20 bp, Artificial Sequence
  Description of Artificial Sequence: Synthetic oligonucleotide
  Target: SCN10A; (+) strand; PAM type: YTN; PAM sequence: TTC
ctgggatcaaagttattctg

SEQ ID NO: 70826 - DNA, 20 bp, Artificial Sequence
  Description of Artificial Sequence: Synthetic oligonucleotide
  Target: SCN10A; (+) strand; PAM type: YTN; PAM sequence: CTG
ggatcaaagttattctgtca

SEQ ID NO: 70827 - DNA, 20 bp, Artificial Sequence
  Description of Artificial Sequence: Synthetic oligonucleotide
  Target: SCN10A; (+) strand; PAM type: YTN; PAM sequence: TTA
ttctgtcatgagttgcttta

SEQ ID NO: 70828 - DNA, 20 bp, Artificial Sequence
  Description of Artificial Sequence: Synthetic oligonucleotide
  Target: SCN10A; (+) strand; PAM type: YTN; PAM sequence: TTC
tgtcatgagttgctttaatg

SEQ ID NO: 70829 - DNA, 20 bp, Artificial Sequence
  Description of Artificial Sequence: Synthetic oligonucleotide
  Target: SCN10A; (+) strand; PAM type: YTN; PAM sequence: CTG
tcatgagttgctttaatggc

SEQ ID NO: 70830 - DNA, 20 bp, Artificial Sequence
  Description of Artificial Sequence: Synthetic oligonucleotide
  Target: SCN10A; (+) strand; PAM type: YTN; PAM sequence: TTG
ctttaatggcctgagctgtt

SEQ ID NO: 70831 - DNA, 20 bp, Artificial Sequence
  Description of Artificial Sequence: Synthetic oligonucleotide
  Target: SCN10A; (+) strand; PAM type: YTN; PAM sequence: CTT
taatggcctgagctgtttga

SEQ ID NO: 70832 - DNA, 20 bp, Artificial Sequence
  Description of Artificial Sequence: Synthetic oligonucleotide
  Target: SCN10A; (+) strand; PAM type: YTN; PAM sequence: TTT
aatggcctgagctgtttgac

SEQ ID NO: 70833 - DNA, 20 bp, Artificial Sequence
  Description of Artificial Sequence: Synthetic oligonucleotide
  Target: SCN10A; (+) strand; PAM type: YTN; PAM sequence: TTA
atggcctgagctgtttgacc

SEQ ID NO: 70834 - DNA, 20 bp, Artificial Sequence
  Description of Artificial Sequence: Synthetic oligonucleotide
  Target: SCN10A; (+) strand; PAM type: YTN; PAM sequence: CTG
agctgtttgacctccagccg

SEQ ID NO: 70835 - DNA, 20 bp, Artificial Sequence
  Description of Artificial Sequence: Synthetic oligonucleotide
  Target: SCN10A; (+) strand; PAM type: YTN; PAM sequence: CTG
tttgacctccagccggtagg

SEQ ID NO: 70836 - DNA, 20 bp, Artificial Sequence
  Description of Artificial Sequence: Synthetic oligonucleotide
  Target: SCN10A; (+) strand; PAM type: YTN; PAM sequence: TTT
gacctccagccggtaggtga

SEQ ID NO: 70837 - DNA, 20 bp, Artificial Sequence
  Description of Artificial Sequence: Synthetic oligonucleotide
  Target: SCN10A; (+) strand; PAM type: YTN; PAM sequence: TTG
acctccagccggtaggtgat

SEQ ID NO: 70838 - DNA, 20 bp, Artificial Sequence
  Description of Artificial Sequence: Synthetic oligonucleotide
  Target: SCN10A; (+) strand; PAM type: YTN; PAM sequence: CTC
cagccggtaggtgatgcttt

SEQ ID NO: 70839 - DNA, 20 bp, Artificial Sequence
  Description of Artificial Sequence: Synthetic oligonucleotide
  Target: SCN10A; (+) strand; PAM type: YTN; PAM sequence: CTT
tcaagagagcactagtgcat

SEQ ID NO: 70840 - DNA, 20 bp, Artificial Sequence
  Description of Artificial Sequence: Synthetic oligonucleotide
  Target: SCN10A; (+) strand; PAM type: YTN; PAM sequence: TTT
caagagagcactagtgcatt

SEQ ID NO: 70841 - DNA, 20 bp, Artificial Sequence
  Description of Artificial Sequence: Synthetic oligonucleotide
  Target: SCN10A; (+) strand; PAM type: YTN; PAM sequence: TTC
aagagagcactagtgcatta

SEQ ID NO: 70842 - DNA, 20 bp, Artificial Sequence
  Description of Artificial Sequence: Synthetic oligonucleotide
  Target: SCN10A; (+) strand; PAM type: YTN; PAM sequence: CTA
gtgcattagtagaaggggga

SEQ ID NO: 70843 - DNA, 20 bp, Artificial Sequence
  Description of Artificial Sequence: Synthetic oligonucleotide
  Target: SCN10A; (+) strand; PAM type: YTN; PAM sequence: TTA
gtagaagggggatctaagct

SEQ ID NO: 70844 - DNA, 20 bp, Artificial Sequence
  Description of Artificial Sequence: Synthetic oligonucleotide
  Target: SCN10A; (+) strand; PAM type: YTN; PAM sequence: CTA
agctcaccctaagttggcca

SEQ ID NO: 70845 - DNA, 20 bp, Artificial Sequence
  Description of Artificial Sequence: Synthetic oligonucleotide
  Target: SCN10A; (+) strand; PAM type: YTN; PAM sequence: CTC
accctaagttggccagggta

SEQ ID NO: 70846 - DNA, 20 bp, Artificial Sequence
  Description of Artificial Sequence: Synthetic oligonucleotide
  Target: SCN10A; (+) strand; PAM type: YTN; PAM sequence: CTA
agttggccagggtaaatatt

SEQ ID NO: 70847 - DNA, 20 bp, Artificial Sequence
  Description of Artificial Sequence: Synthetic oligonucleotide
  Target: SCN10A; (+) strand; PAM type: YTN; PAM sequence: TTG
gccagggtaaatattttagt

SEQ ID NO: 70848 - DNA, 20 bp, Artificial Sequence
  Description of Artificial Sequence: Synthetic oligonucleotide
  Target: SCN10A; (+) strand; PAM type: YTN; PAM sequence: TTT
tagtttcttaggtgatgagc

SEQ ID NO: 70849 - DNA, 20 bp, Artificial Sequence
  Description of Artificial Sequence: Synthetic oligonucleotide
  Target: SCN10A; (+) strand; PAM type: YTN; PAM sequence: TTT
agtttcttaggtgatgagca

SEQ ID NO: 70850 - DNA, 20 bp, Artificial Sequence
  Description of Artificial Sequence: Synthetic oligonucleotide
  Target: SCN10A; (+) strand; PAM type: YTN; PAM sequence: TTA
gtttcttaggtgatgagcag

SEQ ID NO: 70851 - DNA, 20 bp, Artificial Sequence
  Description of Artificial Sequence: Synthetic oligonucleotide
  Target: SCN10A; (+) strand; PAM type: YTN; PAM sequence: TTT
cttaggtgatgagcagggcc

SEQ ID NO: 70852 - DNA, 20 bp, Artificial Sequence
  Description of Artificial Sequence: Synthetic oligonucleotide
  Target: SCN10A; (+) strand; PAM type: YTN; PAM sequence: TTC
ttaggtgatgagcagggcca

SEQ ID NO: 70853 - DNA, 20 bp, Artificial Sequence
  Description of Artificial Sequence: Synthetic oligonucleotide
  Target: SCN10A; (+) strand; PAM type: YTN; PAM sequence: CTT
aggtgatgagcagggccata

SEQ ID NO: 70854 - DNA, 20 bp, Artificial Sequence
  Description of Artificial Sequence: Synthetic oligonucleotide
  Target: SCN10A; (+) strand; PAM type: YTN; PAM sequence: TTA
ggtgatgagcagggccataa

SEQ ID NO: 70855 - DNA, 20 bp, Artificial Sequence
  Description of Artificial Sequence: Synthetic oligonucleotide
  Target: SCN10A; (+) strand; PAM type: YTN; PAM sequence: CTT
ccgagagtttctgggttttg

SEQ ID NO: 70856 - DNA, 20 bp, Artificial Sequence
  Description of Artificial Sequence: Synthetic oligonucleotide
  Target: SCN10A; (+) strand; PAM type: YTN; PAM sequence: TTC
cgagagtttctgggttttgt

SEQ ID NO: 70857 - DNA, 20 bp, Artificial Sequence
  Description of Artificial Sequence: Synthetic oligonucleotide
  Target: SCN10A; (+) strand; PAM type: YTN; PAM sequence: TTT
ctgggttttgtgttcagcta

SEQ ID NO: 70858 - DNA, 20 bp, Artificial Sequence
  Description of Artificial Sequence: Synthetic oligonucleotide
  Target: SCN10A; (+) strand; PAM type: YTN; PAM sequence: TTC
tgggttttgtgttcagctac

SEQ ID NO: 70859 - DNA, 20 bp, Artificial Sequence
  Description of Artificial Sequence: Synthetic oligonucleotide
  Target: SCN10A; (+) strand; PAM type: YTN; PAM sequence: CTG
ggttttgtgttcagctacca

SEQ ID NO: 70860 - DNA, 20 bp, Artificial Sequence
  Description of Artificial Sequence: Synthetic oligonucleotide
  Target: SCN10A; (+) strand; PAM type: YTN; PAM sequence: TTT
tgtgttcagctaccaaggca

SEQ ID NO: 70861 - DNA, 20 bp, Artificial Sequence
  Description of Artificial Sequence: Synthetic oligonucleotide
  Target: SCN10A; (+) strand; PAM type: YTN; PAM sequence: TTT
gtgttcagctaccaaggcag

SEQ ID NO: 70862 - DNA, 20 bp, Artificial Sequence
  Description of Artificial Sequence: Synthetic oligonucleotide
  Target: SCN10A; (+) strand; PAM type: YTN; PAM sequence: TTG
tgttcagctaccaaggcagg

SEQ ID NO: 70863 - DNA, 20 bp, Artificial Sequence
  Description of Artificial Sequence: Synthetic oligonucleotide
  Target: SCN10A; (+) strand; PAM type: YTN; PAM sequence: TTC
agctaccaaggcaggtaggg

SEQ ID NO: 70864 - DNA, 20 bp, Artificial Sequence
  Description of Artificial Sequence: Synthetic oligonucleotide
  Target: SCN10A; (+) strand; PAM type: YTN; PAM sequence: CTA
ccaaggcaggtagggaaata

SEQ ID NO: 70865 - DNA, 20 bp, Artificial Sequence
  Description of Artificial Sequence: Synthetic oligonucleotide
  Target: SCN10A; (+) strand; PAM type: YTN; PAM sequence: CTA
gactcagacccttcttgggt

SEQ ID NO: 70866 - DNA, 20 bp, Artificial Sequence
  Description of Artificial Sequence: Synthetic oligonucleotide
  Target: SCN10A; (+) strand; PAM type: YTN; PAM sequence: CTC
agacccttcttgggtaggga

SEQ ID NO: 70867 - DNA, 20 bp, Artificial Sequence
  Description of Artificial Sequence: Synthetic oligonucleotide
  Target: SCN10A; (+) strand; PAM type: YTN; PAM sequence: CTT
cttgggtagggattgctgtg

SEQ ID NO: 70868 - DNA, 20 bp, Artificial Sequence
  Description of Artificial Sequence: Synthetic oligonucleotide
  Target: SCN10A; (+) strand; PAM type: YTN; PAM sequence: TTC
ttgggtagggattgctgtgg

SEQ ID NO: 70869 - DNA, 20 bp, Artificial Sequence
  Description of Artificial Sequence: Synthetic oligonucleotide
  Target: SCN10A; (+) strand; PAM type: YTN; PAM sequence: CTT
gggtagggattgctgtggcc

SEQ ID NO: 70870 - DNA, 20 bp, Artificial Sequence
  Description of Artificial Sequence: Synthetic oligonucleotide
  Target: SCN10A; (+) strand; PAM type: YTN; PAM sequence: TTG
ggtagggattgctgtggcca

SEQ ID NO: 70871 - DNA, 20 bp, Artificial Sequence
  Description of Artificial Sequence: Synthetic oligonucleotide
  Target: SCN10A; (+) strand; PAM type: YTN; PAM sequence: TTG
ctgtggccactgtggtggat

SEQ ID NO: 70872 - DNA, 20 bp, Artificial Sequence
  Description of Artificial Sequence: Synthetic oligonucleotide
  Target: SCN10A; (+) strand; PAM type: YTN; PAM sequence: CTG
tggccactgtggtggatggg

SEQ ID NO: 70873 - DNA, 20 bp, Artificial Sequence
  Description of Artificial Sequence: Synthetic oligonucleotide
  Target: SCN10A; (+) strand; PAM type: YTN; PAM sequence: CTG
tggtggatgggggttggttc

SEQ ID NO: 70874 - DNA, 20 bp, Artificial Sequence
  Description of Artificial Sequence: Synthetic oligonucleotide
  Target: SCN10A; (+) strand; PAM type: YTN; PAM sequence: TTG
gttctcaggccagtggggtt

SEQ ID NO: 70875 - DNA, 20 bp, Artificial Sequence
  Description of Artificial Sequence: Synthetic oligonucleotide
  Target: SCN10A; (+) strand; PAM type: YTN; PAM sequence: TTC
tcaggccagtggggttgtgt

SEQ ID NO: 70876 - DNA, 20 bp, Artificial Sequence
  Description of Artificial Sequence: Synthetic oligonucleotide
  Target: SCN10A; (+) strand; PAM type: YTN; PAM sequence: CTC
aggccagtggggttgtgttc

SEQ ID NO: 70877 - DNA, 20 bp, Artificial Sequence
  Description of Artificial Sequence: Synthetic oligonucleotide
  Target: SCN10A; (+) strand; PAM type: YTN; PAM sequence: TTG
tgttccagagggaattttgg

SEQ ID NO: 70878 - DNA, 20 bp, Artificial Sequence
  Description of Artificial Sequence: Synthetic oligonucleotide
  Target: SCN10A; (+) strand; PAM type: YTN; PAM sequence: TTC
cagagggaattttggctgcc

SEQ ID NO: 70879 - DNA, 20 bp, Artificial Sequence
  Description of Artificial Sequence: Synthetic oligonucleotide
  Target: SCN10A; (+) strand; PAM type: YTN; PAM sequence: TTT
tggctgcctctgctgtgcca

SEQ ID NO: 70880 - DNA, 20 bp, Artificial Sequence
  Description of Artificial Sequence: Synthetic oligonucleotide
  Target: SCN10A; (+) strand; PAM type: YTN; PAM sequence: TTT
ggctgcctctgctgtgccat

SEQ ID NO: 70881 - DNA, 20 bp, Artificial Sequence
  Description of Artificial Sequence: Synthetic oligonucleotide
  Target: SCN10A; (+) strand; PAM type: YTN; PAM sequence: TTG
gctgcctctgctgtgccata

SEQ ID NO: 70882 - DNA, 20 bp, Artificial Sequence
  Description of Artificial Sequence: Synthetic oligonucleotide
  Target: SCN10A; (+) strand; PAM type: YTN; PAM sequence: CTG
cctctgctgtgccatagagt

SEQ ID NO: 70883 - DNA, 20 bp, Artificial Sequence
  Description of Artificial Sequence: Synthetic oligonucleotide
  Target: SCN10A; (+) strand; PAM type: YTN; PAM sequence: CTC
tgctgtgccatagagttctc

SEQ ID NO: 70884 - DNA, 20 bp, Artificial Sequence
  Description of Artificial Sequence: Synthetic oligonucleotide
  Target: SCN10A; (+) strand; PAM type: YTN; PAM sequence: CTG
ctgtgccatagagttctcca

SEQ ID NO: 70885 - DNA, 20 bp, Artificial Sequence
  Description of Artificial Sequence: Synthetic oligonucleotide
  Target: SCN10A; (+) strand; PAM type: YTN; PAM sequence: CTG
tgccatagagttctccaggg

SEQ ID NO: 70886 - DNA, 20 bp, Artificial Sequence
  Description of Artificial Sequence: Synthetic oligonucleotide
  Target: SCN10A; (+) strand; PAM type: YTN; PAM sequence: TTC
tccagggaagtgggggatag

SEQ ID NO: 70887 - DNA, 20 bp, Artificial Sequence
  Description of Artificial Sequence: Synthetic oligonucleotide
  Target: SCN10A; (+) strand; PAM type: YTN; PAM sequence: CTC
cagggaagtgggggatagct

SEQ ID NO: 70888 - DNA, 20 bp, Artificial Sequence
  Description of Artificial Sequence: Synthetic oligonucleotide
  Target: SCN10A; (+) strand; PAM type: YTN; PAM sequence: CTG
ctagtgagaggcctcaccta

SEQ ID NO: 70889 - DNA, 20 bp, Artificial Sequence
  Description of Artificial Sequence: Synthetic oligonucleotide
  Target: SCN10A; (+) strand; PAM type: YTN; PAM sequence: CTA
gtgagaggcctcacctagct

SEQ ID NO: 70890 - DNA, 20 bp, Artificial Sequence
  Description of Artificial Sequence: Synthetic oligonucleotide
  Target: SCN10A; (+) strand; PAM type: YTN; PAM sequence: CTC
acctagctctcatgtagttg

SEQ ID NO: 70891 - DNA, 20 bp, Artificial Sequence
  Description of Artificial Sequence: Synthetic oligonucleotide
  Target: SCN10A; (+) strand; PAM type: YTN; PAM sequence: CTA
gctctcatgtagttggtgag

SEQ ID NO: 70892 - DNA, 20 bp, Artificial Sequence
  Description of Artificial Sequence: Synthetic oligonucleotide
  Target: SCN10A; (+) strand; PAM type: YTN; PAM sequence: CTC
tcatgtagttggtgaggctg

SEQ ID NO: 70893 - DNA, 20 bp, Artificial Sequence
  Description of Artificial Sequence: Synthetic oligonucleotide
  Target: SCN10A; (+) strand; PAM type: YTN; PAM sequence: CTC
atgtagttggtgaggctggt

SEQ ID NO: 70894 - DNA, 20 bp, Artificial Sequence
  Description of Artificial Sequence: Synthetic oligonucleotide
  Target: SCN10A; (+) strand; PAM type: YTN; PAM sequence: TTG
gtgaggctggtcttgctcct

SEQ ID NO: 70895 - DNA, 20 bp, Artificial Sequence
  Description of Artificial Sequence: Synthetic oligonucleotide
  Target: SCN10A; (+) strand; PAM type: YTN; PAM sequence: CTG
gtcttgctcctgcagtgccc

SEQ ID NO: 70896 - DNA, 20 bp, Artificial Sequence
  Description of Artificial Sequence: Synthetic oligonucleotide
  Target: SCN10A; (+) strand; PAM type: YTN; PAM sequence: CTT
gctcctgcagtgccctactc

SEQ ID NO: 70897 - DNA, 20 bp, Artificial Sequence
  Description of Artificial Sequence: Synthetic oligonucleotide
  Target: SCN10A; (+) strand; PAM type: YTN; PAM sequence: TTG
ctcctgcagtgccctactca

SEQ ID NO: 70898 - DNA, 20 bp, Artificial Sequence
  Description of Artificial Sequence: Synthetic oligonucleotide
  Target: SCN10A; (+) strand; PAM type: YTN; PAM sequence: CTC
ctgcagtgccctactcagac

SEQ ID NO: 70899 - DNA, 20 bp, Artificial Sequence
  Description of Artificial Sequence: Synthetic oligonucleotide
  Target: SCN10A; (+) strand; PAM type: YTN; PAM sequence: CTG
cagtgccctactcagacctt

SEQ ID NO: 70900 - DNA, 20 bp, Artificial Sequence
  Description of Artificial Sequence: Synthetic oligonucleotide
  Target: SCN10A; (+) strand; PAM type: YTN; PAM sequence: CTA
ctcagaccttgccccaggct

SEQ ID NO: 70901 - DNA, 20 bp, Artificial Sequence
  Description of Artificial Sequence: Synthetic oligonucleotide
  Target: SCN10A; (+) strand; PAM type: YTN; PAM sequence: CTC
agaccttgccccaggctgtg

SEQ ID NO: 70902 - DNA, 20 bp, Artificial Sequence
  Description of Artificial Sequence: Synthetic oligonucleotide
  Target: SCN10A; (+) strand; PAM type: YTN; PAM sequence: CTT
gccccaggctgtgagcttcc

SEQ ID NO: 70903 - DNA, 20 bp, Artificial Sequence
  Description of Artificial Sequence: Synthetic oligonucleotide
  Target: SCN10A; (+) strand; PAM type: YTN; PAM sequence: TTG
ccccaggctgtgagcttccc

SEQ ID NO: 70904 - DNA, 20 bp, Artificial Sequence
  Description of Artificial Sequence: Synthetic oligonucleotide
  Target: SCN10A; (+) strand; PAM type: YTN; PAM sequence: CTG
tgagcttccccactgagaaa

SEQ ID NO: 70905 - DNA, 20 bp, Artificial Sequence
  Description of Artificial Sequence: Synthetic oligonucleotide
  Target: SCN10A; (+) strand; PAM type: YTN; PAM sequence: CTT
ccccactgagaaagaaagca

SEQ ID NO: 70906 - DNA, 20 bp, Artificial Sequence
  Description of Artificial Sequence: Synthetic oligonucleotide
  Target: SCN10A; (+) strand; PAM type: YTN; PAM sequence: TTC
cccactgagaaagaaagcat

SEQ ID NO: 70907 - DNA, 20 bp, Artificial Sequence
  Description of Artificial Sequence: Synthetic oligonucleotide
  Target: SCN10A; (+) strand; PAM type: YTN; PAM sequence: CTG
agaaagaaagcatgactttt

SEQ ID NO: 70908 - DNA, 20 bp, Artificial Sequence
  Description of Artificial Sequence: Synthetic oligonucleotide
  Target: SCN10A; (+) strand; PAM type: YTN; PAM sequence: CTT
ttggaccgcatccctcactg

SEQ ID NO: 70909 - DNA, 20 bp, Artificial Sequence
  Description of Artificial Sequence: Synthetic oligonucleotide
  Target: SCN10A; (+) strand; PAM type: YTN; PAM sequence: TTT
tggaccgcatccctcactgt

SEQ ID NO: 70910 - DNA, 20 bp, Artificial Sequence
  Description of Artificial Sequence: Synthetic oligonucleotide
  Target: SCN10A; (+) strand; PAM type: YTN; PAM sequence: TTT
ggaccgcatccctcactgtc

SEQ ID NO: 70911 - DNA, 20 bp, Artificial Sequence
  Description of Artificial Sequence: Synthetic oligonucleotide
  Target: SCN10A; (+) strand; PAM type: YTN; PAM sequence: TTG
gaccgcatccctcactgtct

SEQ ID NO: 70912 - DNA, 20 bp, Artificial Sequence
  Description of Artificial Sequence: Synthetic oligonucleotide
  Target: SCN10A; (+) strand; PAM type: YTN; PAM sequence: CTC
actgtctgcttgcagttccc

SEQ ID NO: 70913 - DNA, 20 bp, Artificial Sequence
  Description of Artificial Sequence: Synthetic oligonucleotide
  Target: SCN10A; (+) strand; PAM type: YTN; PAM sequence: CTG
tctgcttgcagttcccattt

SEQ ID NO: 70914 - DNA, 20 bp, Artificial Sequence
  Description of Artificial Sequence: Synthetic oligonucleotide
  Target: SCN10A; (+) strand; PAM type: YTN; PAM sequence: CTG
cttgcagttcccatttgccc

SEQ ID NO: 70915 - DNA, 20 bp, Artificial Sequence
  Description of Artificial Sequence: Synthetic oligonucleotide
  Target: SCN10A; (+) strand; PAM type: YTN; PAM sequence: CTT
gcagttcccatttgccccct

SEQ ID NO: 70916 - DNA, 20 bp, Artificial Sequence
  Description of Artificial Sequence: Synthetic oligonucleotide
  Target: SCN10A; (+) strand; PAM type: YTN; PAM sequence: TTG
cagttcccatttgccccctg

SEQ ID NO: 70917 - DNA, 20 bp, Artificial Sequence
  Description of Artificial Sequence: Synthetic oligonucleotide
  Target: SCN10A; (+) strand; PAM type: YTN; PAM sequence: TTC
ccatttgccccctggattct

SEQ ID NO: 70918 - DNA, 20 bp, Artificial Sequence
  Description of Artificial Sequence: Synthetic oligonucleotide
  Target: SCN10A; (+) strand; PAM type: YTN; PAM sequence: TTT
gccccctggattctgctcaa

SEQ ID NO: 70919 - DNA, 20 bp, Artificial Sequence
  Description of Artificial Sequence: Synthetic oligonucleotide
  Target: SCN10A; (+) strand; PAM type: YTN; PAM sequence: TTG
ccccctggattctgctcaag

SEQ ID NO: 70920 - DNA, 20 bp, Artificial Sequence
  Description of Artificial Sequence: Synthetic oligonucleotide
  Target: SCN10A; (+) strand; PAM type: YTN; PAM sequence: CTG
gattctgctcaagaaaattt

SEQ ID NO: 70921 - DNA, 20 bp, Artificial Sequence
  Description of Artificial Sequence: Synthetic oligonucleotide
  Target: SCN10A; (+) strand; PAM type: YTN; PAM sequence: TTC
tgctcaagaaaatttgtgcc

SEQ ID NO: 70922 - DNA, 20 bp, Artificial Sequence
  Description of Artificial Sequence: Synthetic oligonucleotide
  Target: SCN10A; (+) strand; PAM type: YTN; PAM sequence: CTG
ctcaagaaaatttgtgccca

SEQ ID NO: 70923 - DNA, 20 bp, Artificial Sequence
  Description of Artificial Sequence: Synthetic oligonucleotide
  Target: SCN10A; (+) strand; PAM type: YTN; PAM sequence: CTC
aagaaaatttgtgcccagtt

SEQ ID NO: 70924 - DNA, 20 bp, Artificial Sequence
  Description of Artificial Sequence: Synthetic oligonucleotide
  Target: SCN10A; (+) strand; PAM type: YTN; PAM sequence: TTT
gtgcccagttgaaattatta

SEQ ID NO: 70925 - DNA, 20 bp, Artificial Sequence
  Description of Artificial Sequence: Synthetic oligonucleotide
  Target: SCN10A; (+) strand; PAM type: YTN; PAM sequence: TTG
tgcccagttgaaattattac

SEQ ID NO: 70926 - DNA, 20 bp, Artificial Sequence
  Description of Artificial Sequence: Synthetic oligonucleotide
  Target: SCN10A; (+) strand; PAM type: YTN; PAM sequence: TTG
aaattattactaattttagt

SEQ ID NO: 70927 - DNA, 20 bp, Artificial Sequence
  Description of Artificial Sequence: Synthetic oligonucleotide
  Target: SCN10A; (+) strand; PAM type: YTN; PAM sequence: TTA
ttactaattttagttgaaac

SEQ ID NO: 70928 - DNA, 20 bp, Artificial Sequence
  Description of Artificial Sequence: Synthetic oligonucleotide
  Target: SCN10A; (+) strand; PAM type: YTN; PAM sequence: TTA
ctaattttagttgaaacttc

SEQ ID NO: 70929 - DNA, 20 bp, Artificial Sequence
  Description of Artificial Sequence: Synthetic oligonucleotide
  Target: SCN10A; (+) strand; PAM type: YTN; PAM sequence: CTA
attttagttgaaacttcttt

SEQ ID NO: 70930 - DNA, 20 bp, Artificial Sequence
  Description of Artificial Sequence: Synthetic oligonucleotide
  Target: SCN10A; (+) strand; PAM type: YTN; PAM sequence: TTT
tagttgaaacttctttcatc

SEQ ID NO: 70931 - DNA, 20 bp, Artificial Sequence
  Description of Artificial Sequence: Synthetic oligonucleotide
  Target: SCN10A; (+) strand; PAM type: YTN; PAM sequence: TTT
agttgaaacttctttcatcc

SEQ ID NO: 70932 - DNA, 20 bp, Artificial Sequence
  Description of Artificial Sequence: Synthetic oligonucleotide
  Target: SCN10A; (+) strand; PAM type: YTN; PAM sequence: TTA
gttgaaacttctttcatcct

SEQ ID NO: 70933 - DNA, 20 bp, Artificial Sequence
  Description of Artificial Sequence: Synthetic oligonucleotide
  Target: SCN10A; (+) strand; PAM type: YTN; PAM sequence: TTG
aaacttctttcatcctgtga

SEQ ID NO: 70934 - DNA, 20 bp, Artificial Sequence
  Description of Artificial Sequence: Synthetic oligonucleotide
  Target: SCN10A; (+) strand; PAM type: YTN; PAM sequence: CTT
ctttcatcctgtgacccctc

SEQ ID NO: 70935 - DNA, 20 bp, Artificial Sequence
  Description of Artificial Sequence: Synthetic oligonucleotide
  Target: SCN10A; (+) strand; PAM type: YTN; PAM sequence: TTC
tttcatcctgtgacccctcc

SEQ ID NO: 70936 - DNA, 20 bp, Artificial Sequence
  Description of Artificial Sequence: Synthetic oligonucleotide
  Target: SCN10A; (+) strand; PAM type: YTN; PAM sequence: CTT
tcatcctgtgacccctccct

SEQ ID NO: 70937 - DNA, 20 bp, Artificial Sequence
  Description of Artificial Sequence: Synthetic oligonucleotide
  Target: SCN10A; (+) strand; PAM type: YTN; PAM sequence: TTT
catcctgtgacccctccctg

SEQ ID NO: 70938 - DNA, 20 bp, Artificial Sequence
  Description of Artificial Sequence: Synthetic oligonucleotide
  Target: SCN10A; (+) strand; PAM type: YTN; PAM sequence: TTC
atcctgtgacccctccctga

SEQ ID NO: 70939 - DNA, 20 bp, Artificial Sequence
  Description of Artificial Sequence: Synthetic oligonucleotide
  Target: SCN10A; (+) strand; PAM type: YTN; PAM sequence: CTG
tgacccctccctgattccac

SEQ ID NO: 70940 - DNA, 20 bp, Artificial Sequence
  Description of Artificial Sequence: Synthetic oligonucleotide
  Target: SCN10A; (+) strand; PAM type: YTN; PAM sequence: CTC
cctgattccactggctgcct

SEQ ID NO: 70941 - DNA, 20 bp, Artificial Sequence
  Description of Artificial Sequence: Synthetic oligonucleotide
  Target: SCN10A; (+) strand; PAM type: YTN; PAM sequence: CTG
attccactggctgccttccc

SEQ ID NO: 70942 - DNA, 20 bp, Artificial Sequence
  Description of Artificial Sequence: Synthetic oligonucleotide
  Target: SCN10A; (+) strand; PAM type: YTN; PAM sequence: TTC
cactggctgccttccccaag

SEQ ID NO: 70943 - DNA, 20 bp, Artificial Sequence
  Description of Artificial Sequence: Synthetic oligonucleotide
  Target: SCN10A; (+) strand; PAM type: YTN; PAM sequence: CTG
gctgccttccccaagggtgc

SEQ ID NO: 70944 - DNA, 20 bp, Artificial Sequence
  Description of Artificial Sequence: Synthetic oligonucleotide
  Target: SCN10A; (+) strand; PAM type: YTN; PAM sequence: CTG
ccttccccaagggtgcctgt

SEQ ID NO: 70945 - DNA, 20 bp, Artificial Sequence
  Description of Artificial Sequence: Synthetic oligonucleotide
  Target: SCN10A; (+) strand; PAM type: YTN; PAM sequence: CTT
ccccaagggtgcctgtgaga

SEQ ID NO: 70946 - DNA, 20 bp, Artificial Sequence
  Description of Artificial Sequence: Synthetic oligonucleotide
  Target: SCN10A; (+) strand; PAM type: YTN; PAM sequence: TTC
cccaagggtgcctgtgagac

SEQ ID NO: 70947 - DNA, 20 bp, Artificial Sequence
  Description of Artificial Sequence: Synthetic oligonucleotide
  Target: SCN10A; (+) strand; PAM type: YTN; PAM sequence: CTG
tgagacatagtcagggatgg

SEQ ID NO: 70948 - DNA, 20 bp, Artificial Sequence
  Description of Artificial Sequence: Synthetic oligonucleotide
  Target: SCN10A; (+) strand; PAM type: YTN; PAM sequence: TTC
cctggtctcaagctggagac

SEQ ID NO: 70949 - DNA, 20 bp, Artificial Sequence
  Description of Artificial Sequence: Synthetic oligonucleotide
  Target: SCN10A; (+) strand; PAM type: YTN; PAM sequence: CTG
gtctcaagctggagactggg

SEQ ID NO: 70950 - DNA, 20 bp, Artificial Sequence
  Description of Artificial Sequence: Synthetic oligonucleotide
  Target: SCN10A; (+) strand; PAM type: YTN; PAM sequence: CTC
aagctggagactgggagtgc

SEQ ID NO: 70951 - DNA, 20 bp, Artificial Sequence
  Description of Artificial Sequence: Synthetic oligonucleotide
  Target: SCN10A; (+) strand; PAM type: YTN; PAM sequence: CTG
gagactgggagtgcctacaa

SEQ ID NO: 70952 - DNA, 20 bp, Artificial Sequence
  Description of Artificial Sequence: Synthetic oligonucleotide
  Target: SCN10A; (+) strand; PAM type: YTN; PAM sequence: CTG
ggagtgcctacaaggcactt

SEQ ID NO: 70953 - DNA, 20 bp, Artificial Sequence
  Description of Artificial Sequence: Synthetic oligonucleotide
  Target: SCN10A; (+) strand; PAM type: YTN; PAM sequence: CTA
caaggcacttccctttgctg

SEQ ID NO: 70954 - DNA, 20 bp, Artificial Sequence
  Description of Artificial Sequence: Synthetic oligonucleotide
  Target: SCN10A; (+) strand; PAM type: YTN; PAM sequence: CTT
ccctttgctgtttctacttt

SEQ ID NO: 70955 - DNA, 20 bp, Artificial Sequence
  Description of Artificial Sequence: Synthetic oligonucleotide
  Target: SCN10A; (+) strand; PAM type: YTN; PAM sequence: TTC
cctttgctgtttctactttt

SEQ ID NO: 70956 - DNA, 20 bp, Artificial Sequence
  Description of Artificial Sequence: Synthetic oligonucleotide
  Target: SCN10A; (+) strand; PAM type: YTN; PAM sequence: CTT
tgctgtttctacttttatat

SEQ ID NO: 70957 - DNA, 20 bp, Artificial Sequence
  Description of Artificial Sequence: Synthetic oligonucleotide
  Target: SCN10A; (+) strand; PAM type: YTN; PAM sequence: TTT
gctgtttctacttttatatt

SEQ ID NO: 70958 - DNA, 20 bp, Artificial Sequence
  Description of Artificial Sequence: Synthetic oligonucleotide
  Target: SCN10A; (+) strand; PAM type: YTN; PAM sequence: TTG
ctgtttctacttttatattt

SEQ ID NO: 70959 - DNA, 20 bp, Artificial Sequence
  Description of Artificial Sequence: Synthetic oligonucleotide
  Target: SCN10A; (+) strand; PAM type: YTN; PAM sequence: CTG
tttctacttttatattttgt

SEQ ID NO: 70960 - DNA, 20 bp, Artificial Sequence
  Description of Artificial Sequence: Synthetic oligonucleotide
  Target: SCN10A; (+) strand; PAM type: YTN; PAM sequence: TTT
ctacttttatattttgtgtg

SEQ ID NO: 70961 - DNA, 20 bp, Artificial Sequence
  Description of Artificial Sequence: Synthetic oligonucleotide
  Target: SCN10A; (+) strand; PAM type: YTN; PAM sequence: TTC
tacttttatattttgtgtgg

SEQ ID NO: 70962 - DNA, 20 bp, Artificial Sequence
  Description of Artificial Sequence: Synthetic oligonucleotide
  Target: SCN10A; (+) strand; PAM type: YTN; PAM sequence: CTA
cttttatattttgtgtggct

SEQ ID NO: 70963 - DNA, 20 bp, Artificial Sequence
  Description of Artificial Sequence: Synthetic oligonucleotide
  Target: SCN10A; (+) strand; PAM type: YTN; PAM sequence: CTT
ttatattttgtgtggcttcc

SEQ ID NO: 70964 - DNA, 20 bp, Artificial Sequence
  Description of Artificial Sequence: Synthetic oligonucleotide
  Target: SCN10A; (+) strand; PAM type: YTN; PAM sequence: TTT
tatattttgtgtggcttcct

SEQ ID NO: 70965 - DNA, 20 bp, Artificial Sequence
  Description of Artificial Sequence: Synthetic oligonucleotide
  Target: SCN10A; (+) strand; PAM type: YTN; PAM sequence: TTT
atattttgtgtggcttccta

SEQ ID NO: 70966 - DNA, 20 bp, Artificial Sequence
  Description of Artificial Sequence: Synthetic oligonucleotide
  Target: SCN10A; (+) strand; PAM type: YTN; PAM sequence: TTA
tattttgtgtggcttcctaa

SEQ ID NO: 70967 - DNA, 20 bp, Artificial Sequence
  Description of Artificial Sequence: Synthetic oligonucleotide
  Target: SCN10A; (+) strand; PAM type: YTN; PAM sequence: TTT
tgtgtggcttcctaaattta

SEQ ID NO: 70968 - DNA, 20 bp, Artificial Sequence
  Description of Artificial Sequence: Synthetic oligonucleotide
  Target: SCN10A; (+) strand; PAM type: YTN; PAM sequence: TTT
gtgtggcttcctaaatttat

SEQ ID NO: 70969 - DNA, 20 bp, Artificial Sequence
  Description of Artificial Sequence: Synthetic oligonucleotide
  Target: SCN10A; (+) strand; PAM type: YTN; PAM sequence: TTG
tgtggcttcctaaatttatt

SEQ ID NO: 70970 - DNA, 20 bp, Artificial Sequence
  Description of Artificial Sequence: Synthetic oligonucleotide
  Target: SCN10A; (+) strand; PAM type: YTN; PAM sequence: CTT
cctaaatttatttacattcc

SEQ ID NO: 70971 - DNA, 20 bp, Artificial Sequence
  Description of Artificial Sequence: Synthetic oligonucleotide
  Target: SCN10A; (+) strand; PAM type: YTN; PAM sequence: TTC
ctaaatttatttacattcca

SEQ ID NO: 70972 - DNA, 20 bp, Artificial Sequence
  Description of Artificial Sequence: Synthetic oligonucleotide
  Target: SCN10A; (+) strand; PAM type: YTN; PAM sequence: CTA
aatttatttacattccaggt

SEQ ID NO: 70973 - DNA, 20 bp, Artificial Sequence
  Description of Artificial Sequence: Synthetic oligonucleotide
  Target: SCN10A; (+) strand; PAM type: YTN; PAM sequence: TTT
atttacattccaggtaaggg

SEQ ID NO: 70974 - DNA, 20 bp, Artificial Sequence
  Description of Artificial Sequence: Synthetic oligonucleotide
  Target: SCN10A; (+) strand; PAM type: YTN; PAM sequence: TTA
tttacattccaggtaagggt

SEQ ID NO: 70975 - DNA, 20 bp, Artificial Sequence
  Description of Artificial Sequence: Synthetic oligonucleotide
  Target: SCN10A; (+) strand; PAM type: YTN; PAM sequence: TTT
acattccaggtaagggtaaa

SEQ ID NO: 70976 - DNA, 20 bp, Artificial Sequence
  Description of Artificial Sequence: Synthetic oligonucleotide
  Target: SCN10A; (+) strand; PAM type: YTN; PAM sequence: TTA
cattccaggtaagggtaaat

SEQ ID NO: 70977 - DNA, 20 bp, Artificial Sequence
  Description of Artificial Sequence: Synthetic oligonucleotide
  Target: SCN10A; (+) strand; PAM type: YTN; PAM sequence: TTC
caggtaagggtaaattcttc

SEQ ID NO: 70978 - DNA, 20 bp, Artificial Sequence
  Description of Artificial Sequence: Synthetic oligonucleotide
  Target: SCN10A; (+) strand; PAM type: YTN; PAM sequence: TTC
ttctcctgtgatctggattt

SEQ ID NO: 70979 - DNA, 20 bp, Artificial Sequence
  Description of Artificial Sequence: Synthetic oligonucleotide
  Target: SCN10A; (+) strand; PAM type: YTN; PAM sequence: CTT
ctcctgtgatctggattttc

SEQ ID NO: 70980 - DNA, 20 bp, Artificial Sequence
  Description of Artificial Sequence: Synthetic oligonucleotide
  Target: SCN10A; (+) strand; PAM type: YTN; PAM sequence: TTC
tcctgtgatctggattttca

SEQ ID NO: 70981 - DNA, 20 bp, Artificial Sequence
  Description of Artificial Sequence: Synthetic oligonucleotide
  Target: SCN10A; (+) strand; PAM type: YTN; PAM sequence: CTC
ctgtgatctggattttcaga

SEQ ID NO: 70982 - DNA, 20 bp, Artificial Sequence
  Description of Artificial Sequence: Synthetic oligonucleotide
  Target: SCN10A; (+) strand; PAM type: YTN; PAM sequence: CTG
tgatctggattttcagatta

SEQ ID NO: 70983 - DNA, 20 bp, Artificial Sequence
  Description of Artificial Sequence: Synthetic oligonucleotide
  Target: SCN10A; (+) strand; PAM type: YTN; PAM sequence: CTG
gattttcagattacccagtt

SEQ ID NO: 70984 - DNA, 20 bp, Artificial Sequence
  Description of Artificial Sequence: Synthetic oligonucleotide
  Target: SCN10A; (+) strand; PAM type: YTN; PAM sequence: TTT
tcagattacccagttgggat

SEQ ID NO: 70985 - DNA, 20 bp, Artificial Sequence
  Description of Artificial Sequence: Synthetic oligonucleotide
  Target: SCN10A; (+) strand; PAM type: YTN; PAM sequence: TTT
cagattacccagttgggatg

SEQ ID NO: 70986 - DNA, 20 bp, Artificial Sequence
  Description of Artificial Sequence: Synthetic oligonucleotide
  Target: SCN10A; (+) strand; PAM type: YTN; PAM sequence: TTC
agattacccagttgggatgt

SEQ ID NO: 70987 - DNA, 20 bp, Artificial Sequence
  Description of Artificial Sequence: Synthetic oligonucleotide
  Target: SCN10A; (+) strand; PAM type: YTN; PAM sequence: TTA
cccagttgggatgtatgttt

SEQ ID NO: 70988 - DNA, 20 bp, Artificial Sequence
  Description of Artificial Sequence: Synthetic oligonucleotide
  Target: SCN10A; (+) strand; PAM type: YTN; PAM sequence: TTG
ggatgtatgtttggaggcag

SEQ ID NO: 70989 - DNA, 20 bp, Artificial Sequence
  Description of Artificial Sequence: Synthetic oligonucleotide
  Target: SCN10A; (+) strand; PAM type: YTN; PAM sequence: TTT
ggaggcaggtttccccccct

SEQ ID NO: 70990 - DNA, 20 bp, Artificial Sequence
  Description of Artificial Sequence: Synthetic oligonucleotide
  Target: SCN10A; (+) strand; PAM type: YTN; PAM sequence: TTG
gaggcaggtttccccccctc

SEQ ID NO: 70991 - DNA, 20 bp, Artificial Sequence
  Description of Artificial Sequence: Synthetic oligonucleotide
  Target: SCN10A; (+) strand; PAM type: YTN; PAM sequence: TTT
ccccccctcacactttggga

SEQ ID NO: 70992 - DNA, 20 bp, Artificial Sequence
  Description of Artificial Sequence: Synthetic oligonucleotide
  Target: SCN10A; (+) strand; PAM type: YTN; PAM sequence: TTC
cccccctcacactttgggag

SEQ ID NO: 70993 - DNA, 20 bp, Artificial Sequence
  Description of Artificial Sequence: Synthetic oligonucleotide
  Target: SCN10A; (+) strand; PAM type: YTN; PAM sequence: CTC
acactttgggagctcacagt

SEQ ID NO: 70994 - DNA, 20 bp, Artificial Sequence
  Description of Artificial Sequence: Synthetic oligonucleotide
  Target: SCN10A; (+) strand; PAM type: YTN; PAM sequence: CTT
tgggagctcacagtttttca

SEQ ID NO: 70995 - DNA, 20 bp, Artificial Sequence
  Description of Artificial Sequence: Synthetic oligonucleotide
  Target: SCN10A; (+) strand; PAM type: YTN; PAM sequence: TTT
gggagctcacagtttttcac

SEQ ID NO: 70996 - DNA, 20 bp, Artificial Sequence
  Description of Artificial Sequence: Synthetic oligonucleotide
  Target: SCN10A; (+) strand; PAM type: YTN; PAM sequence: TTG
ggagctcacagtttttcacc

SEQ ID NO: 70997 - DNA, 20 bp, Artificial Sequence
  Description of Artificial Sequence: Synthetic oligonucleotide
  Target: SCN10A; (+) strand; PAM type: YTN; PAM sequence: CTC
acagtttttcacctgtcttg

SEQ ID NO: 70998 - DNA, 20 bp, Artificial Sequence
  Description of Artificial Sequence: Synthetic oligonucleotide
  Target: SCN10A; (+) strand; PAM type: YTN; PAM sequence: TTT
ttcacctgtcttgcagaatt

SEQ ID NO: 70999 - DNA, 20 bp, Artificial Sequence
  Description of Artificial Sequence: Synthetic oligonucleotide
  Target: SCN10A; (+) strand; PAM type: YTN; PAM sequence: TTT
tcacctgtcttgcagaattt

SEQ ID NO: 71000 - DNA, 20 bp, Artificial Sequence
  Description of Artificial Sequence: Synthetic oligonucleotide
  Target: SCN10A; (+) strand; PAM type: YTN; PAM sequence: TTT
cacctgtcttgcagaatttc

SEQ ID NO: 71001 - DNA, 20 bp, Artificial Sequence
  Description of Artificial Sequence: Synthetic oligonucleotide
  Target: SCN10A; (+) strand; PAM type: YTN; PAM sequence: TTC
acctgtcttgcagaatttcc

SEQ ID NO: 71002 - DNA, 20 bp, Artificial Sequence
  Description of Artificial Sequence: Synthetic oligonucleotide
  Target: SCN10A; (+) strand; PAM type: YTN; PAM sequence: CTG
tcttgcagaatttccagcag

SEQ ID NO: 71003 - DNA, 20 bp, Artificial Sequence
  Description of Artificial Sequence: Synthetic oligonucleotide
  Target: SCN10A; (+) strand; PAM type: YTN; PAM sequence: CTT
gcagaatttccagcagtgtg

SEQ ID NO: 71004 - DNA, 20 bp, Artificial Sequence
  Description of Artificial Sequence: Synthetic oligonucleotide
  Target: SCN10A; (+) strand; PAM type: YTN; PAM sequence: TTG
cagaatttccagcagtgtgc

SEQ ID NO: 71005 - DNA, 20 bp, Artificial Sequence
  Description of Artificial Sequence: Synthetic oligonucleotide
  Target: SCN10A; (+) strand; PAM type: YTN; PAM sequence: TTT
ccagcagtgtgccacttatt

SEQ ID NO: 71006 - DNA, 20 bp, Artificial Sequence
  Description of Artificial Sequence: Synthetic oligonucleotide
  Target: SCN10A; (+) strand; PAM type: YTN; PAM sequence: TTC
cagcagtgtgccacttattt

SEQ ID NO: 71007 - DNA, 20 bp, Artificial Sequence
  Description of Artificial Sequence: Synthetic oligonucleotide
  Target: SCN10A; (+) strand; PAM type: YTN; PAM sequence: CTT
atttaaaaggatctatgaat

SEQ ID NO: 71008 - DNA, 20 bp, Artificial Sequence
  Description of Artificial Sequence: Synthetic oligonucleotide
  Target: SCN10A; (+) strand; PAM type: YTN; PAM sequence: TTA
tttaaaaggatctatgaatt

SEQ ID NO: 71009 - DNA, 20 bp, Artificial Sequence
  Description of Artificial Sequence: Synthetic oligonucleotide
  Target: SCN10A; (+) strand; PAM type: YTN; PAM sequence: TTT
aaaaggatctatgaattctt

SEQ ID NO: 71010 - DNA, 20 bp, Artificial Sequence
  Description of Artificial Sequence: Synthetic oligonucleotide
  Target: SCN10A; (+) strand; PAM type: YTN; PAM sequence: TTA
aaaggatctatgaattcttt

SEQ ID NO: 71011 - DNA, 20 bp, Artificial Sequence
  Description of Artificial Sequence: Synthetic oligonucleotide
  Target: SCN10A; (+) strand; PAM type: YTN; PAM sequence: CTA
tgaattctttcagttctcct

SEQ ID NO: 71012 - DNA, 20 bp, Artificial Sequence
  Description of Artificial Sequence: Synthetic oligonucleotide
  Target: SCN10A; (+) strand; PAM type: YTN; PAM sequence: TTC
tttcagttctcctggtatat

SEQ ID NO: 71013 - DNA, 20 bp, Artificial Sequence
  Description of Artificial Sequence: Synthetic oligonucleotide
  Target: SCN10A; (+) strand; PAM type: YTN; PAM sequence: CTT
tcagttctcctggtatattc

SEQ ID NO: 71014 - DNA, 20 bp, Artificial Sequence
  Description of Artificial Sequence: Synthetic oligonucleotide
  Target: SCN10A; (+) strand; PAM type: YTN; PAM sequence: TTT
cagttctcctggtatattcc

SEQ ID NO: 71015 - DNA, 20 bp, Artificial Sequence
  Description of Artificial Sequence: Synthetic oligonucleotide
  Target: SCN10A; (+) strand; PAM type: YTN; PAM sequence: TTC
agttctcctggtatattcct

SEQ ID NO: 71016 - DNA, 20 bp, Artificial Sequence
  Description of Artificial Sequence: Synthetic oligonucleotide
  Target: SCN10A; (+) strand; PAM type: YTN; PAM sequence: TTC
tcctggtatattcctgcagt

SEQ ID NO: 71017 - DNA, 20 bp, Artificial Sequence
  Description of Artificial Sequence: Synthetic oligonucleotide
  Target: SCN10A; (+) strand; PAM type: YTN; PAM sequence: CTC
ctggtatattcctgcagtgg

SEQ ID NO: 71018 - DNA, 20 bp, Artificial Sequence
  Description of Artificial Sequence: Synthetic oligonucleotide
  Target: SCN10A; (+) strand; PAM type: YTN; PAM sequence: CTG
gtatattcctgcagtggttc

SEQ ID NO: 71019 - DNA, 20 bp, Artificial Sequence
  Description of Artificial Sequence: Synthetic oligonucleotide
  Target: SCN10A; (+) strand; PAM type: YTN; PAM sequence: TTC
ctgcagtggttcttggagca

SEQ ID NO: 71020 - DNA, 20 bp, Artificial Sequence
  Description of Artificial Sequence: Synthetic oligonucleotide
  Target: SCN10A; (+) strand; PAM type: YTN; PAM sequence: CTG
cagtggttcttggagcaaac

SEQ ID NO: 71021 - DNA, 20 bp, Artificial Sequence
  Description of Artificial Sequence: Synthetic oligonucleotide
  Target: SCN10A; (+) strand; PAM type: YTN; PAM sequence: TTC
ttggagcaaacgttcatggt

SEQ ID NO: 71022 - DNA, 20 bp, Artificial Sequence
  Description of Artificial Sequence: Synthetic oligonucleotide
  Target: SCN10A; (+) strand; PAM type: YTN; PAM sequence: CTT
ggagcaaacgttcatggtgt

SEQ ID NO: 71023 - DNA, 20 bp, Artificial Sequence
  Description of Artificial Sequence: Synthetic oligonucleotide
  Target: SCN10A; (+) strand; PAM type: YTN; PAM sequence: TTG
gagcaaacgttcatggtgtg

SEQ ID NO: 71024 - DNA, 20 bp, Artificial Sequence
  Description of Artificial Sequence: Synthetic oligonucleotide
  Target: SCN10A; (+) strand; PAM type: YTN; PAM sequence: TTC
atggtgtgagtctccacact

SEQ ID NO: 71025 - DNA, 20 bp, Artificial Sequence
  Description of Artificial Sequence: Synthetic oligonucleotide
  Target: SCN10A; (+) strand; PAM type: YTN; PAM sequence: CTC
cacactctgtccaagtggga

SEQ ID NO: 71026 - DNA, 20 bp, Artificial Sequence
  Description of Artificial Sequence: Synthetic oligonucleotide
  Target: SCN10A; (+) strand; PAM type: YTN; PAM sequence: CTC
tgtccaagtgggacctgcat

SEQ ID NO: 71027 - DNA, 20 bp, Artificial Sequence
  Description of Artificial Sequence: Synthetic oligonucleotide
  Target: SCN10A; (+) strand; PAM type: YTN; PAM sequence: CTG
tccaagtgggacctgcatgt

SEQ ID NO: 71028 - DNA, 20 bp, Artificial Sequence
  Description of Artificial Sequence: Synthetic oligonucleotide
  Target: SCN10A; (+) strand; PAM type: YTN; PAM sequence: CTG
catgttagccctgtctccta

SEQ ID NO: 71029 - DNA, 20 bp, Artificial Sequence
  Description of Artificial Sequence: Synthetic oligonucleotide
  Target: SCN10A; (+) strand; PAM type: YTN; PAM sequence: TTA
gccctgtctcctacccacca

SEQ ID NO: 71030 - DNA, 20 bp, Artificial Sequence
  Description of Artificial Sequence: Synthetic oligonucleotide
  Target: SCN10A; (+) strand; PAM type: YTN; PAM sequence: CTG
tctcctacccaccattttgt

SEQ ID NO: 71031 - DNA, 20 bp, Artificial Sequence
  Description of Artificial Sequence: Synthetic oligonucleotide
  Target: SCN10A; (+) strand; PAM type: YTN; PAM sequence: CTC
ctacccaccattttgtcccc

SEQ ID NO: 71032 - DNA, 20 bp, Artificial Sequence
  Description of Artificial Sequence: Synthetic oligonucleotide
  Target: SCN10A; (+) strand; PAM type: YTN; PAM sequence: CTA
cccaccattttgtcccctct

SEQ ID NO: 71033 - DNA, 20 bp, Artificial Sequence
  Description of Artificial Sequence: Synthetic oligonucleotide
  Target: SCN10A; (+) strand; PAM type: YTN; PAM sequence: TTT
tgtcccctctcctatcacac

SEQ ID NO: 71034 - DNA, 20 bp, Artificial Sequence
  Description of Artificial Sequence: Synthetic oligonucleotide
  Target: SCN10A; (+) strand; PAM type: YTN; PAM sequence: TTT
gtcccctctcctatcacaca

SEQ ID NO: 71035 - DNA, 20 bp, Artificial Sequence
  Description of Artificial Sequence: Synthetic oligonucleotide
  Target: SCN10A; (+) strand; PAM type: YTN; PAM sequence: TTG
tcccctctcctatcacacat

SEQ ID NO: 71036 - DNA, 20 bp, Artificial Sequence
  Description of Artificial Sequence: Synthetic oligonucleotide
  Target: SCN10A; (+) strand; PAM type: YTN; PAM sequence: CTC
tcctatcacacatgcagatc

SEQ ID NO: 71037 - DNA, 20 bp, Artificial Sequence
  Description of Artificial Sequence: Synthetic oligonucleotide
  Target: SCN10A; (+) strand; PAM type: YTN; PAM sequence: CTC
ctatcacacatgcagatctg

SEQ ID NO: 71038 - DNA, 20 bp, Artificial Sequence
  Description of Artificial Sequence: Synthetic oligonucleotide
  Target: SCN10A; (+) strand; PAM type: YTN; PAM sequence: CTA
tcacacatgcagatctgcat

SEQ ID NO: 71039 - DNA, 20 bp, Artificial Sequence
  Description of Artificial Sequence: Synthetic oligonucleotide
  Target: SCN10A; (+) strand; PAM type: YTN; PAM sequence: CTG
catagagatatactcacgcc

SEQ ID NO: 71040 - DNA, 20 bp, Artificial Sequence
  Description of Artificial Sequence: Synthetic oligonucleotide
  Target: SCN10A; (+) strand; PAM type: YTN; PAM sequence: CTC
acgccagggtaatgacgcta

SEQ ID NO: 71041 - DNA, 20 bp, Artificial Sequence
  Description of Artificial Sequence: Synthetic oligonucleotide
  Target: SCN10A; (+) strand; PAM type: YTN; PAM sequence: CTA
aaatccagccagttccaagg

SEQ ID NO: 71042 - DNA, 20 bp, Artificial Sequence
  Description of Artificial Sequence: Synthetic oligonucleotide
  Target: SCN10A; (+) strand; PAM type: YTN; PAM sequence: TTC
caaggatctctcaggtacgt

SEQ ID NO: 71043 - DNA, 20 bp, Artificial Sequence
  Description of Artificial Sequence: Synthetic oligonucleotide
  Target: SCN10A; (+) strand; PAM type: YTN; PAM sequence: CTC
tcaggtacgtgaactcattt

SEQ ID NO: 71044 - DNA, 20 bp, Artificial Sequence
  Description of Artificial Sequence: Synthetic oligonucleotide
  Target: SCN10A; (+) strand; PAM type: YTN; PAM sequence: CTC
aggtacgtgaactcatttag

SEQ ID NO: 71045 - DNA, 20 bp, Artificial Sequence
  Description of Artificial Sequence: Synthetic oligonucleotide
  Target: SCN10A; (+) strand; PAM type: YTN; PAM sequence: CTC
atttagacaaaatcctcttg

SEQ ID NO: 71046 - DNA, 20 bp, Artificial Sequence
  Description of Artificial Sequence: Synthetic oligonucleotide
  Target: SCN10A; (+) strand; PAM type: YTN; PAM sequence: TTT
agacaaaatcctcttgccag

SEQ ID NO: 71047 - DNA, 20 bp, Artificial Sequence
  Description of Artificial Sequence: Synthetic oligonucleotide
  Target: SCN10A; (+) strand; PAM type: YTN; PAM sequence: TTA
gacaaaatcctcttgccagt

SEQ ID NO: 71048 - DNA, 20 bp, Artificial Sequence
  Description of Artificial Sequence: Synthetic oligonucleotide
  Target: SCN10A; (+) strand; PAM type: YTN; PAM sequence: CTC
ttgccagtatctttatcaag

SEQ ID NO: 71049 - DNA, 20 bp, Artificial Sequence
  Description of Artificial Sequence: Synthetic oligonucleotide
  Target: SCN10A; (+) strand; PAM type: YTN; PAM sequence: CTT
gccagtatctttatcaaggc

SEQ ID NO: 71050 - DNA, 20 bp, Artificial Sequence
  Description of Artificial Sequence: Synthetic oligonucleotide
  Target: SCN10A; (+) strand; PAM type: YTN; PAM sequence: TTG
ccagtatctttatcaaggct

SEQ ID NO: 71051 - DNA, 20 bp, Artificial Sequence
  Description of Artificial Sequence: Synthetic oligonucleotide
  Target: SCN10A; (+) strand; PAM type: YTN; PAM sequence: CTT
tatcaaggcttcaaaggtgt

SEQ ID NO: 71052 - DNA, 20 bp, Artificial Sequence
  Description of Artificial Sequence: Synthetic oligonucleotide
  Target: SCN10A; (+) strand; PAM type: YTN; PAM sequence: TTT
atcaaggcttcaaaggtgta

SEQ ID NO: 71053 - DNA, 20 bp, Artificial Sequence
  Description of Artificial Sequence: Synthetic oligonucleotide
  Target: SCN10A; (+) strand; PAM type: YTN; PAM sequence: TTA
tcaaggcttcaaaggtgtaa

SEQ ID NO: 71054 - DNA, 20 bp, Artificial Sequence
  Description of Artificial Sequence: Synthetic oligonucleotide
  Target: SCN10A; (+) strand; PAM type: YTN; PAM sequence: CTT
caaaggtgtaaatgacagtg

SEQ ID NO: 71055 - DNA, 20 bp, Artificial Sequence
  Description of Artificial Sequence: Synthetic oligonucleotide
  Target: SCN10A; (+) strand; PAM type: YTN; PAM sequence: TTC
aaaggtgtaaatgacagtga

SEQ ID NO: 71056 - DNA, 20 bp, Artificial Sequence
  Description of Artificial Sequence: Synthetic oligonucleotide
  Target: SCN10A; (+) strand; PAM type: YTN; PAM sequence: CTG
ggaaggagggtagaaaagga

SEQ ID NO: 71057 - DNA, 20 bp, Artificial Sequence
  Description of Artificial Sequence: Synthetic oligonucleotide
  Target: SCN10A; (+) strand; PAM type: YTN; PAM sequence: CTG
tgccatggagtgtactcagg

SEQ ID NO: 71058 - DNA, 20 bp, Artificial Sequence
  Description of Artificial Sequence: Synthetic oligonucleotide
  Target: SCN10A; (+) strand; PAM type: YTN; PAM sequence: CTC
agggggttccttcttccagg

SEQ ID NO: 71059 - DNA, 20 bp, Artificial Sequence
  Description of Artificial Sequence: Synthetic oligonucleotide
  Target: SCN10A; (+) strand; PAM type: YTN; PAM sequence: TTC
cttcttccaggagggaggga

SEQ ID NO: 71060 - DNA, 20 bp, Artificial Sequence
  Description of Artificial Sequence: Synthetic oligonucleotide
  Target: SCN10A; (+) strand; PAM type: YTN; PAM sequence: CTT
cttccaggagggagggatga

SEQ ID NO: 71061 - DNA, 20 bp, Artificial Sequence
  Description of Artificial Sequence: Synthetic oligonucleotide
  Target: SCN10A; (+) strand; PAM type: YTN; PAM sequence: TTC
ttccaggagggagggatgac

SEQ ID NO: 71062 - DNA, 20 bp, Artificial Sequence
  Description of Artificial Sequence: Synthetic oligonucleotide
  Target: SCN10A; (+) strand; PAM type: YTN; PAM sequence: CTT
ccaggagggagggatgacct

SEQ ID NO: 71063 - DNA, 20 bp, Artificial Sequence
  Description of Artificial Sequence: Synthetic oligonucleotide
  Target: SCN10A; (+) strand; PAM type: YTN; PAM sequence: TTC
caggagggagggatgacctg

SEQ ID NO: 71064 - DNA, 20 bp, Artificial Sequence
  Description of Artificial Sequence: Synthetic oligonucleotide
  Target: SCN10A; (+) strand; PAM type: YTN; PAM sequence: CTG
ctctgactgctccaagaaaa

SEQ ID NO: 71065 - DNA, 20 bp, Artificial Sequence
  Description of Artificial Sequence: Synthetic oligonucleotide
  Target: SCN10A; (+) strand; PAM type: YTN; PAM sequence: CTC
tgactgctccaagaaaaaac

SEQ ID NO: 71066 - DNA, 20 bp, Artificial Sequence
  Description of Artificial Sequence: Synthetic oligonucleotide
  Target: SCN10A; (+) strand; PAM type: YTN; PAM sequence: CTG
actgctccaagaaaaaacat

SEQ ID NO: 71067 - DNA, 20 bp, Artificial Sequence
  Description of Artificial Sequence: Synthetic oligonucleotide
  Target: SCN10A; (+) strand; PAM type: YTN; PAM sequence: CTG
ctccaagaaaaaacatgcaa

SEQ ID NO: 71068 - DNA, 20 bp, Artificial Sequence
  Description of Artificial Sequence: Synthetic oligonucleotide
  Target: SCN10A; (+) strand; PAM type: YTN; PAM sequence: CTC
caagaaaaaacatgcaaaga

SEQ ID NO: 71069 - DNA, 20 bp, Artificial Sequence
  Description of Artificial Sequence: Synthetic oligonucleotide
  Target: SCN10A; (+) strand; PAM type: YTN; PAM sequence: CTG
agggaaaaagaagggccaca

SEQ ID NO: 71070 - DNA, 20 bp, Artificial Sequence
  Description of Artificial Sequence: Synthetic oligonucleotide
  Target: SCN10A; (+) strand; PAM type: YTN; PAM sequence: CTG
ggacagccagcagcttctgc

SEQ ID NO: 71071 - DNA, 20 bp, Artificial Sequence
  Description of Artificial Sequence: Synthetic oligonucleotide
  Target: SCN10A; (+) strand; PAM type: YTN; PAM sequence: CTT
ctgctgttctggggttaggc

SEQ ID NO: 71072 - DNA, 20 bp, Artificial Sequence
  Description of Artificial Sequence: Synthetic oligonucleotide
  Target: SCN10A; (+) strand; PAM type: YTN; PAM sequence: TTC
tgctgttctggggttaggca

SEQ ID NO: 71073 - DNA, 20 bp, Artificial Sequence
  Description of Artificial Sequence: Synthetic oligonucleotide
  Target: SCN10A; (+) strand; PAM type: YTN; PAM sequence: CTG
ctgttctggggttaggcaga

SEQ ID NO: 71074 - DNA, 20 bp, Artificial Sequence
  Description of Artificial Sequence: Synthetic oligonucleotide
  Target: SCN10A; (+) strand; PAM type: YTN; PAM sequence: CTG
ttctggggttaggcagaggg

SEQ ID NO: 71075 - DNA, 20 bp, Artificial Sequence
  Description of Artificial Sequence: Synthetic oligonucleotide
  Target: SCN10A; (+) strand; PAM type: YTN; PAM sequence: TTC
tggggttaggcagagggcag

SEQ ID NO: 71076 - DNA, 20 bp, Artificial Sequence
  Description of Artificial Sequence: Synthetic oligonucleotide
  Target: SCN10A; (+) strand; PAM type: YTN; PAM sequence: CTG
gggttaggcagagggcagta

SEQ ID NO: 71077 - DNA, 20 bp, Artificial Sequence
  Description of Artificial Sequence: Synthetic oligonucleotide
  Target: SCN10A; (+) strand; PAM type: YTN; PAM sequence: TTA
ggcagagggcagtagcgggt

SEQ ID NO: 71078 - DNA, 20 bp, Artificial Sequence
  Description of Artificial Sequence: Synthetic oligonucleotide
  Target: SCN10A; (+) strand; PAM type: YTN; PAM sequence: TTC
tcctgtttatgtctgccagg

SEQ ID NO: 71079 - DNA, 20 bp, Artificial Sequence
  Description of Artificial Sequence: Synthetic oligonucleotide
  Target: SCN10A; (+) strand; PAM type: YTN; PAM sequence: CTC
ctgtttatgtctgccagggc

SEQ ID NO: 71080 - DNA, 20 bp, Artificial Sequence
  Description of Artificial Sequence: Synthetic oligonucleotide
  Target: SCN10A; (+) strand; PAM type: YTN; PAM sequence: CTG
tttatgtctgccagggcctc

SEQ ID NO: 71081 - DNA, 20 bp, Artificial Sequence
  Description of Artificial Sequence: Synthetic oligonucleotide
  Target: SCN10A; (+) strand; PAM type: YTN; PAM sequence: TTT
atgtctgccagggcctccct

SEQ ID NO: 71082 - DNA, 20 bp, Artificial Sequence
  Description of Artificial Sequence: Synthetic oligonucleotide
  Target: SCN10A; (+) strand; PAM type: YTN; PAM sequence: TTA
tgtctgccagggcctcccta

SEQ ID NO: 71083 - DNA, 20 bp, Artificial Sequence
  Description of Artificial Sequence: Synthetic oligonucleotide
  Target: SCN10A; (+) strand; PAM type: YTN; PAM sequence: CTG
ccagggcctccctatcctgc

SEQ ID NO: 71084 - DNA, 20 bp, Artificial Sequence
  Description of Artificial Sequence: Synthetic oligonucleotide
  Target: SCN10A; (+) strand; PAM type: YTN; PAM sequence: CTC
cctatcctgcaagaagctgg

SEQ ID NO: 71085 - DNA, 20 bp, Artificial Sequence
  Description of Artificial Sequence: Synthetic oligonucleotide
  Target: SCN10A; (+) strand; PAM type: YTN; PAM sequence: CTA
tcctgcaagaagctggaggc

SEQ ID NO: 71086 - DNA, 20 bp, Artificial Sequence
  Description of Artificial Sequence: Synthetic oligonucleotide
  Target: SCN10A; (+) strand; PAM type: YTN; PAM sequence: CTG
caagaagctggaggctcatc

SEQ ID NO: 71087 - DNA, 20 bp, Artificial Sequence
  Description of Artificial Sequence: Synthetic oligonucleotide
  Target: SCN10A; (+) strand; PAM type: YTN; PAM sequence: CTG
gaggctcatctaaaaactcc

SEQ ID NO: 71088 - DNA, 20 bp, Artificial Sequence
  Description of Artificial Sequence: Synthetic oligonucleotide
  Target: SCN10A; (+) strand; PAM type: YTN; PAM sequence: CTC
atctaaaaactcccagtttt

SEQ ID NO: 71089 - DNA, 20 bp, Artificial Sequence
  Description of Artificial Sequence: Synthetic oligonucleotide
  Target: SCN10A; (+) strand; PAM type: YTN; PAM sequence: CTA
aaaactcccagtttttagaa

SEQ ID NO: 71090 - DNA, 20 bp, Artificial Sequence
  Description of Artificial Sequence: Synthetic oligonucleotide
  Target: SCN10A; (+) strand; PAM type: YTN; PAM sequence: CTC
ccagtttttagaaactggag

SEQ ID NO: 71091 - DNA, 20 bp, Artificial Sequence
  Description of Artificial Sequence: Synthetic oligonucleotide
  Target: SCN10A; (+) strand; PAM type: YTN; PAM sequence: TTT
ttagaaactggagtgcagac

SEQ ID NO: 71092 - DNA, 20 bp, Artificial Sequence
  Description of Artificial Sequence: Synthetic oligonucleotide
  Target: SCN10A; (+) strand; PAM type: YTN; PAM sequence: TTT
tagaaactggagtgcagact

SEQ ID NO: 71093 - DNA, 20 bp, Artificial Sequence
  Description of Artificial Sequence: Synthetic oligonucleotide
  Target: SCN10A; (+) strand; PAM type: YTN; PAM sequence: TTT
agaaactggagtgcagactg

SEQ ID NO: 71094 - DNA, 20 bp, Artificial Sequence
  Description of Artificial Sequence: Synthetic oligonucleotide
  Target: SCN10A; (+) strand; PAM type: YTN; PAM sequence: TTA
gaaactggagtgcagactga

SEQ ID NO: 71095 - DNA, 20 bp, Artificial Sequence
  Description of Artificial Sequence: Synthetic oligonucleotide
  Target: SCN10A; (+) strand; PAM type: YTN; PAM sequence: CTG
gagtgcagactgatgagtgg

SEQ ID NO: 71096 - DNA, 20 bp, Artificial Sequence
  Description of Artificial Sequence: Synthetic oligonucleotide
  Target: SCN10A; (+) strand; PAM type: YTN; PAM sequence: CTG
atgagtggtaactgacagag

SEQ ID NO: 71097 - DNA, 20 bp, Artificial Sequence
  Description of Artificial Sequence: Synthetic oligonucleotide
  Target: SCN10A; (+) strand; PAM type: YTN; PAM sequence: CTG
acagagcagacctaagaaag

SEQ ID NO: 71098 - DNA, 20 bp, Artificial Sequence
  Description of Artificial Sequence: Synthetic oligonucleotide
  Target: SCN10A; (+) strand; PAM type: YTN; PAM sequence: CTA
agaaagctgaaaactggctg

SEQ ID NO: 71099 - DNA, 20 bp, Artificial Sequence
  Description of Artificial Sequence: Synthetic oligonucleotide
  Target: SCN10A; (+) strand; PAM type: YTN; PAM sequence: CTG
aaaactggctgaagcaggga

SEQ ID NO: 71100 - DNA, 20 bp, Artificial Sequence
  Description of Artificial Sequence: Synthetic oligonucleotide
  Target: SCN10A; (+) strand; PAM type: YTN; PAM sequence: CTG
gctgaagcagggaataccca

SEQ ID NO: 71101 - DNA, 20 bp, Artificial Sequence
  Description of Artificial Sequence: Synthetic oligonucleotide
  Target: SCN10A; (+) strand; PAM type: YTN; PAM sequence: CTG
aagcagggaatacccagaag

SEQ ID NO: 71102 - DNA, 20 bp, Artificial Sequence
  Description of Artificial Sequence: Synthetic oligonucleotide
  Target: SCN10A; (+) strand; PAM type: YTN; PAM sequence: CTA
tgctgcagagccccagaact

SEQ ID NO: 71103 - DNA, 20 bp, Artificial Sequence
  Description of Artificial Sequence: Synthetic oligonucleotide
  Target: SCN10A; (+) strand; PAM type: YTN; PAM sequence: CTG
cagagccccagaactgcttg

SEQ ID NO: 71104 - DNA, 20 bp, Artificial Sequence
  Description of Artificial Sequence: Synthetic oligonucleotide
  Target: SCN10A; (+) strand; PAM type: YTN; PAM sequence: CTG
cttggaacttagagatgcta

SEQ ID NO: 71105 - DNA, 20 bp, Artificial Sequence
  Description of Artificial Sequence: Synthetic oligonucleotide
  Target: SCN10A; (+) strand; PAM type: YTN; PAM sequence: CTT
ggaacttagagatgctaagt

SEQ ID NO: 71106 - DNA, 20 bp, Artificial Sequence
  Description of Artificial Sequence: Synthetic oligonucleotide
  Target: SCN10A; (+) strand; PAM type: YTN; PAM sequence: TTG
gaacttagagatgctaagta

SEQ ID NO: 71107 - DNA, 20 bp, Artificial Sequence
  Description of Artificial Sequence: Synthetic oligonucleotide
  Target: SCN10A; (+) strand; PAM type: YTN; PAM sequence: CTT
agagatgctaagtatctctg

SEQ ID NO: 71108 - DNA, 20 bp, Artificial Sequence
  Description of Artificial Sequence: Synthetic oligonucleotide
  Target: SCN10A; (+) strand; PAM type: YTN; PAM sequence: TTA
gagatgctaagtatctctga

SEQ ID NO: 71109 - DNA, 20 bp, Artificial Sequence
  Description of Artificial Sequence: Synthetic oligonucleotide
  Target: SCN10A; (+) strand; PAM type: YTN; PAM sequence: CTA
agtatctctgaaagcaaggt

SEQ ID NO: 71110 - DNA, 20 bp, Artificial Sequence
  Description of Artificial Sequence: Synthetic oligonucleotide
  Target: SCN10A; (+) strand; PAM type: YTN; PAM sequence: CTC
tgaaagcaaggtttggggga

SEQ ID NO: 71111 - DNA, 20 bp, Artificial Sequence
  Description of Artificial Sequence: Synthetic oligonucleotide
  Target: SCN10A; (+) strand; PAM type: YTN; PAM sequence: CTG
aaagcaaggtttgggggagg

SEQ ID NO: 71112 - DNA, 20 bp, Artificial Sequence
  Description of Artificial Sequence: Synthetic oligonucleotide
  Target: SCN10A; (+) strand; PAM type: YTN; PAM sequence: TTT
gggggagggtgataagtagg

SEQ ID NO: 71113 - DNA, 20 bp, Artificial Sequence
  Description of Artificial Sequence: Synthetic oligonucleotide
  Target: SCN10A; (+) strand; PAM type: YTN; PAM sequence: TTG
ggggagggtgataagtaggg

SEQ ID NO: 71114 - DNA, 20 bp, Artificial Sequence
  Description of Artificial Sequence: Synthetic oligonucleotide
  Target: SCN10A; (+) strand; PAM type: YTN; PAM sequence: CTG
aaagaattgcttgaaagttt

SEQ ID NO: 71115 - DNA, 20 bp, Artificial Sequence
  Description of Artificial Sequence: Synthetic oligonucleotide
  Target: SCN10A; (+) strand; PAM type: YTN; PAM sequence: TTG
cttgaaagttttttacagga

SEQ ID NO: 71116 - DNA, 20 bp, Artificial Sequence
  Description of Artificial Sequence: Synthetic oligonucleotide
  Target: SCN10A; (+) strand; PAM type: YTN; PAM sequence: CTT
gaaagttttttacaggaacc

SEQ ID NO: 71117 - DNA, 20 bp, Artificial Sequence
  Description of Artificial Sequence: Synthetic oligonucleotide
  Target: SCN10A; (+) strand; PAM type: YTN; PAM sequence: TTG
aaagttttttacaggaacca

SEQ ID NO: 71118 - DNA, 20 bp, Artificial Sequence
  Description of Artificial Sequence: Synthetic oligonucleotide
  Target: SCN10A; (+) strand; PAM type: YTN; PAM sequence: TTT
tttacaggaaccagttgagc

SEQ ID NO: 71119 - DNA, 20 bp, Artificial Sequence
  Description of Artificial Sequence: Synthetic oligonucleotide
  Target: SCN10A; (+) strand; PAM type: YTN; PAM sequence: TTT
ttacaggaaccagttgagct

SEQ ID NO: 71120 - DNA, 20 bp, Artificial Sequence
  Description of Artificial Sequence: Synthetic oligonucleotide
  Target: SCN10A; (+) strand; PAM type: YTN; PAM sequence: TTT
tacaggaaccagttgagctt

SEQ ID NO: 71121 - DNA, 20 bp, Artificial Sequence
  Description of Artificial Sequence: Synthetic oligonucleotide
  Target: SCN10A; (+) strand; PAM type: YTN; PAM sequence: TTT
acaggaaccagttgagcttt

SEQ ID NO: 71122 - DNA, 20 bp, Artificial Sequence
  Description of Artificial Sequence: Synthetic oligonucleotide
  Target: SCN10A; (+) strand; PAM type: YTN; PAM sequence: TTA
caggaaccagttgagctttc

SEQ ID NO: 71123 - DNA, 20 bp, Artificial Sequence
  Description of Artificial Sequence: Synthetic oligonucleotide
  Target: SCN10A; (+) strand; PAM type: YTN; PAM sequence: TTG
agctttctagatgctgcttt

SEQ ID NO: 71124 - DNA, 20 bp, Artificial Sequence
  Description of Artificial Sequence: Synthetic oligonucleotide
  Target: SCN10A; (+) strand; PAM type: YTN; PAM sequence: CTT
tctagatgctgctttatgcc

SEQ ID NO: 71125 - DNA, 20 bp, Artificial Sequence
  Description of Artificial Sequence: Synthetic oligonucleotide
  Target: SCN10A; (+) strand; PAM type: YTN; PAM sequence: TTT
ctagatgctgctttatgcca

SEQ ID NO: 71126 - DNA, 20 bp, Artificial Sequence
  Description of Artificial Sequence: Synthetic oligonucleotide
  Target: SCN10A; (+) strand; PAM type: YTN; PAM sequence: TTC
tagatgctgctttatgccat

SEQ ID NO: 71127 - DNA, 20 bp, Artificial Sequence
  Description of Artificial Sequence: Synthetic oligonucleotide
  Target: SCN10A; (+) strand; PAM type: YTN; PAM sequence: CTA
gatgctgctttatgccatcc

SEQ ID NO: 71128 - DNA, 20 bp, Artificial Sequence
  Description of Artificial Sequence: Synthetic oligonucleotide
  Target: SCN10A; (+) strand; PAM type: YTN; PAM sequence: CTG
ctttatgccatccattcaat

SEQ ID NO: 71129 - DNA, 20 bp, Artificial Sequence
  Description of Artificial Sequence: Synthetic oligonucleotide
  Target: SCN10A; (+) strand; PAM type: YTN; PAM sequence: CTT
tatgccatccattcaatgag

SEQ ID NO: 71130 - DNA, 20 bp, Artificial Sequence
  Description of Artificial Sequence: Synthetic oligonucleotide
  Target: SCN10A; (+) strand; PAM type: YTN; PAM sequence: TTT
atgccatccattcaatgaga

SEQ ID NO: 71131 - DNA, 20 bp, Artificial Sequence
  Description of Artificial Sequence: Synthetic oligonucleotide
  Target: SCN10A; (+) strand; PAM type: YTN; PAM sequence: TTA
tgccatccattcaatgagaa

SEQ ID NO: 71132 - DNA, 20 bp, Artificial Sequence
  Description of Artificial Sequence: Synthetic oligonucleotide
  Target: SCN10A; (+) strand; PAM type: YTN; PAM sequence: TTC
aatgagaaactgtttctgct

SEQ ID NO: 71133 - DNA, 20 bp, Artificial Sequence
  Description of Artificial Sequence: Synthetic oligonucleotide
  Target: SCN10A; (+) strand; PAM type: YTN; PAM sequence: CTG
tttctgctccagaaatggat

SEQ ID NO: 71134 - DNA, 20 bp, Artificial Sequence
  Description of Artificial Sequence: Synthetic oligonucleotide
  Target: SCN10A; (+) strand; PAM type: YTN; PAM sequence: TTT
ctgctccagaaatggattgg

SEQ ID NO: 71135 - DNA, 20 bp, Artificial Sequence
  Description of Artificial Sequence: Synthetic oligonucleotide
  Target: SCN10A; (+) strand; PAM type: YTN; PAM sequence: TTC
tgctccagaaatggattgga

SEQ ID NO: 71136 - DNA, 20 bp, Artificial Sequence
  Description of Artificial Sequence: Synthetic oligonucleotide
  Target: SCN10A; (+) strand; PAM type: YTN; PAM sequence: CTG
ctccagaaatggattggatg

SEQ ID NO: 71137 - DNA, 20 bp, Artificial Sequence
  Description of Artificial Sequence: Synthetic oligonucleotide
  Target: SCN10A; (+) strand; PAM type: YTN; PAM sequence: CTC
cagaaatggattggatgctc

SEQ ID NO: 71138 - DNA, 20 bp, Artificial Sequence
  Description of Artificial Sequence: Synthetic oligonucleotide
  Target: SCN10A; (+) strand; PAM type: YTN; PAM sequence: TTG
gatgctcattttcttaagag

SEQ ID NO: 71139 - DNA, 20 bp, Artificial Sequence
  Description of Artificial Sequence: Synthetic oligonucleotide
  Target: SCN10A; (+) strand; PAM type: YTN; PAM sequence: CTC
attttcttaagagttgaaga

SEQ ID NO: 71140 - DNA, 20 bp, Artificial Sequence
  Description of Artificial Sequence: Synthetic oligonucleotide
  Target: SCN10A; (+) strand; PAM type: YTN; PAM sequence: TTT
tcttaagagttgaagaagag

SEQ ID NO: 71141 - DNA, 20 bp, Artificial Sequence
  Description of Artificial Sequence: Synthetic oligonucleotide
  Target: SCN10A; (+) strand; PAM type: YTN; PAM sequence: TTT
cttaagagttgaagaagagg

SEQ ID NO: 71142 - DNA, 20 bp, Artificial Sequence
  Description of Artificial Sequence: Synthetic oligonucleotide
  Target: SCN10A; (+) strand; PAM type: YTN; PAM sequence: TTC
ttaagagttgaagaagaggg

SEQ ID NO: 71143 - DNA, 20 bp, Artificial Sequence
  Description of Artificial Sequence: Synthetic oligonucleotide
  Target: SCN10A; (+) strand; PAM type: YTN; PAM sequence: CTT
aagagttgaagaagagggaa

SEQ ID NO: 71144 - DNA, 20 bp, Artificial Sequence
  Description of Artificial Sequence: Synthetic oligonucleotide
  Target: SCN10A; (+) strand; PAM type: YTN; PAM sequence: TTA
agagttgaagaagagggaaa

SEQ ID NO: 71145 - DNA, 20 bp, Artificial Sequence
  Description of Artificial Sequence: Synthetic oligonucleotide
  Target: SCN10A; (+) strand; PAM type: YTN; PAM sequence: TTG
aagaagagggaaacagttgc

SEQ ID NO: 71146 - DNA, 20 bp, Artificial Sequence
  Description of Artificial Sequence: Synthetic oligonucleotide
  Target: SCN10A; (+) strand; PAM type: YTN; PAM sequence: TTG
catactgaaaaatgcatata

SEQ ID NO: 71147 - DNA, 20 bp, Artificial Sequence
  Description of Artificial Sequence: Synthetic oligonucleotide
  Target: SCN10A; (+) strand; PAM type: YTN; PAM sequence: CTG
aaaaatgcatataaagaaaa

SEQ ID NO: 71148 - DNA, 20 bp, Artificial Sequence
  Description of Artificial Sequence: Synthetic oligonucleotide
  Target: SCN10A; (+) strand; PAM type: YTN; PAM sequence: TTT
acctactgaaaggcaaacaa

SEQ ID NO: 71149 - DNA, 20 bp, Artificial Sequence
  Description of Artificial Sequence: Synthetic oligonucleotide
  Target: SCN10A; (+) strand; PAM type: YTN; PAM sequence: TTA
cctactgaaaggcaaacaac

SEQ ID NO: 71150 - DNA, 20 bp, Artificial Sequence
  Description of Artificial Sequence: Synthetic oligonucleotide
  Target: SCN10A; (+) strand; PAM type: YTN; PAM sequence: CTA
ctgaaaggcaaacaactccc

SEQ ID NO: 71151 - DNA, 20 bp, Artificial Sequence
  Description of Artificial Sequence: Synthetic oligonucleotide
  Target: SCN10A; (+) strand; PAM type: YTN; PAM sequence: CTG
aaaggcaaacaactcccctc

SEQ ID NO: 71152 - DNA, 20 bp, Artificial Sequence
  Description of Artificial Sequence: Synthetic oligonucleotide
  Target: SCN10A; (+) strand; PAM type: YTN; PAM sequence: CTC
ccctccctattcacttctgc

SEQ ID NO: 71153 - DNA, 20 bp, Artificial Sequence
  Description of Artificial Sequence: Synthetic oligonucleotide
  Target: SCN10A; (+) strand; PAM type: YTN; PAM sequence: CTC
cctattcacttctgctcctc

SEQ ID NO: 71154 - DNA, 20 bp, Artificial Sequence
  Description of Artificial Sequence: Synthetic oligonucleotide
  Target: SCN10A; (+) strand; PAM type: YTN; PAM sequence: CTA
ttcacttctgctcctcgtta

SEQ ID NO: 71155 - DNA, 20 bp, Artificial Sequence
  Description of Artificial Sequence: Synthetic oligonucleotide
  Target: SCN10A; (+) strand; PAM type: YTN; PAM sequence: TTC
acttctgctcctcgttaagt

SEQ ID NO: 71156 - DNA, 20 bp, Artificial Sequence
  Description of Artificial Sequence: Synthetic oligonucleotide
  Target: SCN10A; (+) strand; PAM type: YTN; PAM sequence: CTT
ctgctcctcgttaagtttcc

SEQ ID NO: 71157 - DNA, 20 bp, Artificial Sequence
  Description of Artificial Sequence: Synthetic oligonucleotide
  Target: SCN10A; (+) strand; PAM type: YTN; PAM sequence: TTC
tgctcctcgttaagtttcca

SEQ ID NO: 71158 - DNA, 20 bp, Artificial Sequence
  Description of Artificial Sequence: Synthetic oligonucleotide
  Target: SCN10A; (+) strand; PAM type: YTN; PAM sequence: CTG
ctcctcgttaagtttccaga

SEQ ID NO: 71159 - DNA, 20 bp, Artificial Sequence
  Description of Artificial Sequence: Synthetic oligonucleotide
  Target: SCN10A; (+) strand; PAM type: YTN; PAM sequence: CTC
ctcgttaagtttccagaaga

SEQ ID NO: 71160 - DNA, 20 bp, Artificial Sequence
  Description of Artificial Sequence: Synthetic oligonucleotide
  Target: SCN10A; (+) strand; PAM type: YTN; PAM sequence: CTC
gttaagtttccagaagataa

SEQ ID NO: 71161 - DNA, 20 bp, Artificial Sequence
  Description of Artificial Sequence: Synthetic oligonucleotide
  Target: SCN10A; (+) strand; PAM type: YTN; PAM sequence: TTA
agtttccagaagataatctg

SEQ ID NO: 71162 - DNA, 20 bp, Artificial Sequence
  Description of Artificial Sequence: Synthetic oligonucleotide
  Target: SCN10A; (+) strand; PAM type: YTN; PAM sequence: TTT
ccagaagataatctggttta

SEQ ID NO: 71163 - DNA, 20 bp, Artificial Sequence
  Description of Artificial Sequence: Synthetic oligonucleotide
  Target: SCN10A; (+) strand; PAM type: YTN; PAM sequence: TTC
cagaagataatctggtttag

SEQ ID NO: 71164 - DNA, 20 bp, Artificial Sequence
  Description of Artificial Sequence: Synthetic oligonucleotide
  Target: SCN10A; (+) strand; PAM type: YTN; PAM sequence: CTG
gtttagagcccatgaagatg

SEQ ID NO: 71165 - DNA, 20 bp, Artificial Sequence
  Description of Artificial Sequence: Synthetic oligonucleotide
  Target: SCN10A; (+) strand; PAM type: YTN; PAM sequence: TTT
agagcccatgaagatgctgc

SEQ ID NO: 71166 - DNA, 20 bp, Artificial Sequence
  Description of Artificial Sequence: Synthetic oligonucleotide
  Target: SCN10A; (+) strand; PAM type: YTN; PAM sequence: TTA
gagcccatgaagatgctgca

SEQ ID NO: 71167 - DNA, 20 bp, Artificial Sequence
  Description of Artificial Sequence: Synthetic oligonucleotide
  Target: SCN10A; (+) strand; PAM type: YTN; PAM sequence: CTG
cacttttaacatgaacagcc

SEQ ID NO: 71168 - DNA, 20 bp, Artificial Sequence
  Description of Artificial Sequence: Synthetic oligonucleotide
  Target: SCN10A; (+) strand; PAM type: YTN; PAM sequence: CTT
ttaacatgaacagccagcca

SEQ ID NO: 71169 - DNA, 20 bp, Artificial Sequence
  Description of Artificial Sequence: Synthetic oligonucleotide
  Target: SCN10A; (+) strand; PAM type: YTN; PAM sequence: TTT
taacatgaacagccagccaa

SEQ ID NO: 71170 - DNA, 20 bp, Artificial Sequence
  Description of Artificial Sequence: Synthetic oligonucleotide
  Target: SCN10A; (+) strand; PAM type: YTN; PAM sequence: TTT
aacatgaacagccagccaag

SEQ ID NO: 71171 - DNA, 20 bp, Artificial Sequence
  Description of Artificial Sequence: Synthetic oligonucleotide
  Target: SCN10A; (+) strand; PAM type: YTN; PAM sequence: TTA
acatgaacagccagccaagg

SEQ ID NO: 71172 - DNA, 20 bp, Artificial Sequence
  Description of Artificial Sequence: Synthetic oligonucleotide
  Target: SCN10A; (+) strand; PAM type: YTN; PAM sequence: TTT
gaaggatgcttctaacacca

SEQ ID NO: 71173 - DNA, 20 bp, Artificial Sequence
  Description of Artificial Sequence: Synthetic oligonucleotide
  Target: SCN10A; (+) strand; PAM type: YTN; PAM sequence: TTG
aaggatgcttctaacaccag

SEQ ID NO: 71174 - DNA, 20 bp, Artificial Sequence
  Description of Artificial Sequence: Synthetic oligonucleotide
  Target: SCN10A; (+) strand; PAM type: YTN; PAM sequence: CTT
ctaacaccagaaaccaaagc

SEQ ID NO: 71175 - DNA, 20 bp, Artificial Sequence
  Description of Artificial Sequence: Synthetic oligonucleotide
  Target: SCN10A; (+) strand; PAM type: YTN; PAM sequence: TTC
taacaccagaaaccaaagca

SEQ ID NO: 71176 - DNA, 20 bp, Artificial Sequence
  Description of Artificial Sequence: Synthetic oligonucleotide
  Target: SCN10A; (+) strand; PAM type: YTN; PAM sequence: CTA
acaccagaaaccaaagcaac

SEQ ID NO: 71177 - DNA, 20 bp, Artificial Sequence
  Description of Artificial Sequence: Synthetic oligonucleotide
  Target: SCN10A; (+) strand; PAM type: YTN; PAM sequence: CTG
aaaaaaaaaaaaaaaagaaa

SEQ ID NO: 71178 - DNA, 20 bp, Artificial Sequence
  Description of Artificial Sequence: Synthetic oligonucleotide
  Target: SCN10A; (+) strand; PAM type: YTN; PAM sequence: TTA
gagaaataaaactgtattgg

SEQ ID NO: 71179 - DNA, 20 bp, Artificial Sequence
  Description of Artificial Sequence: Synthetic oligonucleotide
  Target: SCN10A; (+) strand; PAM type: YTN; PAM sequence: CTG
tattggccaggcgctgtggc

SEQ ID NO: 71180 - DNA, 20 bp, Artificial Sequence
  Description of Artificial Sequence: Synthetic oligonucleotide
  Target: SCN10A; (+) strand; PAM type: YTN; PAM sequence: TTG
gccaggcgctgtggctcacg

SEQ ID NO: 71181 - DNA, 20 bp, Artificial Sequence
  Description of Artificial Sequence: Synthetic oligonucleotide
  Target: SCN10A; (+) strand; PAM type: YTN; PAM sequence: CTG
tggctcacgcctgtaatcgc

SEQ ID NO: 71182 - DNA, 20 bp, Artificial Sequence
  Description of Artificial Sequence: Synthetic oligonucleotide
  Target: SCN10A; (+) strand; PAM type: YTN; PAM sequence: CTC
acgcctgtaatcgcagcact

SEQ ID NO: 71183 - DNA, 20 bp, Artificial Sequence
  Description of Artificial Sequence: Synthetic oligonucleotide
  Target: SCN10A; (+) strand; PAM type: YTN; PAM sequence: CTG
taatcgcagcactttgggag

SEQ ID NO: 71184 - DNA, 20 bp, Artificial Sequence
  Description of Artificial Sequence: Synthetic oligonucleotide
  Target: SCN10A; (+) strand; PAM type: YTN; PAM sequence: CTT
tgggaggccgaggcgggcag

SEQ ID NO: 71185 - DNA, 20 bp, Artificial Sequence
  Description of Artificial Sequence: Synthetic oligonucleotide
  Target: SCN10A; (+) strand; PAM type: YTN; PAM sequence: TTT
gggaggccgaggcgggcaga

SEQ ID NO: 71186 - DNA, 20 bp, Artificial Sequence
  Description of Artificial Sequence: Synthetic oligonucleotide
  Target: SCN10A; (+) strand; PAM type: YTN; PAM sequence: TTG
ggaggccgaggcgggcagat

SEQ ID NO: 71187 - DNA, 20 bp, Artificial Sequence
  Description of Artificial Sequence: Synthetic oligonucleotide
  Target: SCN10A; (+) strand; PAM type: YTN; PAM sequence: TTA
cgaggtcaggagatcgagac

SEQ ID NO: 71188 - DNA, 20 bp, Artificial Sequence
  Description of Artificial Sequence: Synthetic oligonucleotide
  Target: SCN10A; (+) strand; PAM type: YTN; PAM sequence: CTG
gctaacgcggtgaaaccccg

SEQ ID NO: 71189 - DNA, 20 bp, Artificial Sequence
  Description of Artificial Sequence: Synthetic oligonucleotide
  Target: SCN10A; (+) strand; PAM type: YTN; PAM sequence: CTA
acgcggtgaaaccccgtctc

SEQ ID NO: 71190 - DNA, 20 bp, Artificial Sequence
  Description of Artificial Sequence: Synthetic oligonucleotide
  Target: SCN10A; (+) strand; PAM type: YTN; PAM sequence: CTC
tactaaaaatacaaaaaatt

SEQ ID NO: 71191 - DNA, 20 bp, Artificial Sequence
  Description of Artificial Sequence: Synthetic oligonucleotide
  Target: SCN10A; (+) strand; PAM type: YTN; PAM sequence: CTA
ctaaaaatacaaaaaattag

SEQ ID NO: 71192 - DNA, 20 bp, Artificial Sequence
  Description of Artificial Sequence: Synthetic oligonucleotide
  Target: SCN10A; (+) strand; PAM type: YTN; PAM sequence: CTA
aaaatacaaaaaattagccg

SEQ ID NO: 71193 - DNA, 20 bp, Artificial Sequence
  Description of Artificial Sequence: Synthetic oligonucleotide
  Target: SCN10A; (+) strand; PAM type: YTN; PAM sequence: TTA
gccgggcgccttggcgggca

SEQ ID NO: 71194 - DNA, 20 bp, Artificial Sequence
  Description of Artificial Sequence: Synthetic oligonucleotide
  Target: SCN10A; (+) strand; PAM type: YTN; PAM sequence: CTT
ggcgggcacctgtagttcca

SEQ ID NO: 71195 - DNA, 20 bp, Artificial Sequence
  Description of Artificial Sequence: Synthetic oligonucleotide
  Target: SCN10A; (+) strand; PAM type: YTN; PAM sequence: TTG
gcgggcacctgtagttccag

SEQ ID NO: 71196 - DNA, 20 bp, Artificial Sequence
  Description of Artificial Sequence: Synthetic oligonucleotide
  Target: SCN10A; (+) strand; PAM type: YTN; PAM sequence: CTG
tagttccagctactccggag

SEQ ID NO: 71197 - DNA, 20 bp, Artificial Sequence
  Description of Artificial Sequence: Synthetic oligonucleotide
  Target: SCN10A; (+) strand; PAM type: YTN; PAM sequence: TTC
cagctactccggaggctgag

SEQ ID NO: 71198 - DNA, 20 bp, Artificial Sequence
  Description of Artificial Sequence: Synthetic oligonucleotide
  Target: SCN10A; (+) strand; PAM type: YTN; PAM sequence: CTA
ctccggaggctgaggcggga

SEQ ID NO: 71199 - DNA, 20 bp, Artificial Sequence
  Description of Artificial Sequence: Synthetic oligonucleotide
  Target: SCN10A; (+) strand; PAM type: YTN; PAM sequence: CTC
cggaggctgaggcgggagaa

SEQ ID NO: 71200 - DNA, 20 bp, Artificial Sequence
  Description of Artificial Sequence: Synthetic oligonucleotide
  Target: SCN10A; (+) strand; PAM type: YTN; PAM sequence: CTG
aggcgggagaatggcgtgaa

SEQ ID NO: 71201 - DNA, 20 bp, Artificial Sequence
  Description of Artificial Sequence: Synthetic oligonucleotide
  Target: SCN10A; (+) strand; PAM type: YTN; PAM sequence: CTT
gcagtgagcctagatcgcgt

SEQ ID NO: 71202 - DNA, 20 bp, Artificial Sequence
  Description of Artificial Sequence: Synthetic oligonucleotide
  Target: SCN10A; (+) strand; PAM type: YTN; PAM sequence: TTG
cagtgagcctagatcgcgtc

SEQ ID NO: 71203 - DNA, 20 bp, Artificial Sequence
  Description of Artificial Sequence: Synthetic oligonucleotide
  Target: SCN10A; (+) strand; PAM type: YTN; PAM sequence: CTA
gatcgcgtcactgcactcca

SEQ ID NO: 71204 - DNA, 20 bp, Artificial Sequence
  Description of Artificial Sequence: Synthetic oligonucleotide
  Target: SCN10A; (+) strand; PAM type: YTN; PAM sequence: CTG
cactccagtctgggtgacag

SEQ ID NO: 71205 - DNA, 20 bp, Artificial Sequence
  Description of Artificial Sequence: Synthetic oligonucleotide
  Target: SCN10A; (+) strand; PAM type: YTN; PAM sequence: CTC
cagtctgggtgacagagcaa

SEQ ID NO: 71206 - DNA, 20 bp, Artificial Sequence
  Description of Artificial Sequence: Synthetic oligonucleotide
  Target: SCN10A; (+) strand; PAM type: YTN; PAM sequence: CTG
ggtgacagagcaagacttcg

SEQ ID NO: 71207 - DNA, 20 bp, Artificial Sequence
  Description of Artificial Sequence: Synthetic oligonucleotide
  Target: SCN10A; (+) strand; PAM type: YTN; PAM sequence: CTT
cgtctccaaaacaacaacaa

SEQ ID NO: 71208 - DNA, 20 bp, Artificial Sequence
  Description of Artificial Sequence: Synthetic oligonucleotide
  Target: SCN10A; (+) strand; PAM type: YTN; PAM sequence: TTC
gtctccaaaacaacaacaac

SEQ ID NO: 71209 - DNA, 20 bp, Artificial Sequence
  Description of Artificial Sequence: Synthetic oligonucleotide
  Target: SCN10A; (+) strand; PAM type: YTN; PAM sequence: CTC
caaaacaacaacaacaacag

SEQ ID NO: 71210 - DNA, 20 bp, Artificial Sequence
  Description of Artificial Sequence: Synthetic oligonucleotide
  Target: SCN10A; (+) strand; PAM type: YTN; PAM sequence: CTG
tactaatatttttagagagt

SEQ ID NO: 71211 - DNA, 20 bp, Artificial Sequence
  Description of Artificial Sequence: Synthetic oligonucleotide
  Target: SCN10A; (+) strand; PAM type: YTN; PAM sequence: CTA
atatttttagagagttaaga

SEQ ID NO: 71212 - DNA, 20 bp, Artificial Sequence
  Description of Artificial Sequence: Synthetic oligonucleotide
  Target: SCN10A; (+) strand; PAM type: YTN; PAM sequence: TTT
ttagagagttaagaggtgag

SEQ ID NO: 71213 - DNA, 20 bp, Artificial Sequence
  Description of Artificial Sequence: Synthetic oligonucleotide
  Target: SCN10A; (+) strand; PAM type: YTN; PAM sequence: TTT
tagagagttaagaggtgaga

SEQ ID NO: 71214 - DNA, 20 bp, Artificial Sequence
  Description of Artificial Sequence: Synthetic oligonucleotide
  Target: SCN10A; (+) strand; PAM type: YTN; PAM sequence: TTT
agagagttaagaggtgagaa

SEQ ID NO: 71215 - DNA, 20 bp, Artificial Sequence
  Description of Artificial Sequence: Synthetic oligonucleotide
  Target: SCN10A; (+) strand; PAM type: YTN; PAM sequence: TTA
gagagttaagaggtgagaag

SEQ ID NO: 71216 - DNA, 20 bp, Artificial Sequence
  Description of Artificial Sequence: Synthetic oligonucleotide
  Target: SCN10A; (+) strand; PAM type: YTN; PAM sequence: TTA
agaggtgagaagaggctcca

SEQ ID NO: 71217 - DNA, 20 bp, Artificial Sequence
  Description of Artificial Sequence: Synthetic oligonucleotide
  Target: SCN10A; (+) strand; PAM type: YTN; PAM sequence: CTC
cacgtatagaacaagagcag

SEQ ID NO: 71218 - DNA, 20 bp, Artificial Sequence
  Description of Artificial Sequence: Synthetic oligonucleotide
  Target: SCN10A; (+) strand; PAM type: YTN; PAM sequence: CTT
caaagacaaaatggaatttt

SEQ ID NO: 71219 - DNA, 20 bp, Artificial Sequence
  Description of Artificial Sequence: Synthetic oligonucleotide
  Target: SCN10A; (+) strand; PAM type: YTN; PAM sequence: TTC
aaagacaaaatggaattttg

SEQ ID NO: 71220 - DNA, 20 bp, Artificial Sequence
  Description of Artificial Sequence: Synthetic oligonucleotide
  Target: SCN10A; (+) strand; PAM type: YTN; PAM sequence: TTT
tgaaaacaaaaatatgatag

SEQ ID NO: 71221 - DNA, 20 bp, Artificial Sequence
  Description of Artificial Sequence: Synthetic oligonucleotide
  Target: SCN10A; (+) strand; PAM type: YTN; PAM sequence: TTT
gaaaacaaaaatatgatagc

SEQ ID NO: 71222 - DNA, 20 bp, Artificial Sequence
  Description of Artificial Sequence: Synthetic oligonucleotide
  Target: SCN10A; (+) strand; PAM type: YTN; PAM sequence: TTG
aaaacaaaaatatgatagca

SEQ ID NO: 71223 - DNA, 20 bp, Artificial Sequence
  Description of Artificial Sequence: Synthetic oligonucleotide
  Target: SCN10A; (+) strand; PAM type: YTN; PAM sequence: CTA
ataggcggacttgtaaataa

SEQ ID NO: 71224 - DNA, 20 bp, Artificial Sequence
  Description of Artificial Sequence: Synthetic oligonucleotide
  Target: SCN10A; (+) strand; PAM type: YTN; PAM sequence: CTT
gtaaataaagttttggaaat

SEQ ID NO: 71225 - DNA, 20 bp, Artificial Sequence
  Description of Artificial Sequence: Synthetic oligonucleotide
  Target: SCN10A; (+) strand; PAM type: YTN; PAM sequence: TTG
taaataaagttttggaaatc

SEQ ID NO: 71226 - DNA, 20 bp, Artificial Sequence
  Description of Artificial Sequence: Synthetic oligonucleotide
  Target: SCN10A; (+) strand; PAM type: YTN; PAM sequence: TTT
tggaaatctcacaggaagtg

SEQ ID NO: 71227 - DNA, 20 bp, Artificial Sequence
  Description of Artificial Sequence: Synthetic oligonucleotide
  Target: SCN10A; (+) strand; PAM type: YTN; PAM sequence: TTT
ggaaatctcacaggaagtgg

SEQ ID NO: 71228 - DNA, 20 bp, Artificial Sequence
  Description of Artificial Sequence: Synthetic oligonucleotide
  Target: SCN10A; (+) strand; PAM type: YTN; PAM sequence: TTG
gaaatctcacaggaagtgga

SEQ ID NO: 71229 - DNA, 20 bp, Artificial Sequence
  Description of Artificial Sequence: Synthetic oligonucleotide
  Target: SCN10A; (+) strand; PAM type: YTN; PAM sequence: CTC
acaggaagtggaacaaaaaa

SEQ ID NO: 71230 - DNA, 20 bp, Artificial Sequence
  Description of Artificial Sequence: Synthetic oligonucleotide
  Target: SCN10A; (+) strand; PAM type: YTN; PAM sequence: TTT
gaaaattagagaatcagact

SEQ ID NO: 71231 - DNA, 20 bp, Artificial Sequence
  Description of Artificial Sequence: Synthetic oligonucleotide
  Target: SCN10A; (+) strand; PAM type: YTN; PAM sequence: TTG
aaaattagagaatcagacta

SEQ ID NO: 71232 - DNA, 20 bp, Artificial Sequence
  Description of Artificial Sequence: Synthetic oligonucleotide
  Target: SCN10A; (+) strand; PAM type: YTN; PAM sequence: TTA
gagaatcagactaggaggta

SEQ ID NO: 71233 - DNA, 20 bp, Artificial Sequence
  Description of Artificial Sequence: Synthetic oligonucleotide
  Target: SCN10A; (+) strand; PAM type: YTN; PAM sequence: CTA
ggaggtatattgtttgacta

SEQ ID NO: 71234 - DNA, 20 bp, Artificial Sequence
  Description of Artificial Sequence: Synthetic oligonucleotide
  Target: SCN10A; (+) strand; PAM type: YTN; PAM sequence: TTG
tttgactaataggaggtcta

SEQ ID NO: 71235 - DNA, 20 bp, Artificial Sequence
  Description of Artificial Sequence: Synthetic oligonucleotide
  Target: SCN10A; (+) strand; PAM type: YTN; PAM sequence: TTT
gactaataggaggtctagaa

SEQ ID NO: 71236 - DNA, 20 bp, Artificial Sequence
  Description of Artificial Sequence: Synthetic oligonucleotide
  Target: SCN10A; (+) strand; PAM type: YTN; PAM sequence: TTG
actaataggaggtctagaaa

SEQ ID NO: 71237 - DNA, 20 bp, Artificial Sequence
  Description of Artificial Sequence: Synthetic oligonucleotide
  Target: SCN10A; (+) strand; PAM type: YTN; PAM sequence: CTA
ataggaggtctagaaagaaa

SEQ ID NO: 71238 - DNA, 20 bp, Artificial Sequence
  Description of Artificial Sequence: Synthetic oligonucleotide
  Target: SCN10A; (+) strand; PAM type: YTN; PAM sequence: CTA
gaaagaaattagaagacaat

SEQ ID NO: 71239 - DNA, 20 bp, Artificial Sequence
  Description of Artificial Sequence: Synthetic oligonucleotide
  Target: SCN10A; (+) strand; PAM type: YTN; PAM sequence: TTA
gaagacaatgagcaaggcct

SEQ ID NO: 71240 - DNA, 20 bp, Artificial Sequence
  Description of Artificial Sequence: Synthetic oligonucleotide
  Target: SCN10A; (+) strand; PAM type: YTN; PAM sequence: CTT
caaaattaagagggaaataa

SEQ ID NO: 71241 - DNA, 20 bp, Artificial Sequence
  Description of Artificial Sequence: Synthetic oligonucleotide
  Target: SCN10A; (+) strand; PAM type: YTN; PAM sequence: TTC
aaaattaagagggaaataat

SEQ ID NO: 71242 - DNA, 20 bp, Artificial Sequence
  Description of Artificial Sequence: Synthetic oligonucleotide
  Target: SCN10A; (+) strand; PAM type: YTN; PAM sequence: TTA
agagggaaataatttctaat

SEQ ID NO: 71243 - DNA, 20 bp, Artificial Sequence
  Description of Artificial Sequence: Synthetic oligonucleotide
  Target: SCN10A; (+) strand; PAM type: YTN; PAM sequence: TTT
ctaatacagaagtctttccc

SEQ ID NO: 71244 - DNA, 20 bp, Artificial Sequence
  Description of Artificial Sequence: Synthetic oligonucleotide
  Target: SCN10A; (+) strand; PAM type: YTN; PAM sequence: TTC
taatacagaagtctttccct

SEQ ID NO: 71245 - DNA, 20 bp, Artificial Sequence
  Description of Artificial Sequence: Synthetic oligonucleotide
  Target: SCN10A; (+) strand; PAM type: YTN; PAM sequence: CTA
atacagaagtctttccctag

SEQ ID NO: 71246 - DNA, 20 bp, Artificial Sequence
  Description of Artificial Sequence: Synthetic oligonucleotide
  Target: SCN10A; (+) strand; PAM type: YTN; PAM sequence: CTT
tccctagccaaactgtcaaa

SEQ ID NO: 71247 - DNA, 20 bp, Artificial Sequence
  Description of Artificial Sequence: Synthetic oligonucleotide
  Target: SCN10A; (+) strand; PAM type: YTN; PAM sequence: TTT
ccctagccaaactgtcaaag

SEQ ID NO: 71248 - DNA, 20 bp, Artificial Sequence
  Description of Artificial Sequence: Synthetic oligonucleotide
  Target: SCN10A; (+) strand; PAM type: YTN; PAM sequence: TTC
cctagccaaactgtcaaaga

SEQ ID NO: 71249 - DNA, 20 bp, Artificial Sequence
  Description of Artificial Sequence: Synthetic oligonucleotide
  Target: SCN10A; (+) strand; PAM type: YTN; PAM sequence: CTA
gccaaactgtcaaagaaggt

SEQ ID NO: 71250 - DNA, 20 bp, Artificial Sequence
  Description of Artificial Sequence: Synthetic oligonucleotide
  Target: SCN10A; (+) strand; PAM type: YTN; PAM sequence: CTG
tcaaagaaggtagaatatat

SEQ ID NO: 71251 - DNA, 20 bp, Artificial Sequence
  Description of Artificial Sequence: Synthetic oligonucleotide
  Target: SCN10A; (+) strand; PAM type: YTN; PAM sequence: CTT
gggaaatgtacttcttagtt

SEQ ID NO: 71252 - DNA, 20 bp, Artificial Sequence
  Description of Artificial Sequence: Synthetic oligonucleotide
  Target: SCN10A; (+) strand; PAM type: YTN; PAM sequence: TTG
ggaaatgtacttcttagtta

SEQ ID NO: 71253 - DNA, 20 bp, Artificial Sequence
  Description of Artificial Sequence: Synthetic oligonucleotide
  Target: SCN10A; (+) strand; PAM type: YTN; PAM sequence: CTT
cttagttacccttctaataa

SEQ ID NO: 71254 - DNA, 20 bp, Artificial Sequence
  Description of Artificial Sequence: Synthetic oligonucleotide
  Target: SCN10A; (+) strand; PAM type: YTN; PAM sequence: TTC
ttagttacccttctaataaa

SEQ ID NO: 71255 - DNA, 20 bp, Artificial Sequence
  Description of Artificial Sequence: Synthetic oligonucleotide
  Target: SCN10A; (+) strand; PAM type: YTN; PAM sequence: CTT
agttacccttctaataaagt

SEQ ID NO: 71256 - DNA, 20 bp, Artificial Sequence
  Description of Artificial Sequence: Synthetic oligonucleotide
  Target: SCN10A; (+) strand; PAM type: YTN; PAM sequence: TTA
gttacccttctaataaagtt

SEQ ID NO: 71257 - DNA, 20 bp, Artificial Sequence
  Description of Artificial Sequence: Synthetic oligonucleotide
  Target: SCN10A; (+) strand; PAM type: YTN; PAM sequence: TTA
cccttctaataaagttacta

SEQ ID NO: 71258 - DNA, 20 bp, Artificial Sequence
  Description of Artificial Sequence: Synthetic oligonucleotide
  Target: SCN10A; (+) strand; PAM type: YTN; PAM sequence: CTT
ctaataaagttactagaagc

SEQ ID NO: 71259 - DNA, 20 bp, Artificial Sequence
  Description of Artificial Sequence: Synthetic oligonucleotide
  Target: SCN10A; (+) strand; PAM type: YTN; PAM sequence: TTC
taataaagttactagaagct

SEQ ID NO: 71260 - DNA, 20 bp, Artificial Sequence
  Description of Artificial Sequence: Synthetic oligonucleotide
  Target: SCN10A; (+) strand; PAM type: YTN; PAM sequence: CTA
ataaagttactagaagctgg

SEQ ID NO: 71261 - DNA, 20 bp, Artificial Sequence
  Description of Artificial Sequence: Synthetic oligonucleotide
  Target: SCN10A; (+) strand; PAM type: YTN; PAM sequence: TTA
ctagaagctgggcatggtgg

SEQ ID NO: 71262 - DNA, 20 bp, Artificial Sequence
  Description of Artificial Sequence: Synthetic oligonucleotide
  Target: SCN10A; (+) strand; PAM type: YTN; PAM sequence: CTA
gaagctgggcatggtggtat

SEQ ID NO: 71263 - DNA, 20 bp, Artificial Sequence
  Description of Artificial Sequence: Synthetic oligonucleotide
  Target: SCN10A; (+) strand; PAM type: YTN; PAM sequence: CTG
ggcatggtggtatgtacctg

SEQ ID NO: 71264 - DNA, 20 bp, Artificial Sequence
  Description of Artificial Sequence: Synthetic oligonucleotide
  Target: SCN10A; (+) strand; PAM type: YTN; PAM sequence: CTG
tagtcctaactacttgggag

SEQ ID NO: 71265 - DNA, 20 bp, Artificial Sequence
  Description of Artificial Sequence: Synthetic oligonucleotide
  Target: SCN10A; (+) strand; PAM type: YTN; PAM sequence: CTA
actacttgggaggttgaggc

SEQ ID NO: 71266 - DNA, 20 bp, Artificial Sequence
  Description of Artificial Sequence: Synthetic oligonucleotide
  Target: SCN10A; (+) strand; PAM type: YTN; PAM sequence: CTA
cttgggaggttgaggcagga

SEQ ID NO: 71267 - DNA, 20 bp, Artificial Sequence
  Description of Artificial Sequence: Synthetic oligonucleotide
  Target: SCN10A; (+) strand; PAM type: YTN; PAM sequence: CTT
gggaggttgaggcaggagga

SEQ ID NO: 71268 - DNA, 20 bp, Artificial Sequence
  Description of Artificial Sequence: Synthetic oligonucleotide
  Target: SCN10A; (+) strand; PAM type: YTN; PAM sequence: TTG
ggaggttgaggcaggaggat

SEQ ID NO: 71269 - DNA, 20 bp, Artificial Sequence
  Description of Artificial Sequence: Synthetic oligonucleotide
  Target: SCN10A; (+) strand; PAM type: YTN; PAM sequence: TTG
aggcaggaggatcacttgaa

SEQ ID NO: 71270 - DNA, 20 bp, Artificial Sequence
  Description of Artificial Sequence: Synthetic oligonucleotide
  Target: SCN10A; (+) strand; PAM type: YTN; PAM sequence: CTT
gaacccaggagtttgaggcc

SEQ ID NO: 71271 - DNA, 20 bp, Artificial Sequence
  Description of Artificial Sequence: Synthetic oligonucleotide
  Target: SCN10A; (+) strand; PAM type: YTN; PAM sequence: TTG
aacccaggagtttgaggcca

SEQ ID NO: 71272 - DNA, 20 bp, Artificial Sequence
  Description of Artificial Sequence: Synthetic oligonucleotide
  Target: SCN10A; (+) strand; PAM type: YTN; PAM sequence: TTT
gaggccaacagcctgggcag

SEQ ID NO: 71273 - DNA, 20 bp, Artificial Sequence
  Description of Artificial Sequence: Synthetic oligonucleotide
  Target: SCN10A; (+) strand; PAM type: YTN; PAM sequence: TTG
aggccaacagcctgggcagc

SEQ ID NO: 71274 - DNA, 20 bp, Artificial Sequence
  Description of Artificial Sequence: Synthetic oligonucleotide
  Target: SCN10A; (+) strand; PAM type: YTN; PAM sequence: CTG
ggcagcatagagagactttg

SEQ ID NO: 71275 - DNA, 20 bp, Artificial Sequence
  Description of Artificial Sequence: Synthetic oligonucleotide
  Target: SCN10A; (+) strand; PAM type: YTN; PAM sequence: CTT
tgtcttaaaaaaaaatgtta

SEQ ID NO: 71276 - DNA, 20 bp, Artificial Sequence
  Description of Artificial Sequence: Synthetic oligonucleotide
  Target: SCN10A; (+) strand; PAM type: YTN; PAM sequence: TTT
gtcttaaaaaaaaatgttac

SEQ ID NO: 71277 - DNA, 20 bp, Artificial Sequence
  Description of Artificial Sequence: Synthetic oligonucleotide
  Target: SCN10A; (+) strand; PAM type: YTN; PAM sequence: TTG
tcttaaaaaaaaatgttact

SEQ ID NO: 71278 - DNA, 20 bp, Artificial Sequence
  Description of Artificial Sequence: Synthetic oligonucleotide
  Target: SCN10A; (+) strand; PAM type: YTN; PAM sequence: CTT
aaaaaaaaatgttactagag

SEQ ID NO: 71279 - DNA, 20 bp, Artificial Sequence
  Description of Artificial Sequence: Synthetic oligonucleotide
  Target: SCN10A; (+) strand; PAM type: YTN; PAM sequence: TTA
aaaaaaaatgttactagagg

SEQ ID NO: 71280 - DNA, 20 bp, Artificial Sequence
  Description of Artificial Sequence: Synthetic oligonucleotide
  Target: SCN10A; (+) strand; PAM type: YTN; PAM sequence: TTA
ctagaggatatgctccattc

SEQ ID NO: 71281 - DNA, 20 bp, Artificial Sequence
  Description of Artificial Sequence: Synthetic oligonucleotide
  Target: SCN10A; (+) strand; PAM type: YTN; PAM sequence: CTA
gaggatatgctccattcaaa

SEQ ID NO: 71282 - DNA, 20 bp, Artificial Sequence
  Description of Artificial Sequence: Synthetic oligonucleotide
  Target: SCN10A; (+) strand; PAM type: YTN; PAM sequence: CTC
cattcaaacaagaaacatat

SEQ ID NO: 71283 - DNA, 20 bp, Artificial Sequence
  Description of Artificial Sequence: Synthetic oligonucleotide
  Target: SCN10A; (+) strand; PAM type: YTN; PAM sequence: TTC
aaacaagaaacatatatgcg

SEQ ID NO: 71284 - DNA, 20 bp, Artificial Sequence
  Description of Artificial Sequence: Synthetic oligonucleotide
  Target: SCN10A; (+) strand; PAM type: YTN; PAM sequence: CTC
tagaaaacagctgtgcatca

SEQ ID NO: 71285 - DNA, 20 bp, Artificial Sequence
  Description of Artificial Sequence: Synthetic oligonucleotide
  Target: SCN10A; (+) strand; PAM type: YTN; PAM sequence: CTA
gaaaacagctgtgcatcagg

SEQ ID NO: 71286 - DNA, 20 bp, Artificial Sequence
  Description of Artificial Sequence: Synthetic oligonucleotide
  Target: SCN10A; (+) strand; PAM type: YTN; PAM sequence: CTG
tgcatcaggcctagaaaaca

SEQ ID NO: 71287 - DNA, 20 bp, Artificial Sequence
  Description of Artificial Sequence: Synthetic oligonucleotide
  Target: SCN10A; (+) strand; PAM type: YTN; PAM sequence: CTA
gaaaacatctaggtcagaat

SEQ ID NO: 71288 - DNA, 20 bp, Artificial Sequence
  Description of Artificial Sequence: Synthetic oligonucleotide
  Target: SCN10A; (+) strand; PAM type: YTN; PAM sequence: CTA
ggtcagaatgaggcagaaga

SEQ ID NO: 71289 - DNA, 20 bp, Artificial Sequence
  Description of Artificial Sequence: Synthetic oligonucleotide
  Target: SCN10A; (+) strand; PAM type: YTN; PAM sequence: CTC
tagctgtgattcccatagga

SEQ ID NO: 71290 - DNA, 20 bp, Artificial Sequence
  Description of Artificial Sequence: Synthetic oligonucleotide
  Target: SCN10A; (+) strand; PAM type: YTN; PAM sequence: CTA
gctgtgattcccataggaaa

SEQ ID NO: 71291 - DNA, 20 bp, Artificial Sequence
  Description of Artificial Sequence: Synthetic oligonucleotide
  Target: SCN10A; (+) strand; PAM type: YTN; PAM sequence: CTG
tgattcccataggaaaaaaa

SEQ ID NO: 71292 - DNA, 20 bp, Artificial Sequence
  Description of Artificial Sequence: Synthetic oligonucleotide
  Target: SCN10A; (+) strand; PAM type: YTN; PAM sequence: TTC
ccataggaaaaaaatgatac

SEQ ID NO: 71293 - DNA, 20 bp, Artificial Sequence
  Description of Artificial Sequence: Synthetic oligonucleotide
  Target: SCN10A; (+) strand; PAM type: YTN; PAM sequence: CTG
atgtgtgcaaataaattgaa

SEQ ID NO: 71294 - DNA, 20 bp, Artificial Sequence
  Description of Artificial Sequence: Synthetic oligonucleotide
  Target: SCN10A; (+) strand; PAM type: YTN; PAM sequence: TTG
aagcaacaattaaacatctg

SEQ ID NO: 71295 - DNA, 20 bp, Artificial Sequence
  Description of Artificial Sequence: Synthetic oligonucleotide
  Target: SCN10A; (+) strand; PAM type: YTN; PAM sequence: TTA
aacatctggagaagagtttg

SEQ ID NO: 71296 - DNA, 20 bp, Artificial Sequence
  Description of Artificial Sequence: Synthetic oligonucleotide
  Target: SCN10A; (+) strand; PAM type: YTN; PAM sequence: CTG
gagaagagtttgggaacaaa

SEQ ID NO: 71297 - DNA, 20 bp, Artificial Sequence
  Description of Artificial Sequence: Synthetic oligonucleotide
  Target: SCN10A; (+) strand; PAM type: YTN; PAM sequence: TTT
gggaacaaattagggataaa

SEQ ID NO: 71298 - DNA, 20 bp, Artificial Sequence
  Description of Artificial Sequence: Synthetic oligonucleotide
  Target: SCN10A; (+) strand; PAM type: YTN; PAM sequence: TTG
ggaacaaattagggataaat

SEQ ID NO: 71299 - DNA, 20 bp, Artificial Sequence
  Description of Artificial Sequence: Synthetic oligonucleotide
  Target: SCN10A; (+) strand; PAM type: YTN; PAM sequence: TTA
gggataaatagaaaactgag

SEQ ID NO: 71300 - DNA, 20 bp, Artificial Sequence
  Description of Artificial Sequence: Synthetic oligonucleotide
  Target: SCN10A; (+) strand; PAM type: YTN; PAM sequence: CTG
agcaaacaaaaaaataaaat

SEQ ID NO: 71301 - DNA, 20 bp, Artificial Sequence
  Description of Artificial Sequence: Synthetic oligonucleotide
  Target: SCN10A; (+) strand; PAM type: YTN; PAM sequence: CTT
attaactccaaggaaagcaa

SEQ ID NO: 71302 - DNA, 20 bp, Artificial Sequence
  Description of Artificial Sequence: Synthetic oligonucleotide
  Target: SCN10A; (+) strand; PAM type: YTN; PAM sequence: TTA
ttaactccaaggaaagcaaa

SEQ ID NO: 71303 - DNA, 20 bp, Artificial Sequence
  Description of Artificial Sequence: Synthetic oligonucleotide
  Target: SCN10A; (+) strand; PAM type: YTN; PAM sequence: TTA
actccaaggaaagcaaaaac

SEQ ID NO: 71304 - DNA, 20 bp, Artificial Sequence
  Description of Artificial Sequence: Synthetic oligonucleotide
  Target: SCN10A; (+) strand; PAM type: YTN; PAM sequence: CTC
caaggaaagcaaaaacattg

SEQ ID NO: 71305 - DNA, 20 bp, Artificial Sequence
  Description of Artificial Sequence: Synthetic oligonucleotide
  Target: SCN10A; (+) strand; PAM type: YTN; PAM sequence: TTG
tgcaaaaaggaaatatagtc

SEQ ID NO: 71306 - DNA, 20 bp, Artificial Sequence
  Description of Artificial Sequence: Synthetic oligonucleotide
  Target: SCN10A; (+) strand; PAM type: YTN; PAM sequence: CTG
catgacacagctgtaaacag

SEQ ID NO: 71307 - DNA, 20 bp, Artificial Sequence
  Description of Artificial Sequence: Synthetic oligonucleotide
  Target: SCN10A; (+) strand; PAM type: YTN; PAM sequence: CTG
taaacagtgtttacttagca

SEQ ID NO: 71308 - DNA, 20 bp, Artificial Sequence
  Description of Artificial Sequence: Synthetic oligonucleotide
  Target: SCN10A; (+) strand; PAM type: YTN; PAM sequence: TTT
acttagcaatgtaatgtaat

SEQ ID NO: 71309 - DNA, 20 bp, Artificial Sequence
  Description of Artificial Sequence: Synthetic oligonucleotide
  Target: SCN10A; (+) strand; PAM type: YTN; PAM sequence: TTA
cttagcaatgtaatgtaatt

SEQ ID NO: 71310 - DNA, 20 bp, Artificial Sequence
  Description of Artificial Sequence: Synthetic oligonucleotide
  Target: SCN10A; (+) strand; PAM type: YTN; PAM sequence: CTT
agcaatgtaatgtaattata

SEQ ID NO: 71311 - DNA, 20 bp, Artificial Sequence
  Description of Artificial Sequence: Synthetic oligonucleotide
  Target: SCN10A; (+) strand; PAM type: YTN; PAM sequence: TTA
gcaatgtaatgtaattatat

SEQ ID NO: 71312 - DNA, 20 bp, Artificial Sequence
  Description of Artificial Sequence: Synthetic oligonucleotide
  Target: SCN10A; (+) strand; PAM type: YTN; PAM sequence: TTA
tatatgtagtcatacaatgg

SEQ ID NO: 71313 - DNA, 20 bp, Artificial Sequence
  Description of Artificial Sequence: Synthetic oligonucleotide
  Target: SCN10A; (+) strand; PAM type: YTN; PAM sequence: TTA
tctgatgatctaactgaaga

SEQ ID NO: 71314 - DNA, 20 bp, Artificial Sequence
  Description of Artificial Sequence: Synthetic oligonucleotide
  Target: SCN10A; (+) strand; PAM type: YTN; PAM sequence: CTG
atgatctaactgaagattac

SEQ ID NO: 71315 - DNA, 20 bp, Artificial Sequence
  Description of Artificial Sequence: Synthetic oligonucleotide
  Target: SCN10A; (+) strand; PAM type: YTN; PAM sequence: CTA
actgaagattacaatataac

SEQ ID NO: 71316 - DNA, 20 bp, Artificial Sequence
  Description of Artificial Sequence: Synthetic oligonucleotide
  Target: SCN10A; (+) strand; PAM type: YTN; PAM sequence: CTG
aagattacaatataactgta

SEQ ID NO: 71317 - DNA, 20 bp, Artificial Sequence
  Description of Artificial Sequence: Synthetic oligonucleotide
  Target: SCN10A; (+) strand; PAM type: YTN; PAM sequence: TTA
caatataactgtaacaggaa

SEQ ID NO: 71318 - DNA, 20 bp, Artificial Sequence
  Description of Artificial Sequence: Synthetic oligonucleotide
  Target: SCN10A; (+) strand; PAM type: YTN; PAM sequence: CTG
taacaggaagatgagggtga

SEQ ID NO: 71319 - DNA, 20 bp, Artificial Sequence
  Description of Artificial Sequence: Synthetic oligonucleotide
  Target: SCN10A; (+) strand; PAM type: YTN; PAM sequence: TTT
gtggatgtggccttaagttt

SEQ ID NO: 71320 - DNA, 20 bp, Artificial Sequence
  Description of Artificial Sequence: Synthetic oligonucleotide
  Target: SCN10A; (+) strand; PAM type: YTN; PAM sequence: TTG
tggatgtggccttaagtttt

SEQ ID NO: 71321 - DNA, 20 bp, Artificial Sequence
  Description of Artificial Sequence: Synthetic oligonucleotide
  Target: SCN10A; (+) strand; PAM type: YTN; PAM sequence: CTT
aagttttttctcataatagg

SEQ ID NO: 71322 - DNA, 20 bp, Artificial Sequence
  Description of Artificial Sequence: Synthetic oligonucleotide
  Target: SCN10A; (+) strand; PAM type: YTN; PAM sequence: TTA
agttttttctcataatagga

SEQ ID NO: 71323 - DNA, 20 bp, Artificial Sequence
  Description of Artificial Sequence: Synthetic oligonucleotide
  Target: SCN10A; (+) strand; PAM type: YTN; PAM sequence: TTT
tttctcataataggaagcca

SEQ ID NO: 71324 - DNA, 20 bp, Artificial Sequence
  Description of Artificial Sequence: Synthetic oligonucleotide
  Target: SCN10A; (+) strand; PAM type: YTN; PAM sequence: TTT
ttctcataataggaagccaa

SEQ ID NO: 71325 - DNA, 20 bp, Artificial Sequence
  Description of Artificial Sequence: Synthetic oligonucleotide
  Target: SCN10A; (+) strand; PAM type: YTN; PAM sequence: TTT
tctcataataggaagccaat

SEQ ID NO: 71326 - DNA, 20 bp, Artificial Sequence
  Description of Artificial Sequence: Synthetic oligonucleotide
  Target: SCN10A; (+) strand; PAM type: YTN; PAM sequence: TTT
ctcataataggaagccaata

SEQ ID NO: 71327 - DNA, 20 bp, Artificial Sequence
  Description of Artificial Sequence: Synthetic oligonucleotide
  Target: SCN10A; (+) strand; PAM type: YTN; PAM sequence: TTC
tcataataggaagccaataa

SEQ ID NO: 71328 - DNA, 20 bp, Artificial Sequence
  Description of Artificial Sequence: Synthetic oligonucleotide
  Target: SCN10A; (+) strand; PAM type: YTN; PAM sequence: CTC
ataataggaagccaataaat

SEQ ID NO: 71329 - DNA, 20 bp, Artificial Sequence
  Description of Artificial Sequence: Synthetic oligonucleotide
  Target: SCN10A; (+) strand; PAM type: YTN; PAM sequence: TTG
aaaaattaaaaattagtatt

SEQ ID NO: 71330 - DNA, 20 bp, Artificial Sequence
  Description of Artificial Sequence: Synthetic oligonucleotide
  Target: SCN10A; (+) strand; PAM type: YTN; PAM sequence: TTA
aaaattagtattatgagtat

SEQ ID NO: 71331 - DNA, 20 bp, Artificial Sequence
  Description of Artificial Sequence: Synthetic oligonucleotide
  Target: SCN10A; (+) strand; PAM type: YTN; PAM sequence: TTA
gtattatgagtatattattg

SEQ ID NO: 71332 - DNA, 20 bp, Artificial Sequence
  Description of Artificial Sequence: Synthetic oligonucleotide
  Target: SCN10A; (+) strand; PAM type: YTN; PAM sequence: TTA
tgagtatattattggagata

SEQ ID NO: 71333 - DNA, 20 bp, Artificial Sequence
  Description of Artificial Sequence: Synthetic oligonucleotide
  Target: SCN10A; (+) strand; PAM type: YTN; PAM sequence: TTA
ttggagatagggaggtatca

SEQ ID NO: 71334 - DNA, 20 bp, Artificial Sequence
  Description of Artificial Sequence: Synthetic oligonucleotide
  Target: SCN10A; (+) strand; PAM type: YTN; PAM sequence: TTG
gagatagggaggtatcagaa

SEQ ID NO: 71335 - DNA, 20 bp, Artificial Sequence
  Description of Artificial Sequence: Synthetic oligonucleotide
  Target: SCN10A; (+) strand; PAM type: YTN; PAM sequence: CTA
aaagtggtggcctctggaaa

SEQ ID NO: 71336 - DNA, 20 bp, Artificial Sequence
  Description of Artificial Sequence: Synthetic oligonucleotide
  Target: SCN10A; (+) strand; PAM type: YTN; PAM sequence: CTC
tggaaagaagagatgagaaa

SEQ ID NO: 71337 - DNA, 20 bp, Artificial Sequence
  Description of Artificial Sequence: Synthetic oligonucleotide
  Target: SCN10A; (+) strand; PAM type: YTN; PAM sequence: CTG
gaaagaagagatgagaaaaa

SEQ ID NO: 71338 - DNA, 20 bp, Artificial Sequence
  Description of Artificial Sequence: Synthetic oligonucleotide
  Target: SCN10A; (+) strand; PAM type: YTN; PAM sequence: TTG
ctgttttttttgtcagaatc

SEQ ID NO: 71339 - DNA, 20 bp, Artificial Sequence
  Description of Artificial Sequence: Synthetic oligonucleotide
  Target: SCN10A; (+) strand; PAM type: YTN; PAM sequence: CTG
ttttttttgtcagaatcttt

SEQ ID NO: 71340 - DNA, 20 bp, Artificial Sequence
  Description of Artificial Sequence: Synthetic oligonucleotide
  Target: SCN10A; (+) strand; PAM type: YTN; PAM sequence: TTT
tttttgtcagaatctttata

SEQ ID NO: 71341 - DNA, 20 bp, Artificial Sequence
  Description of Artificial Sequence: Synthetic oligonucleotide
  Target: SCN10A; (+) strand; PAM type: YTN; PAM sequence: TTT
ttttgtcagaatctttataa

SEQ ID NO: 71342 - DNA, 20 bp, Artificial Sequence
  Description of Artificial Sequence: Synthetic oligonucleotide
  Target: SCN10A; (+) strand; PAM type: YTN; PAM sequence: TTT
tttgtcagaatctttataaa

SEQ ID NO: 71343 - DNA, 20 bp, Artificial Sequence
  Description of Artificial Sequence: Synthetic oligonucleotide
  Target: SCN10A; (+) strand; PAM type: YTN; PAM sequence: TTT
ttgtcagaatctttataaaa

SEQ ID NO: 71344 - DNA, 20 bp, Artificial Sequence
  Description of Artificial Sequence: Synthetic oligonucleotide
  Target: SCN10A; (+) strand; PAM type: YTN; PAM sequence: TTT
tgtcagaatctttataaaac

SEQ ID NO: 71345 - DNA, 20 bp, Artificial Sequence
  Description of Artificial Sequence: Synthetic oligonucleotide
  Target: SCN10A; (+) strand; PAM type: YTN; PAM sequence: TTT
gtcagaatctttataaaact

SEQ ID NO: 71346 - DNA, 20 bp, Artificial Sequence
  Description of Artificial Sequence: Synthetic oligonucleotide
  Target: SCN10A; (+) strand; PAM type: YTN; PAM sequence: TTG
tcagaatctttataaaactc

SEQ ID NO: 71347 - DNA, 20 bp, Artificial Sequence
  Description of Artificial Sequence: Synthetic oligonucleotide
  Target: SCN10A; (+) strand; PAM type: YTN; PAM sequence: CTT
tataaaactctgtgaccttt

SEQ ID NO: 71348 - DNA, 20 bp, Artificial Sequence
  Description of Artificial Sequence: Synthetic oligonucleotide
  Target: SCN10A; (+) strand; PAM type: YTN; PAM sequence: TTT
ataaaactctgtgacctttt

SEQ ID NO: 71349 - DNA, 20 bp, Artificial Sequence
  Description of Artificial Sequence: Synthetic oligonucleotide
  Target: SCN10A; (+) strand; PAM type: YTN; PAM sequence: TTA
taaaactctgtgacctttta

SEQ ID NO: 71350 - DNA, 20 bp, Artificial Sequence
  Description of Artificial Sequence: Synthetic oligonucleotide
  Target: SCN10A; (+) strand; PAM type: YTN; PAM sequence: CTC
tgtgaccttttaaattatga

SEQ ID NO: 71351 - DNA, 20 bp, Artificial Sequence
  Description of Artificial Sequence: Synthetic oligonucleotide
  Target: SCN10A; (+) strand; PAM type: YTN; PAM sequence: CTG
tgaccttttaaattatgaac

SEQ ID NO: 71352 - DNA, 20 bp, Artificial Sequence
  Description of Artificial Sequence: Synthetic oligonucleotide
  Target: SCN10A; (+) strand; PAM type: YTN; PAM sequence: CTT
ttaaattatgaacatatatg

SEQ ID NO: 71353 - DNA, 20 bp, Artificial Sequence
  Description of Artificial Sequence: Synthetic oligonucleotide
  Target: SCN10A; (+) strand; PAM type: YTN; PAM sequence: TTT
taaattatgaacatatatgt

SEQ ID NO: 71354 - DNA, 20 bp, Artificial Sequence
  Description of Artificial Sequence: Synthetic oligonucleotide
  Target: SCN10A; (+) strand; PAM type: YTN; PAM sequence: TTT
aaattatgaacatatatgtc

SEQ ID NO: 71355 - DNA, 20 bp, Artificial Sequence
  Description of Artificial Sequence: Synthetic oligonucleotide
  Target: SCN10A; (+) strand; PAM type: YTN; PAM sequence: TTA
aattatgaacatatatgtct

SEQ ID NO: 71356 - DNA, 20 bp, Artificial Sequence
  Description of Artificial Sequence: Synthetic oligonucleotide
  Target: SCN10A; (+) strand; PAM type: YTN; PAM sequence: TTA
tgaacatatatgtcttaaat

SEQ ID NO: 71357 - DNA, 20 bp, Artificial Sequence
  Description of Artificial Sequence: Synthetic oligonucleotide
  Target: SCN10A; (+) strand; PAM type: YTN; PAM sequence: CTT
aaataaaagtaaaagtcaag

SEQ ID NO: 71358 - DNA, 20 bp, Artificial Sequence
  Description of Artificial Sequence: Synthetic oligonucleotide
  Target: SCN10A; (+) strand; PAM type: YTN; PAM sequence: TTA
aataaaagtaaaagtcaagt

SEQ ID NO: 71359 - DNA, 20 bp, Artificial Sequence
  Description of Artificial Sequence: Synthetic oligonucleotide
  Target: SCN10A; (+) strand; PAM type: YTN; PAM sequence: TTA
aaaagtgaataatttttttt

SEQ ID NO: 71360 - DNA, 20 bp, Artificial Sequence
  Description of Artificial Sequence: Synthetic oligonucleotide
  Target: SCN10A; (+) strand; PAM type: YTN; PAM sequence: TTT
tttttcacatctgtgagagg

SEQ ID NO: 71361 - DNA, 20 bp, Artificial Sequence
  Description of Artificial Sequence: Synthetic oligonucleotide
  Target: SCN10A; (+) strand; PAM type: YTN; PAM sequence: TTT
ttttcacatctgtgagagga

SEQ ID NO: 71362 - DNA, 20 bp, Artificial Sequence
  Description of Artificial Sequence: Synthetic oligonucleotide
  Target: SCN10A; (+) strand; PAM type: YTN; PAM sequence: TTT
tttcacatctgtgagaggag

SEQ ID NO: 71363 - DNA, 20 bp, Artificial Sequence
  Description of Artificial Sequence: Synthetic oligonucleotide
  Target: SCN10A; (+) strand; PAM type: YTN; PAM sequence: TTT
ttcacatctgtgagaggaga

SEQ ID NO: 71364 - DNA, 20 bp, Artificial Sequence
  Description of Artificial Sequence: Synthetic oligonucleotide
  Target: SCN10A; (+) strand; PAM type: YTN; PAM sequence: TTT
tcacatctgtgagaggagaa

SEQ ID NO: 71365 - DNA, 20 bp, Artificial Sequence
  Description of Artificial Sequence: Synthetic oligonucleotide
  Target: SCN10A; (+) strand; PAM type: YTN; PAM sequence: TTT
cacatctgtgagaggagaaa

SEQ ID NO: 71366 - DNA, 20 bp, Artificial Sequence
  Description of Artificial Sequence: Synthetic oligonucleotide
  Target: SCN10A; (+) strand; PAM type: YTN; PAM sequence: TTC
acatctgtgagaggagaaat

SEQ ID NO: 71367 - DNA, 20 bp, Artificial Sequence
  Description of Artificial Sequence: Synthetic oligonucleotide
  Target: SCN10A; (+) strand; PAM type: YTN; PAM sequence: CTG
tgagaggagaaatcgtgttt

SEQ ID NO: 71368 - DNA, 20 bp, Artificial Sequence
  Description of Artificial Sequence: Synthetic oligonucleotide
  Target: SCN10A; (+) strand; PAM type: YTN; PAM sequence: TTT
gaaatcatttaggaatctat

SEQ ID NO: 71369 - DNA, 20 bp, Artificial Sequence
  Description of Artificial Sequence: Synthetic oligonucleotide
  Target: SCN10A; (+) strand; PAM type: YTN; PAM sequence: TTG
aaatcatttaggaatctata

SEQ ID NO: 71370 - DNA, 20 bp, Artificial Sequence
  Description of Artificial Sequence: Synthetic oligonucleotide
  Target: SCN10A; (+) strand; PAM type: YTN; PAM sequence: TTT
aggaatctatatctggttgc

SEQ ID NO: 71371 - DNA, 20 bp, Artificial Sequence
  Description of Artificial Sequence: Synthetic oligonucleotide
  Target: SCN10A; (+) strand; PAM type: YTN; PAM sequence: TTA
ggaatctatatctggttgca

SEQ ID NO: 71372 - DNA, 20 bp, Artificial Sequence
  Description of Artificial Sequence: Synthetic oligonucleotide
  Target: SCN10A; (+) strand; PAM type: YTN; PAM sequence: CTA
tatctggttgcatagctgct

SEQ ID NO: 71373 - DNA, 20 bp, Artificial Sequence
  Description of Artificial Sequence: Synthetic oligonucleotide
  Target: SCN10A; (+) strand; PAM type: YTN; PAM sequence: CTG
gttgcatagctgcttgagct

SEQ ID NO: 71374 - DNA, 20 bp, Artificial Sequence
  Description of Artificial Sequence: Synthetic oligonucleotide
  Target: SCN10A; (+) strand; PAM type: YTN; PAM sequence: TTG
catagctgcttgagctgtca

SEQ ID NO: 71375 - DNA, 20 bp, Artificial Sequence
  Description of Artificial Sequence: Synthetic oligonucleotide
  Target: SCN10A; (+) strand; PAM type: YTN; PAM sequence: CTG
cttgagctgtcagcttccat

SEQ ID NO: 71376 - DNA, 20 bp, Artificial Sequence
  Description of Artificial Sequence: Synthetic oligonucleotide
  Target: SCN10A; (+) strand; PAM type: YTN; PAM sequence: CTT
gagctgtcagcttccatatc

SEQ ID NO: 71377 - DNA, 20 bp, Artificial Sequence
  Description of Artificial Sequence: Synthetic oligonucleotide
  Target: SCN10A; (+) strand; PAM type: YTN; PAM sequence: TTG
agctgtcagcttccatatct

SEQ ID NO: 71378 - DNA, 20 bp, Artificial Sequence
  Description of Artificial Sequence: Synthetic oligonucleotide
  Target: SCN10A; (+) strand; PAM type: YTN; PAM sequence: CTG
tcagcttccatatcttgttg

SEQ ID NO: 71379 - DNA, 20 bp, Artificial Sequence
  Description of Artificial Sequence: Synthetic oligonucleotide
  Target: SCN10A; (+) strand; PAM type: YTN; PAM sequence: CTT
ccatatcttgttggtttccc

SEQ ID NO: 71380 - DNA, 20 bp, Artificial Sequence
  Description of Artificial Sequence: Synthetic oligonucleotide
  Target: SCN10A; (+) strand; PAM type: YTN; PAM sequence: TTC
catatcttgttggtttcccc

SEQ ID NO: 71381 - DNA, 20 bp, Artificial Sequence
  Description of Artificial Sequence: Synthetic oligonucleotide
  Target: SCN10A; (+) strand; PAM type: YTN; PAM sequence: CTT
gttggtttcccccccacact

SEQ ID NO: 71382 - DNA, 20 bp, Artificial Sequence
  Description of Artificial Sequence: Synthetic oligonucleotide
  Target: SCN10A; (+) strand; PAM type: YTN; PAM sequence: TTG
ttggtttcccccccacactc

SEQ ID NO: 71383 - DNA, 20 bp, Artificial Sequence
  Description of Artificial Sequence: Synthetic oligonucleotide
  Target: SCN10A; (+) strand; PAM type: YTN; PAM sequence: TTG
gtttcccccccacactcttt

SEQ ID NO: 71384 - DNA, 20 bp, Artificial Sequence
  Description of Artificial Sequence: Synthetic oligonucleotide
  Target: SCN10A; (+) strand; PAM type: YTN; PAM sequence: TTT
cccccccacactctttatgt

SEQ ID NO: 71385 - DNA, 20 bp, Artificial Sequence
  Description of Artificial Sequence: Synthetic oligonucleotide
  Target: SCN10A; (+) strand; PAM type: YTN; PAM sequence: TTC
ccccccacactctttatgtt

SEQ ID NO: 71386 - DNA, 20 bp, Artificial Sequence
  Description of Artificial Sequence: Synthetic oligonucleotide
  Target: SCN10A; (+) strand; PAM type: YTN; PAM sequence: CTC
tttatgttttctaaattaga

SEQ ID NO: 71387 - DNA, 20 bp, Artificial Sequence
  Description of Artificial Sequence: Synthetic oligonucleotide
  Target: SCN10A; (+) strand; PAM type: YTN; PAM sequence: CTT
tatgttttctaaattagaaa

SEQ ID NO: 71388 - DNA, 20 bp, Artificial Sequence
  Description of Artificial Sequence: Synthetic oligonucleotide
  Target: SCN10A; (+) strand; PAM type: YTN; PAM sequence: TTT
atgttttctaaattagaaaa

SEQ ID NO: 71389 - DNA, 20 bp, Artificial Sequence
  Description of Artificial Sequence: Synthetic oligonucleotide
  Target: SCN10A; (+) strand; PAM type: YTN; PAM sequence: TTA
tgttttctaaattagaaaat

SEQ ID NO: 71390 - DNA, 20 bp, Artificial Sequence
  Description of Artificial Sequence: Synthetic oligonucleotide
  Target: SCN10A; (+) strand; PAM type: YTN; PAM sequence: TTT
tctaaattagaaaatcttaa

SEQ ID NO: 71391 - DNA, 20 bp, Artificial Sequence
  Description of Artificial Sequence: Synthetic oligonucleotide
  Target: SCN10A; (+) strand; PAM type: YTN; PAM sequence: TTT
ctaaattagaaaatcttaac

SEQ ID NO: 71392 - DNA, 20 bp, Artificial Sequence
  Description of Artificial Sequence: Synthetic oligonucleotide
  Target: SCN10A; (+) strand; PAM type: YTN; PAM sequence: TTC
taaattagaaaatcttaact

SEQ ID NO: 71393 - DNA, 20 bp, Artificial Sequence
  Description of Artificial Sequence: Synthetic oligonucleotide
  Target: SCN10A; (+) strand; PAM type: YTN; PAM sequence: CTA
aattagaaaatcttaactca

SEQ ID NO: 71394 - DNA, 20 bp, Artificial Sequence
  Description of Artificial Sequence: Synthetic oligonucleotide
  Target: SCN10A; (+) strand; PAM type: YTN; PAM sequence: TTA
gaaaatcttaactcagaatt

SEQ ID NO: 71395 - DNA, 20 bp, Artificial Sequence
  Description of Artificial Sequence: Synthetic oligonucleotide
  Target: SCN10A; (+) strand; PAM type: YTN; PAM sequence: CTT
aactcagaattataggttgt

SEQ ID NO: 71396 - DNA, 20 bp, Artificial Sequence
  Description of Artificial Sequence: Synthetic oligonucleotide
  Target: SCN10A; (+) strand; PAM type: YTN; PAM sequence: TTA
actcagaattataggttgtt

SEQ ID NO: 71397 - DNA, 20 bp, Artificial Sequence
  Description of Artificial Sequence: Synthetic oligonucleotide
  Target: SCN10A; (+) strand; PAM type: YTN; PAM sequence: CTC
agaattataggttgttggga

SEQ ID NO: 71398 - DNA, 20 bp, Artificial Sequence
  Description of Artificial Sequence: Synthetic oligonucleotide
  Target: SCN10A; (+) strand; PAM type: YTN; PAM sequence: TTA
taggttgttgggaagctttg

SEQ ID NO: 71399 - DNA, 20 bp, Artificial Sequence
  Description of Artificial Sequence: Synthetic oligonucleotide
  Target: SCN10A; (+) strand; PAM type: YTN; PAM sequence: TTG
ttgggaagctttgatggata

SEQ ID NO: 71400 - DNA, 20 bp, Artificial Sequence
  Description of Artificial Sequence: Synthetic oligonucleotide
  Target: SCN10A; (+) strand; PAM type: YTN; PAM sequence: TTG
ggaagctttgatggatattt

SEQ ID NO: 71401 - DNA, 20 bp, Artificial Sequence
  Description of Artificial Sequence: Synthetic oligonucleotide
  Target: SCN10A; (+) strand; PAM type: YTN; PAM sequence: CTT
tgatggatatttctggtttg

SEQ ID NO: 71402 - DNA, 20 bp, Artificial Sequence
  Description of Artificial Sequence: Synthetic oligonucleotide
  Target: SCN10A; (+) strand; PAM type: YTN; PAM sequence: TTT
gatggatatttctggtttgt

SEQ ID NO: 71403 - DNA, 20 bp, Artificial Sequence
  Description of Artificial Sequence: Synthetic oligonucleotide
  Target: SCN10A; (+) strand; PAM type: YTN; PAM sequence: TTG
atggatatttctggtttgtc

SEQ ID NO: 71404 - DNA, 20 bp, Artificial Sequence
  Description of Artificial Sequence: Synthetic oligonucleotide
  Target: SCN10A; (+) strand; PAM type: YTN; PAM sequence: TTT
ctggtttgtcaaatcaaaca

SEQ ID NO: 71405 - DNA, 20 bp, Artificial Sequence
  Description of Artificial Sequence: Synthetic oligonucleotide
  Target: SCN10A; (+) strand; PAM type: YTN; PAM sequence: TTC
tggtttgtcaaatcaaacac

SEQ ID NO: 71406 - DNA, 20 bp, Artificial Sequence
  Description of Artificial Sequence: Synthetic oligonucleotide
  Target: SCN10A; (+) strand; PAM type: YTN; PAM sequence: CTG
gtttgtcaaatcaaacacag

SEQ ID NO: 71407 - DNA, 20 bp, Artificial Sequence
  Description of Artificial Sequence: Synthetic oligonucleotide
  Target: SCN10A; (+) strand; PAM type: YTN; PAM sequence: TTT
gtcaaatcaaacacagaccc

SEQ ID NO: 71408 - DNA, 20 bp, Artificial Sequence
  Description of Artificial Sequence: Synthetic oligonucleotide
  Target: SCN10A; (+) strand; PAM type: YTN; PAM sequence: TTG
tcaaatcaaacacagaccca

SEQ ID NO: 71409 - DNA, 20 bp, Artificial Sequence
  Description of Artificial Sequence: Synthetic oligonucleotide
  Target: SCN10A; (+) strand; PAM type: YTN; PAM sequence: TTA
tggagagagtgctctctaaa

SEQ ID NO: 71410 - DNA, 20 bp, Artificial Sequence
  Description of Artificial Sequence: Synthetic oligonucleotide
  Target: SCN10A; (+) strand; PAM type: YTN; PAM sequence: CTC
tctaaagactattttcagtg

SEQ ID NO: 71411 - DNA, 20 bp, Artificial Sequence
  Description of Artificial Sequence: Synthetic oligonucleotide
  Target: SCN10A; (+) strand; PAM type: YTN; PAM sequence: CTC
taaagactattttcagtgct

SEQ ID NO: 71412 - DNA, 20 bp, Artificial Sequence
  Description of Artificial Sequence: Synthetic oligonucleotide
  Target: SCN10A; (+) strand; PAM type: YTN; PAM sequence: CTA
aagactattttcagtgcttc

SEQ ID NO: 71413 - DNA, 20 bp, Artificial Sequence
  Description of Artificial Sequence: Synthetic oligonucleotide
  Target: SCN10A; (+) strand; PAM type: YTN; PAM sequence: CTA
ttttcagtgcttcaccagaa

SEQ ID NO: 71414 - DNA, 20 bp, Artificial Sequence
  Description of Artificial Sequence: Synthetic oligonucleotide
  Target: SCN10A; (+) strand; PAM type: YTN; PAM sequence: TTT
tcagtgcttcaccagaaggc

SEQ ID NO: 71415 - DNA, 20 bp, Artificial Sequence
  Description of Artificial Sequence: Synthetic oligonucleotide
  Target: SCN10A; (+) strand; PAM type: YTN; PAM sequence: TTT
cagtgcttcaccagaaggca

SEQ ID NO: 71416 - DNA, 20 bp, Artificial Sequence
  Description of Artificial Sequence: Synthetic oligonucleotide
  Target: SCN10A; (+) strand; PAM type: YTN; PAM sequence: TTC
agtgcttcaccagaaggcaa

SEQ ID NO: 71417 - DNA, 20 bp, Artificial Sequence
  Description of Artificial Sequence: Synthetic oligonucleotide
  Target: SCN10A; (+) strand; PAM type: YTN; PAM sequence: CTT
caccagaaggcaagtgcccc

SEQ ID NO: 71418 - DNA, 20 bp, Artificial Sequence
  Description of Artificial Sequence: Synthetic oligonucleotide
  Target: SCN10A; (+) strand; PAM type: YTN; PAM sequence: TTC
accagaaggcaagtgcccca

SEQ ID NO: 71419 - DNA, 20 bp, Artificial Sequence
  Description of Artificial Sequence: Synthetic oligonucleotide
  Target: SCN10A; (+) strand; PAM type: YTN; PAM sequence: CTC
aacagcagctaatggagttg

SEQ ID NO: 71420 - DNA, 20 bp, Artificial Sequence
  Description of Artificial Sequence: Synthetic oligonucleotide
  Target: SCN10A; (+) strand; PAM type: YTN; PAM sequence: CTA
atggagttgcatcctctctt

SEQ ID NO: 71421 - DNA, 20 bp, Artificial Sequence
  Description of Artificial Sequence: Synthetic oligonucleotide
  Target: SCN10A; (+) strand; PAM type: YTN; PAM sequence: TTG
catcctctctttggtggtat

SEQ ID NO: 71422 - DNA, 20 bp, Artificial Sequence
  Description of Artificial Sequence: Synthetic oligonucleotide
  Target: SCN10A; (+) strand; PAM type: YTN; PAM sequence: CTC
tctttggtggtatttggctc

SEQ ID NO: 71423 - DNA, 20 bp, Artificial Sequence
  Description of Artificial Sequence: Synthetic oligonucleotide
  Target: SCN10A; (+) strand; PAM type: YTN; PAM sequence: CTC
tttggtggtatttggctctg

SEQ ID NO: 71424 - DNA, 20 bp, Artificial Sequence
  Description of Artificial Sequence: Synthetic oligonucleotide
  Target: SCN10A; (+) strand; PAM type: YTN; PAM sequence: CTT
tggtggtatttggctctgca

SEQ ID NO: 71425 - DNA, 20 bp, Artificial Sequence
  Description of Artificial Sequence: Synthetic oligonucleotide
  Target: SCN10A; (+) strand; PAM type: YTN; PAM sequence: TTT
ggtggtatttggctctgcaa

SEQ ID NO: 71426 - DNA, 20 bp, Artificial Sequence
  Description of Artificial Sequence: Synthetic oligonucleotide
  Target: SCN10A; (+) strand; PAM type: YTN; PAM sequence: TTG
gtggtatttggctctgcaag

SEQ ID NO: 71427 - DNA, 20 bp, Artificial Sequence
  Description of Artificial Sequence: Synthetic oligonucleotide
  Target: SCN10A; (+) strand; PAM type: YTN; PAM sequence: TTT
ggctctgcaaggtatttctt

SEQ ID NO: 71428 - DNA, 20 bp, Artificial Sequence
  Description of Artificial Sequence: Synthetic oligonucleotide
  Target: SCN10A; (+) strand; PAM type: YTN; PAM sequence: TTG
gctctgcaaggtatttcttg

SEQ ID NO: 71429 - DNA, 20 bp, Artificial Sequence
  Description of Artificial Sequence: Synthetic oligonucleotide
  Target: SCN10A; (+) strand; PAM type: YTN; PAM sequence: CTC
tgcaaggtatttcttgatgt

SEQ ID NO: 71430 - DNA, 20 bp, Artificial Sequence
  Description of Artificial Sequence: Synthetic oligonucleotide
  Target: SCN10A; (+) strand; PAM type: YTN; PAM sequence: CTG
caaggtatttcttgatgttg

SEQ ID NO: 71431 - DNA, 20 bp, Artificial Sequence
  Description of Artificial Sequence: Synthetic oligonucleotide
  Target: SCN10A; (+) strand; PAM type: YTN; PAM sequence: TTT
cttgatgttgggttgcagca

SEQ ID NO: 71432 - DNA, 20 bp, Artificial Sequence
  Description of Artificial Sequence: Synthetic oligonucleotide
  Target: SCN10A; (+) strand; PAM type: YTN; PAM sequence: TTC
ttgatgttgggttgcagcat

SEQ ID NO: 71433 - DNA, 20 bp, Artificial Sequence
  Description of Artificial Sequence: Synthetic oligonucleotide
  Target: SCN10A; (+) strand; PAM type: YTN; PAM sequence: CTT
gatgttgggttgcagcattc

SEQ ID NO: 71434 - DNA, 20 bp, Artificial Sequence
  Description of Artificial Sequence: Synthetic oligonucleotide
  Target: SCN10A; (+) strand; PAM type: YTN; PAM sequence: TTG
atgttgggttgcagcattca

SEQ ID NO: 71435 - DNA, 20 bp, Artificial Sequence
  Description of Artificial Sequence: Synthetic oligonucleotide
  Target: SCN10A; (+) strand; PAM type: YTN; PAM sequence: TTG
ggttgcagcattcagatgta

SEQ ID NO: 71436 - DNA, 20 bp, Artificial Sequence
  Description of Artificial Sequence: Synthetic oligonucleotide
  Target: SCN10A; (+) strand; PAM type: YTN; PAM sequence: TTG
cagcattcagatgtaatttt

SEQ ID NO: 71437 - DNA, 20 bp, Artificial Sequence
  Description of Artificial Sequence: Synthetic oligonucleotide
  Target: SCN10A; (+) strand; PAM type: YTN; PAM sequence: TTC
agatgtaatttttaataagc

SEQ ID NO: 71438 - DNA, 20 bp, Artificial Sequence
  Description of Artificial Sequence: Synthetic oligonucleotide
  Target: SCN10A; (+) strand; PAM type: YTN; PAM sequence: TTT
ttaataagcccaatgtgtta

SEQ ID NO: 71439 - DNA, 20 bp, Artificial Sequence
  Description of Artificial Sequence: Synthetic oligonucleotide
  Target: SCN10A; (+) strand; PAM type: YTN; PAM sequence: TTT
taataagcccaatgtgttat

SEQ ID NO: 71440 - DNA, 20 bp, Artificial Sequence
  Description of Artificial Sequence: Synthetic oligonucleotide
  Target: SCN10A; (+) strand; PAM type: YTN; PAM sequence: TTT
aataagcccaatgtgttatt

SEQ ID NO: 71441 - DNA, 20 bp, Artificial Sequence
  Description of Artificial Sequence: Synthetic oligonucleotide
  Target: SCN10A; (+) strand; PAM type: YTN; PAM sequence: TTA
ataagcccaatgtgttattt

SEQ ID NO: 71442 - DNA, 20 bp, Artificial Sequence
  Description of Artificial Sequence: Synthetic oligonucleotide
  Target: SCN10A; (+) strand; PAM type: YTN; PAM sequence: TTA
tttcctaagtgctttttctg

SEQ ID NO: 71443 - DNA, 20 bp, Artificial Sequence
  Description of Artificial Sequence: Synthetic oligonucleotide
  Target: SCN10A; (+) strand; PAM type: YTN; PAM sequence: TTT
cctaagtgctttttctggtg

SEQ ID NO: 71444 - DNA, 20 bp, Artificial Sequence
  Description of Artificial Sequence: Synthetic oligonucleotide
  Target: SCN10A; (+) strand; PAM type: YTN; PAM sequence: TTC
ctaagtgctttttctggtga

SEQ ID NO: 71445 - DNA, 20 bp, Artificial Sequence
  Description of Artificial Sequence: Synthetic oligonucleotide
  Target: SCN10A; (+) strand; PAM type: YTN; PAM sequence: CTA
agtgctttttctggtgaatg

SEQ ID NO: 71446 - DNA, 20 bp, Artificial Sequence
  Description of Artificial Sequence: Synthetic oligonucleotide
  Target: SCN10A; (+) strand; PAM type: YTN; PAM sequence: CTT
tttctggtgaatgaagaaaa

SEQ ID NO: 71447 - DNA, 20 bp, Artificial Sequence
  Description of Artificial Sequence: Synthetic oligonucleotide
  Target: SCN10A; (+) strand; PAM type: YTN; PAM sequence: TTT
ttctggtgaatgaagaaaat

SEQ ID NO: 71448 - DNA, 20 bp, Artificial Sequence
  Description of Artificial Sequence: Synthetic oligonucleotide
  Target: SCN10A; (+) strand; PAM type: YTN; PAM sequence: TTT
tctggtgaatgaagaaaatc

SEQ ID NO: 71449 - DNA, 20 bp, Artificial Sequence
  Description of Artificial Sequence: Synthetic oligonucleotide
  Target: SCN10A; (+) strand; PAM type: YTN; PAM sequence: TTT
ctggtgaatgaagaaaatca

SEQ ID NO: 71450 - DNA, 20 bp, Artificial Sequence
  Description of Artificial Sequence: Synthetic oligonucleotide
  Target: SCN10A; (+) strand; PAM type: YTN; PAM sequence: TTC
tggtgaatgaagaaaatcat

SEQ ID NO: 71451 - DNA, 20 bp, Artificial Sequence
  Description of Artificial Sequence: Synthetic oligonucleotide
  Target: SCN10A; (+) strand; PAM type: YTN; PAM sequence: CTG
gtgaatgaagaaaatcattg

SEQ ID NO: 71452 - DNA, 20 bp, Artificial Sequence
  Description of Artificial Sequence: Synthetic oligonucleotide
  Target: SCN10A; (+) strand; PAM type: YTN; PAM sequence: TTG
ggtattgggaaaaagtcaag

SEQ ID NO: 71453 - DNA, 20 bp, Artificial Sequence
  Description of Artificial Sequence: Synthetic oligonucleotide
  Target: SCN10A; (+) strand; PAM type: YTN; PAM sequence: TTG
ggaaaaagtcaagttctcag

SEQ ID NO: 71454 - DNA, 20 bp, Artificial Sequence
  Description of Artificial Sequence: Synthetic oligonucleotide
  Target: SCN10A; (+) strand; PAM type: YTN; PAM sequence: TTC
tcagccgttgagccacttgc

SEQ ID NO: 71455 - DNA, 20 bp, Artificial Sequence
  Description of Artificial Sequence: Synthetic oligonucleotide
  Target: SCN10A; (+) strand; PAM type: YTN; PAM sequence: CTC
agccgttgagccacttgcac

SEQ ID NO: 71456 - DNA, 20 bp, Artificial Sequence
  Description of Artificial Sequence: Synthetic oligonucleotide
  Target: SCN10A; (+) strand; PAM type: YTN; PAM sequence: TTG
agccacttgcaccactgatg

SEQ ID NO: 71457 - DNA, 20 bp, Artificial Sequence
  Description of Artificial Sequence: Synthetic oligonucleotide
  Target: SCN10A; (+) strand; PAM type: YTN; PAM sequence: CTT
gcaccactgatgtctgattg

SEQ ID NO: 71458 - DNA, 20 bp, Artificial Sequence
  Description of Artificial Sequence: Synthetic oligonucleotide
  Target: SCN10A; (+) strand; PAM type: YTN; PAM sequence: TTG
caccactgatgtctgattgt

SEQ ID NO: 71459 - DNA, 20 bp, Artificial Sequence
  Description of Artificial Sequence: Synthetic oligonucleotide
  Target: SCN10A; (+) strand; PAM type: YTN; PAM sequence: CTG
atgtctgattgttacaaatc

SEQ ID NO: 71460 - DNA, 20 bp, Artificial Sequence
  Description of Artificial Sequence: Synthetic oligonucleotide
  Target: SCN10A; (+) strand; PAM type: YTN; PAM sequence: CTG
attgttacaaatcccgatat

SEQ ID NO: 71461 - DNA, 20 bp, Artificial Sequence
  Description of Artificial Sequence: Synthetic oligonucleotide
  Target: SCN10A; (+) strand; PAM type: YTN; PAM sequence: TTG
ttacaaatcccgatattcag

SEQ ID NO: 71462 - DNA, 20 bp, Artificial Sequence
  Description of Artificial Sequence: Synthetic oligonucleotide
  Target: SCN10A; (+) strand; PAM type: YTN; PAM sequence: TTA
caaatcccgatattcaggct

SEQ ID NO: 71463 - DNA, 20 bp, Artificial Sequence
  Description of Artificial Sequence: Synthetic oligonucleotide
  Target: SCN10A; (+) strand; PAM type: YTN; PAM sequence: TTC
aggctctgaaaacaaagatt

SEQ ID NO: 71464 - DNA, 20 bp, Artificial Sequence
  Description of Artificial Sequence: Synthetic oligonucleotide
  Target: SCN10A; (+) strand; PAM type: YTN; PAM sequence: CTC
tgaaaacaaagattcataat

SEQ ID NO: 71465 - DNA, 20 bp, Artificial Sequence
  Description of Artificial Sequence: Synthetic oligonucleotide
  Target: SCN10A; (+) strand; PAM type: YTN; PAM sequence: CTG
aaaacaaagattcataatat

SEQ ID NO: 71466 - DNA, 20 bp, Artificial Sequence
  Description of Artificial Sequence: Synthetic oligonucleotide
  Target: SCN10A; (+) strand; PAM type: YTN; PAM sequence: TTC
ataatattcaaattctgaat

SEQ ID NO: 71467 - DNA, 20 bp, Artificial Sequence
  Description of Artificial Sequence: Synthetic oligonucleotide
  Target: SCN10A; (+) strand; PAM type: YTN; PAM sequence: TTC
aaattctgaatggatcactg

SEQ ID NO: 71468 - DNA, 20 bp, Artificial Sequence
  Description of Artificial Sequence: Synthetic oligonucleotide
  Target: SCN10A; (+) strand; PAM type: YTN; PAM sequence: TTC
tgaatggatcactgagatac

SEQ ID NO: 71469 - DNA, 20 bp, Artificial Sequence
  Description of Artificial Sequence: Synthetic oligonucleotide
  Target: SCN10A; (+) strand; PAM type: YTN; PAM sequence: CTG
aatggatcactgagataccc

SEQ ID NO: 71470 - DNA, 20 bp, Artificial Sequence
  Description of Artificial Sequence: Synthetic oligonucleotide
  Target: SCN10A; (+) strand; PAM type: YTN; PAM sequence: CTG
agatacccaacttgtattca

SEQ ID NO: 71471 - DNA, 20 bp, Artificial Sequence
  Description of Artificial Sequence: Synthetic oligonucleotide
  Target: SCN10A; (+) strand; PAM type: YTN; PAM sequence: CTT
gtattcataaaaatggtaat

SEQ ID NO: 71472 - DNA, 20 bp, Artificial Sequence
  Description of Artificial Sequence: Synthetic oligonucleotide
  Target: SCN10A; (+) strand; PAM type: YTN; PAM sequence: TTG
tattcataaaaatggtaatt

SEQ ID NO: 71473 - DNA, 20 bp, Artificial Sequence
  Description of Artificial Sequence: Synthetic oligonucleotide
  Target: SCN10A; (+) strand; PAM type: YTN; PAM sequence: TTC
ataaaaatggtaatttaaaa

SEQ ID NO: 71474 - DNA, 20 bp, Artificial Sequence
  Description of Artificial Sequence: Synthetic oligonucleotide
  Target: SCN10A; (+) strand; PAM type: YTN; PAM sequence: TTT
aaaacatttcattccttatt

SEQ ID NO: 71475 - DNA, 20 bp, Artificial Sequence
  Description of Artificial Sequence: Synthetic oligonucleotide
  Target: SCN10A; (+) strand; PAM type: YTN; PAM sequence: TTA
aaacatttcattccttattt

SEQ ID NO: 71476 - DNA, 20 bp, Artificial Sequence
  Description of Artificial Sequence: Synthetic oligonucleotide
  Target: SCN10A; (+) strand; PAM type: YTN; PAM sequence: TTT
cattccttatttttaaaact

SEQ ID NO: 71477 - DNA, 20 bp, Artificial Sequence
  Description of Artificial Sequence: Synthetic oligonucleotide
  Target: SCN10A; (+) strand; PAM type: YTN; PAM sequence: TTC
attccttatttttaaaactc

SEQ ID NO: 71478 - DNA, 20 bp, Artificial Sequence
  Description of Artificial Sequence: Synthetic oligonucleotide
  Target: SCN10A; (+) strand; PAM type: YTN; PAM sequence: TTC
cttatttttaaaactctgtg

SEQ ID NO: 71479 - DNA, 20 bp, Artificial Sequence
  Description of Artificial Sequence: Synthetic oligonucleotide
  Target: SCN10A; (+) strand; PAM type: YTN; PAM sequence: CTT
atttttaaaactctgtgtaa

SEQ ID NO: 71480 - DNA, 20 bp, Artificial Sequence
  Description of Artificial Sequence: Synthetic oligonucleotide
  Target: SCN10A; (+) strand; PAM type: YTN; PAM sequence: TTA
tttttaaaactctgtgtaag

SEQ ID NO: 71481 - DNA, 20 bp, Artificial Sequence
  Description of Artificial Sequence: Synthetic oligonucleotide
  Target: SCN10A; (+) strand; PAM type: YTN; PAM sequence: TTT
ttaaaactctgtgtaagccc

SEQ ID NO: 71482 - DNA, 20 bp, Artificial Sequence
  Description of Artificial Sequence: Synthetic oligonucleotide
  Target: SCN10A; (+) strand; PAM type: YTN; PAM sequence: TTT
taaaactctgtgtaagccct

SEQ ID NO: 71483 - DNA, 20 bp, Artificial Sequence
  Description of Artificial Sequence: Synthetic oligonucleotide
  Target: SCN10A; (+) strand; PAM type: YTN; PAM sequence: TTT
aaaactctgtgtaagccctt

SEQ ID NO: 71484 - DNA, 20 bp, Artificial Sequence
  Description of Artificial Sequence: Synthetic oligonucleotide
  Target: SCN10A; (+) strand; PAM type: YTN; PAM sequence: TTA
aaactctgtgtaagcccttc

SEQ ID NO: 71485 - DNA, 20 bp, Artificial Sequence
  Description of Artificial Sequence: Synthetic oligonucleotide
  Target: SCN10A; (+) strand; PAM type: YTN; PAM sequence: CTC
tgtgtaagcccttcccattt

SEQ ID NO: 71486 - DNA, 20 bp, Artificial Sequence
  Description of Artificial Sequence: Synthetic oligonucleotide
  Target: SCN10A; (+) strand; PAM type: YTN; PAM sequence: CTG
tgtaagcccttcccatttgc

SEQ ID NO: 71487 - DNA, 20 bp, Artificial Sequence
  Description of Artificial Sequence: Synthetic oligonucleotide
  Target: SCN10A; (+) strand; PAM type: YTN; PAM sequence: CTT
cccatttgccagccaaagca

SEQ ID NO: 71488 - DNA, 20 bp, Artificial Sequence
  Description of Artificial Sequence: Synthetic oligonucleotide
  Target: SCN10A; (+) strand; PAM type: YTN; PAM sequence: TTC
ccatttgccagccaaagcaa

SEQ ID NO: 71489 - DNA, 20 bp, Artificial Sequence
  Description of Artificial Sequence: Synthetic oligonucleotide
  Target: SCN10A; (+) strand; PAM type: YTN; PAM sequence: TTT
gccagccaaagcaattcagt

SEQ ID NO: 71490 - DNA, 20 bp, Artificial Sequence
  Description of Artificial Sequence: Synthetic oligonucleotide
  Target: SCN10A; (+) strand; PAM type: YTN; PAM sequence: TTG
ccagccaaagcaattcagtg

SEQ ID NO: 71491 - DNA, 20 bp, Artificial Sequence
  Description of Artificial Sequence: Synthetic oligonucleotide
  Target: SCN10A; (+) strand; PAM type: YTN; PAM sequence: TTC
agtgtgggagagcagcctct

SEQ ID NO: 71492 - DNA, 20 bp, Artificial Sequence
  Description of Artificial Sequence: Synthetic oligonucleotide
  Target: SCN10A; (+) strand; PAM type: YTN; PAM sequence: CTC
tcttactcacttttcatttc

SEQ ID NO: 71493 - DNA, 20 bp, Artificial Sequence
  Description of Artificial Sequence: Synthetic oligonucleotide
  Target: SCN10A; (+) strand; PAM type: YTN; PAM sequence: CTC
ttactcacttttcatttcag

SEQ ID NO: 71494 - DNA, 20 bp, Artificial Sequence
  Description of Artificial Sequence: Synthetic oligonucleotide
  Target: SCN10A; (+) strand; PAM type: YTN; PAM sequence: CTT
actcacttttcatttcagcc

SEQ ID NO: 71495 - DNA, 20 bp, Artificial Sequence
  Description of Artificial Sequence: Synthetic oligonucleotide
  Target: SCN10A; (+) strand; PAM type: YTN; PAM sequence: TTA
ctcacttttcatttcagccc

SEQ ID NO: 71496 - DNA, 20 bp, Artificial Sequence
  Description of Artificial Sequence: Synthetic oligonucleotide
  Target: SCN10A; (+) strand; PAM type: YTN; PAM sequence: CTC
acttttcatttcagcccagt

SEQ ID NO: 71497 - DNA, 20 bp, Artificial Sequence
  Description of Artificial Sequence: Synthetic oligonucleotide
  Target: SCN10A; (+) strand; PAM type: YTN; PAM sequence: CTT
ttcatttcagcccagtaggc

SEQ ID NO: 71498 - DNA, 20 bp, Artificial Sequence
  Description of Artificial Sequence: Synthetic oligonucleotide
  Target: SCN10A; (+) strand; PAM type: YTN; PAM sequence: TTT
tcatttcagcccagtaggcc

SEQ ID NO: 71499 - DNA, 20 bp, Artificial Sequence
  Description of Artificial Sequence: Synthetic oligonucleotide
  Target: SCN10A; (+) strand; PAM type: YTN; PAM sequence: TTT
catttcagcccagtaggcca

SEQ ID NO: 71500 - DNA, 20 bp, Artificial Sequence
  Description of Artificial Sequence: Synthetic oligonucleotide
  Target: SCN10A; (+) strand; PAM type: YTN; PAM sequence: TTC
atttcagcccagtaggccaa

SEQ ID NO: 71501 - DNA, 20 bp, Artificial Sequence
  Description of Artificial Sequence: Synthetic oligonucleotide
  Target: SCN10A; (+) strand; PAM type: YTN; PAM sequence: TTT
cagcccagtaggccaaagag

SEQ ID NO: 71502 - DNA, 20 bp, Artificial Sequence
  Description of Artificial Sequence: Synthetic oligonucleotide
  Target: SCN10A; (+) strand; PAM type: YTN; PAM sequence: TTC
agcccagtaggccaaagaga

SEQ ID NO: 71503 - DNA, 20 bp, Artificial Sequence
  Description of Artificial Sequence: Synthetic oligonucleotide
  Target: SCN10A; (+) strand; PAM type: YTN; PAM sequence: CTA
agtgaccacaatcagtttgt

SEQ ID NO: 71504 - DNA, 20 bp, Artificial Sequence
  Description of Artificial Sequence: Synthetic oligonucleotide
  Target: SCN10A; (+) strand; PAM type: YTN; PAM sequence: TTT
gtattcacaatttccactgt

SEQ ID NO: 71505 - DNA, 20 bp, Artificial Sequence
  Description of Artificial Sequence: Synthetic oligonucleotide
  Target: SCN10A; (+) strand; PAM type: YTN; PAM sequence: TTG
tattcacaatttccactgtg

SEQ ID NO: 71506 - DNA, 20 bp, Artificial Sequence
  Description of Artificial Sequence: Synthetic oligonucleotide
  Target: SCN10A; (+) strand; PAM type: YTN; PAM sequence: TTC
acaatttccactgtgtacct

SEQ ID NO: 71507 - DNA, 20 bp, Artificial Sequence
  Description of Artificial Sequence: Synthetic oligonucleotide
  Target: SCN10A; (+) strand; PAM type: YTN; PAM sequence: TTT
ccactgtgtacctcaacagc

SEQ ID NO: 71508 - DNA, 20 bp, Artificial Sequence
  Description of Artificial Sequence: Synthetic oligonucleotide
  Target: SCN10A; (+) strand; PAM type: YTN; PAM sequence: TTC
cactgtgtacctcaacagca

SEQ ID NO: 71509 - DNA, 20 bp, Artificial Sequence
  Description of Artificial Sequence: Synthetic oligonucleotide
  Target: SCN10A; (+) strand; PAM type: YTN; PAM sequence: CTG
tgtacctcaacagcaaatca

SEQ ID NO: 71510 - DNA, 20 bp, Artificial Sequence
  Description of Artificial Sequence: Synthetic oligonucleotide
  Target: SCN10A; (+) strand; PAM type: YTN; PAM sequence: CTC
aacagcaaatcagaatctgg

SEQ ID NO: 71511 - DNA, 20 bp, Artificial Sequence
  Description of Artificial Sequence: Synthetic oligonucleotide
  Target: SCN10A; (+) strand; PAM type: YTN; PAM sequence: CTG
gaggcatattacagaccccc

SEQ ID NO: 71512 - DNA, 20 bp, Artificial Sequence
  Description of Artificial Sequence: Synthetic oligonucleotide
  Target: SCN10A; (+) strand; PAM type: YTN; PAM sequence: TTA
cagacccccagctgcgttcc

SEQ ID NO: 71513 - DNA, 20 bp, Artificial Sequence
  Description of Artificial Sequence: Synthetic oligonucleotide
  Target: SCN10A; (+) strand; PAM type: YTN; PAM sequence: CTG
cgttccgtgaataaggtatg

SEQ ID NO: 71514 - DNA, 20 bp, Artificial Sequence
  Description of Artificial Sequence: Synthetic oligonucleotide
  Target: SCN10A; (+) strand; PAM type: YTN; PAM sequence: TTC
cgtgaataaggtatgcacta

SEQ ID NO: 71515 - DNA, 20 bp, Artificial Sequence
  Description of Artificial Sequence: Synthetic oligonucleotide
  Target: SCN10A; (+) strand; PAM type: YTN; PAM sequence: CTA
gcattgggatctgggagcag

SEQ ID NO: 71516 - DNA, 20 bp, Artificial Sequence
  Description of Artificial Sequence: Synthetic oligonucleotide
  Target: SCN10A; (+) strand; PAM type: YTN; PAM sequence: TTG
ggatctgggagcagcatctt

SEQ ID NO: 71517 - DNA, 20 bp, Artificial Sequence
  Description of Artificial Sequence: Synthetic oligonucleotide
  Target: SCN10A; (+) strand; PAM type: YTN; PAM sequence: CTG
ggagcagcatcttctatctg

SEQ ID NO: 71518 - DNA, 20 bp, Artificial Sequence
  Description of Artificial Sequence: Synthetic oligonucleotide
  Target: SCN10A; (+) strand; PAM type: YTN; PAM sequence: CTT
ctatctggatagtgatacct

SEQ ID NO: 71519 - DNA, 20 bp, Artificial Sequence
  Description of Artificial Sequence: Synthetic oligonucleotide
  Target: SCN10A; (+) strand; PAM type: YTN; PAM sequence: TTC
tatctggatagtgatacctt

SEQ ID NO: 71520 - DNA, 20 bp, Artificial Sequence
  Description of Artificial Sequence: Synthetic oligonucleotide
  Target: SCN10A; (+) strand; PAM type: YTN; PAM sequence: CTA
tctggatagtgatacctttc

SEQ ID NO: 71521 - DNA, 20 bp, Artificial Sequence
  Description of Artificial Sequence: Synthetic oligonucleotide
  Target: SCN10A; (+) strand; PAM type: YTN; PAM sequence: CTG
gatagtgatacctttccttg

SEQ ID NO: 71522 - DNA, 20 bp, Artificial Sequence
  Description of Artificial Sequence: Synthetic oligonucleotide
  Target: SCN10A; (+) strand; PAM type: YTN; PAM sequence: CTT
tccttgctgaccatgtggct

SEQ ID NO: 71523 - DNA, 20 bp, Artificial Sequence
  Description of Artificial Sequence: Synthetic oligonucleotide
  Target: SCN10A; (+) strand; PAM type: YTN; PAM sequence: TTT
ccttgctgaccatgtggctg

SEQ ID NO: 71524 - DNA, 20 bp, Artificial Sequence
  Description of Artificial Sequence: Synthetic oligonucleotide
  Target: SCN10A; (+) strand; PAM type: YTN; PAM sequence: TTC
cttgctgaccatgtggctgg

SEQ ID NO: 71525 - DNA, 20 bp, Artificial Sequence
  Description of Artificial Sequence: Synthetic oligonucleotide
  Target: SCN10A; (+) strand; PAM type: YTN; PAM sequence: CTT
gctgaccatgtggctggagt

SEQ ID NO: 71526 - DNA, 20 bp, Artificial Sequence
  Description of Artificial Sequence: Synthetic oligonucleotide
  Target: SCN10A; (+) strand; PAM type: YTN; PAM sequence: TTG
ctgaccatgtggctggagtt

SEQ ID NO: 71527 - DNA, 20 bp, Artificial Sequence
  Description of Artificial Sequence: Synthetic oligonucleotide
  Target: SCN10A; (+) strand; PAM type: YTN; PAM sequence: CTG
accatgtggctggagtttct

SEQ ID NO: 71528 - DNA, 20 bp, Artificial Sequence
  Description of Artificial Sequence: Synthetic oligonucleotide
  Target: SCN10A; (+) strand; PAM type: YTN; PAM sequence: CTG
gagtttcttcaatggcaatt

SEQ ID NO: 71529 - DNA, 20 bp, Artificial Sequence
  Description of Artificial Sequence: Synthetic oligonucleotide
  Target: SCN10A; (+) strand; PAM type: YTN; PAM sequence: TTT
cttcaatggcaatttaacac

SEQ ID NO: 71530 - DNA, 20 bp, Artificial Sequence
  Description of Artificial Sequence: Synthetic oligonucleotide
  Target: SCN10A; (+) strand; PAM type: YTN; PAM sequence: TTC
ttcaatggcaatttaacacc

SEQ ID NO: 71531 - DNA, 20 bp, Artificial Sequence
  Description of Artificial Sequence: Synthetic oligonucleotide
  Target: SCN10A; (+) strand; PAM type: YTN; PAM sequence: CTT
caatggcaatttaacacctt

SEQ ID NO: 71532 - DNA, 20 bp, Artificial Sequence
  Description of Artificial Sequence: Synthetic oligonucleotide
  Target: SCN10A; (+) strand; PAM type: YTN; PAM sequence: TTC
aatggcaatttaacaccttt

SEQ ID NO: 71533 - DNA, 20 bp, Artificial Sequence
  Description of Artificial Sequence: Synthetic oligonucleotide
  Target: SCN10A; (+) strand; PAM type: YTN; PAM sequence: TTT
aacacctttcctcttttaaa

SEQ ID NO: 71534 - DNA, 20 bp, Artificial Sequence
  Description of Artificial Sequence: Synthetic oligonucleotide
  Target: SCN10A; (+) strand; PAM type: YTN; PAM sequence: TTA
acacctttcctcttttaaaa

SEQ ID NO: 71535 - DNA, 20 bp, Artificial Sequence
  Description of Artificial Sequence: Synthetic oligonucleotide
  Target: SCN10A; (+) strand; PAM type: YTN; PAM sequence: CTT
tcctcttttaaaaaaaagtt

SEQ ID NO: 71536 - DNA, 20 bp, Artificial Sequence
  Description of Artificial Sequence: Synthetic oligonucleotide
  Target: SCN10A; (+) strand; PAM type: YTN; PAM sequence: TTT
cctcttttaaaaaaaagttt

SEQ ID NO: 71537 - DNA, 20 bp, Artificial Sequence
  Description of Artificial Sequence: Synthetic oligonucleotide
  Target: SCN10A; (+) strand; PAM type: YTN; PAM sequence: TTC
ctcttttaaaaaaaagtttt

SEQ ID NO: 71538 - DNA, 20 bp, Artificial Sequence
  Description of Artificial Sequence: Synthetic oligonucleotide
  Target: SCN10A; (+) strand; PAM type: YTN; PAM sequence: CTC
ttttaaaaaaaagttttggt

SEQ ID NO: 71539 - DNA, 20 bp, Artificial Sequence
  Description of Artificial Sequence: Synthetic oligonucleotide
  Target: SCN10A; (+) strand; PAM type: YTN; PAM sequence: CTT
ttaaaaaaaagttttggtaa

SEQ ID NO: 71540 - DNA, 20 bp, Artificial Sequence
  Description of Artificial Sequence: Synthetic oligonucleotide
  Target: SCN10A; (+) strand; PAM type: YTN; PAM sequence: TTT
taaaaaaaagttttggtaaa

SEQ ID NO: 71541 - DNA, 20 bp, Artificial Sequence
  Description of Artificial Sequence: Synthetic oligonucleotide
  Target: SCN10A; (+) strand; PAM type: YTN; PAM sequence: TTT
aaaaaaaagttttggtaaaa

SEQ ID NO: 71542 - DNA, 20 bp, Artificial Sequence
  Description of Artificial Sequence: Synthetic oligonucleotide
  Target: SCN10A; (+) strand; PAM type: YTN; PAM sequence: TTA
aaaaaaagttttggtaaaat

SEQ ID NO: 71543 - DNA, 20 bp, Artificial Sequence
  Description of Artificial Sequence: Synthetic oligonucleotide
  Target: SCN10A; (+) strand; PAM type: YTN; PAM sequence: TTT
tggtaaaatatgcataatat

SEQ ID NO: 71544 - DNA, 20 bp, Artificial Sequence
  Description of Artificial Sequence: Synthetic oligonucleotide
  Target: SCN10A; (+) strand; PAM type: YTN; PAM sequence: TTT
ggtaaaatatgcataatata

SEQ ID NO: 71545 - DNA, 20 bp, Artificial Sequence
  Description of Artificial Sequence: Synthetic oligonucleotide
  Target: SCN10A; (+) strand; PAM type: YTN; PAM sequence: TTG
gtaaaatatgcataatatac

SEQ ID NO: 71546 - DNA, 20 bp, Artificial Sequence
  Description of Artificial Sequence: Synthetic oligonucleotide
  Target: SCN10A; (+) strand; PAM type: YTN; PAM sequence: TTT
accactttcaccatttttaa

SEQ ID NO: 71547 - DNA, 20 bp, Artificial Sequence
  Description of Artificial Sequence: Synthetic oligonucleotide
  Target: SCN10A; (+) strand; PAM type: YTN; PAM sequence: TTA
ccactttcaccatttttaag

SEQ ID NO: 71548 - DNA, 20 bp, Artificial Sequence
  Description of Artificial Sequence: Synthetic oligonucleotide
  Target: SCN10A; (+) strand; PAM type: YTN; PAM sequence: CTT
tcaccatttttaagtacaca

SEQ ID NO: 71549 - DNA, 20 bp, Artificial Sequence
  Description of Artificial Sequence: Synthetic oligonucleotide
  Target: SCN10A; (+) strand; PAM type: YTN; PAM sequence: TTT
caccatttttaagtacacaa

SEQ ID NO: 71550 - DNA, 20 bp, Artificial Sequence
  Description of Artificial Sequence: Synthetic oligonucleotide
  Target: SCN10A; (+) strand; PAM type: YTN; PAM sequence: TTC
accatttttaagtacacaat

SEQ ID NO: 71551 - DNA, 20 bp, Artificial Sequence
  Description of Artificial Sequence: Synthetic oligonucleotide
  Target: SCN10A; (+) strand; PAM type: YTN; PAM sequence: TTT
ttaagtacacaatttagtgg

SEQ ID NO: 71552 - DNA, 20 bp, Artificial Sequence
  Description of Artificial Sequence: Synthetic oligonucleotide
  Target: SCN10A; (+) strand; PAM type: YTN; PAM sequence: TTT
taagtacacaatttagtggc

SEQ ID NO: 71553 - DNA, 20 bp, Artificial Sequence
  Description of Artificial Sequence: Synthetic oligonucleotide
  Target: SCN10A; (+) strand; PAM type: YTN; PAM sequence: TTT
aagtacacaatttagtggca

SEQ ID NO: 71554 - DNA, 20 bp, Artificial Sequence
  Description of Artificial Sequence: Synthetic oligonucleotide
  Target: SCN10A; (+) strand; PAM type: YTN; PAM sequence: TTA
agtacacaatttagtggcat

SEQ ID NO: 71555 - DNA, 20 bp, Artificial Sequence
  Description of Artificial Sequence: Synthetic oligonucleotide
  Target: SCN10A; (+) strand; PAM type: YTN; PAM sequence: TTT
agtggcattaagtacattca

SEQ ID NO: 71556 - DNA, 20 bp, Artificial Sequence
  Description of Artificial Sequence: Synthetic oligonucleotide
  Target: SCN10A; (+) strand; PAM type: YTN; PAM sequence: TTA
gtggcattaagtacattcag

SEQ ID NO: 71557 - DNA, 20 bp, Artificial Sequence
  Description of Artificial Sequence: Synthetic oligonucleotide
  Target: SCN10A; (+) strand; PAM type: YTN; PAM sequence: TTA
agtacattcagtattgtgga

SEQ ID NO: 71558 - DNA, 20 bp, Artificial Sequence
  Description of Artificial Sequence: Synthetic oligonucleotide
  Target: SCN10A; (+) strand; PAM type: YTN; PAM sequence: TTC
agtattgtggaactatcacc

SEQ ID NO: 71559 - DNA, 20 bp, Artificial Sequence
  Description of Artificial Sequence: Synthetic oligonucleotide
  Target: SCN10A; (+) strand; PAM type: YTN; PAM sequence: TTG
tggaactatcaccactatct

SEQ ID NO: 71560 - DNA, 20 bp, Artificial Sequence
  Description of Artificial Sequence: Synthetic oligonucleotide
  Target: SCN10A; (+) strand; PAM type: YTN; PAM sequence: CTA
tcaccactatctgtttccaa

SEQ ID NO: 71561 - DNA, 20 bp, Artificial Sequence
  Description of Artificial Sequence: Synthetic oligonucleotide
  Target: SCN10A; (+) strand; PAM type: YTN; PAM sequence: CTA
tctgtttccaaactttttta

SEQ ID NO: 71562 - DNA, 20 bp, Artificial Sequence
  Description of Artificial Sequence: Synthetic oligonucleotide
  Target: SCN10A; (+) strand; PAM type: YTN; PAM sequence: CTG
tttccaaacttttttataat

SEQ ID NO: 71563 - DNA, 20 bp, Artificial Sequence
  Description of Artificial Sequence: Synthetic oligonucleotide
  Target: SCN10A; (+) strand; PAM type: YTN; PAM sequence: TTT
ccaaacttttttataatccc

SEQ ID NO: 71564 - DNA, 20 bp, Artificial Sequence
  Description of Artificial Sequence: Synthetic oligonucleotide
  Target: SCN10A; (+) strand; PAM type: YTN; PAM sequence: TTC
caaacttttttataatcccg

SEQ ID NO: 71565 - DNA, 20 bp, Artificial Sequence
  Description of Artificial Sequence: Synthetic oligonucleotide
  Target: SCN10A; (+) strand; PAM type: YTN; PAM sequence: CTT
ttttataatcccgaacagaa

SEQ ID NO: 71566 - DNA, 20 bp, Artificial Sequence
  Description of Artificial Sequence: Synthetic oligonucleotide
  Target: SCN10A; (+) strand; PAM type: YTN; PAM sequence: TTT
tttataatcccgaacagaaa

SEQ ID NO: 71567 - DNA, 20 bp, Artificial Sequence
  Description of Artificial Sequence: Synthetic oligonucleotide
  Target: SCN10A; (+) strand; PAM type: YTN; PAM sequence: TTT
ttataatcccgaacagaaat

SEQ ID NO: 71568 - DNA, 20 bp, Artificial Sequence
  Description of Artificial Sequence: Synthetic oligonucleotide
  Target: SCN10A; (+) strand; PAM type: YTN; PAM sequence: TTT
tataatcccgaacagaaatg

SEQ ID NO: 71569 - DNA, 20 bp, Artificial Sequence
  Description of Artificial Sequence: Synthetic oligonucleotide
  Target: SCN10A; (+) strand; PAM type: YTN; PAM sequence: TTT
ataatcccgaacagaaatgt

SEQ ID NO: 71570 - DNA, 20 bp, Artificial Sequence
  Description of Artificial Sequence: Synthetic oligonucleotide
  Target: SCN10A; (+) strand; PAM type: YTN; PAM sequence: TTA
taatcccgaacagaaatgta

SEQ ID NO: 71571 - DNA, 20 bp, Artificial Sequence
  Description of Artificial Sequence: Synthetic oligonucleotide
  Target: SCN10A; (+) strand; PAM type: YTN; PAM sequence: TTA
aataataactccccattccc

SEQ ID NO: 71572 - DNA, 20 bp, Artificial Sequence
  Description of Artificial Sequence: Synthetic oligonucleotide
  Target: SCN10A; (+) strand; PAM type: YTN; PAM sequence: CTC
cccattccccctctctggca

SEQ ID NO: 71573 - DNA, 20 bp, Artificial Sequence
  Description of Artificial Sequence: Synthetic oligonucleotide
  Target: SCN10A; (+) strand; PAM type: YTN; PAM sequence: TTC
cccctctctggcaacttcca

SEQ ID NO: 71574 - DNA, 20 bp, Artificial Sequence
  Description of Artificial Sequence: Synthetic oligonucleotide
  Target: SCN10A; (+) strand; PAM type: YTN; PAM sequence: CTC
tctggcaacttccattctac

SEQ ID NO: 71575 - DNA, 20 bp, Artificial Sequence
  Description of Artificial Sequence: Synthetic oligonucleotide
  Target: SCN10A; (+) strand; PAM type: YTN; PAM sequence: CTC
tggcaacttccattctactt

SEQ ID NO: 71576 - DNA, 20 bp, Artificial Sequence
  Description of Artificial Sequence: Synthetic oligonucleotide
  Target: SCN10A; (+) strand; PAM type: YTN; PAM sequence: CTG
gcaacttccattctactttc

SEQ ID NO: 71577 - DNA, 20 bp, Artificial Sequence
  Description of Artificial Sequence: Synthetic oligonucleotide
  Target: SCN10A; (+) strand; PAM type: YTN; PAM sequence: CTT
ccattctactttctgtctcc

SEQ ID NO: 71578 - DNA, 20 bp, Artificial Sequence
  Description of Artificial Sequence: Synthetic oligonucleotide
  Target: SCN10A; (+) strand; PAM type: YTN; PAM sequence: TTC
cattctactttctgtctcca

SEQ ID NO: 71579 - DNA, 20 bp, Artificial Sequence
  Description of Artificial Sequence: Synthetic oligonucleotide
  Target: SCN10A; (+) strand; PAM type: YTN; PAM sequence: TTC
tactttctgtctccatgaat

SEQ ID NO: 71580 - DNA, 20 bp, Artificial Sequence
  Description of Artificial Sequence: Synthetic oligonucleotide
  Target: SCN10A; (+) strand; PAM type: YTN; PAM sequence: CTA
ctttctgtctccatgaattt

SEQ ID NO: 71581 - DNA, 20 bp, Artificial Sequence
  Description of Artificial Sequence: Synthetic oligonucleotide
  Target: SCN10A; (+) strand; PAM type: YTN; PAM sequence: CTT
tctgtctccatgaatttgcc

SEQ ID NO: 71582 - DNA, 20 bp, Artificial Sequence
  Description of Artificial Sequence: Synthetic oligonucleotide
  Target: SCN10A; (+) strand; PAM type: YTN; PAM sequence: TTT
ctgtctccatgaatttgcct

SEQ ID NO: 71583 - DNA, 20 bp, Artificial Sequence
  Description of Artificial Sequence: Synthetic oligonucleotide
  Target: SCN10A; (+) strand; PAM type: YTN; PAM sequence: TTC
tgtctccatgaatttgcctg

SEQ ID NO: 71584 - DNA, 20 bp, Artificial Sequence
  Description of Artificial Sequence: Synthetic oligonucleotide
  Target: SCN10A; (+) strand; PAM type: YTN; PAM sequence: CTG
tctccatgaatttgcctgtt

SEQ ID NO: 71585 - DNA, 20 bp, Artificial Sequence
  Description of Artificial Sequence: Synthetic oligonucleotide
  Target: SCN10A; (+) strand; PAM type: YTN; PAM sequence: CTC
catgaatttgcctgttctag

SEQ ID NO: 71586 - DNA, 20 bp, Artificial Sequence
  Description of Artificial Sequence: Synthetic oligonucleotide
  Target: SCN10A; (+) strand; PAM type: YTN; PAM sequence: TTT
gcctgttctaggtacctact

SEQ ID NO: 71587 - DNA, 20 bp, Artificial Sequence
  Description of Artificial Sequence: Synthetic oligonucleotide
  Target: SCN10A; (+) strand; PAM type: YTN; PAM sequence: TTG
cctgttctaggtacctacta

SEQ ID NO: 71588 - DNA, 20 bp, Artificial Sequence
  Description of Artificial Sequence: Synthetic oligonucleotide
  Target: SCN10A; (+) strand; PAM type: YTN; PAM sequence: CTG
ttctaggtacctactaaagg

SEQ ID NO: 71589 - DNA, 20 bp, Artificial Sequence
  Description of Artificial Sequence: Synthetic oligonucleotide
  Target: SCN10A; (+) strand; PAM type: YTN; PAM sequence: TTC
taggtacctactaaaggtgg

SEQ ID NO: 71590 - DNA, 20 bp, Artificial Sequence
  Description of Artificial Sequence: Synthetic oligonucleotide
  Target: SCN10A; (+) strand; PAM type: YTN; PAM sequence: CTA
ggtacctactaaaggtggaa

SEQ ID NO: 71591 - DNA, 20 bp, Artificial Sequence
  Description of Artificial Sequence: Synthetic oligonucleotide
  Target: SCN10A; (+) strand; PAM type: YTN; PAM sequence: CTA
ctaaaggtggaatcatgcaa

SEQ ID NO: 71592 - DNA, 20 bp, Artificial Sequence
  Description of Artificial Sequence: Synthetic oligonucleotide
  Target: SCN10A; (+) strand; PAM type: YTN; PAM sequence: CTA
aaggtggaatcatgcaacat

SEQ ID NO: 71593 - DNA, 20 bp, Artificial Sequence
  Description of Artificial Sequence: Synthetic oligonucleotide
  Target: SCN10A; (+) strand; PAM type: YTN; PAM sequence: TTT
gttcttttgcgtttgagtta

SEQ ID NO: 71594 - DNA, 20 bp, Artificial Sequence
  Description of Artificial Sequence: Synthetic oligonucleotide
  Target: SCN10A; (+) strand; PAM type: YTN; PAM sequence: TTG
ttcttttgcgtttgagttat

SEQ ID NO: 71595 - DNA, 20 bp, Artificial Sequence
  Description of Artificial Sequence: Synthetic oligonucleotide
  Target: SCN10A; (+) strand; PAM type: YTN; PAM sequence: TTC
ttttgcgtttgagttatttt

SEQ ID NO: 71596 - DNA, 20 bp, Artificial Sequence
  Description of Artificial Sequence: Synthetic oligonucleotide
  Target: SCN10A; (+) strand; PAM type: YTN; PAM sequence: CTT
ttgcgtttgagttattttac

SEQ ID NO: 71597 - DNA, 20 bp, Artificial Sequence
  Description of Artificial Sequence: Synthetic oligonucleotide
  Target: SCN10A; (+) strand; PAM type: YTN; PAM sequence: TTT
tgcgtttgagttattttact

SEQ ID NO: 71598 - DNA, 20 bp, Artificial Sequence
  Description of Artificial Sequence: Synthetic oligonucleotide
  Target: SCN10A; (+) strand; PAM type: YTN; PAM sequence: TTT
gcgtttgagttattttactt

SEQ ID NO: 71599 - DNA, 20 bp, Artificial Sequence
  Description of Artificial Sequence: Synthetic oligonucleotide
  Target: SCN10A; (+) strand; PAM type: YTN; PAM sequence: TTG
cgtttgagttattttactta

SEQ ID NO: 71600 - DNA, 20 bp, Artificial Sequence
  Description of Artificial Sequence: Synthetic oligonucleotide
  Target: SCN10A; (+) strand; PAM type: YTN; PAM sequence: TTT
gagttattttacttagcaca

SEQ ID NO: 71601 - DNA, 20 bp, Artificial Sequence
  Description of Artificial Sequence: Synthetic oligonucleotide
  Target: SCN10A; (+) strand; PAM type: YTN; PAM sequence: TTG
agttattttacttagcacaa

SEQ ID NO: 71602 - DNA, 20 bp, Artificial Sequence
  Description of Artificial Sequence: Synthetic oligonucleotide
  Target: SCN10A; (+) strand; PAM type: YTN; PAM sequence: TTA
ttttacttagcacaatgctt

SEQ ID NO: 71603 - DNA, 20 bp, Artificial Sequence
  Description of Artificial Sequence: Synthetic oligonucleotide
  Target: SCN10A; (+) strand; PAM type: YTN; PAM sequence: TTT
tacttagcacaatgctttgt

SEQ ID NO: 71604 - DNA, 20 bp, Artificial Sequence
  Description of Artificial Sequence: Synthetic oligonucleotide
  Target: SCN10A; (+) strand; PAM type: YTN; PAM sequence: TTT
acttagcacaatgctttgtc

SEQ ID NO: 71605 - DNA, 20 bp, Artificial Sequence
  Description of Artificial Sequence: Synthetic oligonucleotide
  Target: SCN10A; (+) strand; PAM type: YTN; PAM sequence: TTA
cttagcacaatgctttgtca

SEQ ID NO: 71606 - DNA, 20 bp, Artificial Sequence
  Description of Artificial Sequence: Synthetic oligonucleotide
  Target: SCN10A; (+) strand; PAM type: YTN; PAM sequence: CTT
agcacaatgctttgtcaatg

SEQ ID NO: 71607 - DNA, 20 bp, Artificial Sequence
  Description of Artificial Sequence: Synthetic oligonucleotide
  Target: SCN10A; (+) strand; PAM type: YTN; PAM sequence: TTA
gcacaatgctttgtcaatgt

SEQ ID NO: 71608 - DNA, 20 bp, Artificial Sequence
  Description of Artificial Sequence: Synthetic oligonucleotide
  Target: SCN10A; (+) strand; PAM type: YTN; PAM sequence: CTT
tgtcaatgttgtggcatgta

SEQ ID NO: 71609 - DNA, 20 bp, Artificial Sequence
  Description of Artificial Sequence: Synthetic oligonucleotide
  Target: SCN10A; (+) strand; PAM type: YTN; PAM sequence: TTT
gtcaatgttgtggcatgtat

SEQ ID NO: 71610 - DNA, 20 bp, Artificial Sequence
  Description of Artificial Sequence: Synthetic oligonucleotide
  Target: SCN10A; (+) strand; PAM type: YTN; PAM sequence: TTG
tcaatgttgtggcatgtatc

SEQ ID NO: 71611 - DNA, 20 bp, Artificial Sequence
  Description of Artificial Sequence: Synthetic oligonucleotide
  Target: SCN10A; (+) strand; PAM type: YTN; PAM sequence: TTG
tggcatgtatcagaatctca

SEQ ID NO: 71612 - DNA, 20 bp, Artificial Sequence
  Description of Artificial Sequence: Synthetic oligonucleotide
  Target: SCN10A; (+) strand; PAM type: YTN; PAM sequence: CTC
attcatttttaaaactgaat

SEQ ID NO: 71613 - DNA, 20 bp, Artificial Sequence
  Description of Artificial Sequence: Synthetic oligonucleotide
  Target: SCN10A; (+) strand; PAM type: YTN; PAM sequence: TTC
atttttaaaactgaatgata

SEQ ID NO: 71614 - DNA, 20 bp, Artificial Sequence
  Description of Artificial Sequence: Synthetic oligonucleotide
  Target: SCN10A; (+) strand; PAM type: YTN; PAM sequence: TTT
ttaaaactgaatgatattca

SEQ ID NO: 71615 - DNA, 20 bp, Artificial Sequence
  Description of Artificial Sequence: Synthetic oligonucleotide
  Target: SCN10A; (+) strand; PAM type: YTN; PAM sequence: TTT
taaaactgaatgatattcaa

SEQ ID NO: 71616 - DNA, 20 bp, Artificial Sequence
  Description of Artificial Sequence: Synthetic oligonucleotide
  Target: SCN10A; (+) strand; PAM type: YTN; PAM sequence: TTT
aaaactgaatgatattcaat

SEQ ID NO: 71617 - DNA, 20 bp, Artificial Sequence
  Description of Artificial Sequence: Synthetic oligonucleotide
  Target: SCN10A; (+) strand; PAM type: YTN; PAM sequence: TTA
aaactgaatgatattcaatt

SEQ ID NO: 71618 - DNA, 20 bp, Artificial Sequence
  Description of Artificial Sequence: Synthetic oligonucleotide
  Target: SCN10A; (+) strand; PAM type: YTN; PAM sequence: CTG
aatgatattcaattgtttac

SEQ ID NO: 71619 - DNA, 20 bp, Artificial Sequence
  Description of Artificial Sequence: Synthetic oligonucleotide
  Target: SCN10A; (+) strand; PAM type: YTN; PAM sequence: TTC
aattgtttacatatatacta

SEQ ID NO: 71620 - DNA, 20 bp, Artificial Sequence
  Description of Artificial Sequence: Synthetic oligonucleotide
  Target: SCN10A; (+) strand; PAM type: YTN; PAM sequence: TTG
tttacatatatactacattt

SEQ ID NO: 71621 - DNA, 20 bp, Artificial Sequence
  Description of Artificial Sequence: Synthetic oligonucleotide
  Target: SCN10A; (+) strand; PAM type: YTN; PAM sequence: TTT
acatatatactacatttttt

SEQ ID NO: 71622 - DNA, 20 bp, Artificial Sequence
  Description of Artificial Sequence: Synthetic oligonucleotide
  Target: SCN10A; (+) strand; PAM type: YTN; PAM sequence: TTA
catatatactacatttttta

SEQ ID NO: 71623 - DNA, 20 bp, Artificial Sequence
  Description of Artificial Sequence: Synthetic oligonucleotide
  Target: SCN10A; (+) strand; PAM type: YTN; PAM sequence: CTA
cattttttatccattcatct

SEQ ID NO: 71624 - DNA, 20 bp, Artificial Sequence
  Description of Artificial Sequence: Synthetic oligonucleotide
  Target: SCN10A; (+) strand; PAM type: YTN; PAM sequence: TTT
tttatccattcatctgttga

SEQ ID NO: 71625 - DNA, 20 bp, Artificial Sequence
  Description of Artificial Sequence: Synthetic oligonucleotide
  Target: SCN10A; (+) strand; PAM type: YTN; PAM sequence: TTT
ttatccattcatctgttgat

SEQ ID NO: 71626 - DNA, 20 bp, Artificial Sequence
  Description of Artificial Sequence: Synthetic oligonucleotide
  Target: SCN10A; (+) strand; PAM type: YTN; PAM sequence: TTT
tatccattcatctgttgatg

SEQ ID NO: 71627 - DNA, 20 bp, Artificial Sequence
  Description of Artificial Sequence: Synthetic oligonucleotide
  Target: SCN10A; (+) strand; PAM type: YTN; PAM sequence: TTT
atccattcatctgttgatgg

SEQ ID NO: 71628 - DNA, 20 bp, Artificial Sequence
  Description of Artificial Sequence: Synthetic oligonucleotide
  Target: SCN10A; (+) strand; PAM type: YTN; PAM sequence: TTA
tccattcatctgttgatgga

SEQ ID NO: 71629 - DNA, 20 bp, Artificial Sequence
  Description of Artificial Sequence: Synthetic oligonucleotide
  Target: SCN10A; (+) strand; PAM type: YTN; PAM sequence: TTC
atctgttgatggacatattt

SEQ ID NO: 71630 - DNA, 20 bp, Artificial Sequence
  Description of Artificial Sequence: Synthetic oligonucleotide
  Target: SCN10A; (+) strand; PAM type: YTN; PAM sequence: CTG
ttgatggacatatttggcta

SEQ ID NO: 71631 - DNA, 20 bp, Artificial Sequence
  Description of Artificial Sequence: Synthetic oligonucleotide
  Target: SCN10A; (+) strand; PAM type: YTN; PAM sequence: TTG
atggacatatttggctattg

SEQ ID NO: 71632 - DNA, 20 bp, Artificial Sequence
  Description of Artificial Sequence: Synthetic oligonucleotide
  Target: SCN10A; (+) strand; PAM type: YTN; PAM sequence: TTT
ggctattgtgaataacgctg

SEQ ID NO: 71633 - DNA, 20 bp, Artificial Sequence
  Description of Artificial Sequence: Synthetic oligonucleotide
  Target: SCN10A; (+) strand; PAM type: YTN; PAM sequence: TTG
gctattgtgaataacgctgc

SEQ ID NO: 71634 - DNA, 20 bp, Artificial Sequence
  Description of Artificial Sequence: Synthetic oligonucleotide
  Target: SCN10A; (+) strand; PAM type: YTN; PAM sequence: CTA
ttgtgaataacgctgctaca

SEQ ID NO: 71635 - DNA, 20 bp, Artificial Sequence
  Description of Artificial Sequence: Synthetic oligonucleotide
  Target: SCN10A; (+) strand; PAM type: YTN; PAM sequence: TTG
tgaataacgctgctacaaac

SEQ ID NO: 71636 - DNA, 20 bp, Artificial Sequence
  Description of Artificial Sequence: Synthetic oligonucleotide
  Target: SCN10A; (+) strand; PAM type: YTN; PAM sequence: CTG
ctacaaacattagtgcataa

SEQ ID NO: 71637 - DNA, 20 bp, Artificial Sequence
  Description of Artificial Sequence: Synthetic oligonucleotide
  Target: SCN10A; (+) strand; PAM type: YTN; PAM sequence: CTA
caaacattagtgcataagcc

SEQ ID NO: 71638 - DNA, 20 bp, Artificial Sequence
  Description of Artificial Sequence: Synthetic oligonucleotide
  Target: SCN10A; (+) strand; PAM type: YTN; PAM sequence: TTA
gtgcataagccaacatacct

SEQ ID NO: 71639 - DNA, 20 bp, Artificial Sequence
  Description of Artificial Sequence: Synthetic oligonucleotide
  Target: SCN10A; (+) strand; PAM type: YTN; PAM sequence: CTT
ttaaagtctgtttcataggt

SEQ ID NO: 71640 - DNA, 20 bp, Artificial Sequence
  Description of Artificial Sequence: Synthetic oligonucleotide
  Target: SCN10A; (+) strand; PAM type: YTN; PAM sequence: TTT
taaagtctgtttcataggtt

SEQ ID NO: 71641 - DNA, 20 bp, Artificial Sequence
  Description of Artificial Sequence: Synthetic oligonucleotide
  Target: SCN10A; (+) strand; PAM type: YTN; PAM sequence: TTT
aaagtctgtttcataggttc

SEQ ID NO: 71642 - DNA, 20 bp, Artificial Sequence
  Description of Artificial Sequence: Synthetic oligonucleotide
  Target: SCN10A; (+) strand; PAM type: YTN; PAM sequence: TTA
aagtctgtttcataggttca

SEQ ID NO: 71643 - DNA, 20 bp, Artificial Sequence
  Description of Artificial Sequence: Synthetic oligonucleotide
  Target: SCN10A; (+) strand; PAM type: YTN; PAM sequence: CTG
tttcataggttcaaactaat

SEQ ID NO: 71644 - DNA, 20 bp, Artificial Sequence
  Description of Artificial Sequence: Synthetic oligonucleotide
  Target: SCN10A; (+) strand; PAM type: YTN; PAM sequence: TTT
cataggttcaaactaatttt

SEQ ID NO: 71645 - DNA, 20 bp, Artificial Sequence
  Description of Artificial Sequence: Synthetic oligonucleotide
  Target: SCN10A; (+) strand; PAM type: YTN; PAM sequence: TTC
ataggttcaaactaattttt

SEQ ID NO: 71646 - DNA, 20 bp, Artificial Sequence
  Description of Artificial Sequence: Synthetic oligonucleotide
  Target: SCN10A; (+) strand; PAM type: YTN; PAM sequence: TTC
aaactaatttttaattaaac

SEQ ID NO: 71647 - DNA, 20 bp, Artificial Sequence
  Description of Artificial Sequence: Synthetic oligonucleotide
  Target: SCN10A; (+) strand; PAM type: YTN; PAM sequence: CTA
atttttaattaaaccagaga

SEQ ID NO: 71648 - DNA, 20 bp, Artificial Sequence
  Description of Artificial Sequence: Synthetic oligonucleotide
  Target: SCN10A; (+) strand; PAM type: YTN; PAM sequence: TTT
ttaattaaaccagagagctc

SEQ ID NO: 71649 - DNA, 20 bp, Artificial Sequence
  Description of Artificial Sequence: Synthetic oligonucleotide
  Target: SCN10A; (+) strand; PAM type: YTN; PAM sequence: TTT
taattaaaccagagagctct

SEQ ID NO: 71650 - DNA, 20 bp, Artificial Sequence
  Description of Artificial Sequence: Synthetic oligonucleotide
  Target: SCN10A; (+) strand; PAM type: YTN; PAM sequence: TTT
aattaaaccagagagctctt

SEQ ID NO: 71651 - DNA, 20 bp, Artificial Sequence
  Description of Artificial Sequence: Synthetic oligonucleotide
  Target: SCN10A; (+) strand; PAM type: YTN; PAM sequence: TTA
attaaaccagagagctcttc

SEQ ID NO: 71652 - DNA, 20 bp, Artificial Sequence
  Description of Artificial Sequence: Synthetic oligonucleotide
  Target: SCN10A; (+) strand; PAM type: YTN; PAM sequence: TTA
aaccagagagctcttctttt

SEQ ID NO: 71653 - DNA, 20 bp, Artificial Sequence
  Description of Artificial Sequence: Synthetic oligonucleotide
  Target: SCN10A; (+) strand; PAM type: YTN; PAM sequence: CTC
ttcttttaaaattagcttca

SEQ ID NO: 71654 - DNA, 20 bp, Artificial Sequence
  Description of Artificial Sequence: Synthetic oligonucleotide
  Target: SCN10A; (+) strand; PAM type: YTN; PAM sequence: CTT
cttttaaaattagcttcatg

SEQ ID NO: 71655 - DNA, 20 bp, Artificial Sequence
  Description of Artificial Sequence: Synthetic oligonucleotide
  Target: SCN10A; (+) strand; PAM type: YTN; PAM sequence: TTC
ttttaaaattagcttcatga

SEQ ID NO: 71656 - DNA, 20 bp, Artificial Sequence
  Description of Artificial Sequence: Synthetic oligonucleotide
  Target: SCN10A; (+) strand; PAM type: YTN; PAM sequence: CTT
ttaaaattagcttcatgata

SEQ ID NO: 71657 - DNA, 20 bp, Artificial Sequence
  Description of Artificial Sequence: Synthetic oligonucleotide
  Target: SCN10A; (+) strand; PAM type: YTN; PAM sequence: TTT
taaaattagcttcatgataa

SEQ ID NO: 71658 - DNA, 20 bp, Artificial Sequence
  Description of Artificial Sequence: Synthetic oligonucleotide
  Target: SCN10A; (+) strand; PAM type: YTN; PAM sequence: TTT
aaaattagcttcatgataaa

SEQ ID NO: 71659 - DNA, 20 bp, Artificial Sequence
  Description of Artificial Sequence: Synthetic oligonucleotide
  Target: SCN10A; (+) strand; PAM type: YTN; PAM sequence: TTA
aaattagcttcatgataaat

SEQ ID NO: 71660 - DNA, 20 bp, Artificial Sequence
  Description of Artificial Sequence: Synthetic oligonucleotide
  Target: SCN10A; (+) strand; PAM type: YTN; PAM sequence: TTA
gcttcatgataaatagaaca

SEQ ID NO: 71661 - DNA, 20 bp, Artificial Sequence
  Description of Artificial Sequence: Synthetic oligonucleotide
  Target: SCN10A; (+) strand; PAM type: YTN; PAM sequence: CTT
catgataaatagaacaaaaa

SEQ ID NO: 71662 - DNA, 20 bp, Artificial Sequence
  Description of Artificial Sequence: Synthetic oligonucleotide
  Target: SCN10A; (+) strand; PAM type: YTN; PAM sequence: TTC
atgataaatagaacaaaaag

SEQ ID NO: 71663 - DNA, 20 bp, Artificial Sequence
  Description of Artificial Sequence: Synthetic oligonucleotide
  Target: SCN10A; (+) strand; PAM type: YTN; PAM sequence: CTG
agtctttcccatatatatag

SEQ ID NO: 71664 - DNA, 20 bp, Artificial Sequence
  Description of Artificial Sequence: Synthetic oligonucleotide
  Target: SCN10A; (+) strand; PAM type: YTN; PAM sequence: CTT
tcccatatatatagtgaaga

SEQ ID NO: 71665 - DNA, 20 bp, Artificial Sequence
  Description of Artificial Sequence: Synthetic oligonucleotide
  Target: SCN10A; (+) strand; PAM type: YTN; PAM sequence: TTT
cccatatatatagtgaagat

SEQ ID NO: 71666 - DNA, 20 bp, Artificial Sequence
  Description of Artificial Sequence: Synthetic oligonucleotide
  Target: SCN10A; (+) strand; PAM type: YTN; PAM sequence: TTC
ccatatatatagtgaagata

SEQ ID NO: 71667 - DNA, 20 bp, Artificial Sequence
  Description of Artificial Sequence: Synthetic oligonucleotide
  Target: SCN10A; (+) strand; PAM type: YTN; PAM sequence: CTG
acaacttacttattcatagt

SEQ ID NO: 71668 - DNA, 20 bp, Artificial Sequence
  Description of Artificial Sequence: Synthetic oligonucleotide
  Target: SCN10A; (+) strand; PAM type: YTN; PAM sequence: CTT
acttattcatagttttgttc

SEQ ID NO: 71669 - DNA, 20 bp, Artificial Sequence
  Description of Artificial Sequence: Synthetic oligonucleotide
  Target: SCN10A; (+) strand; PAM type: YTN; PAM sequence: TTA
cttattcatagttttgttca

SEQ ID NO: 71670 - DNA, 20 bp, Artificial Sequence
  Description of Artificial Sequence: Synthetic oligonucleotide
  Target: SCN10A; (+) strand; PAM type: YTN; PAM sequence: CTT
attcatagttttgttcaact

SEQ ID NO: 71671 - DNA, 20 bp, Artificial Sequence
  Description of Artificial Sequence: Synthetic oligonucleotide
  Target: SCN10A; (+) strand; PAM type: YTN; PAM sequence: TTA
ttcatagttttgttcaacta

SEQ ID NO: 71672 - DNA, 20 bp, Artificial Sequence
  Description of Artificial Sequence: Synthetic oligonucleotide
  Target: SCN10A; (+) strand; PAM type: YTN; PAM sequence: TTC
atagttttgttcaactataa

SEQ ID NO: 71673 - DNA, 20 bp, Artificial Sequence
  Description of Artificial Sequence: Synthetic oligonucleotide
  Target: SCN10A; (+) strand; PAM type: YTN; PAM sequence: TTT
tgttcaactataaaataaaa

SEQ ID NO: 71674 - DNA, 20 bp, Artificial Sequence
  Description of Artificial Sequence: Synthetic oligonucleotide
  Target: SCN10A; (+) strand; PAM type: YTN; PAM sequence: TTT
gttcaactataaaataaaat

SEQ ID NO: 71675 - DNA, 20 bp, Artificial Sequence
  Description of Artificial Sequence: Synthetic oligonucleotide
  Target: SCN10A; (+) strand; PAM type: YTN; PAM sequence: TTG
ttcaactataaaataaaatg

SEQ ID NO: 71676 - DNA, 20 bp, Artificial Sequence
  Description of Artificial Sequence: Synthetic oligonucleotide
  Target: SCN10A; (+) strand; PAM type: YTN; PAM sequence: TTC
aactataaaataaaatgtct

SEQ ID NO: 71677 - DNA, 20 bp, Artificial Sequence
  Description of Artificial Sequence: Synthetic oligonucleotide
  Target: SCN10A; (+) strand; PAM type: YTN; PAM sequence: CTA
taaaataaaatgtctgctcg

SEQ ID NO: 71678 - DNA, 20 bp, Artificial Sequence
  Description of Artificial Sequence: Synthetic oligonucleotide
  Target: SCN10A; (+) strand; PAM type: YTN; PAM sequence: CTG
ctcgtatacctaacagtcat

SEQ ID NO: 71679 - DNA, 20 bp, Artificial Sequence
  Description of Artificial Sequence: Synthetic oligonucleotide
  Target: SCN10A; (+) strand; PAM type: YTN; PAM sequence: CTC
gtatacctaacagtcattga

SEQ ID NO: 71680 - DNA, 20 bp, Artificial Sequence
  Description of Artificial Sequence: Synthetic oligonucleotide
  Target: SCN10A; (+) strand; PAM type: YTN; PAM sequence: CTA
acagtcattgactttaaatg

SEQ ID NO: 71681 - DNA, 20 bp, Artificial Sequence
  Description of Artificial Sequence: Synthetic oligonucleotide
  Target: SCN10A; (+) strand; PAM type: YTN; PAM sequence: TTG
actttaaatgccagtcacat

SEQ ID NO: 71682 - DNA, 20 bp, Artificial Sequence
  Description of Artificial Sequence: Synthetic oligonucleotide
  Target: SCN10A; (+) strand; PAM type: YTN; PAM sequence: CTT
taaatgccagtcacattata

SEQ ID NO: 71683 - DNA, 20 bp, Artificial Sequence
  Description of Artificial Sequence: Synthetic oligonucleotide
  Target: SCN10A; (+) strand; PAM type: YTN; PAM sequence: TTT
aaatgccagtcacattataa

SEQ ID NO: 71684 - DNA, 20 bp, Artificial Sequence
  Description of Artificial Sequence: Synthetic oligonucleotide
  Target: SCN10A; (+) strand; PAM type: YTN; PAM sequence: TTA
aatgccagtcacattataag

SEQ ID NO: 71685 - DNA, 20 bp, Artificial Sequence
  Description of Artificial Sequence: Synthetic oligonucleotide
  Target: SCN10A; (+) strand; PAM type: YTN; PAM sequence: TTA
taaggaatgcaatacttcta

SEQ ID NO: 71686 - DNA, 20 bp, Artificial Sequence
  Description of Artificial Sequence: Synthetic oligonucleotide
  Target: SCN10A; (+) strand; PAM type: YTN; PAM sequence: CTT
ctaattaaggaattatacca

SEQ ID NO: 71687 - DNA, 20 bp, Artificial Sequence
  Description of Artificial Sequence: Synthetic oligonucleotide
  Target: SCN10A; (+) strand; PAM type: YTN; PAM sequence: TTC
taattaaggaattataccaa

SEQ ID NO: 71688 - DNA, 20 bp, Artificial Sequence
  Description of Artificial Sequence: Synthetic oligonucleotide
  Target: SCN10A; (+) strand; PAM type: YTN; PAM sequence: CTA
attaaggaattataccaatt

SEQ ID NO: 71689 - DNA, 20 bp, Artificial Sequence
  Description of Artificial Sequence: Synthetic oligonucleotide
  Target: SCN10A; (+) strand; PAM type: YTN; PAM sequence: TTA
aggaattataccaattgttt

SEQ ID NO: 71690 - DNA, 20 bp, Artificial Sequence
  Description of Artificial Sequence: Synthetic oligonucleotide
  Target: SCN10A; (+) strand; PAM type: YTN; PAM sequence: TTA
taccaattgtttttcttgtt

SEQ ID NO: 71691 - DNA, 20 bp, Artificial Sequence
  Description of Artificial Sequence: Synthetic oligonucleotide
  Target: SCN10A; (+) strand; PAM type: YTN; PAM sequence: TTG
tttttcttgtttcttctcca

SEQ ID NO: 71692 - DNA, 20 bp, Artificial Sequence
  Description of Artificial Sequence: Synthetic oligonucleotide
  Target: SCN10A; (+) strand; PAM type: YTN; PAM sequence: TTT
ttcttgtttcttctccaacc

SEQ ID NO: 71693 - DNA, 20 bp, Artificial Sequence
  Description of Artificial Sequence: Synthetic oligonucleotide
  Target: SCN10A; (+) strand; PAM type: YTN; PAM sequence: TTT
tcttgtttcttctccaacca

SEQ ID NO: 71694 - DNA, 20 bp, Artificial Sequence
  Description of Artificial Sequence: Synthetic oligonucleotide
  Target: SCN10A; (+) strand; PAM type: YTN; PAM sequence: TTT
cttgtttcttctccaaccac

SEQ ID NO: 71695 - DNA, 20 bp, Artificial Sequence
  Description of Artificial Sequence: Synthetic oligonucleotide
  Target: SCN10A; (+) strand; PAM type: YTN; PAM sequence: TTC
ttgtttcttctccaaccaca

SEQ ID NO: 71696 - DNA, 20 bp, Artificial Sequence
  Description of Artificial Sequence: Synthetic oligonucleotide
  Target: SCN10A; (+) strand; PAM type: YTN; PAM sequence: CTT
gtttcttctccaaccacaat

SEQ ID NO: 71697 - DNA, 20 bp, Artificial Sequence
  Description of Artificial Sequence: Synthetic oligonucleotide
  Target: SCN10A; (+) strand; PAM type: YTN; PAM sequence: TTG
tttcttctccaaccacaata

SEQ ID NO: 71698 - DNA, 20 bp, Artificial Sequence
  Description of Artificial Sequence: Synthetic oligonucleotide
  Target: SCN10A; (+) strand; PAM type: YTN; PAM sequence: TTT
cttctccaaccacaatattt

SEQ ID NO: 71699 - DNA, 20 bp, Artificial Sequence
  Description of Artificial Sequence: Synthetic oligonucleotide
  Target: SCN10A; (+) strand; PAM type: YTN; PAM sequence: TTC
ttctccaaccacaatatttg

SEQ ID NO: 71700 - DNA, 20 bp, Artificial Sequence
  Description of Artificial Sequence: Synthetic oligonucleotide
  Target: SCN10A; (+) strand; PAM type: YTN; PAM sequence: CTT
ctccaaccacaatatttgta

SEQ ID NO: 71701 - DNA, 20 bp, Artificial Sequence
  Description of Artificial Sequence: Synthetic oligonucleotide
  Target: SCN10A; (+) strand; PAM type: YTN; PAM sequence: TTC
tccaaccacaatatttgtaa

SEQ ID NO: 71702 - DNA, 20 bp, Artificial Sequence
  Description of Artificial Sequence: Synthetic oligonucleotide
  Target: SCN10A; (+) strand; PAM type: YTN; PAM sequence: CTC
caaccacaatatttgtaatt

SEQ ID NO: 71703 - DNA, 20 bp, Artificial Sequence
  Description of Artificial Sequence: Synthetic oligonucleotide
  Target: SCN10A; (+) strand; PAM type: YTN; PAM sequence: TTT
gtaattgatttggaaactgg

SEQ ID NO: 71704 - DNA, 20 bp, Artificial Sequence
  Description of Artificial Sequence: Synthetic oligonucleotide
  Target: SCN10A; (+) strand; PAM type: YTN; PAM sequence: TTG
taattgatttggaaactggt

SEQ ID NO: 71705 - DNA, 20 bp, Artificial Sequence
  Description of Artificial Sequence: Synthetic oligonucleotide
  Target: SCN10A; (+) strand; PAM type: YTN; PAM sequence: TTG
atttggaaactggttttgta

SEQ ID NO: 71706 - DNA, 20 bp, Artificial Sequence
  Description of Artificial Sequence: Synthetic oligonucleotide
  Target: SCN10A; (+) strand; PAM type: YTN; PAM sequence: TTT
ggaaactggttttgtatctt

SEQ ID NO: 71707 - DNA, 20 bp, Artificial Sequence
  Description of Artificial Sequence: Synthetic oligonucleotide
  Target: SCN10A; (+) strand; PAM type: YTN; PAM sequence: TTG
gaaactggttttgtatctta

SEQ ID NO: 71708 - DNA, 20 bp, Artificial Sequence
  Description of Artificial Sequence: Synthetic oligonucleotide
  Target: SCN10A; (+) strand; PAM type: YTN; PAM sequence: CTG
gttttgtatcttaccagcag

SEQ ID NO: 71709 - DNA, 20 bp, Artificial Sequence
  Description of Artificial Sequence: Synthetic oligonucleotide
  Target: SCN10A; (+) strand; PAM type: YTN; PAM sequence: TTT
tgtatcttaccagcaggagt

SEQ ID NO: 71710 - DNA, 20 bp, Artificial Sequence
  Description of Artificial Sequence: Synthetic oligonucleotide
  Target: SCN10A; (+) strand; PAM type: YTN; PAM sequence: TTT
gtatcttaccagcaggagtg

SEQ ID NO: 71711 - DNA, 20 bp, Artificial Sequence
  Description of Artificial Sequence: Synthetic oligonucleotide
  Target: SCN10A; (+) strand; PAM type: YTN; PAM sequence: TTG
tatcttaccagcaggagtgc

SEQ ID NO: 71712 - DNA, 20 bp, Artificial Sequence
  Description of Artificial Sequence: Synthetic oligonucleotide
  Target: SCN10A; (+) strand; PAM type: YTN; PAM sequence: CTT
accagcaggagtgcaattgt

SEQ ID NO: 71713 - DNA, 20 bp, Artificial Sequence
  Description of Artificial Sequence: Synthetic oligonucleotide
  Target: SCN10A; (+) strand; PAM type: YTN; PAM sequence: TTA
ccagcaggagtgcaattgtg

SEQ ID NO: 71714 - DNA, 20 bp, Artificial Sequence
  Description of Artificial Sequence: Synthetic oligonucleotide
  Target: SCN10A; (+) strand; PAM type: YTN; PAM sequence: TTG
tgcttatttttgatatgagg

SEQ ID NO: 71715 - DNA, 20 bp, Artificial Sequence
  Description of Artificial Sequence: Synthetic oligonucleotide
  Target: SCN10A; (+) strand; PAM type: YTN; PAM sequence: CTT
atttttgatatgaggatgaa

SEQ ID NO: 71716 - DNA, 20 bp, Artificial Sequence
  Description of Artificial Sequence: Synthetic oligonucleotide
  Target: SCN10A; (+) strand; PAM type: YTN; PAM sequence: TTA
tttttgatatgaggatgaat

SEQ ID NO: 71717 - DNA, 20 bp, Artificial Sequence
  Description of Artificial Sequence: Synthetic oligonucleotide
  Target: SCN10A; (+) strand; PAM type: YTN; PAM sequence: TTT
ttgatatgaggatgaatgat

SEQ ID NO: 71718 - DNA, 20 bp, Artificial Sequence
  Description of Artificial Sequence: Synthetic oligonucleotide
  Target: SCN10A; (+) strand; PAM type: YTN; PAM sequence: TTT
tgatatgaggatgaatgatg

SEQ ID NO: 71719 - DNA, 20 bp, Artificial Sequence
  Description of Artificial Sequence: Synthetic oligonucleotide
  Target: SCN10A; (+) strand; PAM type: YTN; PAM sequence: TTT
gatatgaggatgaatgatga

SEQ ID NO: 71720 - DNA, 20 bp, Artificial Sequence
  Description of Artificial Sequence: Synthetic oligonucleotide
  Target: SCN10A; (+) strand; PAM type: YTN; PAM sequence: TTG
atatgaggatgaatgatgac

SEQ ID NO: 71721 - DNA, 20 bp, Artificial Sequence
  Description of Artificial Sequence: Synthetic oligonucleotide
  Target: SCN10A; (+) strand; PAM type: YTN; PAM sequence: CTC
tatagttttgttgtcttctc

SEQ ID NO: 71722 - DNA, 20 bp, Artificial Sequence
  Description of Artificial Sequence: Synthetic oligonucleotide
  Target: SCN10A; (+) strand; PAM type: YTN; PAM sequence: CTA
tagttttgttgtcttctcaa

SEQ ID NO: 71723 - DNA, 20 bp, Artificial Sequence
  Description of Artificial Sequence: Synthetic oligonucleotide
  Target: SCN10A; (+) strand; PAM type: YTN; PAM sequence: TTT
tgttgtcttctcaaccttta

SEQ ID NO: 71724 - DNA, 20 bp, Artificial Sequence
  Description of Artificial Sequence: Synthetic oligonucleotide
  Target: SCN10A; (+) strand; PAM type: YTN; PAM sequence: TTT
gttgtcttctcaacctttaa

SEQ ID NO: 71725 - DNA, 20 bp, Artificial Sequence
  Description of Artificial Sequence: Synthetic oligonucleotide
  Target: SCN10A; (+) strand; PAM type: YTN; PAM sequence: TTG
ttgtcttctcaacctttaac

SEQ ID NO: 71726 - DNA, 20 bp, Artificial Sequence
  Description of Artificial Sequence: Synthetic oligonucleotide
  Target: SCN10A; (+) strand; PAM type: YTN; PAM sequence: TTG
tcttctcaacctttaacata

SEQ ID NO: 71727 - DNA, 20 bp, Artificial Sequence
  Description of Artificial Sequence: Synthetic oligonucleotide
  Target: SCN10A; (+) strand; PAM type: YTN; PAM sequence: CTT
ctcaacctttaacataaaat

SEQ ID NO: 71728 - DNA, 20 bp, Artificial Sequence
  Description of Artificial Sequence: Synthetic oligonucleotide
  Target: SCN10A; (+) strand; PAM type: YTN; PAM sequence: TTC
tcaacctttaacataaaatt

SEQ ID NO: 71729 - DNA, 20 bp, Artificial Sequence
  Description of Artificial Sequence: Synthetic oligonucleotide
  Target: SCN10A; (+) strand; PAM type: YTN; PAM sequence: CTC
aacctttaacataaaatttt

SEQ ID NO: 71730 - DNA, 20 bp, Artificial Sequence
  Description of Artificial Sequence: Synthetic oligonucleotide
  Target: SCN10A; (+) strand; PAM type: YTN; PAM sequence: CTT
taacataaaattttcacaat

SEQ ID NO: 71731 - DNA, 20 bp, Artificial Sequence
  Description of Artificial Sequence: Synthetic oligonucleotide
  Target: SCN10A; (+) strand; PAM type: YTN; PAM sequence: TTT
aacataaaattttcacaatt

SEQ ID NO: 71732 - DNA, 20 bp, Artificial Sequence
  Description of Artificial Sequence: Synthetic oligonucleotide
  Target: SCN10A; (+) strand; PAM type: YTN; PAM sequence: TTA
acataaaattttcacaattt

SEQ ID NO: 71733 - DNA, 20 bp, Artificial Sequence
  Description of Artificial Sequence: Synthetic oligonucleotide
  Target: SCN10A; (+) strand; PAM type: YTN; PAM sequence: TTT
tcacaattttatactgggaa

SEQ ID NO: 71734 - DNA, 20 bp, Artificial Sequence
  Description of Artificial Sequence: Synthetic oligonucleotide
  Target: SCN10A; (+) strand; PAM type: YTN; PAM sequence: TTT
cacaattttatactgggaaa

SEQ ID NO: 71735 - DNA, 20 bp, Artificial Sequence
  Description of Artificial Sequence: Synthetic oligonucleotide
  Target: SCN10A; (+) strand; PAM type: YTN; PAM sequence: TTC
acaattttatactgggaaag

SEQ ID NO: 71736 - DNA, 20 bp, Artificial Sequence
  Description of Artificial Sequence: Synthetic oligonucleotide
  Target: SCN10A; (+) strand; PAM type: YTN; PAM sequence: TTT
tatactgggaaagccttatt

SEQ ID NO: 71737 - DNA, 20 bp, Artificial Sequence
  Description of Artificial Sequence: Synthetic oligonucleotide
  Target: SCN10A; (+) strand; PAM type: YTN; PAM sequence: TTT
atactgggaaagccttattt

SEQ ID NO: 71738 - DNA, 20 bp, Artificial Sequence
  Description of Artificial Sequence: Synthetic oligonucleotide
  Target: SCN10A; (+) strand; PAM type: YTN; PAM sequence: TTA
tactgggaaagccttatttt

SEQ ID NO: 71739 - DNA, 20 bp, Artificial Sequence
  Description of Artificial Sequence: Synthetic oligonucleotide
  Target: SCN10A; (+) strand; PAM type: YTN; PAM sequence: CTG
ggaaagccttattttgtgct

SEQ ID NO: 71740 - DNA, 20 bp, Artificial Sequence
  Description of Artificial Sequence: Synthetic oligonucleotide
  Target: SCN10A; (+) strand; PAM type: YTN; PAM sequence: CTT
attttgtgcttgtagtagag

SEQ ID NO: 71741 - DNA, 20 bp, Artificial Sequence
  Description of Artificial Sequence: Synthetic oligonucleotide
  Target: SCN10A; (+) strand; PAM type: YTN; PAM sequence: TTA
ttttgtgcttgtagtagaga

SEQ ID NO: 71742 - DNA, 20 bp, Artificial Sequence
  Description of Artificial Sequence: Synthetic oligonucleotide
  Target: SCN10A; (+) strand; PAM type: YTN; PAM sequence: TTT
tgtgcttgtagtagagatat

SEQ ID NO: 71743 - DNA, 20 bp, Artificial Sequence
  Description of Artificial Sequence: Synthetic oligonucleotide
  Target: SCN10A; (+) strand; PAM type: YTN; PAM sequence: TTT
gtgcttgtagtagagatatt

SEQ ID NO: 71744 - DNA, 20 bp, Artificial Sequence
  Description of Artificial Sequence: Synthetic oligonucleotide
  Target: SCN10A; (+) strand; PAM type: YTN; PAM sequence: TTG
tgcttgtagtagagatattc

SEQ ID NO: 71745 - DNA, 20 bp, Artificial Sequence
  Description of Artificial Sequence: Synthetic oligonucleotide
  Target: SCN10A; (+) strand; PAM type: YTN; PAM sequence: CTT
gtagtagagatattcaattg

SEQ ID NO: 71746 - DNA, 20 bp, Artificial Sequence
  Description of Artificial Sequence: Synthetic oligonucleotide
  Target: SCN10A; (+) strand; PAM type: YTN; PAM sequence: TTG
tagtagagatattcaattgg

SEQ ID NO: 71747 - DNA, 20 bp, Artificial Sequence
  Description of Artificial Sequence: Synthetic oligonucleotide
  Target: SCN10A; (+) strand; PAM type: YTN; PAM sequence: TTC
aattggtttaaaagtggggt

SEQ ID NO: 71748 - DNA, 20 bp, Artificial Sequence
  Description of Artificial Sequence: Synthetic oligonucleotide
  Target: SCN10A; (+) strand; PAM type: YTN; PAM sequence: TTG
gtttaaaagtggggttgata

SEQ ID NO: 71749 - DNA, 20 bp, Artificial Sequence
  Description of Artificial Sequence: Synthetic oligonucleotide
  Target: SCN10A; (+) strand; PAM type: YTN; PAM sequence: TTT
aaaagtggggttgataaact

SEQ ID NO: 71750 - DNA, 20 bp, Artificial Sequence
  Description of Artificial Sequence: Synthetic oligonucleotide
  Target: SCN10A; (+) strand; PAM type: YTN; PAM sequence: TTA
aaagtggggttgataaactt

SEQ ID NO: 71751 - DNA, 20 bp, Artificial Sequence
  Description of Artificial Sequence: Synthetic oligonucleotide
  Target: SCN10A; (+) strand; PAM type: YTN; PAM sequence: TTG
ataaactttattggaaaata

SEQ ID NO: 71752 - DNA, 20 bp, Artificial Sequence
  Description of Artificial Sequence: Synthetic oligonucleotide
  Target: SCN10A; (+) strand; PAM type: YTN; PAM sequence: CTT
tattggaaaataatatggaa

SEQ ID NO: 71753 - DNA, 20 bp, Artificial Sequence
  Description of Artificial Sequence: Synthetic oligonucleotide
  Target: SCN10A; (+) strand; PAM type: YTN; PAM sequence: TTT
attggaaaataatatggaag

SEQ ID NO: 71754 - DNA, 20 bp, Artificial Sequence
  Description of Artificial Sequence: Synthetic oligonucleotide
  Target: SCN10A; (+) strand; PAM type: YTN; PAM sequence: TTA
ttggaaaataatatggaagt

SEQ ID NO: 71755 - DNA, 20 bp, Artificial Sequence
  Description of Artificial Sequence: Synthetic oligonucleotide
  Target: SCN10A; (+) strand; PAM type: YTN; PAM sequence: TTG
gaaaataatatggaagtttt

SEQ ID NO: 71756 - DNA, 20 bp, Artificial Sequence
  Description of Artificial Sequence: Synthetic oligonucleotide
  Target: SCN10A; (+) strand; PAM type: YTN; PAM sequence: TTT
tgatagctttatatcattac

SEQ ID NO: 71757 - DNA, 20 bp, Artificial Sequence
  Description of Artificial Sequence: Synthetic oligonucleotide
  Target: SCN10A; (+) strand; PAM type: YTN; PAM sequence: TTT
gatagctttatatcattact

SEQ ID NO: 71758 - DNA, 20 bp, Artificial Sequence
  Description of Artificial Sequence: Synthetic oligonucleotide
  Target: SCN10A; (+) strand; PAM type: YTN; PAM sequence: TTG
atagctttatatcattactt

SEQ ID NO: 71759 - DNA, 20 bp, Artificial Sequence
  Description of Artificial Sequence: Synthetic oligonucleotide
  Target: SCN10A; (+) strand; PAM type: YTN; PAM sequence: CTT
tatatcattacttgacaaaa

SEQ ID NO: 71760 - DNA, 20 bp, Artificial Sequence
  Description of Artificial Sequence: Synthetic oligonucleotide
  Target: SCN10A; (+) strand; PAM type: YTN; PAM sequence: TTT
atatcattacttgacaaaaa

SEQ ID NO: 71761 - DNA, 20 bp, Artificial Sequence
  Description of Artificial Sequence: Synthetic oligonucleotide
  Target: SCN10A; (+) strand; PAM type: YTN; PAM sequence: TTA
tatcattacttgacaaaaac

SEQ ID NO: 71762 - DNA, 20 bp, Artificial Sequence
  Description of Artificial Sequence: Synthetic oligonucleotide
  Target: SCN10A; (+) strand; PAM type: YTN; PAM sequence: TTA
cttgacaaaaacgttagcag

SEQ ID NO: 71763 - DNA, 20 bp, Artificial Sequence
  Description of Artificial Sequence: Synthetic oligonucleotide
  Target: SCN10A; (+) strand; PAM type: YTN; PAM sequence: CTT
gacaaaaacgttagcagata

SEQ ID NO: 71764 - DNA, 20 bp, Artificial Sequence
  Description of Artificial Sequence: Synthetic oligonucleotide
  Target: SCN10A; (+) strand; PAM type: YTN; PAM sequence: TTG
acaaaaacgttagcagataa

SEQ ID NO: 71765 - DNA, 20 bp, Artificial Sequence
  Description of Artificial Sequence: Synthetic oligonucleotide
  Target: SCN10A; (+) strand; PAM type: YTN; PAM sequence: TTA
gcagataataaattgggtac

SEQ ID NO: 71766 - DNA, 20 bp, Artificial Sequence
  Description of Artificial Sequence: Synthetic oligonucleotide
  Target: SCN10A; (+) strand; PAM type: YTN; PAM sequence: TTG
ggtactaggacaaaaggatc

SEQ ID NO: 71767 - DNA, 20 bp, Artificial Sequence
  Description of Artificial Sequence: Synthetic oligonucleotide
  Target: SCN10A; (+) strand; PAM type: YTN; PAM sequence: CTA
ggacaaaaggatcattggtc

SEQ ID NO: 71768 - DNA, 20 bp, Artificial Sequence
  Description of Artificial Sequence: Synthetic oligonucleotide
  Target: SCN10A; (+) strand; PAM type: YTN; PAM sequence: TTG
gtccaataaaattcaattat

SEQ ID NO: 71769 - DNA, 20 bp, Artificial Sequence
  Description of Artificial Sequence: Synthetic oligonucleotide
  Target: SCN10A; (+) strand; PAM type: YTN; PAM sequence: TTC
aattatcattattcattgtc

SEQ ID NO: 71770 - DNA, 20 bp, Artificial Sequence
  Description of Artificial Sequence: Synthetic oligonucleotide
  Target: SCN10A; (+) strand; PAM type: YTN; PAM sequence: TTA
tcattattcattgtcatggc

SEQ ID NO: 71771 - DNA, 20 bp, Artificial Sequence
  Description of Artificial Sequence: Synthetic oligonucleotide
  Target: SCN10A; (+) strand; PAM type: YTN; PAM sequence: TTA
ttcattgtcatggctcccat

SEQ ID NO: 71772 - DNA, 20 bp, Artificial Sequence
  Description of Artificial Sequence: Synthetic oligonucleotide
  Target: SCN10A; (+) strand; PAM type: YTN; PAM sequence: TTC
attgtcatggctcccatttt

SEQ ID NO: 71773 - DNA, 20 bp, Artificial Sequence
  Description of Artificial Sequence: Synthetic oligonucleotide
  Target: SCN10A; (+) strand; PAM type: YTN; PAM sequence: TTG
tcatggctcccattttctta

SEQ ID NO: 71774 - DNA, 20 bp, Artificial Sequence
  Description of Artificial Sequence: Synthetic oligonucleotide
  Target: SCN10A; (+) strand; PAM type: YTN; PAM sequence: CTC
ccattttcttatatattttt

SEQ ID NO: 71775 - DNA, 20 bp, Artificial Sequence
  Description of Artificial Sequence: Synthetic oligonucleotide
  Target: SCN10A; (+) strand; PAM type: YTN; PAM sequence: TTT
tcttatatatttttgtctgg

SEQ ID NO: 71776 - DNA, 20 bp, Artificial Sequence
  Description of Artificial Sequence: Synthetic oligonucleotide
  Target: SCN10A; (+) strand; PAM type: YTN; PAM sequence: TTT
cttatatatttttgtctggt

SEQ ID NO: 71777 - DNA, 20 bp, Artificial Sequence
  Description of Artificial Sequence: Synthetic oligonucleotide
  Target: SCN10A; (+) strand; PAM type: YTN; PAM sequence: TTC
ttatatatttttgtctggtt

SEQ ID NO: 71778 - DNA, 20 bp, Artificial Sequence
  Description of Artificial Sequence: Synthetic oligonucleotide
  Target: SCN10A; (+) strand; PAM type: YTN; PAM sequence: CTT
atatatttttgtctggtttt

SEQ ID NO: 71779 - DNA, 20 bp, Artificial Sequence
  Description of Artificial Sequence: Synthetic oligonucleotide
  Target: SCN10A; (+) strand; PAM type: YTN; PAM sequence: TTA
tatatttttgtctggttttg

SEQ ID NO: 71780 - DNA, 20 bp, Artificial Sequence
  Description of Artificial Sequence: Synthetic oligonucleotide
  Target: SCN10A; (+) strand; PAM type: YTN; PAM sequence: TTT
ttgtctggttttgggagatt

SEQ ID NO: 71781 - DNA, 20 bp, Artificial Sequence
  Description of Artificial Sequence: Synthetic oligonucleotide
  Target: SCN10A; (+) strand; PAM type: YTN; PAM sequence: TTT
tgtctggttttgggagatta

SEQ ID NO: 71782 - DNA, 20 bp, Artificial Sequence
  Description of Artificial Sequence: Synthetic oligonucleotide
  Target: SCN10A; (+) strand; PAM type: YTN; PAM sequence: TTT
gtctggttttgggagattat

SEQ ID NO: 71783 - DNA, 20 bp, Artificial Sequence
  Description of Artificial Sequence: Synthetic oligonucleotide
  Target: SCN10A; (+) strand; PAM type: YTN; PAM sequence: TTG
tctggttttgggagattatc

SEQ ID NO: 71784 - DNA, 20 bp, Artificial Sequence
  Description of Artificial Sequence: Synthetic oligonucleotide
  Target: SCN10A; (+) strand; PAM type: YTN; PAM sequence: CTG
gttttgggagattatccaca

SEQ ID NO: 71785 - DNA, 20 bp, Artificial Sequence
  Description of Artificial Sequence: Synthetic oligonucleotide
  Target: SCN10A; (+) strand; PAM type: YTN; PAM sequence: TTT
tgggagattatccacatcca

SEQ ID NO: 71786 - DNA, 20 bp, Artificial Sequence
  Description of Artificial Sequence: Synthetic oligonucleotide
  Target: SCN10A; (+) strand; PAM type: YTN; PAM sequence: TTT
gggagattatccacatccat

SEQ ID NO: 71787 - DNA, 20 bp, Artificial Sequence
  Description of Artificial Sequence: Synthetic oligonucleotide
  Target: SCN10A; (+) strand; PAM type: YTN; PAM sequence: TTG
ggagattatccacatccatt

SEQ ID NO: 71788 - DNA, 20 bp, Artificial Sequence
  Description of Artificial Sequence: Synthetic oligonucleotide
  Target: SCN10A; (+) strand; PAM type: YTN; PAM sequence: TTA
tccacatccattatccactt

SEQ ID NO: 71789 - DNA, 20 bp, Artificial Sequence
  Description of Artificial Sequence: Synthetic oligonucleotide
  Target: SCN10A; (+) strand; PAM type: YTN; PAM sequence: TTA
tccacttgtctcatgacaaa

SEQ ID NO: 71790 - DNA, 20 bp, Artificial Sequence
  Description of Artificial Sequence: Synthetic oligonucleotide
  Target: SCN10A; (+) strand; PAM type: YTN; PAM sequence: CTT
gtctcatgacaaacagattc

SEQ ID NO: 71791 - DNA, 20 bp, Artificial Sequence
  Description of Artificial Sequence: Synthetic oligonucleotide
  Target: SCN10A; (+) strand; PAM type: YTN; PAM sequence: TTG
tctcatgacaaacagattca

SEQ ID NO: 71792 - DNA, 20 bp, Artificial Sequence
  Description of Artificial Sequence: Synthetic oligonucleotide
  Target: SCN10A; (+) strand; PAM type: YTN; PAM sequence: CTC
atgacaaacagattcatgct

SEQ ID NO: 71793 - DNA, 20 bp, Artificial Sequence
  Description of Artificial Sequence: Synthetic oligonucleotide
  Target: SCN10A; (+) strand; PAM type: YTN; PAM sequence: TTC
atgctttgtatttttacaat

SEQ ID NO: 71794 - DNA, 20 bp, Artificial Sequence
  Description of Artificial Sequence: Synthetic oligonucleotide
  Target: SCN10A; (+) strand; PAM type: YTN; PAM sequence: CTT
tgtatttttacaatggaggc

SEQ ID NO: 71795 - DNA, 20 bp, Artificial Sequence
  Description of Artificial Sequence: Synthetic oligonucleotide
  Target: SCN10A; (+) strand; PAM type: YTN; PAM sequence: TTT
gtatttttacaatggaggcc

SEQ ID NO: 71796 - DNA, 20 bp, Artificial Sequence
  Description of Artificial Sequence: Synthetic oligonucleotide
  Target: SCN10A; (+) strand; PAM type: YTN; PAM sequence: TTG
tatttttacaatggaggcca

SEQ ID NO: 71797 - DNA, 20 bp, Artificial Sequence
  Description of Artificial Sequence: Synthetic oligonucleotide
  Target: SCN10A; (+) strand; PAM type: YTN; PAM sequence: TTT
ttacaatggaggccattcat

SEQ ID NO: 71798 - DNA, 20 bp, Artificial Sequence
  Description of Artificial Sequence: Synthetic oligonucleotide
  Target: SCN10A; (+) strand; PAM type: YTN; PAM sequence: TTT
tacaatggaggccattcatt

SEQ ID NO: 71799 - DNA, 20 bp, Artificial Sequence
  Description of Artificial Sequence: Synthetic oligonucleotide
  Target: SCN10A; (+) strand; PAM type: YTN; PAM sequence: TTT
acaatggaggccattcatta

SEQ ID NO: 71800 - DNA, 20 bp, Artificial Sequence
  Description of Artificial Sequence: Synthetic oligonucleotide
  Target: SCN10A; (+) strand; PAM type: YTN; PAM sequence: TTA
caatggaggccattcattac

SEQ ID NO: 71801 - DNA, 20 bp, Artificial Sequence
  Description of Artificial Sequence: Synthetic oligonucleotide
  Target: SCN10A; (+) strand; PAM type: YTN; PAM sequence: TTC
attacttacattgtgacctt

SEQ ID NO: 71802 - DNA, 20 bp, Artificial Sequence
  Description of Artificial Sequence: Synthetic oligonucleotide
  Target: SCN10A; (+) strand; PAM type: YTN; PAM sequence: TTA
cttacattgtgaccttattt

SEQ ID NO: 71803 - DNA, 20 bp, Artificial Sequence
  Description of Artificial Sequence: Synthetic oligonucleotide
  Target: SCN10A; (+) strand; PAM type: YTN; PAM sequence: CTT
acattgtgaccttatttcac

SEQ ID NO: 71804 - DNA, 20 bp, Artificial Sequence
  Description of Artificial Sequence: Synthetic oligonucleotide
  Target: SCN10A; (+) strand; PAM type: YTN; PAM sequence: TTA
cattgtgaccttatttcaca

SEQ ID NO: 71805 - DNA, 20 bp, Artificial Sequence
  Description of Artificial Sequence: Synthetic oligonucleotide
  Target: SCN10A; (+) strand; PAM type: YTN; PAM sequence: TTG
tgaccttatttcacattgta

SEQ ID NO: 71806 - DNA, 20 bp, Artificial Sequence
  Description of Artificial Sequence: Synthetic oligonucleotide
  Target: SCN10A; (+) strand; PAM type: YTN; PAM sequence: CTT
atttcacattgtaggattta

SEQ ID NO: 71807 - DNA, 20 bp, Artificial Sequence
  Description of Artificial Sequence: Synthetic oligonucleotide
  Target: SCN10A; (+) strand; PAM type: YTN; PAM sequence: TTA
tttcacattgtaggatttat

SEQ ID NO: 71808 - DNA, 20 bp, Artificial Sequence
  Description of Artificial Sequence: Synthetic oligonucleotide
  Target: SCN10A; (+) strand; PAM type: YTN; PAM sequence: TTT
cacattgtaggatttatatt

SEQ ID NO: 71809 - DNA, 20 bp, Artificial Sequence
  Description of Artificial Sequence: Synthetic oligonucleotide
  Target: SCN10A; (+) strand; PAM type: YTN; PAM sequence: TTC
acattgtaggatttatattt

SEQ ID NO: 71810 - DNA, 20 bp, Artificial Sequence
  Description of Artificial Sequence: Synthetic oligonucleotide
  Target: SCN10A; (+) strand; PAM type: YTN; PAM sequence: TTG
taggatttatatttctattt

SEQ ID NO: 71811 - DNA, 20 bp, Artificial Sequence
  Description of Artificial Sequence: Synthetic oligonucleotide
  Target: SCN10A; (+) strand; PAM type: YTN; PAM sequence: TTT
atatttctatttttatcatt

SEQ ID NO: 71812 - DNA, 20 bp, Artificial Sequence
  Description of Artificial Sequence: Synthetic oligonucleotide
  Target: SCN10A; (+) strand; PAM type: YTN; PAM sequence: TTA
tatttctatttttatcatta

SEQ ID NO: 71813 - DNA, 20 bp, Artificial Sequence
  Description of Artificial Sequence: Synthetic oligonucleotide
  Target: SCN10A; (+) strand; PAM type: YTN; PAM sequence: TTT
ctatttttatcattattgtt

SEQ ID NO: 71814 - DNA, 20 bp, Artificial Sequence
  Description of Artificial Sequence: Synthetic oligonucleotide
  Target: SCN10A; (+) strand; PAM type: YTN; PAM sequence: TTC
tatttttatcattattgtta

SEQ ID NO: 71815 - DNA, 20 bp, Artificial Sequence
  Description of Artificial Sequence: Synthetic oligonucleotide
  Target: SCN10A; (+) strand; PAM type: YTN; PAM sequence: CTA
tttttatcattattgttatg

SEQ ID NO: 71816 - DNA, 20 bp, Artificial Sequence
  Description of Artificial Sequence: Synthetic oligonucleotide
  Target: SCN10A; (+) strand; PAM type: YTN; PAM sequence: TTT
ttatcattattgttatgctt

SEQ ID NO: 71817 - DNA, 20 bp, Artificial Sequence
  Description of Artificial Sequence: Synthetic oligonucleotide
  Target: SCN10A; (+) strand; PAM type: YTN; PAM sequence: TTT
tatcattattgttatgcttc

SEQ ID NO: 71818 - DNA, 20 bp, Artificial Sequence
  Description of Artificial Sequence: Synthetic oligonucleotide
  Target: SCN10A; (+) strand; PAM type: YTN; PAM sequence: TTT
atcattattgttatgcttca

SEQ ID NO: 71819 - DNA, 20 bp, Artificial Sequence
  Description of Artificial Sequence: Synthetic oligonucleotide
  Target: SCN10A; (+) strand; PAM type: YTN; PAM sequence: TTA
tcattattgttatgcttcag

SEQ ID NO: 71820 - DNA, 20 bp, Artificial Sequence
  Description of Artificial Sequence: Synthetic oligonucleotide
  Target: SCN10A; (+) strand; PAM type: YTN; PAM sequence: TTA
ttgttatgcttcagaaaacc

SEQ ID NO: 71821 - DNA, 20 bp, Artificial Sequence
  Description of Artificial Sequence: Synthetic oligonucleotide
  Target: SCN10A; (+) strand; PAM type: YTN; PAM sequence: TTG
ttatgcttcagaaaaccact

SEQ ID NO: 71822 - DNA, 20 bp, Artificial Sequence
  Description of Artificial Sequence: Synthetic oligonucleotide
  Target: SCN10A; (+) strand; PAM type: YTN; PAM sequence: TTA
tgcttcagaaaaccactttc

SEQ ID NO: 71823 - DNA, 20 bp, Artificial Sequence
  Description of Artificial Sequence: Synthetic oligonucleotide
  Target: SCN10A; (+) strand; PAM type: YTN; PAM sequence: CTT
cagaaaaccactttcgaagt

SEQ ID NO: 71824 - DNA, 20 bp, Artificial Sequence
  Description of Artificial Sequence: Synthetic oligonucleotide
  Target: SCN10A; (+) strand; PAM type: YTN; PAM sequence: TTC
agaaaaccactttcgaagtg

SEQ ID NO: 71825 - DNA, 20 bp, Artificial Sequence
  Description of Artificial Sequence: Synthetic oligonucleotide
  Target: SCN10A; (+) strand; PAM type: YTN; PAM sequence: CTT
tcgaagtgatgactcttttt

SEQ ID NO: 71826 - DNA, 20 bp, Artificial Sequence
  Description of Artificial Sequence: Synthetic oligonucleotide
  Target: SCN10A; (+) strand; PAM type: YTN; PAM sequence: TTT
cgaagtgatgactctttttt

SEQ ID NO: 71827 - DNA, 20 bp, Artificial Sequence
  Description of Artificial Sequence: Synthetic oligonucleotide
  Target: SCN10A; (+) strand; PAM type: YTN; PAM sequence: TTC
gaagtgatgactcttttttt

SEQ ID NO: 71828 - DNA, 20 bp, Artificial Sequence
  Description of Artificial Sequence: Synthetic oligonucleotide
  Target: SCN10A; (+) strand; PAM type: YTN; PAM sequence: CTC
ttttttttgaattgtgatat

SEQ ID NO: 71829 - DNA, 20 bp, Artificial Sequence
  Description of Artificial Sequence: Synthetic oligonucleotide
  Target: SCN10A; (+) strand; PAM type: YTN; PAM sequence: CTT
ttttttgaattgtgatatta

SEQ ID NO: 71830 - DNA, 20 bp, Artificial Sequence
  Description of Artificial Sequence: Synthetic oligonucleotide
  Target: SCN10A; (+) strand; PAM type: YTN; PAM sequence: TTT
tttttgaattgtgatattat

SEQ ID NO: 71831 - DNA, 20 bp, Artificial Sequence
  Description of Artificial Sequence: Synthetic oligonucleotide
  Target: SCN10A; (+) strand; PAM type: YTN; PAM sequence: TTT
ttttgaattgtgatattatg

SEQ ID NO: 71832 - DNA, 20 bp, Artificial Sequence
  Description of Artificial Sequence: Synthetic oligonucleotide
  Target: SCN10A; (+) strand; PAM type: YTN; PAM sequence: TTT
tttgaattgtgatattatgc

SEQ ID NO: 71833 - DNA, 20 bp, Artificial Sequence
  Description of Artificial Sequence: Synthetic oligonucleotide
  Target: SCN10A; (+) strand; PAM type: YTN; PAM sequence: TTT
ttgaattgtgatattatgca

SEQ ID NO: 71834 - DNA, 20 bp, Artificial Sequence
  Description of Artificial Sequence: Synthetic oligonucleotide
  Target: SCN10A; (+) strand; PAM type: YTN; PAM sequence: TTT
tgaattgtgatattatgcaa

SEQ ID NO: 71835 - DNA, 20 bp, Artificial Sequence
  Description of Artificial Sequence: Synthetic oligonucleotide
  Target: SCN10A; (+) strand; PAM type: YTN; PAM sequence: TTT
gaattgtgatattatgcaaa

SEQ ID NO: 71836 - DNA, 20 bp, Artificial Sequence
  Description of Artificial Sequence: Synthetic oligonucleotide
  Target: SCN10A; (+) strand; PAM type: YTN; PAM sequence: TTG
aattgtgatattatgcaaag

SEQ ID NO: 71837 - DNA, 20 bp, Artificial Sequence
  Description of Artificial Sequence: Synthetic oligonucleotide
  Target: SCN10A; (+) strand; PAM type: YTN; PAM sequence: TTG
tgatattatgcaaagcgaca

SEQ ID NO: 71838 - DNA, 20 bp, Artificial Sequence
  Description of Artificial Sequence: Synthetic oligonucleotide
  Target: SCN10A; (+) strand; PAM type: YTN; PAM sequence: TTA
tgcaaagcgacagtaataat

SEQ ID NO: 71839 - DNA, 20 bp, Artificial Sequence
  Description of Artificial Sequence: Synthetic oligonucleotide
  Target: SCN10A; (+) strand; PAM type: YTN; PAM sequence: CTG
acaagtgtaaataactgtca

SEQ ID NO: 71840 - DNA, 20 bp, Artificial Sequence
  Description of Artificial Sequence: Synthetic oligonucleotide
  Target: SCN10A; (+) strand; PAM type: YTN; PAM sequence: CTG
tcaggtgacaataaaataca

SEQ ID NO: 71841 - DNA, 20 bp, Artificial Sequence
  Description of Artificial Sequence: Synthetic oligonucleotide
  Target: SCN10A; (+) strand; PAM type: YTN; PAM sequence: TTA
gtcaagataaactgcctatg

SEQ ID NO: 71842 - DNA, 20 bp, Artificial Sequence
  Description of Artificial Sequence: Synthetic oligonucleotide
  Target: SCN10A; (+) strand; PAM type: YTN; PAM sequence: CTG
cctatgattaactccatgtt

SEQ ID NO: 71843 - DNA, 20 bp, Artificial Sequence
  Description of Artificial Sequence: Synthetic oligonucleotide
  Target: SCN10A; (+) strand; PAM type: YTN; PAM sequence: CTA
tgattaactccatgttaacc

SEQ ID NO: 71844 - DNA, 20 bp, Artificial Sequence
  Description of Artificial Sequence: Synthetic oligonucleotide
  Target: SCN10A; (+) strand; PAM type: YTN; PAM sequence: TTA
actccatgttaaccattatg

SEQ ID NO: 71845 - DNA, 20 bp, Artificial Sequence
  Description of Artificial Sequence: Synthetic oligonucleotide
  Target: SCN10A; (+) strand; PAM type: YTN; PAM sequence: CTC
catgttaaccattatgaatg

SEQ ID NO: 71846 - DNA, 20 bp, Artificial Sequence
  Description of Artificial Sequence: Synthetic oligonucleotide
  Target: SCN10A; (+) strand; PAM type: YTN; PAM sequence: TTA
accattatgaatgaaatcag

SEQ ID NO: 71847 - DNA, 20 bp, Artificial Sequence
  Description of Artificial Sequence: Synthetic oligonucleotide
  Target: SCN10A; (+) strand; PAM type: YTN; PAM sequence: TTA
tgaatgaaatcagtttttga

SEQ ID NO: 71848 - DNA, 20 bp, Artificial Sequence
  Description of Artificial Sequence: Synthetic oligonucleotide
  Target: SCN10A; (+) strand; PAM type: YTN; PAM sequence: TTT
ttgaagcacatacactgttt

SEQ ID NO: 71849 - DNA, 20 bp, Artificial Sequence
  Description of Artificial Sequence: Synthetic oligonucleotide
  Target: SCN10A; (+) strand; PAM type: YTN; PAM sequence: TTT
tgaagcacatacactgtttt

SEQ ID NO: 71850 - DNA, 20 bp, Artificial Sequence
  Description of Artificial Sequence: Synthetic oligonucleotide
  Target: SCN10A; (+) strand; PAM type: YTN; PAM sequence: TTT
gaagcacatacactgttttt

SEQ ID NO: 71851 - DNA, 20 bp, Artificial Sequence
  Description of Artificial Sequence: Synthetic oligonucleotide
  Target: SCN10A; (+) strand; PAM type: YTN; PAM sequence: TTG
aagcacatacactgtttttg

SEQ ID NO: 71852 - DNA, 20 bp, Artificial Sequence
  Description of Artificial Sequence: Synthetic oligonucleotide
  Target: SCN10A; (+) strand; PAM type: YTN; PAM sequence: CTG
tttttgaaaacataaaaagt

SEQ ID NO: 71853 - DNA, 20 bp, Artificial Sequence
  Description of Artificial Sequence: Synthetic oligonucleotide
  Target: SCN10A; (+) strand; PAM type: YTN; PAM sequence: TTT
ttgaaaacataaaaagttag

SEQ ID NO: 71854 - DNA, 20 bp, Artificial Sequence
  Description of Artificial Sequence: Synthetic oligonucleotide
  Target: SCN10A; (+) strand; PAM type: YTN; PAM sequence: TTT
tgaaaacataaaaagttaga

SEQ ID NO: 71855 - DNA, 20 bp, Artificial Sequence
  Description of Artificial Sequence: Synthetic oligonucleotide
  Target: SCN10A; (+) strand; PAM type: YTN; PAM sequence: TTT
gaaaacataaaaagttagaa

SEQ ID NO: 71856 - DNA, 20 bp, Artificial Sequence
  Description of Artificial Sequence: Synthetic oligonucleotide
  Target: SCN10A; (+) strand; PAM type: YTN; PAM sequence: TTG
aaaacataaaaagttagaaa

SEQ ID NO: 71857 - DNA, 20 bp, Artificial Sequence
  Description of Artificial Sequence: Synthetic oligonucleotide
  Target: SCN10A; (+) strand; PAM type: YTN; PAM sequence: TTA
gaaattctatgaatataata

SEQ ID NO: 71858 - DNA, 20 bp, Artificial Sequence
  Description of Artificial Sequence: Synthetic oligonucleotide
  Target: SCN10A; (+) strand; PAM type: YTN; PAM sequence: TTC
tatgaatataataattaatc

SEQ ID NO: 71859 - DNA, 20 bp, Artificial Sequence
  Description of Artificial Sequence: Synthetic oligonucleotide
  Target: SCN10A; (+) strand; PAM type: YTN; PAM sequence: CTA
tgaatataataattaatctt

SEQ ID NO: 71860 - DNA, 20 bp, Artificial Sequence
  Description of Artificial Sequence: Synthetic oligonucleotide
  Target: SCN10A; (+) strand; PAM type: YTN; PAM sequence: TTA
atcttacatgttagatttta

SEQ ID NO: 71861 - DNA, 20 bp, Artificial Sequence
  Description of Artificial Sequence: Synthetic oligonucleotide
  Target: SCN10A; (+) strand; PAM type: YTN; PAM sequence: CTT
acatgttagattttaaaatt

SEQ ID NO: 71862 - DNA, 20 bp, Artificial Sequence
  Description of Artificial Sequence: Synthetic oligonucleotide
  Target: SCN10A; (+) strand; PAM type: YTN; PAM sequence: TTA
catgttagattttaaaatta

SEQ ID NO: 71863 - DNA, 20 bp, Artificial Sequence
  Description of Artificial Sequence: Synthetic oligonucleotide
  Target: SCN10A; (+) strand; PAM type: YTN; PAM sequence: TTA
gattttaaaattatatgtgc

SEQ ID NO: 71864 - DNA, 20 bp, Artificial Sequence
  Description of Artificial Sequence: Synthetic oligonucleotide
  Target: SCN10A; (+) strand; PAM type: YTN; PAM sequence: TTT
taaaattatatgtgcataga

SEQ ID NO: 71865 - DNA, 20 bp, Artificial Sequence
  Description of Artificial Sequence: Synthetic oligonucleotide
  Target: SCN10A; (+) strand; PAM type: YTN; PAM sequence: TTT
aaaattatatgtgcatagag

SEQ ID NO: 71866 - DNA, 20 bp, Artificial Sequence
  Description of Artificial Sequence: Synthetic oligonucleotide
  Target: SCN10A; (+) strand; PAM type: YTN; PAM sequence: TTA
aaattatatgtgcatagaga

SEQ ID NO: 71867 - DNA, 20 bp, Artificial Sequence
  Description of Artificial Sequence: Synthetic oligonucleotide
  Target: SCN10A; (+) strand; PAM type: YTN; PAM sequence: TTA
tatgtgcatagagatcctta

SEQ ID NO: 71868 - DNA, 20 bp, Artificial Sequence
  Description of Artificial Sequence: Synthetic oligonucleotide
  Target: SCN10A; (+) strand; PAM type: YTN; PAM sequence: CTT
agatcacttgttgagaaaca

SEQ ID NO: 71869 - DNA, 20 bp, Artificial Sequence
  Description of Artificial Sequence: Synthetic oligonucleotide
  Target: SCN10A; (+) strand; PAM type: YTN; PAM sequence: TTA
gatcacttgttgagaaacat

SEQ ID NO: 71870 - DNA, 20 bp, Artificial Sequence
  Description of Artificial Sequence: Synthetic oligonucleotide
  Target: SCN10A; (+) strand; PAM type: YTN; PAM sequence: CTT
gttgagaaacattgtaggag

SEQ ID NO: 71871 - DNA, 20 bp, Artificial Sequence
  Description of Artificial Sequence: Synthetic oligonucleotide
  Target: SCN10A; (+) strand; PAM type: YTN; PAM sequence: TTG
ttgagaaacattgtaggaga

SEQ ID NO: 71872 - DNA, 20 bp, Artificial Sequence
  Description of Artificial Sequence: Synthetic oligonucleotide
  Target: SCN10A; (+) strand; PAM type: YTN; PAM sequence: TTG
agaaacattgtaggagatgg

SEQ ID NO: 71873 - DNA, 20 bp, Artificial Sequence
  Description of Artificial Sequence: Synthetic oligonucleotide
  Target: SCN10A; (+) strand; PAM type: YTN; PAM sequence: TTG
taggagatggagagagatga

SEQ ID NO: 71874 - DNA, 20 bp, Artificial Sequence
  Description of Artificial Sequence: Synthetic oligonucleotide
  Target: SCN10A; (+) strand; PAM type: YTN; PAM sequence: TTG
ctctgctaaacaaagtaaga

SEQ ID NO: 71875 - DNA, 20 bp, Artificial Sequence
  Description of Artificial Sequence: Synthetic oligonucleotide
  Target: SCN10A; (+) strand; PAM type: YTN; PAM sequence: CTC
tgctaaacaaagtaagaata

SEQ ID NO: 71876 - DNA, 20 bp, Artificial Sequence
  Description of Artificial Sequence: Synthetic oligonucleotide
  Target: SCN10A; (+) strand; PAM type: YTN; PAM sequence: CTG
ctaaacaaagtaagaataag

SEQ ID NO: 71877 - DNA, 20 bp, Artificial Sequence
  Description of Artificial Sequence: Synthetic oligonucleotide
  Target: SCN10A; (+) strand; PAM type: YTN; PAM sequence: CTA
aacaaagtaagaataagttg

SEQ ID NO: 71878 - DNA, 20 bp, Artificial Sequence
  Description of Artificial Sequence: Synthetic oligonucleotide
  Target: SCN10A; (+) strand; PAM type: YTN; PAM sequence: TTG
gagttcccagggacaattga

SEQ ID NO: 71879 - DNA, 20 bp, Artificial Sequence
  Description of Artificial Sequence: Synthetic oligonucleotide
  Target: SCN10A; (+) strand; PAM type: YTN; PAM sequence: TTC
ccagggacaattgaggagag

SEQ ID NO: 71880 - DNA, 20 bp, Artificial Sequence
  Description of Artificial Sequence: Synthetic oligonucleotide
  Target: SCN10A; (+) strand; PAM type: YTN; PAM sequence: TTG
aggagagagttggaacatcc

SEQ ID NO: 71881 - DNA, 20 bp, Artificial Sequence
  Description of Artificial Sequence: Synthetic oligonucleotide
  Target: SCN10A; (+) strand; PAM type: YTN; PAM sequence: TTG
gaacatcccaaagggacagt

SEQ ID NO: 71882 - DNA, 20 bp, Artificial Sequence
  Description of Artificial Sequence: Synthetic oligonucleotide
  Target: SCN10A; (+) strand; PAM type: YTN; PAM sequence: TTT
atgaaagaagattacaggcc

SEQ ID NO: 71883 - DNA, 20 bp, Artificial Sequence
  Description of Artificial Sequence: Synthetic oligonucleotide
  Target: SCN10A; (+) strand; PAM type: YTN; PAM sequence: TTA
tgaaagaagattacaggcca

SEQ ID NO: 71884 - DNA, 20 bp, Artificial Sequence
  Description of Artificial Sequence: Synthetic oligonucleotide
  Target: SCN10A; (+) strand; PAM type: YTN; PAM sequence: TTA
caggccagcctcatttagca

SEQ ID NO: 71885 - DNA, 20 bp, Artificial Sequence
  Description of Artificial Sequence: Synthetic oligonucleotide
  Target: SCN10A; (+) strand; PAM type: YTN; PAM sequence: CTC
atttagcaaaatagataaaa

SEQ ID NO: 71886 - DNA, 20 bp, Artificial Sequence
  Description of Artificial Sequence: Synthetic oligonucleotide
  Target: SCN10A; (+) strand; PAM type: YTN; PAM sequence: TTT
agcaaaatagataaaatgaa

SEQ ID NO: 71887 - DNA, 20 bp, Artificial Sequence
  Description of Artificial Sequence: Synthetic oligonucleotide
  Target: SCN10A; (+) strand; PAM type: YTN; PAM sequence: TTA
gcaaaatagataaaatgaaa

SEQ ID NO: 71888 - DNA, 20 bp, Artificial Sequence
  Description of Artificial Sequence: Synthetic oligonucleotide
  Target: SCN10A; (+) strand; PAM type: YTN; PAM sequence: CTA
attgaatccagcaaaatgat

SEQ ID NO: 71889 - DNA, 20 bp, Artificial Sequence
  Description of Artificial Sequence: Synthetic oligonucleotide
  Target: SCN10A; (+) strand; PAM type: YTN; PAM sequence: TTG
aatccagcaaaatgatcagc

SEQ ID NO: 71890 - DNA, 20 bp, Artificial Sequence
  Description of Artificial Sequence: Synthetic oligonucleotide
  Target: SCN10A; (+) strand; PAM type: YTN; PAM sequence: CTG
gaaccattaaaaatagacta

SEQ ID NO: 71891 - DNA, 20 bp, Artificial Sequence
  Description of Artificial Sequence: Synthetic oligonucleotide
  Target: SCN10A; (+) strand; PAM type: YTN; PAM sequence: TTA
aaaatagactaacaaacctg

SEQ ID NO: 71892 - DNA, 20 bp, Artificial Sequence
  Description of Artificial Sequence: Synthetic oligonucleotide
  Target: SCN10A; (+) strand; PAM type: YTN; PAM sequence: CTA
acaaacctgttagtttacag

SEQ ID NO: 71893 - DNA, 20 bp, Artificial Sequence
  Description of Artificial Sequence: Synthetic oligonucleotide
  Target: SCN10A; (+) strand; PAM type: YTN; PAM sequence: CTG
ttagtttacagatttactat

SEQ ID NO: 71894 - DNA, 20 bp, Artificial Sequence
  Description of Artificial Sequence: Synthetic oligonucleotide
  Target: SCN10A; (+) strand; PAM type: YTN; PAM sequence: TTA
gtttacagatttactatact

SEQ ID NO: 71895 - DNA, 20 bp, Artificial Sequence
  Description of Artificial Sequence: Synthetic oligonucleotide
  Target: SCN10A; (+) strand; PAM type: YTN; PAM sequence: TTT
acagatttactatactaaca

SEQ ID NO: 71896 - DNA, 20 bp, Artificial Sequence
  Description of Artificial Sequence: Synthetic oligonucleotide
  Target: SCN10A; (+) strand; PAM type: YTN; PAM sequence: TTA
cagatttactatactaacag

SEQ ID NO: 71897 - DNA, 20 bp, Artificial Sequence
  Description of Artificial Sequence: Synthetic oligonucleotide
  Target: SCN10A; (+) strand; PAM type: YTN; PAM sequence: TTT
actatactaacagatgaaag

SEQ ID NO: 71898 - DNA, 20 bp, Artificial Sequence
  Description of Artificial Sequence: Synthetic oligonucleotide
  Target: SCN10A; (+) strand; PAM type: YTN; PAM sequence: TTA
ctatactaacagatgaaaga

SEQ ID NO: 71899 - DNA, 20 bp, Artificial Sequence
  Description of Artificial Sequence: Synthetic oligonucleotide
  Target: SCN10A; (+) strand; PAM type: YTN; PAM sequence: CTA
tactaacagatgaaagacta

SEQ ID NO: 71900 - DNA, 20 bp, Artificial Sequence
  Description of Artificial Sequence: Synthetic oligonucleotide
  Target: SCN10A; (+) strand; PAM type: YTN; PAM sequence: CTA
acagatgaaagactatatga

SEQ ID NO: 71901 - DNA, 20 bp, Artificial Sequence
  Description of Artificial Sequence: Synthetic oligonucleotide
  Target: SCN10A; (+) strand; PAM type: YTN; PAM sequence: CTA
tatgataacctcaataaata

SEQ ID NO: 71902 - DNA, 20 bp, Artificial Sequence
  Description of Artificial Sequence: Synthetic oligonucleotide
  Target: SCN10A; (+) strand; PAM type: YTN; PAM sequence: CTC
aataaatataaaaatactga

SEQ ID NO: 71903 - DNA, 20 bp, Artificial Sequence
  Description of Artificial Sequence: Synthetic oligonucleotide
  Target: SCN10A; (+) strand; PAM type: YTN; PAM sequence: CTG
atagaagccaacacccattc

SEQ ID NO: 71904 - DNA, 20 bp, Artificial Sequence
  Description of Artificial Sequence: Synthetic oligonucleotide
  Target: SCN10A; (+) strand; PAM type: YTN; PAM sequence: TTC
atgatgaaagtctcaacaaa

SEQ ID NO: 71905 - DNA, 20 bp, Artificial Sequence
  Description of Artificial Sequence: Synthetic oligonucleotide
  Target: SCN10A; (+) strand; PAM type: YTN; PAM sequence: CTC
aacaaacaagaaatggaaaa

SEQ ID NO: 71906 - DNA, 20 bp, Artificial Sequence
  Description of Artificial Sequence: Synthetic oligonucleotide
  Target: SCN10A; (+) strand; PAM type: YTN; PAM sequence: TTG
atataaaaagtaattatgag

SEQ ID NO: 71907 - DNA, 20 bp, Artificial Sequence
  Description of Artificial Sequence: Synthetic oligonucleotide
  Target: SCN10A; (+) strand; PAM type: YTN; PAM sequence: TTA
tgagactctcataaacatca

SEQ ID NO: 71908 - DNA, 20 bp, Artificial Sequence
  Description of Artificial Sequence: Synthetic oligonucleotide
  Target: SCN10A; (+) strand; PAM type: YTN; PAM sequence: CTC
tcataaacatcataatagtg

SEQ ID NO: 71909 - DNA, 20 bp, Artificial Sequence
  Description of Artificial Sequence: Synthetic oligonucleotide
  Target: SCN10A; (+) strand; PAM type: YTN; PAM sequence: CTC
ataaacatcataatagtgaa

SEQ ID NO: 71910 - DNA, 20 bp, Artificial Sequence
  Description of Artificial Sequence: Synthetic oligonucleotide
  Target: SCN10A; (+) strand; PAM type: YTN; PAM sequence: TTA
gaagcacacactttaaaatc

SEQ ID NO: 71911 - DNA, 20 bp, Artificial Sequence
  Description of Artificial Sequence: Synthetic oligonucleotide
  Target: SCN10A; (+) strand; PAM type: YTN; PAM sequence: CTT
taaaatcaagagcaaaataa

SEQ ID NO: 71912 - DNA, 20 bp, Artificial Sequence
  Description of Artificial Sequence: Synthetic oligonucleotide
  Target: SCN10A; (+) strand; PAM type: YTN; PAM sequence: TTT
aaaatcaagagcaaaataaa

SEQ ID NO: 71913 - DNA, 20 bp, Artificial Sequence
  Description of Artificial Sequence: Synthetic oligonucleotide
  Target: SCN10A; (+) strand; PAM type: YTN; PAM sequence: TTA
aaatcaagagcaaaataaat

SEQ ID NO: 71914 - DNA, 20 bp, Artificial Sequence
  Description of Artificial Sequence: Synthetic oligonucleotide
  Target: SCN10A; (+) strand; PAM type: YTN; PAM sequence: CTC
actgtcatagctttgaatta

SEQ ID NO: 71915 - DNA, 20 bp, Artificial Sequence
  Description of Artificial Sequence: Synthetic oligonucleotide
  Target: SCN10A; (+) strand; PAM type: YTN; PAM sequence: CTG
tcatagctttgaattaccat

SEQ ID NO: 71916 - DNA, 20 bp, Artificial Sequence
  Description of Artificial Sequence: Synthetic oligonucleotide
  Target: SCN10A; (+) strand; PAM type: YTN; PAM sequence: CTT
tgaattaccatcttgttgaa

SEQ ID NO: 71917 - DNA, 20 bp, Artificial Sequence
  Description of Artificial Sequence: Synthetic oligonucleotide
  Target: SCN10A; (+) strand; PAM type: YTN; PAM sequence: TTT
gaattaccatcttgttgaag

SEQ ID NO: 71918 - DNA, 20 bp, Artificial Sequence
  Description of Artificial Sequence: Synthetic oligonucleotide
  Target: SCN10A; (+) strand; PAM type: YTN; PAM sequence: TTG
aattaccatcttgttgaagg

SEQ ID NO: 71919 - DNA, 20 bp, Artificial Sequence
  Description of Artificial Sequence: Synthetic oligonucleotide
  Target: SCN10A; (+) strand; PAM type: YTN; PAM sequence: TTA
ccatcttgttgaaggtcccg

SEQ ID NO: 71920 - DNA, 20 bp, Artificial Sequence
  Description of Artificial Sequence: Synthetic oligonucleotide
  Target: SCN10A; (+) strand; PAM type: YTN; PAM sequence: CTT
gttgaaggtcccggccaatt

SEQ ID NO: 71921 - DNA, 20 bp, Artificial Sequence
  Description of Artificial Sequence: Synthetic oligonucleotide
  Target: SCN10A; (+) strand; PAM type: YTN; PAM sequence: TTG
ttgaaggtcccggccaattc

SEQ ID NO: 71922 - DNA, 20 bp, Artificial Sequence
  Description of Artificial Sequence: Synthetic oligonucleotide
  Target: SCN10A; (+) strand; PAM type: YTN; PAM sequence: TTG
aaggtcccggccaattcaat

SEQ ID NO: 71923 - DNA, 20 bp, Artificial Sequence
  Description of Artificial Sequence: Synthetic oligonucleotide
  Target: SCN10A; (+) strand; PAM type: YTN; PAM sequence: TTC
aataagacaggaaaaataaa

SEQ ID NO: 71924 - DNA, 20 bp, Artificial Sequence
  Description of Artificial Sequence: Synthetic oligonucleotide
  Target: SCN10A; (+) strand; PAM type: YTN; PAM sequence: TTT
gtcattatttgcagataata

SEQ ID NO: 71925 - DNA, 20 bp, Artificial Sequence
  Description of Artificial Sequence: Synthetic oligonucleotide
  Target: SCN10A; (+) strand; PAM type: YTN; PAM sequence: TTG
tcattatttgcagataatat

SEQ ID NO: 71926 - DNA, 20 bp, Artificial Sequence
  Description of Artificial Sequence: Synthetic oligonucleotide
  Target: SCN10A; (+) strand; PAM type: YTN; PAM sequence: TTA
tttgcagataatataactgt

SEQ ID NO: 71927 - DNA, 20 bp, Artificial Sequence
  Description of Artificial Sequence: Synthetic oligonucleotide
  Target: SCN10A; (+) strand; PAM type: YTN; PAM sequence: TTT
gcagataatataactgtcta

SEQ ID NO: 71928 - DNA, 20 bp, Artificial Sequence
  Description of Artificial Sequence: Synthetic oligonucleotide
  Target: SCN10A; (+) strand; PAM type: YTN; PAM sequence: TTG
cagataatataactgtctaa

SEQ ID NO: 71929 - DNA, 20 bp, Artificial Sequence
  Description of Artificial Sequence: Synthetic oligonucleotide
  Target: SCN10A; (+) strand; PAM type: YTN; PAM sequence: CTG
tctaaataggaagtccaagg

SEQ ID NO: 71930 - DNA, 20 bp, Artificial Sequence
  Description of Artificial Sequence: Synthetic oligonucleotide
  Target: SCN10A; (+) strand; PAM type: YTN; PAM sequence: CTA
aataggaagtccaagggaat

SEQ ID NO: 71931 - DNA, 20 bp, Artificial Sequence
  Description of Artificial Sequence: Synthetic oligonucleotide
  Target: SCN10A; (+) strand; PAM type: YTN; PAM sequence: CTA
cagaaaaatttaactttaag

SEQ ID NO: 71932 - DNA, 20 bp, Artificial Sequence
  Description of Artificial Sequence: Synthetic oligonucleotide
  Target: SCN10A; (+) strand; PAM type: YTN; PAM sequence: TTT
aactttaaggagctcagcag

SEQ ID NO: 71933 - DNA, 20 bp, Artificial Sequence
  Description of Artificial Sequence: Synthetic oligonucleotide
  Target: SCN10A; (+) strand; PAM type: YTN; PAM sequence: TTA
actttaaggagctcagcagg

SEQ ID NO: 71934 - DNA, 20 bp, Artificial Sequence
  Description of Artificial Sequence: Synthetic oligonucleotide
  Target: SCN10A; (+) strand; PAM type: YTN; PAM sequence: CTT
taaggagctcagcagggttg

SEQ ID NO: 71935 - DNA, 20 bp, Artificial Sequence
  Description of Artificial Sequence: Synthetic oligonucleotide
  Target: SCN10A; (+) strand; PAM type: YTN; PAM sequence: TTT
aaggagctcagcagggttgc

SEQ ID NO: 71936 - DNA, 20 bp, Artificial Sequence
  Description of Artificial Sequence: Synthetic oligonucleotide
  Target: SCN10A; (+) strand; PAM type: YTN; PAM sequence: TTA
aggagctcagcagggttgct

SEQ ID NO: 71937 - DNA, 20 bp, Artificial Sequence
  Description of Artificial Sequence: Synthetic oligonucleotide
  Target: SCN10A; (+) strand; PAM type: YTN; PAM sequence: CTC
agcagggttgctggatgcaa

SEQ ID NO: 71938 - DNA, 20 bp, Artificial Sequence
  Description of Artificial Sequence: Synthetic oligonucleotide
  Target: SCN10A; (+) strand; PAM type: YTN; PAM sequence: TTG
ctggatgcaaaatcactata

SEQ ID NO: 71939 - DNA, 20 bp, Artificial Sequence
  Description of Artificial Sequence: Synthetic oligonucleotide
  Target: SCN10A; (+) strand; PAM type: YTN; PAM sequence: CTG
gatgcaaaatcactatatag

SEQ ID NO: 71940 - DNA, 20 bp, Artificial Sequence
  Description of Artificial Sequence: Synthetic oligonucleotide
  Target: SCN10A; (+) strand; PAM type: YTN; PAM sequence: CTA
tatagaaattaataatatta

SEQ ID NO: 71941 - DNA, 20 bp, Artificial Sequence
  Description of Artificial Sequence: Synthetic oligonucleotide
  Target: SCN10A; (+) strand; PAM type: YTN; PAM sequence: TTA
ataatattaagacagtttag

SEQ ID NO: 71942 - DNA, 20 bp, Artificial Sequence
  Description of Artificial Sequence: Synthetic oligonucleotide
  Target: SCN10A; (+) strand; PAM type: YTN; PAM sequence: TTA
agacagtttagcaataataa

SEQ ID NO: 71943 - DNA, 20 bp, Artificial Sequence
  Description of Artificial Sequence: Synthetic oligonucleotide
  Target: SCN10A; (+) strand; PAM type: YTN; PAM sequence: TTT
agcaataataagtattcaat

SEQ ID NO: 71944 - DNA, 20 bp, Artificial Sequence
  Description of Artificial Sequence: Synthetic oligonucleotide
  Target: SCN10A; (+) strand; PAM type: YTN; PAM sequence: TTA
gcaataataagtattcaata

SEQ ID NO: 71945 - DNA, 20 bp, Artificial Sequence
  Description of Artificial Sequence: Synthetic oligonucleotide
  Target: SCN10A; (+) strand; PAM type: YTN; PAM sequence: TTC
aatagggcaaccaaaattgc

SEQ ID NO: 71946 - DNA, 20 bp, Artificial Sequence
  Description of Artificial Sequence: Synthetic oligonucleotide
  Target: SCN10A; (+) strand; PAM type: YTN; PAM sequence: TTG
caatgtacctaggaaaaaga

SEQ ID NO: 71947 - DNA, 20 bp, Artificial Sequence
  Description of Artificial Sequence: Synthetic oligonucleotide
  Target: SCN10A; (+) strand; PAM type: YTN; PAM sequence: CTA
ggaaaaagacattataaaat

SEQ ID NO: 71948 - DNA, 20 bp, Artificial Sequence
  Description of Artificial Sequence: Synthetic oligonucleotide
  Target: SCN10A; (+) strand; PAM type: YTN; PAM sequence: TTA
taaaatgtagaaaaatatta

SEQ ID NO: 71949 - DNA, 20 bp, Artificial Sequence
  Description of Artificial Sequence: Synthetic oligonucleotide
  Target: SCN10A; (+) strand; PAM type: YTN; PAM sequence: TTA
aagaagacctgtataaatta

SEQ ID NO: 71950 - DNA, 20 bp, Artificial Sequence
  Description of Artificial Sequence: Synthetic oligonucleotide
  Target: SCN10A; (+) strand; PAM type: YTN; PAM sequence: CTG
tataaattaagagatctgcc

SEQ ID NO: 71951 - DNA, 20 bp, Artificial Sequence
  Description of Artificial Sequence: Synthetic oligonucleotide
  Target: SCN10A; (+) strand; PAM type: YTN; PAM sequence: TTA
agagatctgccatactgatg

SEQ ID NO: 71952 - DNA, 20 bp, Artificial Sequence
  Description of Artificial Sequence: Synthetic oligonucleotide
  Target: SCN10A; (+) strand; PAM type: YTN; PAM sequence: CTG
ccatactgatgtgtgggaag

SEQ ID NO: 71953 - DNA, 20 bp, Artificial Sequence
  Description of Artificial Sequence: Synthetic oligonucleotide
  Target: SCN10A; (+) strand; PAM type: YTN; PAM sequence: CTG
atgtgtgggaaggcttcgta

SEQ ID NO: 71954 - DNA, 20 bp, Artificial Sequence
  Description of Artificial Sequence: Synthetic oligonucleotide
  Target: SCN10A; (+) strand; PAM type: YTN; PAM sequence: CTT
cgtattgtaaatgtggcgat

SEQ ID NO: 71955 - DNA, 20 bp, Artificial Sequence
  Description of Artificial Sequence: Synthetic oligonucleotide
  Target: SCN10A; (+) strand; PAM type: YTN; PAM sequence: TTC
gtattgtaaatgtggcgatt

SEQ ID NO: 71956 - DNA, 20 bp, Artificial Sequence
  Description of Artificial Sequence: Synthetic oligonucleotide
  Target: SCN10A; (+) strand; PAM type: YTN; PAM sequence: TTG
taaatgtggcgattcttcct

SEQ ID NO: 71957 - DNA, 20 bp, Artificial Sequence
  Description of Artificial Sequence: Synthetic oligonucleotide
  Target: SCN10A; (+) strand; PAM type: YTN; PAM sequence: TTC
ttcctgtggtgataaatcaa

SEQ ID NO: 71958 - DNA, 20 bp, Artificial Sequence
  Description of Artificial Sequence: Synthetic oligonucleotide
  Target: SCN10A; (+) strand; PAM type: YTN; PAM sequence: CTT
cctgtggtgataaatcaatt

SEQ ID NO: 71959 - DNA, 20 bp, Artificial Sequence
  Description of Artificial Sequence: Synthetic oligonucleotide
  Target: SCN10A; (+) strand; PAM type: YTN; PAM sequence: TTC
ctgtggtgataaatcaattc

SEQ ID NO: 71960 - DNA, 20 bp, Artificial Sequence
  Description of Artificial Sequence: Synthetic oligonucleotide
  Target: SCN10A; (+) strand; PAM type: YTN; PAM sequence: CTG
tggtgataaatcaattcagt

SEQ ID NO: 71961 - DNA, 20 bp, Artificial Sequence
  Description of Artificial Sequence: Synthetic oligonucleotide
  Target: SCN10A; (+) strand; PAM type: YTN; PAM sequence: TTC
agtgcattaccaaacaaagt

SEQ ID NO: 71962 - DNA, 20 bp, Artificial Sequence
  Description of Artificial Sequence: Synthetic oligonucleotide
  Target: SCN10A; (+) strand; PAM type: YTN; PAM sequence: TTA
ccaaacaaagtttccacaga

SEQ ID NO: 71963 - DNA, 20 bp, Artificial Sequence
  Description of Artificial Sequence: Synthetic oligonucleotide
  Target: SCN10A; (+) strand; PAM type: YTN; PAM sequence: TTT
ccacagagttgtaagaaaag

SEQ ID NO: 71964 - DNA, 20 bp, Artificial Sequence
  Description of Artificial Sequence: Synthetic oligonucleotide
  Target: SCN10A; (+) strand; PAM type: YTN; PAM sequence: TTC
cacagagttgtaagaaaaga

SEQ ID NO: 71965 - DNA, 20 bp, Artificial Sequence
  Description of Artificial Sequence: Synthetic oligonucleotide
  Target: SCN10A; (+) strand; PAM type: YTN; PAM sequence: TTG
taagaaaagagctggaaaat

SEQ ID NO: 71966 - DNA, 20 bp, Artificial Sequence
  Description of Artificial Sequence: Synthetic oligonucleotide
  Target: SCN10A; (+) strand; PAM type: YTN; PAM sequence: CTG
gaaaatgtgacccttaaact

SEQ ID NO: 71967 - DNA, 20 bp, Artificial Sequence
  Description of Artificial Sequence: Synthetic oligonucleotide
  Target: SCN10A; (+) strand; PAM type: YTN; PAM sequence: CTT
aaactgatatggaaaagtaa

SEQ ID NO: 71968 - DNA, 20 bp, Artificial Sequence
  Description of Artificial Sequence: Synthetic oligonucleotide
  Target: SCN10A; (+) strand; PAM type: YTN; PAM sequence: TTA
aactgatatggaaaagtaaa

SEQ ID NO: 71969 - DNA, 20 bp, Artificial Sequence
  Description of Artificial Sequence: Synthetic oligonucleotide
  Target: SCN10A; (+) strand; PAM type: YTN; PAM sequence: CTG
atatggaaaagtaaagaaac

SEQ ID NO: 71970 - DNA, 20 bp, Artificial Sequence
  Description of Artificial Sequence: Synthetic oligonucleotide
  Target: SCN10A; (+) strand; PAM type: YTN; PAM sequence: TTT
tcaagaagacaaataaggag

SEQ ID NO: 71971 - DNA, 20 bp, Artificial Sequence
  Description of Artificial Sequence: Synthetic oligonucleotide
  Target: SCN10A; (+) strand; PAM type: YTN; PAM sequence: TTT
caagaagacaaataaggagg

SEQ ID NO: 71972 - DNA, 20 bp, Artificial Sequence
  Description of Artificial Sequence: Synthetic oligonucleotide
  Target: SCN10A; (+) strand; PAM type: YTN; PAM sequence: TTC
aagaagacaaataaggaggg

SEQ ID NO: 71973 - DNA, 20 bp, Artificial Sequence
  Description of Artificial Sequence: Synthetic oligonucleotide
  Target: SCN10A; (+) strand; PAM type: YTN; PAM sequence: CTT
actatagagcatttaaatcc

SEQ ID NO: 71974 - DNA, 20 bp, Artificial Sequence
  Description of Artificial Sequence: Synthetic oligonucleotide
  Target: SCN10A; (+) strand; PAM type: YTN; PAM sequence: TTA
ctatagagcatttaaatcca

SEQ ID NO: 71975 - DNA, 20 bp, Artificial Sequence
  Description of Artificial Sequence: Synthetic oligonucleotide
  Target: SCN10A; (+) strand; PAM type: YTN; PAM sequence: CTA
tagagcatttaaatccacgt

SEQ ID NO: 71976 - DNA, 20 bp, Artificial Sequence
  Description of Artificial Sequence: Synthetic oligonucleotide
  Target: SCN10A; (+) strand; PAM type: YTN; PAM sequence: TTT
aaatccacgtggtgttgact

SEQ ID NO: 71977 - DNA, 20 bp, Artificial Sequence
  Description of Artificial Sequence: Synthetic oligonucleotide
  Target: SCN10A; (+) strand; PAM type: YTN; PAM sequence: TTA
aatccacgtggtgttgactc

SEQ ID NO: 71978 - DNA, 20 bp, Artificial Sequence
  Description of Artificial Sequence: Synthetic oligonucleotide
  Target: SCN10A; (+) strand; PAM type: YTN; PAM sequence: TTG
actcaggatgtgacaatgag

SEQ ID NO: 71979 - DNA, 20 bp, Artificial Sequence
  Description of Artificial Sequence: Synthetic oligonucleotide
  Target: SCN10A; (+) strand; PAM type: YTN; PAM sequence: CTC
aggatgtgacaatgagatta

SEQ ID NO: 71980 - DNA, 20 bp, Artificial Sequence
  Description of Artificial Sequence: Synthetic oligonucleotide
  Target: SCN10A; (+) strand; PAM type: YTN; PAM sequence: TTA
ctgggagaaacagattcagt

SEQ ID NO: 71981 - DNA, 20 bp, Artificial Sequence
  Description of Artificial Sequence: Synthetic oligonucleotide
  Target: SCN10A; (+) strand; PAM type: YTN; PAM sequence: CTG
ggagaaacagattcagtaga

SEQ ID NO: 71982 - DNA, 20 bp, Artificial Sequence
  Description of Artificial Sequence: Synthetic oligonucleotide
  Target: SCN10A; (+) strand; PAM type: YTN; PAM sequence: TTC
agtagacatgggaatctggt

SEQ ID NO: 71983 - DNA, 20 bp, Artificial Sequence
  Description of Artificial Sequence: Synthetic oligonucleotide
  Target: SCN10A; (+) strand; PAM type: YTN; PAM sequence: CTG
gtgcatggcagaagcagtgg

SEQ ID NO: 71984 - DNA, 20 bp, Artificial Sequence
  Description of Artificial Sequence: Synthetic oligonucleotide
  Target: SCN10A; (+) strand; PAM type: YTN; PAM sequence: CTT
gggaaatgatgtattgaaaa

SEQ ID NO: 71985 - DNA, 20 bp, Artificial Sequence
  Description of Artificial Sequence: Synthetic oligonucleotide
  Target: SCN10A; (+) strand; PAM type: YTN; PAM sequence: TTG
ggaaatgatgtattgaaaaa

SEQ ID NO: 71986 - DNA, 20 bp, Artificial Sequence
  Description of Artificial Sequence: Synthetic oligonucleotide
  Target: SCN10A; (+) strand; PAM type: YTN; PAM sequence: TTG
aaaaaaatgttggaataatc

SEQ ID NO: 71987 - DNA, 20 bp, Artificial Sequence
  Description of Artificial Sequence: Synthetic oligonucleotide
  Target: SCN10A; (+) strand; PAM type: YTN; PAM sequence: TTG
gaataatccatatggaaaaa

SEQ ID NO: 71988 - DNA, 20 bp, Artificial Sequence
  Description of Artificial Sequence: Synthetic oligonucleotide
  Target: SCN10A; (+) strand; PAM type: YTN; PAM sequence: TTG
gaagcctatctcataccaca

SEQ ID NO: 71989 - DNA, 20 bp, Artificial Sequence
  Description of Artificial Sequence: Synthetic oligonucleotide
  Target: SCN10A; (+) strand; PAM type: YTN; PAM sequence: CTA
tctcataccacacacataca

SEQ ID NO: 71990 - DNA, 20 bp, Artificial Sequence
  Description of Artificial Sequence: Synthetic oligonucleotide
  Target: SCN10A; (+) strand; PAM type: YTN; PAM sequence: CTC
ataccacacacatacaaaaa

SEQ ID NO: 71991 - DNA, 20 bp, Artificial Sequence
  Description of Artificial Sequence: Synthetic oligonucleotide
  Target: SCN10A; (+) strand; PAM type: YTN; PAM sequence: TTC
taggagattgaaatacctaa

SEQ ID NO: 71992 - DNA, 20 bp, Artificial Sequence
  Description of Artificial Sequence: Synthetic oligonucleotide
  Target: SCN10A; (+) strand; PAM type: YTN; PAM sequence: CTA
ggagattgaaatacctaaat

SEQ ID NO: 71993 - DNA, 20 bp, Artificial Sequence
  Description of Artificial Sequence: Synthetic oligonucleotide
  Target: SCN10A; (+) strand; PAM type: YTN; PAM sequence: TTG
aaatacctaaatgtagaaag

SEQ ID NO: 71994 - DNA, 20 bp, Artificial Sequence
  Description of Artificial Sequence: Synthetic oligonucleotide
  Target: SCN10A; (+) strand; PAM type: YTN; PAM sequence: CTA
aatgtagaaaggaaaactgt

SEQ ID NO: 71995 - DNA, 20 bp, Artificial Sequence
  Description of Artificial Sequence: Synthetic oligonucleotide
  Target: SCN10A; (+) strand; PAM type: YTN; PAM sequence: CTG
taactttgaggagaaaacac

SEQ ID NO: 71996 - DNA, 20 bp, Artificial Sequence
  Description of Artificial Sequence: Synthetic oligonucleotide
  Target: SCN10A; (+) strand; PAM type: YTN; PAM sequence: CTT
tgaggagaaaacacaggata

SEQ ID NO: 71997 - DNA, 20 bp, Artificial Sequence
  Description of Artificial Sequence: Synthetic oligonucleotide
  Target: SCN10A; (+) strand; PAM type: YTN; PAM sequence: TTT
gaggagaaaacacaggataa

SEQ ID NO: 71998 - DNA, 20 bp, Artificial Sequence
  Description of Artificial Sequence: Synthetic oligonucleotide
  Target: SCN10A; (+) strand; PAM type: YTN; PAM sequence: TTG
aggagaaaacacaggataat

SEQ ID NO: 71999 - DNA, 20 bp, Artificial Sequence
  Description of Artificial Sequence: Synthetic oligonucleotide
  Target: SCN10A; (+) strand; PAM type: YTN; PAM sequence: CTT
tatggaatactatatggcaa

SEQ ID NO: 72000 - DNA, 20 bp, Artificial Sequence
  Description of Artificial Sequence: Synthetic oligonucleotide
  Target: SCN10A; (+) strand; PAM type: YTN; PAM sequence: TTT
atggaatactatatggcaat

SEQ ID NO: 72001 - DNA, 20 bp, Artificial Sequence
  Description of Artificial Sequence: Synthetic oligonucleotide
  Target: SCN10A; (+) strand; PAM type: YTN; PAM sequence: TTA
tggaatactatatggcaata

SEQ ID NO: 72002 - DNA, 20 bp, Artificial Sequence
  Description of Artificial Sequence: Synthetic oligonucleotide
  Target: SCN10A; (+) strand; PAM type: YTN; PAM sequence: CTA
tatggcaataaaaaatgaat

SEQ ID NO: 72003 - DNA, 20 bp, Artificial Sequence
  Description of Artificial Sequence: Synthetic oligonucleotide
  Target: SCN10A; (+) strand; PAM type: YTN; PAM sequence: TTA
ggtctacatgtatccatttg

SEQ ID NO: 72004 - DNA, 20 bp, Artificial Sequence
  Description of Artificial Sequence: Synthetic oligonucleotide
  Target: SCN10A; (+) strand; PAM type: YTN; PAM sequence: CTA
catgtatccatttgggcaaa

SEQ ID NO: 72005 - DNA, 20 bp, Artificial Sequence
  Description of Artificial Sequence: Synthetic oligonucleotide
  Target: SCN10A; (+) strand; PAM type: YTN; PAM sequence: TTT
gggcaaatcccaaaaacata

SEQ ID NO: 72006 - DNA, 20 bp, Artificial Sequence
  Description of Artificial Sequence: Synthetic oligonucleotide
  Target: SCN10A; (+) strand; PAM type: YTN; PAM sequence: TTG
ggcaaatcccaaaaacataa

SEQ ID NO: 72007 - DNA, 20 bp, Artificial Sequence
  Description of Artificial Sequence: Synthetic oligonucleotide
  Target: SCN10A; (+) strand; PAM type: YTN; PAM sequence: TTT
taaaacatcagataaagcac

SEQ ID NO: 72008 - DNA, 20 bp, Artificial Sequence
  Description of Artificial Sequence: Synthetic oligonucleotide
  Target: SCN10A; (+) strand; PAM type: YTN; PAM sequence: TTT
aaaacatcagataaagcaca

SEQ ID NO: 72009 - DNA, 20 bp, Artificial Sequence
  Description of Artificial Sequence: Synthetic oligonucleotide
  Target: SCN10A; (+) strand; PAM type: YTN; PAM sequence: TTA
aaacatcagataaagcacac

SEQ ID NO: 72010 - DNA, 20 bp, Artificial Sequence
  Description of Artificial Sequence: Synthetic oligonucleotide
  Target: SCN10A; (+) strand; PAM type: YTN; PAM sequence: TTC
cataaatttgaaaagataca

SEQ ID NO: 72011 - DNA, 20 bp, Artificial Sequence
  Description of Artificial Sequence: Synthetic oligonucleotide
  Target: SCN10A; (+) strand; PAM type: YTN; PAM sequence: TTT
gaaaagatacaaatcaatac

SEQ ID NO: 72012 - DNA, 20 bp, Artificial Sequence
  Description of Artificial Sequence: Synthetic oligonucleotide
  Target: SCN10A; (+) strand; PAM type: YTN; PAM sequence: TTG
aaaagatacaaatcaatact

SEQ ID NO: 72013 - DNA, 20 bp, Artificial Sequence
  Description of Artificial Sequence: Synthetic oligonucleotide
  Target: SCN10A; (+) strand; PAM type: YTN; PAM sequence: CTT
tatgcatgcagtgttaaaca

SEQ ID NO: 72014 - DNA, 20 bp, Artificial Sequence
  Description of Artificial Sequence: Synthetic oligonucleotide
  Target: SCN10A; (+) strand; PAM type: YTN; PAM sequence: TTT
atgcatgcagtgttaaacac

SEQ ID NO: 72015 - DNA, 20 bp, Artificial Sequence
  Description of Artificial Sequence: Synthetic oligonucleotide
  Target: SCN10A; (+) strand; PAM type: YTN; PAM sequence: TTA
tgcatgcagtgttaaacacc

SEQ ID NO: 72016 - DNA, 20 bp, Artificial Sequence
  Description of Artificial Sequence: Synthetic oligonucleotide
  Target: SCN10A; (+) strand; PAM type: YTN; PAM sequence: TTA
aacacccacttccccgtttg

SEQ ID NO: 72017 - DNA, 20 bp, Artificial Sequence
  Description of Artificial Sequence: Synthetic oligonucleotide
  Target: SCN10A; (+) strand; PAM type: YTN; PAM sequence: CTT
ccccgtttgcagtagattca

SEQ ID NO: 72018 - DNA, 20 bp, Artificial Sequence
  Description of Artificial Sequence: Synthetic oligonucleotide
  Target: SCN10A; (+) strand; PAM type: YTN; PAM sequence: TTC
cccgtttgcagtagattcag

SEQ ID NO: 72019 - DNA, 20 bp, Artificial Sequence
  Description of Artificial Sequence: Synthetic oligonucleotide
  Target: SCN10A; (+) strand; PAM type: YTN; PAM sequence: TTT
gcagtagattcagcttcatt

SEQ ID NO: 72020 - DNA, 20 bp, Artificial Sequence
  Description of Artificial Sequence: Synthetic oligonucleotide
  Target: SCN10A; (+) strand; PAM type: YTN; PAM sequence: TTG
cagtagattcagcttcattt

SEQ ID NO: 72021 - DNA, 20 bp, Artificial Sequence
  Description of Artificial Sequence: Synthetic oligonucleotide
  Target: SCN10A; (+) strand; PAM type: YTN; PAM sequence: TTC
agcttcatttcacatgttct

SEQ ID NO: 72022 - DNA, 20 bp, Artificial Sequence
  Description of Artificial Sequence: Synthetic oligonucleotide
  Target: SCN10A; (+) strand; PAM type: YTN; PAM sequence: CTT
catttcacatgttctttgcc

SEQ ID NO: 72023 - DNA, 20 bp, Artificial Sequence
  Description of Artificial Sequence: Synthetic oligonucleotide
  Target: SCN10A; (+) strand; PAM type: YTN; PAM sequence: TTC
atttcacatgttctttgcca

SEQ ID NO: 72024 - DNA, 20 bp, Artificial Sequence
  Description of Artificial Sequence: Synthetic oligonucleotide
  Target: SCN10A; (+) strand; PAM type: YTN; PAM sequence: TTT
cacatgttctttgccaggtg

SEQ ID NO: 72025 - DNA, 20 bp, Artificial Sequence
  Description of Artificial Sequence: Synthetic oligonucleotide
  Target: SCN10A; (+) strand; PAM type: YTN; PAM sequence: TTC
acatgttctttgccaggtga

SEQ ID NO: 72026 - DNA, 20 bp, Artificial Sequence
  Description of Artificial Sequence: Synthetic oligonucleotide
  Target: SCN10A; (+) strand; PAM type: YTN; PAM sequence: TTC
tttgccaggtgagaaaacat

SEQ ID NO: 72027 - DNA, 20 bp, Artificial Sequence
  Description of Artificial Sequence: Synthetic oligonucleotide
  Target: SCN10A; (+) strand; PAM type: YTN; PAM sequence: CTT
tgccaggtgagaaaacattt

SEQ ID NO: 72028 - DNA, 20 bp, Artificial Sequence
  Description of Artificial Sequence: Synthetic oligonucleotide
  Target: SCN10A; (+) strand; PAM type: YTN; PAM sequence: TTT
gccaggtgagaaaacattta

SEQ ID NO: 72029 - DNA, 20 bp, Artificial Sequence
  Description of Artificial Sequence: Synthetic oligonucleotide
  Target: SCN10A; (+) strand; PAM type: YTN; PAM sequence: TTG
ccaggtgagaaaacatttat

SEQ ID NO: 72030 - DNA, 20 bp, Artificial Sequence
  Description of Artificial Sequence: Synthetic oligonucleotide
  Target: SCN10A; (+) strand; PAM type: YTN; PAM sequence: TTT
atcttctctacaaccaaatt

SEQ ID NO: 72031 - DNA, 20 bp, Artificial Sequence
  Description of Artificial Sequence: Synthetic oligonucleotide
  Target: SCN10A; (+) strand; PAM type: YTN; PAM sequence: TTA
tcttctctacaaccaaattg

SEQ ID NO: 72032 - DNA, 20 bp, Artificial Sequence
  Description of Artificial Sequence: Synthetic oligonucleotide
  Target: SCN10A; (+) strand; PAM type: YTN; PAM sequence: CTT
ctctacaaccaaattgctat

SEQ ID NO: 72033 - DNA, 20 bp, Artificial Sequence
  Description of Artificial Sequence: Synthetic oligonucleotide
  Target: SCN10A; (+) strand; PAM type: YTN; PAM sequence: TTC
tctacaaccaaattgctata

SEQ ID NO: 72034 - DNA, 20 bp, Artificial Sequence
  Description of Artificial Sequence: Synthetic oligonucleotide
  Target: SCN10A; (+) strand; PAM type: YTN; PAM sequence: CTC
tacaaccaaattgctataat

SEQ ID NO: 72035 - DNA, 20 bp, Artificial Sequence
  Description of Artificial Sequence: Synthetic oligonucleotide
  Target: SCN10A; (+) strand; PAM type: YTN; PAM sequence: CTA
caaccaaattgctataattt

SEQ ID NO: 72036 - DNA, 20 bp, Artificial Sequence
  Description of Artificial Sequence: Synthetic oligonucleotide
  Target: SCN10A; (+) strand; PAM type: YTN; PAM sequence: TTG
ctataatttgtcaaaggttt

SEQ ID NO: 72037 - DNA, 20 bp, Artificial Sequence
  Description of Artificial Sequence: Synthetic oligonucleotide
  Target: SCN10A; (+) strand; PAM type: YTN; PAM sequence: CTA
taatttgtcaaaggttttcc

SEQ ID NO: 72038 - DNA, 20 bp, Artificial Sequence
  Description of Artificial Sequence: Synthetic oligonucleotide
  Target: SCN10A; (+) strand; PAM type: YTN; PAM sequence: TTT
gtcaaaggttttccagaata

SEQ ID NO: 72039 - DNA, 20 bp, Artificial Sequence
  Description of Artificial Sequence: Synthetic oligonucleotide
  Target: SCN10A; (+) strand; PAM type: YTN; PAM sequence: TTG
tcaaaggttttccagaatat

SEQ ID NO: 72040 - DNA, 20 bp, Artificial Sequence
  Description of Artificial Sequence: Synthetic oligonucleotide
  Target: SCN10A; (+) strand; PAM type: YTN; PAM sequence: TTT
tccagaatattgttatgctt

SEQ ID NO: 72041 - DNA, 20 bp, Artificial Sequence
  Description of Artificial Sequence: Synthetic oligonucleotide
  Target: SCN10A; (+) strand; PAM type: YTN; PAM sequence: TTT
ccagaatattgttatgctta

SEQ ID NO: 72042 - DNA, 20 bp, Artificial Sequence
  Description of Artificial Sequence: Synthetic oligonucleotide
  Target: SCN10A; (+) strand; PAM type: YTN; PAM sequence: TTC
cagaatattgttatgcttag

SEQ ID NO: 72043 - DNA, 20 bp, Artificial Sequence
  Description of Artificial Sequence: Synthetic oligonucleotide
  Target: SCN10A; (+) strand; PAM type: YTN; PAM sequence: TTG
ttatgcttagaggtgagtgt

SEQ ID NO: 72044 - DNA, 20 bp, Artificial Sequence
  Description of Artificial Sequence: Synthetic oligonucleotide
  Target: SCN10A; (+) strand; PAM type: YTN; PAM sequence: TTA
tgcttagaggtgagtgtcct

SEQ ID NO: 72045 - DNA, 20 bp, Artificial Sequence
  Description of Artificial Sequence: Synthetic oligonucleotide
  Target: SCN10A; (+) strand; PAM type: YTN; PAM sequence: CTT
agaggtgagtgtcctagggt

SEQ ID NO: 72046 - DNA, 20 bp, Artificial Sequence
  Description of Artificial Sequence: Synthetic oligonucleotide
  Target: SCN10A; (+) strand; PAM type: YTN; PAM sequence: TTA
gaggtgagtgtcctagggtc

SEQ ID NO: 72047 - DNA, 20 bp, Artificial Sequence
  Description of Artificial Sequence: Synthetic oligonucleotide
  Target: SCN10A; (+) strand; PAM type: YTN; PAM sequence: CTA
gggtcatcaaagagcccctt

SEQ ID NO: 72048 - DNA, 20 bp, Artificial Sequence
  Description of Artificial Sequence: Synthetic oligonucleotide
  Target: SCN10A; (+) strand; PAM type: YTN; PAM sequence: CTT
caatgattctctgaaaccag

SEQ ID NO: 72049 - DNA, 20 bp, Artificial Sequence
  Description of Artificial Sequence: Synthetic oligonucleotide
  Target: SCN10A; (+) strand; PAM type: YTN; PAM sequence: TTC
aatgattctctgaaaccagg

SEQ ID NO: 72050 - DNA, 20 bp, Artificial Sequence
  Description of Artificial Sequence: Synthetic oligonucleotide
  Target: SCN10A; (+) strand; PAM type: YTN; PAM sequence: TTC
tctgaaaccagggcatgggg

SEQ ID NO: 72051 - DNA, 20 bp, Artificial Sequence
  Description of Artificial Sequence: Synthetic oligonucleotide
  Target: SCN10A; (+) strand; PAM type: YTN; PAM sequence: CTC
tgaaaccagggcatggggag

SEQ ID NO: 72052 - DNA, 20 bp, Artificial Sequence
  Description of Artificial Sequence: Synthetic oligonucleotide
  Target: SCN10A; (+) strand; PAM type: YTN; PAM sequence: CTG
aaaccagggcatggggagag

SEQ ID NO: 72053 - DNA, 20 bp, Artificial Sequence
  Description of Artificial Sequence: Synthetic oligonucleotide
  Target: SCN10A; (+) strand; PAM type: YTN; PAM sequence: TTC
tagtcttgcccttcttaaca

SEQ ID NO: 72054 - DNA, 20 bp, Artificial Sequence
  Description of Artificial Sequence: Synthetic oligonucleotide
  Target: SCN10A; (+) strand; PAM type: YTN; PAM sequence: CTA
gtcttgcccttcttaacaat

SEQ ID NO: 72055 - DNA, 20 bp, Artificial Sequence
  Description of Artificial Sequence: Synthetic oligonucleotide
  Target: SCN10A; (+) strand; PAM type: YTN; PAM sequence: CTT
gcccttcttaacaatttttg

SEQ ID NO: 72056 - DNA, 20 bp, Artificial Sequence
  Description of Artificial Sequence: Synthetic oligonucleotide
  Target: SCN10A; (+) strand; PAM type: YTN; PAM sequence: TTG
cccttcttaacaatttttga

SEQ ID NO: 72057 - DNA, 20 bp, Artificial Sequence
  Description of Artificial Sequence: Synthetic oligonucleotide
  Target: SCN10A; (+) strand; PAM type: YTN; PAM sequence: CTT
cttaacaatttttgaccccc

SEQ ID NO: 72058 - DNA, 20 bp, Artificial Sequence
  Description of Artificial Sequence: Synthetic oligonucleotide
  Target: SCN10A; (+) strand; PAM type: YTN; PAM sequence: TTC
ttaacaatttttgaccccct

SEQ ID NO: 72059 - DNA, 20 bp, Artificial Sequence
  Description of Artificial Sequence: Synthetic oligonucleotide
  Target: SCN10A; (+) strand; PAM type: YTN; PAM sequence: CTT
aacaatttttgaccccctgc

SEQ ID NO: 72060 - DNA, 20 bp, Artificial Sequence
  Description of Artificial Sequence: Synthetic oligonucleotide
  Target: SCN10A; (+) strand; PAM type: YTN; PAM sequence: TTA
acaatttttgaccccctgct

SEQ ID NO: 72061 - DNA, 20 bp, Artificial Sequence
  Description of Artificial Sequence: Synthetic oligonucleotide
  Target: SCN10A; (+) strand; PAM type: YTN; PAM sequence: TTT
ttgaccccctgctctcttta

SEQ ID NO: 72062 - DNA, 20 bp, Artificial Sequence
  Description of Artificial Sequence: Synthetic oligonucleotide
  Target: SCN10A; (+) strand; PAM type: YTN; PAM sequence: TTT
tgaccccctgctctctttac

SEQ ID NO: 72063 - DNA, 20 bp, Artificial Sequence
  Description of Artificial Sequence: Synthetic oligonucleotide
  Target: SCN10A; (+) strand; PAM type: YTN; PAM sequence: TTT
gaccccctgctctctttacc

SEQ ID NO: 72064 - DNA, 20 bp, Artificial Sequence
  Description of Artificial Sequence: Synthetic oligonucleotide
  Target: SCN10A; (+) strand; PAM type: YTN; PAM sequence: TTG
accccctgctctctttacct

SEQ ID NO: 72065 - DNA, 20 bp, Artificial Sequence
  Description of Artificial Sequence: Synthetic oligonucleotide
  Target: SCN10A; (+) strand; PAM type: YTN; PAM sequence: CTG
ctctctttaccttctggtgc

SEQ ID NO: 72066 - DNA, 20 bp, Artificial Sequence
  Description of Artificial Sequence: Synthetic oligonucleotide
  Target: SCN10A; (+) strand; PAM type: YTN; PAM sequence: CTC
tctttaccttctggtgccca

SEQ ID NO: 72067 - DNA, 20 bp, Artificial Sequence
  Description of Artificial Sequence: Synthetic oligonucleotide
  Target: SCN10A; (+) strand; PAM type: YTN; PAM sequence: CTC
tttaccttctggtgcccaat

SEQ ID NO: 72068 - DNA, 20 bp, Artificial Sequence
  Description of Artificial Sequence: Synthetic oligonucleotide
  Target: SCN10A; (+) strand; PAM type: YTN; PAM sequence: CTT
taccttctggtgcccaatct

SEQ ID NO: 72069 - DNA, 20 bp, Artificial Sequence
  Description of Artificial Sequence: Synthetic oligonucleotide
  Target: SCN10A; (+) strand; PAM type: YTN; PAM sequence: TTT
accttctggtgcccaatctg

SEQ ID NO: 72070 - DNA, 20 bp, Artificial Sequence
  Description of Artificial Sequence: Synthetic oligonucleotide
  Target: SCN10A; (+) strand; PAM type: YTN; PAM sequence: TTA
ccttctggtgcccaatctga

SEQ ID NO: 72071 - DNA, 20 bp, Artificial Sequence
  Description of Artificial Sequence: Synthetic oligonucleotide
  Target: SCN10A; (+) strand; PAM type: YTN; PAM sequence: CTT
ctggtgcccaatctgaggaa

SEQ ID NO: 72072 - DNA, 20 bp, Artificial Sequence
  Description of Artificial Sequence: Synthetic oligonucleotide
  Target: SCN10A; (+) strand; PAM type: YTN; PAM sequence: TTC
tggtgcccaatctgaggaag

SEQ ID NO: 72073 - DNA, 20 bp, Artificial Sequence
  Description of Artificial Sequence: Synthetic oligonucleotide
  Target: SCN10A; (+) strand; PAM type: YTN; PAM sequence: CTG
gtgcccaatctgaggaagaa

SEQ ID NO: 72074 - DNA, 20 bp, Artificial Sequence
  Description of Artificial Sequence: Synthetic oligonucleotide
  Target: SCN10A; (+) strand; PAM type: YTN; PAM sequence: CTG
aggaagaacctctagtttct

SEQ ID NO: 72075 - DNA, 20 bp, Artificial Sequence
  Description of Artificial Sequence: Synthetic oligonucleotide
  Target: SCN10A; (+) strand; PAM type: YTN; PAM sequence: CTC
tagtttcttcccaagcaaaa

SEQ ID NO: 72076 - DNA, 20 bp, Artificial Sequence
  Description of Artificial Sequence: Synthetic oligonucleotide
  Target: SCN10A; (+) strand; PAM type: YTN; PAM sequence: CTA
gtttcttcccaagcaaaaga

SEQ ID NO: 72077 - DNA, 20 bp, Artificial Sequence
  Description of Artificial Sequence: Synthetic oligonucleotide
  Target: SCN10A; (+) strand; PAM type: YTN; PAM sequence: TTT
cttcccaagcaaaagagggg

SEQ ID NO: 72078 - DNA, 20 bp, Artificial Sequence
  Description of Artificial Sequence: Synthetic oligonucleotide
  Target: SCN10A; (+) strand; PAM type: YTN; PAM sequence: TTC
ttcccaagcaaaagagggga

SEQ ID NO: 72079 - DNA, 20 bp, Artificial Sequence
  Description of Artificial Sequence: Synthetic oligonucleotide
  Target: SCN10A; (+) strand; PAM type: YTN; PAM sequence: CTT
cccaagcaaaagaggggatt

SEQ ID NO: 72080 - DNA, 20 bp, Artificial Sequence
  Description of Artificial Sequence: Synthetic oligonucleotide
  Target: SCN10A; (+) strand; PAM type: YTN; PAM sequence: TTC
ccaagcaaaagaggggatta

SEQ ID NO: 72081 - DNA, 20 bp, Artificial Sequence
  Description of Artificial Sequence: Synthetic oligonucleotide
  Target: SCN10A; (+) strand; PAM type: YTN; PAM sequence: TTA
gaaaatggaatatctatctt

SEQ ID NO: 72082 - DNA, 20 bp, Artificial Sequence
  Description of Artificial Sequence: Synthetic oligonucleotide
  Target: SCN10A; (+) strand; PAM type: YTN; PAM sequence: CTA
tctttatctttccacaagca

SEQ ID NO: 72083 - DNA, 20 bp, Artificial Sequence
  Description of Artificial Sequence: Synthetic oligonucleotide
  Target: SCN10A; (+) strand; PAM type: YTN; PAM sequence: CTT
tatctttccacaagcagaca

SEQ ID NO: 72084 - DNA, 20 bp, Artificial Sequence
  Description of Artificial Sequence: Synthetic oligonucleotide
  Target: SCN10A; (+) strand; PAM type: YTN; PAM sequence: TTT
atctttccacaagcagacag

SEQ ID NO: 72085 - DNA, 20 bp, Artificial Sequence
  Description of Artificial Sequence: Synthetic oligonucleotide
  Target: SCN10A; (+) strand; PAM type: YTN; PAM sequence: TTA
tctttccacaagcagacaga

SEQ ID NO: 72086 - DNA, 20 bp, Artificial Sequence
  Description of Artificial Sequence: Synthetic oligonucleotide
  Target: SCN10A; (+) strand; PAM type: YTN; PAM sequence: CTT
tccacaagcagacagatagg

SEQ ID NO: 72087 - DNA, 20 bp, Artificial Sequence
  Description of Artificial Sequence: Synthetic oligonucleotide
  Target: SCN10A; (+) strand; PAM type: YTN; PAM sequence: TTT
ccacaagcagacagataggc

SEQ ID NO: 72088 - DNA, 20 bp, Artificial Sequence
  Description of Artificial Sequence: Synthetic oligonucleotide
  Target: SCN10A; (+) strand; PAM type: YTN; PAM sequence: TTC
cacaagcagacagataggca

SEQ ID NO: 72089 - DNA, 20 bp, Artificial Sequence
  Description of Artificial Sequence: Synthetic oligonucleotide
  Target: SCN10A; (+) strand; PAM type: YTN; PAM sequence: CTA
ccattatcagcaggtaattg

SEQ ID NO: 72090 - DNA, 20 bp, Artificial Sequence
  Description of Artificial Sequence: Synthetic oligonucleotide
  Target: SCN10A; (+) strand; PAM type: YTN; PAM sequence: TTA
tcagcaggtaattgtgcaaa

SEQ ID NO: 72091 - DNA, 20 bp, Artificial Sequence
  Description of Artificial Sequence: Synthetic oligonucleotide
  Target: SCN10A; (+) strand; PAM type: YTN; PAM sequence: TTG
tgcaaagctaatgtttcagc

SEQ ID NO: 72092 - DNA, 20 bp, Artificial Sequence
  Description of Artificial Sequence: Synthetic oligonucleotide
  Target: SCN10A; (+) strand; PAM type: YTN; PAM sequence: CTA
atgtttcagcaaggaataat

SEQ ID NO: 72093 - DNA, 20 bp, Artificial Sequence
  Description of Artificial Sequence: Synthetic oligonucleotide
  Target: SCN10A; (+) strand; PAM type: YTN; PAM sequence: TTT
cagcaaggaataatggaagg

SEQ ID NO: 72094 - DNA, 20 bp, Artificial Sequence
  Description of Artificial Sequence: Synthetic oligonucleotide
  Target: SCN10A; (+) strand; PAM type: YTN; PAM sequence: TTC
agcaaggaataatggaaggg

SEQ ID NO: 72095 - DNA, 20 bp, Artificial Sequence
  Description of Artificial Sequence: Synthetic oligonucleotide
  Target: SCN10A; (+) strand; PAM type: YTN; PAM sequence: TTG
tgttaagaacatggcaataa

SEQ ID NO: 72096 - DNA, 20 bp, Artificial Sequence
  Description of Artificial Sequence: Synthetic oligonucleotide
  Target: SCN10A; (+) strand; PAM type: YTN; PAM sequence: TTA
agaacatggcaataagattg

SEQ ID NO: 72097 - DNA, 20 bp, Artificial Sequence
  Description of Artificial Sequence: Synthetic oligonucleotide
  Target: SCN10A; (+) strand; PAM type: YTN; PAM sequence: TTG
gtttctgattcctcactggc

SEQ ID NO: 72098 - DNA, 20 bp, Artificial Sequence
  Description of Artificial Sequence: Synthetic oligonucleotide
  Target: SCN10A; (+) strand; PAM type: YTN; PAM sequence: TTT
ctgattcctcactggctaca

SEQ ID NO: 72099 - DNA, 20 bp, Artificial Sequence
  Description of Artificial Sequence: Synthetic oligonucleotide
  Target: SCN10A; (+) strand; PAM type: YTN; PAM sequence: TTC
tgattcctcactggctacaa

SEQ ID NO: 72100 - DNA, 20 bp, Artificial Sequence
  Description of Artificial Sequence: Synthetic oligonucleotide
  Target: SCN10A; (+) strand; PAM type: YTN; PAM sequence: CTG
attcctcactggctacaatt

SEQ ID NO: 72101 - DNA, 20 bp, Artificial Sequence
  Description of Artificial Sequence: Synthetic oligonucleotide
  Target: SCN10A; (+) strand; PAM type: YTN; PAM sequence: TTC
ctcactggctacaatttaat

SEQ ID NO: 72102 - DNA, 20 bp, Artificial Sequence
  Description of Artificial Sequence: Synthetic oligonucleotide
  Target: SCN10A; (+) strand; PAM type: YTN; PAM sequence: CTC
actggctacaatttaatgct

SEQ ID NO: 72103 - DNA, 20 bp, Artificial Sequence
  Description of Artificial Sequence: Synthetic oligonucleotide
  Target: SCN10A; (+) strand; PAM type: YTN; PAM sequence: CTG
gctacaatttaatgcttttt

SEQ ID NO: 72104 - DNA, 20 bp, Artificial Sequence
  Description of Artificial Sequence: Synthetic oligonucleotide
  Target: SCN10A; (+) strand; PAM type: YTN; PAM sequence: CTA
caatttaatgctttttcaaa

SEQ ID NO: 72105 - DNA, 20 bp, Artificial Sequence
  Description of Artificial Sequence: Synthetic oligonucleotide
  Target: SCN10A; (+) strand; PAM type: YTN; PAM sequence: TTT
aatgctttttcaaaagtata

SEQ ID NO: 72106 - DNA, 20 bp, Artificial Sequence
  Description of Artificial Sequence: Synthetic oligonucleotide
  Target: SCN10A; (+) strand; PAM type: YTN; PAM sequence: TTA
atgctttttcaaaagtatac

SEQ ID NO: 72107 - DNA, 20 bp, Artificial Sequence
  Description of Artificial Sequence: Synthetic oligonucleotide
  Target: SCN10A; (+) strand; PAM type: YTN; PAM sequence: CTT
tttcaaaagtatacagcatg

SEQ ID NO: 72108 - DNA, 20 bp, Artificial Sequence
  Description of Artificial Sequence: Synthetic oligonucleotide
  Target: SCN10A; (+) strand; PAM type: YTN; PAM sequence: TTT
ttcaaaagtatacagcatga

SEQ ID NO: 72109 - DNA, 20 bp, Artificial Sequence
  Description of Artificial Sequence: Synthetic oligonucleotide
  Target: SCN10A; (+) strand; PAM type: YTN; PAM sequence: TTT
tcaaaagtatacagcatgat

SEQ ID NO: 72110 - DNA, 20 bp, Artificial Sequence
  Description of Artificial Sequence: Synthetic oligonucleotide
  Target: SCN10A; (+) strand; PAM type: YTN; PAM sequence: TTT
caaaagtatacagcatgatc

SEQ ID NO: 72111 - DNA, 20 bp, Artificial Sequence
  Description of Artificial Sequence: Synthetic oligonucleotide
  Target: SCN10A; (+) strand; PAM type: YTN; PAM sequence: TTC
aaaagtatacagcatgatct

SEQ ID NO: 72112 - DNA, 20 bp, Artificial Sequence
  Description of Artificial Sequence: Synthetic oligonucleotide
  Target: SCN10A; (+) strand; PAM type: YTN; PAM sequence: CTT
tggagccccagtctatccca

SEQ ID NO: 72113 - DNA, 20 bp, Artificial Sequence
  Description of Artificial Sequence: Synthetic oligonucleotide
  Target: SCN10A; (+) strand; PAM type: YTN; PAM sequence: TTT
ggagccccagtctatcccaa

SEQ ID NO: 72114 - DNA, 20 bp, Artificial Sequence
  Description of Artificial Sequence: Synthetic oligonucleotide
  Target: SCN10A; (+) strand; PAM type: YTN; PAM sequence: TTG
gagccccagtctatcccaag

SEQ ID NO: 72115 - DNA, 20 bp, Artificial Sequence
  Description of Artificial Sequence: Synthetic oligonucleotide
  Target: SCN10A; (+) strand; PAM type: YTN; PAM sequence: CTA
tcccaaggacatttattatc

SEQ ID NO: 72116 - DNA, 20 bp, Artificial Sequence
  Description of Artificial Sequence: Synthetic oligonucleotide
  Target: SCN10A; (+) strand; PAM type: YTN; PAM sequence: TTT
attatcttcctctgggttct

SEQ ID NO: 72117 - DNA, 20 bp, Artificial Sequence
  Description of Artificial Sequence: Synthetic oligonucleotide
  Target: SCN10A; (+) strand; PAM type: YTN; PAM sequence: TTA
ttatcttcctctgggttctc

SEQ ID NO: 72118 - DNA, 20 bp, Artificial Sequence
  Description of Artificial Sequence: Synthetic oligonucleotide
  Target: SCN10A; (+) strand; PAM type: YTN; PAM sequence: TTA
tcttcctctgggttctcagc

SEQ ID NO: 72119 - DNA, 20 bp, Artificial Sequence
  Description of Artificial Sequence: Synthetic oligonucleotide
  Target: SCN10A; (+) strand; PAM type: YTN; PAM sequence: CTT
cctctgggttctcagcaaca

SEQ ID NO: 72120 - DNA, 20 bp, Artificial Sequence
  Description of Artificial Sequence: Synthetic oligonucleotide
  Target: SCN10A; (+) strand; PAM type: YTN; PAM sequence: TTC
ctctgggttctcagcaacat

SEQ ID NO: 72121 - DNA, 20 bp, Artificial Sequence
  Description of Artificial Sequence: Synthetic oligonucleotide
  Target: SCN10A; (+) strand; PAM type: YTN; PAM sequence: CTC
tgggttctcagcaacatagg

SEQ ID NO: 72122 - DNA, 20 bp, Artificial Sequence
  Description of Artificial Sequence: Synthetic oligonucleotide
  Target: SCN10A; (+) strand; PAM type: YTN; PAM sequence: CTG
ggttctcagcaacataggaa

SEQ ID NO: 72123 - DNA, 20 bp, Artificial Sequence
  Description of Artificial Sequence: Synthetic oligonucleotide
  Target: SCN10A; (+) strand; PAM type: YTN; PAM sequence: TTC
tcagcaacataggaaacaac

SEQ ID NO: 72124 - DNA, 20 bp, Artificial Sequence
  Description of Artificial Sequence: Synthetic oligonucleotide
  Target: SCN10A; (+) strand; PAM type: YTN; PAM sequence: CTC
agcaacataggaaacaacta

SEQ ID NO: 72125 - DNA, 20 bp, Artificial Sequence
  Description of Artificial Sequence: Synthetic oligonucleotide
  Target: SCN10A; (+) strand; PAM type: YTN; PAM sequence: CTA
atggctattatcaatttgca

SEQ ID NO: 72126 - DNA, 20 bp, Artificial Sequence
  Description of Artificial Sequence: Synthetic oligonucleotide
  Target: SCN10A; (+) strand; PAM type: YTN; PAM sequence: CTA
ttatcaatttgcatttcaaa

SEQ ID NO: 72127 - DNA, 20 bp, Artificial Sequence
  Description of Artificial Sequence: Synthetic oligonucleotide
  Target: SCN10A; (+) strand; PAM type: YTN; PAM sequence: TTA
tcaatttgcatttcaaaaag

SEQ ID NO: 72128 - DNA, 20 bp, Artificial Sequence
  Description of Artificial Sequence: Synthetic oligonucleotide
  Target: SCN10A; (+) strand; PAM type: YTN; PAM sequence: TTT
gcatttcaaaaagaaaatct

SEQ ID NO: 72129 - DNA, 20 bp, Artificial Sequence
  Description of Artificial Sequence: Synthetic oligonucleotide
  Target: SCN10A; (+) strand; PAM type: YTN; PAM sequence: TTG
catttcaaaaagaaaatcta

SEQ ID NO: 72130 - DNA, 20 bp, Artificial Sequence
  Description of Artificial Sequence: Synthetic oligonucleotide
  Target: SCN10A; (+) strand; PAM type: YTN; PAM sequence: TTT
caaaaagaaaatctagtctg

SEQ ID NO: 72131 - DNA, 20 bp, Artificial Sequence
  Description of Artificial Sequence: Synthetic oligonucleotide
  Target: SCN10A; (+) strand; PAM type: YTN; PAM sequence: TTC
aaaaagaaaatctagtctga

SEQ ID NO: 72132 - DNA, 20 bp, Artificial Sequence
  Description of Artificial Sequence: Synthetic oligonucleotide
  Target: SCN10A; (+) strand; PAM type: YTN; PAM sequence: CTA
gtctgattatttccacgagg

SEQ ID NO: 72133 - DNA, 20 bp, Artificial Sequence
  Description of Artificial Sequence: Synthetic oligonucleotide
  Target: SCN10A; (+) strand; PAM type: YTN; PAM sequence: CTG
attatttccacgaggccaag

SEQ ID NO: 72134 - DNA, 20 bp, Artificial Sequence
  Description of Artificial Sequence: Synthetic oligonucleotide
  Target: SCN10A; (+) strand; PAM type: YTN; PAM sequence: TTA
tttccacgaggccaaggatg

SEQ ID NO: 72135 - DNA, 20 bp, Artificial Sequence
  Description of Artificial Sequence: Synthetic oligonucleotide
  Target: SCN10A; (+) strand; PAM type: YTN; PAM sequence: TTT
ccacgaggccaaggatgctg

SEQ ID NO: 72136 - DNA, 20 bp, Artificial Sequence
  Description of Artificial Sequence: Synthetic oligonucleotide
  Target: SCN10A; (+) strand; PAM type: YTN; PAM sequence: TTC
cacgaggccaaggatgctga

SEQ ID NO: 72137 - DNA, 20 bp, Artificial Sequence
  Description of Artificial Sequence: Synthetic oligonucleotide
  Target: SCN10A; (+) strand; PAM type: YTN; PAM sequence: CTG
aacatcatccaatacctgtc

SEQ ID NO: 72138 - DNA, 20 bp, Artificial Sequence
  Description of Artificial Sequence: Synthetic oligonucleotide
  Target: SCN10A; (+) strand; PAM type: YTN; PAM sequence: CTG
tcacataaattcccaggatt

SEQ ID NO: 72139 - DNA, 20 bp, Artificial Sequence
  Description of Artificial Sequence: Synthetic oligonucleotide
  Target: SCN10A; (+) strand; PAM type: YTN; PAM sequence: TTC
ccaggattgtgaccatatag

SEQ ID NO: 72140 - DNA, 20 bp, Artificial Sequence
  Description of Artificial Sequence: Synthetic oligonucleotide
  Target: SCN10A; (+) strand; PAM type: YTN; PAM sequence: TTG
tgaccatataggtagatttg

SEQ ID NO: 72141 - DNA, 20 bp, Artificial Sequence
  Description of Artificial Sequence: Synthetic oligonucleotide
  Target: SCN10A; (+) strand; PAM type: YTN; PAM sequence: TTT
gtatatgttatacttttcat

SEQ ID NO: 72142 - DNA, 20 bp, Artificial Sequence
  Description of Artificial Sequence: Synthetic oligonucleotide
  Target: SCN10A; (+) strand; PAM type: YTN; PAM sequence: TTG
tatatgttatacttttcata

SEQ ID NO: 72143 - DNA, 20 bp, Artificial Sequence
  Description of Artificial Sequence: Synthetic oligonucleotide
  Target: SCN10A; (+) strand; PAM type: YTN; PAM sequence: TTA
tacttttcatagtgtgcata

SEQ ID NO: 72144 - DNA, 20 bp, Artificial Sequence
  Description of Artificial Sequence: Synthetic oligonucleotide
  Target: SCN10A; (+) strand; PAM type: YTN; PAM sequence: CTT
ttcatagtgtgcatataaag

SEQ ID NO: 72145 - DNA, 20 bp, Artificial Sequence
  Description of Artificial Sequence: Synthetic oligonucleotide
  Target: SCN10A; (+) strand; PAM type: YTN; PAM sequence: TTT
tcatagtgtgcatataaagg

SEQ ID NO: 72146 - DNA, 20 bp, Artificial Sequence
  Description of Artificial Sequence: Synthetic oligonucleotide
  Target: SCN10A; (+) strand; PAM type: YTN; PAM sequence: TTT
catagtgtgcatataaaggg

SEQ ID NO: 72147 - DNA, 20 bp, Artificial Sequence
  Description of Artificial Sequence: Synthetic oligonucleotide
  Target: SCN10A; (+) strand; PAM type: YTN; PAM sequence: TTC
atagtgtgcatataaaggga

SEQ ID NO: 72148 - DNA, 20 bp, Artificial Sequence
  Description of Artificial Sequence: Synthetic oligonucleotide
  Target: SCN10A; (+) strand; PAM type: YTN; PAM sequence: TTA
tgtcaacagttcagttaata

SEQ ID NO: 72149 - DNA, 20 bp, Artificial Sequence
  Description of Artificial Sequence: Synthetic oligonucleotide
  Target: SCN10A; (+) strand; PAM type: YTN; PAM sequence: TTC
agttaatacaaaatctccta

SEQ ID NO: 72150 - DNA, 20 bp, Artificial Sequence
  Description of Artificial Sequence: Synthetic oligonucleotide
  Target: SCN10A; (+) strand; PAM type: YTN; PAM sequence: TTA
atacaaaatctcctaaagaa

SEQ ID NO: 72151 - DNA, 20 bp, Artificial Sequence
  Description of Artificial Sequence: Synthetic oligonucleotide
  Target: SCN10A; (+) strand; PAM type: YTN; PAM sequence: CTC
ctaaagaatggatttgataa

SEQ ID NO: 72152 - DNA, 20 bp, Artificial Sequence
  Description of Artificial Sequence: Synthetic oligonucleotide
  Target: SCN10A; (+) strand; PAM type: YTN; PAM sequence: CTA
aagaatggatttgataatta

SEQ ID NO: 72153 - DNA, 20 bp, Artificial Sequence
  Description of Artificial Sequence: Synthetic oligonucleotide
  Target: SCN10A; (+) strand; PAM type: YTN; PAM sequence: TTT
gataattactgggaatggaa

SEQ ID NO: 72154 - DNA, 20 bp, Artificial Sequence
  Description of Artificial Sequence: Synthetic oligonucleotide
  Target: SCN10A; (+) strand; PAM type: YTN; PAM sequence: TTG
ataattactgggaatggaaa

SEQ ID NO: 72155 - DNA, 20 bp, Artificial Sequence
  Description of Artificial Sequence: Synthetic oligonucleotide
  Target: SCN10A; (+) strand; PAM type: YTN; PAM sequence: TTA
ctgggaatggaaaggatcca

SEQ ID NO: 72156 - DNA, 20 bp, Artificial Sequence
  Description of Artificial Sequence: Synthetic oligonucleotide
  Target: SCN10A; (+) strand; PAM type: YTN; PAM sequence: CTG
ggaatggaaaggatccaact

SEQ ID NO: 72157 - DNA, 20 bp, Artificial Sequence
  Description of Artificial Sequence: Synthetic oligonucleotide
  Target: SCN10A; (+) strand; PAM type: YTN; PAM sequence: CTT
tggaagacgatttggcaata

SEQ ID NO: 72158 - DNA, 20 bp, Artificial Sequence
  Description of Artificial Sequence: Synthetic oligonucleotide
  Target: SCN10A; (+) strand; PAM type: YTN; PAM sequence: TTT
ggaagacgatttggcaatat

SEQ ID NO: 72159 - DNA, 20 bp, Artificial Sequence
  Description of Artificial Sequence: Synthetic oligonucleotide
  Target: SCN10A; (+) strand; PAM type: YTN; PAM sequence: TTG
gaagacgatttggcaatatc

SEQ ID NO: 72160 - DNA, 20 bp, Artificial Sequence
  Description of Artificial Sequence: Synthetic oligonucleotide
  Target: SCN10A; (+) strand; PAM type: YTN; PAM sequence: TTT
ggcaatatctcaaaaattaa

SEQ ID NO: 72161 - DNA, 20 bp, Artificial Sequence
  Description of Artificial Sequence: Synthetic oligonucleotide
  Target: SCN10A; (+) strand; PAM type: YTN; PAM sequence: TTG
gcaatatctcaaaaattaaa

SEQ ID NO: 72162 - DNA, 20 bp, Artificial Sequence
  Description of Artificial Sequence: Synthetic oligonucleotide
  Target: SCN10A; (+) strand; PAM type: YTN; PAM sequence: CTC
aaaaattaaaatgtacaccc

SEQ ID NO: 72163 - DNA, 20 bp, Artificial Sequence
  Description of Artificial Sequence: Synthetic oligonucleotide
  Target: SCN10A; (+) strand; PAM type: YTN; PAM sequence: TTA
aaatgtacacccctttgacc

SEQ ID NO: 72164 - DNA, 20 bp, Artificial Sequence
  Description of Artificial Sequence: Synthetic oligonucleotide
  Target: SCN10A; (+) strand; PAM type: YTN; PAM sequence: CTT
tgacctggcaattctacttc

SEQ ID NO: 72165 - DNA, 20 bp, Artificial Sequence
  Description of Artificial Sequence: Synthetic oligonucleotide
  Target: SCN10A; (+) strand; PAM type: YTN; PAM sequence: TTT
gacctggcaattctacttct

SEQ ID NO: 72166 - DNA, 20 bp, Artificial Sequence
  Description of Artificial Sequence: Synthetic oligonucleotide
  Target: SCN10A; (+) strand; PAM type: YTN; PAM sequence: TTG
acctggcaattctacttcta

SEQ ID NO: 72167 - DNA, 20 bp, Artificial Sequence
  Description of Artificial Sequence: Synthetic oligonucleotide
  Target: SCN10A; (+) strand; PAM type: YTN; PAM sequence: CTG
gcaattctacttctagaaat

SEQ ID NO: 72168 - DNA, 20 bp, Artificial Sequence
  Description of Artificial Sequence: Synthetic oligonucleotide
  Target: SCN10A; (+) strand; PAM type: YTN; PAM sequence: TTC
tacttctagaaattcatcct

SEQ ID NO: 72169 - DNA, 20 bp, Artificial Sequence
  Description of Artificial Sequence: Synthetic oligonucleotide
  Target: SCN10A; (+) strand; PAM type: YTN; PAM sequence: CTA
cttctagaaattcatcctta

SEQ ID NO: 72170 - DNA, 20 bp, Artificial Sequence
  Description of Artificial Sequence: Synthetic oligonucleotide
  Target: SCN10A; (+) strand; PAM type: YTN; PAM sequence: CTT
ctagaaattcatccttaatt

SEQ ID NO: 72171 - DNA, 20 bp, Artificial Sequence
  Description of Artificial Sequence: Synthetic oligonucleotide
  Target: SCN10A; (+) strand; PAM type: YTN; PAM sequence: TTC
tagaaattcatccttaattt

SEQ ID NO: 72172 - DNA, 20 bp, Artificial Sequence
  Description of Artificial Sequence: Synthetic oligonucleotide
  Target: SCN10A; (+) strand; PAM type: YTN; PAM sequence: CTA
gaaattcatccttaatttta

SEQ ID NO: 72173 - DNA, 20 bp, Artificial Sequence
  Description of Artificial Sequence: Synthetic oligonucleotide
  Target: SCN10A; (+) strand; PAM type: YTN; PAM sequence: TTC
atccttaattttactcatat

SEQ ID NO: 72174 - DNA, 20 bp, Artificial Sequence
  Description of Artificial Sequence: Synthetic oligonucleotide
  Target: SCN10A; (+) strand; PAM type: YTN; PAM sequence: CTT
aattttactcatattatgtg

SEQ ID NO: 72175 - DNA, 20 bp, Artificial Sequence
  Description of Artificial Sequence: Synthetic oligonucleotide
  Target: SCN10A; (+) strand; PAM type: YTN; PAM sequence: TTA
attttactcatattatgtgt

SEQ ID NO: 72176 - DNA, 20 bp, Artificial Sequence
  Description of Artificial Sequence: Synthetic oligonucleotide
  Target: SCN10A; (+) strand; PAM type: YTN; PAM sequence: TTT
tactcatattatgtgtacaa

SEQ ID NO: 72177 - DNA, 20 bp, Artificial Sequence
  Description of Artificial Sequence: Synthetic oligonucleotide
  Target: SCN10A; (+) strand; PAM type: YTN; PAM sequence: TTT
actcatattatgtgtacaaa

SEQ ID NO: 72178 - DNA, 20 bp, Artificial Sequence
  Description of Artificial Sequence: Synthetic oligonucleotide
  Target: SCN10A; (+) strand; PAM type: YTN; PAM sequence: TTA
ctcatattatgtgtacaaag

SEQ ID NO: 72179 - DNA, 20 bp, Artificial Sequence
  Description of Artificial Sequence: Synthetic oligonucleotide
  Target: SCN10A; (+) strand; PAM type: YTN; PAM sequence: CTC
atattatgtgtacaaagata

SEQ ID NO: 72180 - DNA, 20 bp, Artificial Sequence
  Description of Artificial Sequence: Synthetic oligonucleotide
  Target: SCN10A; (+) strand; PAM type: YTN; PAM sequence: TTA
tgtgtacaaagatacatgtg

SEQ ID NO: 72181 - DNA, 20 bp, Artificial Sequence
  Description of Artificial Sequence: Synthetic oligonucleotide
  Target: SCN10A; (+) strand; PAM type: YTN; PAM sequence: CTC
accaaaaaattaatatgtgg

SEQ ID NO: 72182 - DNA, 20 bp, Artificial Sequence
  Description of Artificial Sequence: Synthetic oligonucleotide
  Target: SCN10A; (+) strand; PAM type: YTN; PAM sequence: TTA
atatgtggtggcaaaatatg

SEQ ID NO: 72183 - DNA, 20 bp, Artificial Sequence
  Description of Artificial Sequence: Synthetic oligonucleotide
  Target: SCN10A; (+) strand; PAM type: YTN; PAM sequence: TTA
tgttaattatgataaatgtg

SEQ ID NO: 72184 - DNA, 20 bp, Artificial Sequence
  Description of Artificial Sequence: Synthetic oligonucleotide
  Target: SCN10A; (+) strand; PAM type: YTN; PAM sequence: TTA
attatgataaatgtgaatgt

SEQ ID NO: 72185 - DNA, 20 bp, Artificial Sequence
  Description of Artificial Sequence: Synthetic oligonucleotide
  Target: SCN10A; (+) strand; PAM type: YTN; PAM sequence: TTA
tgataaatgtgaatgtctat

SEQ ID NO: 72186 - DNA, 20 bp, Artificial Sequence
  Description of Artificial Sequence: Synthetic oligonucleotide
  Target: SCN10A; (+) strand; PAM type: YTN; PAM sequence: CTA
tcaataggaaaatagttaaa

SEQ ID NO: 72187 - DNA, 20 bp, Artificial Sequence
  Description of Artificial Sequence: Synthetic oligonucleotide
  Target: SCN10A; (+) strand; PAM type: YTN; PAM sequence: TTA
aataaacttcacttcatcca

SEQ ID NO: 72188 - DNA, 20 bp, Artificial Sequence
  Description of Artificial Sequence: Synthetic oligonucleotide
  Target: SCN10A; (+) strand; PAM type: YTN; PAM sequence: CTT
cacttcatccatgcaaatga

SEQ ID NO: 72189 - DNA, 20 bp, Artificial Sequence
  Description of Artificial Sequence: Synthetic oligonucleotide
  Target: SCN10A; (+) strand; PAM type: YTN; PAM sequence: TTC
acttcatccatgcaaatgaa

SEQ ID NO: 72190 - DNA, 20 bp, Artificial Sequence
  Description of Artificial Sequence: Synthetic oligonucleotide
  Target: SCN10A; (+) strand; PAM type: YTN; PAM sequence: CTT
catccatgcaaatgaaatct

SEQ ID NO: 72191 - DNA, 20 bp, Artificial Sequence
  Description of Artificial Sequence: Synthetic oligonucleotide
  Target: SCN10A; (+) strand; PAM type: YTN; PAM sequence: TTC
atccatgcaaatgaaatctg

SEQ ID NO: 72192 - DNA, 20 bp, Artificial Sequence
  Description of Artificial Sequence: Synthetic oligonucleotide
  Target: SCN10A; (+) strand; PAM type: YTN; PAM sequence: CTG
ttcagctaatttctataaaa

SEQ ID NO: 72193 - DNA, 20 bp, Artificial Sequence
  Description of Artificial Sequence: Synthetic oligonucleotide
  Target: SCN10A; (+) strand; PAM type: YTN; PAM sequence: TTC
agctaatttctataaaacag

SEQ ID NO: 72194 - DNA, 20 bp, Artificial Sequence
  Description of Artificial Sequence: Synthetic oligonucleotide
  Target: SCN10A; (+) strand; PAM type: YTN; PAM sequence: CTA
atttctataaaacagctgct

SEQ ID NO: 72195 - DNA, 20 bp, Artificial Sequence
  Description of Artificial Sequence: Synthetic oligonucleotide
  Target: SCN10A; (+) strand; PAM type: YTN; PAM sequence: TTT
ctataaaacagctgctgctg

SEQ ID NO: 72196 - DNA, 20 bp, Artificial Sequence
  Description of Artificial Sequence: Synthetic oligonucleotide
  Target: SCN10A; (+) strand; PAM type: YTN; PAM sequence: TTC
tataaaacagctgctgctgg

SEQ ID NO: 72197 - DNA, 20 bp, Artificial Sequence
  Description of Artificial Sequence: Synthetic oligonucleotide
  Target: SCN10A; (+) strand; PAM type: YTN; PAM sequence: CTA
taaaacagctgctgctggga

SEQ ID NO: 72198 - DNA, 20 bp, Artificial Sequence
  Description of Artificial Sequence: Synthetic oligonucleotide
  Target: SCN10A; (+) strand; PAM type: YTN; PAM sequence: CTG
ctgctgggatttttttgggg

SEQ ID NO: 72199 - DNA, 20 bp, Artificial Sequence
  Description of Artificial Sequence: Synthetic oligonucleotide
  Target: SCN10A; (+) strand; PAM type: YTN; PAM sequence: CTG
ctgggatttttttggggatg

SEQ ID NO: 72200 - DNA, 20 bp, Artificial Sequence
  Description of Artificial Sequence: Synthetic oligonucleotide
  Target: SCN10A; (+) strand; PAM type: YTN; PAM sequence: CTG
ggatttttttggggatgtca

SEQ ID NO: 72201 - DNA, 20 bp, Artificial Sequence
  Description of Artificial Sequence: Synthetic oligonucleotide
  Target: SCN10A; (+) strand; PAM type: YTN; PAM sequence: TTT
ttttggggatgtcattgaat

SEQ ID NO: 72202 - DNA, 20 bp, Artificial Sequence
  Description of Artificial Sequence: Synthetic oligonucleotide
  Target: SCN10A; (+) strand; PAM type: YTN; PAM sequence: TTT
tttggggatgtcattgaatt

SEQ ID NO: 72203 - DNA, 20 bp, Artificial Sequence
  Description of Artificial Sequence: Synthetic oligonucleotide
  Target: SCN10A; (+) strand; PAM type: YTN; PAM sequence: TTT
ttggggatgtcattgaattt

SEQ ID NO: 72204 - DNA, 20 bp, Artificial Sequence
  Description of Artificial Sequence: Synthetic oligonucleotide
  Target: SCN10A; (+) strand; PAM type: YTN; PAM sequence: TTT
tggggatgtcattgaattta

SEQ ID NO: 72205 - DNA, 20 bp, Artificial Sequence
  Description of Artificial Sequence: Synthetic oligonucleotide
  Target: SCN10A; (+) strand; PAM type: YTN; PAM sequence: TTT
ggggatgtcattgaatttat

SEQ ID NO: 72206 - DNA, 20 bp, Artificial Sequence
  Description of Artificial Sequence: Synthetic oligonucleotide
  Target: SCN10A; (+) strand; PAM type: YTN; PAM sequence: TTG
gggatgtcattgaatttata

SEQ ID NO: 72207 - DNA, 20 bp, Artificial Sequence
  Description of Artificial Sequence: Synthetic oligonucleotide
  Target: SCN10A; (+) strand; PAM type: YTN; PAM sequence: TTG
aatttatagactaatttggg

SEQ ID NO: 72208 - DNA, 20 bp, Artificial Sequence
  Description of Artificial Sequence: Synthetic oligonucleotide
  Target: SCN10A; (+) strand; PAM type: YTN; PAM sequence: TTT
atagactaatttgggcagca

SEQ ID NO: 72209 - DNA, 20 bp, Artificial Sequence
  Description of Artificial Sequence: Synthetic oligonucleotide
  Target: SCN10A; (+) strand; PAM type: YTN; PAM sequence: TTA
tagactaatttgggcagcac

SEQ ID NO: 72210 - DNA, 20 bp, Artificial Sequence
  Description of Artificial Sequence: Synthetic oligonucleotide
  Target: SCN10A; (+) strand; PAM type: YTN; PAM sequence: CTA
atttgggcagcactgacatt

SEQ ID NO: 72211 - DNA, 20 bp, Artificial Sequence
  Description of Artificial Sequence: Synthetic oligonucleotide
  Target: SCN10A; (+) strand; PAM type: YTN; PAM sequence: TTT
gggcagcactgacattctaa

SEQ ID NO: 72212 - DNA, 20 bp, Artificial Sequence
  Description of Artificial Sequence: Synthetic oligonucleotide
  Target: SCN10A; (+) strand; PAM type: YTN; PAM sequence: TTG
ggcagcactgacattctaac

SEQ ID NO: 72213 - DNA, 20 bp, Artificial Sequence
  Description of Artificial Sequence: Synthetic oligonucleotide
  Target: SCN10A; (+) strand; PAM type: YTN; PAM sequence: CTG
acattctaacaattatgaat

SEQ ID NO: 72214 - DNA, 20 bp, Artificial Sequence
  Description of Artificial Sequence: Synthetic oligonucleotide
  Target: SCN10A; (+) strand; PAM type: YTN; PAM sequence: TTC
taacaattatgaatcttcta

SEQ ID NO: 72215 - DNA, 20 bp, Artificial Sequence
  Description of Artificial Sequence: Synthetic oligonucleotide
  Target: SCN10A; (+) strand; PAM type: YTN; PAM sequence: CTA
acaattatgaatcttctaat

SEQ ID NO: 72216 - DNA, 20 bp, Artificial Sequence
  Description of Artificial Sequence: Synthetic oligonucleotide
  Target: SCN10A; (+) strand; PAM type: YTN; PAM sequence: TTA
tgaatcttctaatccagtca

SEQ ID NO: 72217 - DNA, 20 bp, Artificial Sequence
  Description of Artificial Sequence: Synthetic oligonucleotide
  Target: SCN10A; (+) strand; PAM type: YTN; PAM sequence: CTT
ctaatccagtcacatgagac

SEQ ID NO: 72218 - DNA, 20 bp, Artificial Sequence
  Description of Artificial Sequence: Synthetic oligonucleotide
  Target: SCN10A; (+) strand; PAM type: YTN; PAM sequence: TTC
taatccagtcacatgagaca

SEQ ID NO: 72219 - DNA, 20 bp, Artificial Sequence
  Description of Artificial Sequence: Synthetic oligonucleotide
  Target: SCN10A; (+) strand; PAM type: YTN; PAM sequence: CTA
atccagtcacatgagacatc

SEQ ID NO: 72220 - DNA, 20 bp, Artificial Sequence
  Description of Artificial Sequence: Synthetic oligonucleotide
  Target: SCN10A; (+) strand; PAM type: YTN; PAM sequence: CTT
taattcatttaggtacttta

SEQ ID NO: 72221 - DNA, 20 bp, Artificial Sequence
  Description of Artificial Sequence: Synthetic oligonucleotide
  Target: SCN10A; (+) strand; PAM type: YTN; PAM sequence: TTT
aattcatttaggtactttaa

SEQ ID NO: 72222 - DNA, 20 bp, Artificial Sequence
  Description of Artificial Sequence: Synthetic oligonucleotide
  Target: SCN10A; (+) strand; PAM type: YTN; PAM sequence: TTA
attcatttaggtactttaaa

SEQ ID NO: 72223 - DNA, 20 bp, Artificial Sequence
  Description of Artificial Sequence: Synthetic oligonucleotide
  Target: SCN10A; (+) strand; PAM type: YTN; PAM sequence: TTC
atttaggtactttaaaattt

SEQ ID NO: 72224 - DNA, 20 bp, Artificial Sequence
  Description of Artificial Sequence: Synthetic oligonucleotide
  Target: SCN10A; (+) strand; PAM type: YTN; PAM sequence: TTT
aggtactttaaaatttctct

SEQ ID NO: 72225 - DNA, 20 bp, Artificial Sequence
  Description of Artificial Sequence: Synthetic oligonucleotide
  Target: SCN10A; (+) strand; PAM type: YTN; PAM sequence: TTA
ggtactttaaaatttctctc

SEQ ID NO: 72226 - DNA, 20 bp, Artificial Sequence
  Description of Artificial Sequence: Synthetic oligonucleotide
  Target: SCN10A; (+) strand; PAM type: YTN; PAM sequence: CTT
taaaatttctctcaataatg

SEQ ID NO: 72227 - DNA, 20 bp, Artificial Sequence
  Description of Artificial Sequence: Synthetic oligonucleotide
  Target: SCN10A; (+) strand; PAM type: YTN; PAM sequence: TTT
aaaatttctctcaataatgc

SEQ ID NO: 72228 - DNA, 20 bp, Artificial Sequence
  Description of Artificial Sequence: Synthetic oligonucleotide
  Target: SCN10A; (+) strand; PAM type: YTN; PAM sequence: TTA
aaatttctctcaataatgct

SEQ ID NO: 72229 - DNA, 20 bp, Artificial Sequence
  Description of Artificial Sequence: Synthetic oligonucleotide
  Target: SCN10A; (+) strand; PAM type: YTN; PAM sequence: TTT
ctctcaataatgctgtatta

SEQ ID NO: 72230 - DNA, 20 bp, Artificial Sequence
  Description of Artificial Sequence: Synthetic oligonucleotide
  Target: SCN10A; (+) strand; PAM type: YTN; PAM sequence: TTC
tctcaataatgctgtattat

SEQ ID NO: 72231 - DNA, 20 bp, Artificial Sequence
  Description of Artificial Sequence: Synthetic oligonucleotide
  Target: SCN10A; (+) strand; PAM type: YTN; PAM sequence: CTC
tcaataatgctgtattattt

SEQ ID NO: 72232 - DNA, 20 bp, Artificial Sequence
  Description of Artificial Sequence: Synthetic oligonucleotide
  Target: SCN10A; (+) strand; PAM type: YTN; PAM sequence: CTC
aataatgctgtattattttt

SEQ ID NO: 72233 - DNA, 20 bp, Artificial Sequence
  Description of Artificial Sequence: Synthetic oligonucleotide
  Target: SCN10A; (+) strand; PAM type: YTN; PAM sequence: CTG
tattattttttagtataaag

SEQ ID NO: 72234 - DNA, 20 bp, Artificial Sequence
  Description of Artificial Sequence: Synthetic oligonucleotide
  Target: SCN10A; (+) strand; PAM type: YTN; PAM sequence: TTA
ttttttagtataaaggtctt

SEQ ID NO: 72235 - DNA, 20 bp, Artificial Sequence
  Description of Artificial Sequence: Synthetic oligonucleotide
  Target: SCN10A; (+) strand; PAM type: YTN; PAM sequence: TTT
tttagtataaaggtcttgtg

SEQ ID NO: 72236 - DNA, 20 bp, Artificial Sequence
  Description of Artificial Sequence: Synthetic oligonucleotide
  Target: SCN10A; (+) strand; PAM type: YTN; PAM sequence: TTT
ttagtataaaggtcttgtgc

SEQ ID NO: 72237 - DNA, 20 bp, Artificial Sequence
  Description of Artificial Sequence: Synthetic oligonucleotide
  Target: SCN10A; (+) strand; PAM type: YTN; PAM sequence: TTT
tagtataaaggtcttgtgca

SEQ ID NO: 72238 - DNA, 20 bp, Artificial Sequence
  Description of Artificial Sequence: Synthetic oligonucleotide
  Target: SCN10A; (+) strand; PAM type: YTN; PAM sequence: TTT
agtataaaggtcttgtgcat

SEQ ID NO: 72239 - DNA, 20 bp, Artificial Sequence
  Description of Artificial Sequence: Synthetic oligonucleotide
  Target: SCN10A; (+) strand; PAM type: YTN; PAM sequence: TTA
gtataaaggtcttgtgcata

SEQ ID NO: 72240 - DNA, 20 bp, Artificial Sequence
  Description of Artificial Sequence: Synthetic oligonucleotide
  Target: SCN10A; (+) strand; PAM type: YTN; PAM sequence: CTT
gtgcatatttttacaacagc

SEQ ID NO: 72241 - DNA, 20 bp, Artificial Sequence
  Description of Artificial Sequence: Synthetic oligonucleotide
  Target: SCN10A; (+) strand; PAM type: YTN; PAM sequence: TTG
tgcatatttttacaacagca

SEQ ID NO: 72242 - DNA, 20 bp, Artificial Sequence
  Description of Artificial Sequence: Synthetic oligonucleotide
  Target: SCN10A; (+) strand; PAM type: YTN; PAM sequence: TTT
ttacaacagcatttggattt

SEQ ID NO: 72243 - DNA, 20 bp, Artificial Sequence
  Description of Artificial Sequence: Synthetic oligonucleotide
  Target: SCN10A; (+) strand; PAM type: YTN; PAM sequence: TTT
tacaacagcatttggattta

SEQ ID NO: 72244 - DNA, 20 bp, Artificial Sequence
  Description of Artificial Sequence: Synthetic oligonucleotide
  Target: SCN10A; (+) strand; PAM type: YTN; PAM sequence: TTT
acaacagcatttggatttat

SEQ ID NO: 72245 - DNA, 20 bp, Artificial Sequence
  Description of Artificial Sequence: Synthetic oligonucleotide
  Target: SCN10A; (+) strand; PAM type: YTN; PAM sequence: TTA
caacagcatttggatttatt

SEQ ID NO: 72246 - DNA, 20 bp, Artificial Sequence
  Description of Artificial Sequence: Synthetic oligonucleotide
  Target: SCN10A; (+) strand; PAM type: YTN; PAM sequence: TTT
ggatttattagatctactgt

SEQ ID NO: 72247 - DNA, 20 bp, Artificial Sequence
  Description of Artificial Sequence: Synthetic oligonucleotide
  Target: SCN10A; (+) strand; PAM type: YTN; PAM sequence: TTG
gatttattagatctactgtt

SEQ ID NO: 72248 - DNA, 20 bp, Artificial Sequence
  Description of Artificial Sequence: Synthetic oligonucleotide
  Target: SCN10A; (+) strand; PAM type: YTN; PAM sequence: TTT
attagatctactgtttttct

SEQ ID NO: 72249 - DNA, 20 bp, Artificial Sequence
  Description of Artificial Sequence: Synthetic oligonucleotide
  Target: SCN10A; (+) strand; PAM type: YTN; PAM sequence: TTA
ttagatctactgtttttcta

SEQ ID NO: 72250 - DNA, 20 bp, Artificial Sequence
  Description of Artificial Sequence: Synthetic oligonucleotide
  Target: SCN10A; (+) strand; PAM type: YTN; PAM sequence: TTA
gatctactgtttttctattt

SEQ ID NO: 72251 - DNA, 20 bp, Artificial Sequence
  Description of Artificial Sequence: Synthetic oligonucleotide
  Target: SCN10A; (+) strand; PAM type: YTN; PAM sequence: CTA
ctgtttttctattttgtaat

SEQ ID NO: 72252 - DNA, 20 bp, Artificial Sequence
  Description of Artificial Sequence: Synthetic oligonucleotide
  Target: SCN10A; (+) strand; PAM type: YTN; PAM sequence: CTG
tttttctattttgtaattta

SEQ ID NO: 72253 - DNA, 20 bp, Artificial Sequence
  Description of Artificial Sequence: Synthetic oligonucleotide
  Target: SCN10A; (+) strand; PAM type: YTN; PAM sequence: TTT
ttctattttgtaatttattg

SEQ ID NO: 72254 - DNA, 20 bp, Artificial Sequence
  Description of Artificial Sequence: Synthetic oligonucleotide
  Target: SCN10A; (+) strand; PAM type: YTN; PAM sequence: TTT
tctattttgtaatttattgc

SEQ ID NO: 72255 - DNA, 20 bp, Artificial Sequence
  Description of Artificial Sequence: Synthetic oligonucleotide
  Target: SCN10A; (+) strand; PAM type: YTN; PAM sequence: TTT
ctattttgtaatttattgct

SEQ ID NO: 72256 - DNA, 20 bp, Artificial Sequence
  Description of Artificial Sequence: Synthetic oligonucleotide
  Target: SCN10A; (+) strand; PAM type: YTN; PAM sequence: TTC
tattttgtaatttattgctt

SEQ ID NO: 72257 - DNA, 20 bp, Artificial Sequence
  Description of Artificial Sequence: Synthetic oligonucleotide
  Target: SCN10A; (+) strand; PAM type: YTN; PAM sequence: CTA
ttttgtaatttattgctttt

SEQ ID NO: 72258 - DNA, 20 bp, Artificial Sequence
  Description of Artificial Sequence: Synthetic oligonucleotide
  Target: SCN10A; (+) strand; PAM type: YTN; PAM sequence: TTT
tgtaatttattgctttttat

SEQ ID NO: 72259 - DNA, 20 bp, Artificial Sequence
  Description of Artificial Sequence: Synthetic oligonucleotide
  Target: SCN10A; (+) strand; PAM type: YTN; PAM sequence: TTT
gtaatttattgctttttata

SEQ ID NO: 72260 - DNA, 20 bp, Artificial Sequence
  Description of Artificial Sequence: Synthetic oligonucleotide
  Target: SCN10A; (+) strand; PAM type: YTN; PAM sequence: TTG
taatttattgctttttataa

SEQ ID NO: 72261 - DNA, 20 bp, Artificial Sequence
  Description of Artificial Sequence: Synthetic oligonucleotide
  Target: SCN10A; (+) strand; PAM type: YTN; PAM sequence: TTT
attgctttttataattatta

SEQ ID NO: 72262 - DNA, 20 bp, Artificial Sequence
  Description of Artificial Sequence: Synthetic oligonucleotide
  Target: SCN10A; (+) strand; PAM type: YTN; PAM sequence: TTA
ttgctttttataattattaa

SEQ ID NO: 72263 - DNA, 20 bp, Artificial Sequence
  Description of Artificial Sequence: Synthetic oligonucleotide
  Target: SCN10A; (+) strand; PAM type: YTN; PAM sequence: TTG
ctttttataattattaactt

SEQ ID NO: 72264 - DNA, 20 bp, Artificial Sequence
  Description of Artificial Sequence: Synthetic oligonucleotide
  Target: SCN10A; (+) strand; PAM type: YTN; PAM sequence: CTT
tttataattattaacttctt

SEQ ID NO: 72265 - DNA, 20 bp, Artificial Sequence
  Description of Artificial Sequence: Synthetic oligonucleotide
  Target: SCN10A; (+) strand; PAM type: YTN; PAM sequence: TTT
ttataattattaacttcttt

SEQ ID NO: 72266 - DNA, 20 bp, Artificial Sequence
  Description of Artificial Sequence: Synthetic oligonucleotide
  Target: SCN10A; (+) strand; PAM type: YTN; PAM sequence: TTT
tataattattaacttctttc

SEQ ID NO: 72267 - DNA, 20 bp, Artificial Sequence
  Description of Artificial Sequence: Synthetic oligonucleotide
  Target: SCN10A; (+) strand; PAM type: YTN; PAM sequence: TTT
ataattattaacttctttct

SEQ ID NO: 72268 - DNA, 20 bp, Artificial Sequence
  Description of Artificial Sequence: Synthetic oligonucleotide
  Target: SCN10A; (+) strand; PAM type: YTN; PAM sequence: TTA
taattattaacttctttctt

SEQ ID NO: 72269 - DNA, 20 bp, Artificial Sequence
  Description of Artificial Sequence: Synthetic oligonucleotide
  Target: SCN10A; (+) strand; PAM type: YTN; PAM sequence: TTA
ttaacttctttctttcattt

SEQ ID NO: 72270 - DNA, 20 bp, Artificial Sequence
  Description of Artificial Sequence: Synthetic oligonucleotide
  Target: SCN10A; (+) strand; PAM type: YTN; PAM sequence: TTA
acttctttctttcatttgtt

SEQ ID NO: 72271 - DNA, 20 bp, Artificial Sequence
  Description of Artificial Sequence: Synthetic oligonucleotide
  Target: SCN10A; (+) strand; PAM type: YTN; PAM sequence: CTT
ctttctttcatttgttatcc

SEQ ID NO: 72272 - DNA, 20 bp, Artificial Sequence
  Description of Artificial Sequence: Synthetic oligonucleotide
  Target: SCN10A; (+) strand; PAM type: YTN; PAM sequence: TTC
tttctttcatttgttatcct

SEQ ID NO: 72273 - DNA, 20 bp, Artificial Sequence
  Description of Artificial Sequence: Synthetic oligonucleotide
  Target: SCN10A; (+) strand; PAM type: YTN; PAM sequence: CTT
tctttcatttgttatccttt

SEQ ID NO: 72274 - DNA, 20 bp, Artificial Sequence
  Description of Artificial Sequence: Synthetic oligonucleotide
  Target: SCN10A; (+) strand; PAM type: YTN; PAM sequence: TTT
ctttcatttgttatcctttt

SEQ ID NO: 72275 - DNA, 20 bp, Artificial Sequence
  Description of Artificial Sequence: Synthetic oligonucleotide
  Target: SCN10A; (+) strand; PAM type: YTN; PAM sequence: TTC
tttcatttgttatccttttt

SEQ ID NO: 72276 - DNA, 20 bp, Artificial Sequence
  Description of Artificial Sequence: Synthetic oligonucleotide
  Target: SCN10A; (+) strand; PAM type: YTN; PAM sequence: CTT
tcatttgttatcctttttct

SEQ ID NO: 72277 - DNA, 20 bp, Artificial Sequence
  Description of Artificial Sequence: Synthetic oligonucleotide
  Target: SCN10A; (+) strand; PAM type: YTN; PAM sequence: TTT
catttgttatcctttttcta

SEQ ID NO: 72278 - DNA, 20 bp, Artificial Sequence
  Description of Artificial Sequence: Synthetic oligonucleotide
  Target: SCN10A; (+) strand; PAM type: YTN; PAM sequence: TTC
atttgttatcctttttctag

SEQ ID NO: 72279 - DNA, 20 bp, Artificial Sequence
  Description of Artificial Sequence: Synthetic oligonucleotide
  Target: SCN10A; (+) strand; PAM type: YTN; PAM sequence: TTT
gttatcctttttctagtttt

SEQ ID NO: 72280 - DNA, 20 bp, Artificial Sequence
  Description of Artificial Sequence: Synthetic oligonucleotide
  Target: SCN10A; (+) strand; PAM type: YTN; PAM sequence: TTG
ttatcctttttctagttttg

SEQ ID NO: 72281 - DNA, 20 bp, Artificial Sequence
  Description of Artificial Sequence: Synthetic oligonucleotide
  Target: SCN10A; (+) strand; PAM type: YTN; PAM sequence: TTA
tcctttttctagttttgtta

SEQ ID NO: 72282 - DNA, 20 bp, Artificial Sequence
  Description of Artificial Sequence: Synthetic oligonucleotide
  Target: SCN10A; (+) strand; PAM type: YTN; PAM sequence: CTT
tttctagttttgttaggtct

SEQ ID NO: 72283 - DNA, 20 bp, Artificial Sequence
  Description of Artificial Sequence: Synthetic oligonucleotide
  Target: SCN10A; (+) strand; PAM type: YTN; PAM sequence: TTT
ttctagttttgttaggtctt

SEQ ID NO: 72284 - DNA, 20 bp, Artificial Sequence
  Description of Artificial Sequence: Synthetic oligonucleotide
  Target: SCN10A; (+) strand; PAM type: YTN; PAM sequence: TTT
tctagttttgttaggtcttt

SEQ ID NO: 72285 - DNA, 20 bp, Artificial Sequence
  Description of Artificial Sequence: Synthetic oligonucleotide
  Target: SCN10A; (+) strand; PAM type: YTN; PAM sequence: TTT
ctagttttgttaggtcttta

SEQ ID NO: 72286 - DNA, 20 bp, Artificial Sequence
  Description of Artificial Sequence: Synthetic oligonucleotide
  Target: SCN10A; (+) strand; PAM type: YTN; PAM sequence: TTC
tagttttgttaggtctttaa

SEQ ID NO: 72287 - DNA, 20 bp, Artificial Sequence
  Description of Artificial Sequence: Synthetic oligonucleotide
  Target: SCN10A; (+) strand; PAM type: YTN; PAM sequence: CTA
gttttgttaggtctttaaat

SEQ ID NO: 72288 - DNA, 20 bp, Artificial Sequence
  Description of Artificial Sequence: Synthetic oligonucleotide
  Target: SCN10A; (+) strand; PAM type: YTN; PAM sequence: TTT
tgttaggtctttaaataatt

SEQ ID NO: 72289 - DNA, 20 bp, Artificial Sequence
  Description of Artificial Sequence: Synthetic oligonucleotide
  Target: SCN10A; (+) strand; PAM type: YTN; PAM sequence: TTT
gttaggtctttaaataattt

SEQ ID NO: 72290 - DNA, 20 bp, Artificial Sequence
  Description of Artificial Sequence: Synthetic oligonucleotide
  Target: SCN10A; (+) strand; PAM type: YTN; PAM sequence: TTG
ttaggtctttaaataatttc

SEQ ID NO: 72291 - DNA, 20 bp, Artificial Sequence
  Description of Artificial Sequence: Synthetic oligonucleotide
  Target: SCN10A; (+) strand; PAM type: YTN; PAM sequence: TTA
ggtctttaaataatttcttt

SEQ ID NO: 72292 - DNA, 20 bp, Artificial Sequence
  Description of Artificial Sequence: Synthetic oligonucleotide
  Target: SCN10A; (+) strand; PAM type: YTN; PAM sequence: CTT
taaataatttcttttcagct

SEQ ID NO: 72293 - DNA, 20 bp, Artificial Sequence
  Description of Artificial Sequence: Synthetic oligonucleotide
  Target: SCN10A; (+) strand; PAM type: YTN; PAM sequence: TTT
aaataatttcttttcagctt

SEQ ID NO: 72294 - DNA, 20 bp, Artificial Sequence
  Description of Artificial Sequence: Synthetic oligonucleotide
  Target: SCN10A; (+) strand; PAM type: YTN; PAM sequence: TTA
aataatttcttttcagcttt

SEQ ID NO: 72295 - DNA, 20 bp, Artificial Sequence
  Description of Artificial Sequence: Synthetic oligonucleotide
  Target: SCN10A; (+) strand; PAM type: YTN; PAM sequence: TTT
cttttcagcttttactgata

SEQ ID NO: 72296 - DNA, 20 bp, Artificial Sequence
  Description of Artificial Sequence: Synthetic oligonucleotide
  Target: SCN10A; (+) strand; PAM type: YTN; PAM sequence: TTC
ttttcagcttttactgatat

SEQ ID NO: 72297 - DNA, 20 bp, Artificial Sequence
  Description of Artificial Sequence: Synthetic oligonucleotide
  Target: SCN10A; (+) strand; PAM type: YTN; PAM sequence: CTT
ttcagcttttactgatataa

SEQ ID NO: 72298 - DNA, 20 bp, Artificial Sequence
  Description of Artificial Sequence: Synthetic oligonucleotide
  Target: SCN10A; (+) strand; PAM type: YTN; PAM sequence: TTT
tcagcttttactgatataaa

SEQ ID NO: 72299 - DNA, 20 bp, Artificial Sequence
  Description of Artificial Sequence: Synthetic oligonucleotide
  Target: SCN10A; (+) strand; PAM type: YTN; PAM sequence: TTT
cagcttttactgatataaat

SEQ ID NO: 72300 - DNA, 20 bp, Artificial Sequence
  Description of Artificial Sequence: Synthetic oligonucleotide
  Target: SCN10A; (+) strand; PAM type: YTN; PAM sequence: TTC
agcttttactgatataaata

SEQ ID NO: 72301 - DNA, 20 bp, Artificial Sequence
  Description of Artificial Sequence: Synthetic oligonucleotide
  Target: SCN10A; (+) strand; PAM type: YTN; PAM sequence: CTT
ttactgatataaatattcta

SEQ ID NO: 72302 - DNA, 20 bp, Artificial Sequence
  Description of Artificial Sequence: Synthetic oligonucleotide
  Target: SCN10A; (+) strand; PAM type: YTN; PAM sequence: TTT
tactgatataaatattctat

SEQ ID NO: 72303 - DNA, 20 bp, Artificial Sequence
  Description of Artificial Sequence: Synthetic oligonucleotide
  Target: SCN10A; (+) strand; PAM type: YTN; PAM sequence: TTT
actgatataaatattctatg

SEQ ID NO: 72304 - DNA, 20 bp, Artificial Sequence
  Description of Artificial Sequence: Synthetic oligonucleotide
  Target: SCN10A; (+) strand; PAM type: YTN; PAM sequence: TTA
ctgatataaatattctatgc

SEQ ID NO: 72305 - DNA, 20 bp, Artificial Sequence
  Description of Artificial Sequence: Synthetic oligonucleotide
  Target: SCN10A; (+) strand; PAM type: YTN; PAM sequence: CTG
atataaatattctatgcttc

SEQ ID NO: 72306 - DNA, 20 bp, Artificial Sequence
  Description of Artificial Sequence: Synthetic oligonucleotide
  Target: SCN10A; (+) strand; PAM type: YTN; PAM sequence: TTC
tatgcttccatgctgtgact

SEQ ID NO: 72307 - DNA, 20 bp, Artificial Sequence
  Description of Artificial Sequence: Synthetic oligonucleotide
  Target: SCN10A; (+) strand; PAM type: YTN; PAM sequence: CTA
tgcttccatgctgtgactta

SEQ ID NO: 72308 - DNA, 20 bp, Artificial Sequence
  Description of Artificial Sequence: Synthetic oligonucleotide
  Target: SCN10A; (+) strand; PAM type: YTN; PAM sequence: CTT
ccatgctgtgacttattccc

SEQ ID NO: 72309 - DNA, 20 bp, Artificial Sequence
  Description of Artificial Sequence: Synthetic oligonucleotide
  Target: SCN10A; (+) strand; PAM type: YTN; PAM sequence: TTC
catgctgtgacttattccct

SEQ ID NO: 72310 - DNA, 20 bp, Artificial Sequence
  Description of Artificial Sequence: Synthetic oligonucleotide
  Target: SCN10A; (+) strand; PAM type: YTN; PAM sequence: CTG
tgacttattccctgaatatg

SEQ ID NO: 72311 - DNA, 20 bp, Artificial Sequence
  Description of Artificial Sequence: Synthetic oligonucleotide
  Target: SCN10A; (+) strand; PAM type: YTN; PAM sequence: CTT
attccctgaatatgtatgtc

SEQ ID NO: 72312 - DNA, 20 bp, Artificial Sequence
  Description of Artificial Sequence: Synthetic oligonucleotide
  Target: SCN10A; (+) strand; PAM type: YTN; PAM sequence: TTA
ttccctgaatatgtatgtct

SEQ ID NO: 72313 - DNA, 20 bp, Artificial Sequence
  Description of Artificial Sequence: Synthetic oligonucleotide
  Target: SCN10A; (+) strand; PAM type: YTN; PAM sequence: TTC
cctgaatatgtatgtcttta

SEQ ID NO: 72314 - DNA, 20 bp, Artificial Sequence
  Description of Artificial Sequence: Synthetic oligonucleotide
  Target: SCN10A; (+) strand; PAM type: YTN; PAM sequence: CTG
aatatgtatgtctttaactg

SEQ ID NO: 72315 - DNA, 20 bp, Artificial Sequence
  Description of Artificial Sequence: Synthetic oligonucleotide
  Target: SCN10A; (+) strand; PAM type: YTN; PAM sequence: CTT
taactgcactctctaggttc

SEQ ID NO: 72316 - DNA, 20 bp, Artificial Sequence
  Description of Artificial Sequence: Synthetic oligonucleotide
  Target: SCN10A; (+) strand; PAM type: YTN; PAM sequence: TTT
aactgcactctctaggttct

SEQ ID NO: 72317 - DNA, 20 bp, Artificial Sequence
  Description of Artificial Sequence: Synthetic oligonucleotide
  Target: SCN10A; (+) strand; PAM type: YTN; PAM sequence: TTA
actgcactctctaggttctg

SEQ ID NO: 72318 - DNA, 20 bp, Artificial Sequence
  Description of Artificial Sequence: Synthetic oligonucleotide
  Target: SCN10A; (+) strand; PAM type: YTN; PAM sequence: CTG
cactctctaggttctgatta

SEQ ID NO: 72319 - DNA, 20 bp, Artificial Sequence
  Description of Artificial Sequence: Synthetic oligonucleotide
  Target: SCN10A; (+) strand; PAM type: YTN; PAM sequence: CTC
tctaggttctgattaaactg

SEQ ID NO: 72320 - DNA, 20 bp, Artificial Sequence
  Description of Artificial Sequence: Synthetic oligonucleotide
  Target: SCN10A; (+) strand; PAM type: YTN; PAM sequence: CTC
taggttctgattaaactgtt

SEQ ID NO: 72321 - DNA, 20 bp, Artificial Sequence
  Description of Artificial Sequence: Synthetic oligonucleotide
  Target: SCN10A; (+) strand; PAM type: YTN; PAM sequence: CTA
ggttctgattaaactgtttt

SEQ ID NO: 72322 - DNA, 20 bp, Artificial Sequence
  Description of Artificial Sequence: Synthetic oligonucleotide
  Target: SCN10A; (+) strand; PAM type: YTN; PAM sequence: TTC
tgattaaactgttttttatc

SEQ ID NO: 72323 - DNA, 20 bp, Artificial Sequence
  Description of Artificial Sequence: Synthetic oligonucleotide
  Target: SCN10A; (+) strand; PAM type: YTN; PAM sequence: CTG
attaaactgttttttatctt

SEQ ID NO: 72324 - DNA, 20 bp, Artificial Sequence
  Description of Artificial Sequence: Synthetic oligonucleotide
  Target: SCN10A; (+) strand; PAM type: YTN; PAM sequence: TTA
aactgttttttatctttcct

SEQ ID NO: 72325 - DNA, 20 bp, Artificial Sequence
  Description of Artificial Sequence: Synthetic oligonucleotide
  Target: SCN10A; (+) strand; PAM type: YTN; PAM sequence: CTG
ttttttatctttccttccct

SEQ ID NO: 72326 - DNA, 20 bp, Artificial Sequence
  Description of Artificial Sequence: Synthetic oligonucleotide
  Target: SCN10A; (+) strand; PAM type: YTN; PAM sequence: TTT
tttatctttccttccctcga

SEQ ID NO: 72327 - DNA, 20 bp, Artificial Sequence
  Description of Artificial Sequence: Synthetic oligonucleotide
  Target: SCN10A; (+) strand; PAM type: YTN; PAM sequence: TTT
ttatctttccttccctcgaa

SEQ ID NO: 72328 - DNA, 20 bp, Artificial Sequence
  Description of Artificial Sequence: Synthetic oligonucleotide
  Target: SCN10A; (+) strand; PAM type: YTN; PAM sequence: TTT
tatctttccttccctcgaaa

SEQ ID NO: 72329 - DNA, 20 bp, Artificial Sequence
  Description of Artificial Sequence: Synthetic oligonucleotide
  Target: SCN10A; (+) strand; PAM type: YTN; PAM sequence: TTT
atctttccttccctcgaaat

SEQ ID NO: 72330 - DNA, 20 bp, Artificial Sequence
  Description of Artificial Sequence: Synthetic oligonucleotide
  Target: SCN10A; (+) strand; PAM type: YTN; PAM sequence: TTA
tctttccttccctcgaaatt

SEQ ID NO: 72331 - DNA, 20 bp, Artificial Sequence
  Description of Artificial Sequence: Synthetic oligonucleotide
  Target: SCN10A; (+) strand; PAM type: YTN; PAM sequence: CTT
tccttccctcgaaattatat

SEQ ID NO: 72332 - DNA, 20 bp, Artificial Sequence
  Description of Artificial Sequence: Synthetic oligonucleotide
  Target: SCN10A; (+) strand; PAM type: YTN; PAM sequence: TTT
ccttccctcgaaattatata

SEQ ID NO: 72333 - DNA, 20 bp, Artificial Sequence
  Description of Artificial Sequence: Synthetic oligonucleotide
  Target: SCN10A; (+) strand; PAM type: YTN; PAM sequence: TTC
cttccctcgaaattatataa

SEQ ID NO: 72334 - DNA, 20 bp, Artificial Sequence
  Description of Artificial Sequence: Synthetic oligonucleotide
  Target: SCN10A; (+) strand; PAM type: YTN; PAM sequence: CTT
ccctcgaaattatataattt

SEQ ID NO: 72335 - DNA, 20 bp, Artificial Sequence
  Description of Artificial Sequence: Synthetic oligonucleotide
  Target: SCN10A; (+) strand; PAM type: YTN; PAM sequence: TTC
cctcgaaattatataatttt

SEQ ID NO: 72336 - DNA, 20 bp, Artificial Sequence
  Description of Artificial Sequence: Synthetic oligonucleotide
  Target: SCN10A; (+) strand; PAM type: YTN; PAM sequence: CTC
gaaattatataattttagtt

SEQ ID NO: 72337 - DNA, 20 bp, Artificial Sequence
  Description of Artificial Sequence: Synthetic oligonucleotide
  Target: SCN10A; (+) strand; PAM type: YTN; PAM sequence: TTA
tataattttagtttatagtt

SEQ ID NO: 72338 - DNA, 20 bp, Artificial Sequence
  Description of Artificial Sequence: Synthetic oligonucleotide
  Target: SCN10A; (+) strand; PAM type: YTN; PAM sequence: TTT
tagtttatagtttgtctttt

SEQ ID NO: 72339 - DNA, 20 bp, Artificial Sequence
  Description of Artificial Sequence: Synthetic oligonucleotide
  Target: SCN10A; (+) strand; PAM type: YTN; PAM sequence: TTT
agtttatagtttgtcttttg

SEQ ID NO: 72340 - DNA, 20 bp, Artificial Sequence
  Description of Artificial Sequence: Synthetic oligonucleotide
  Target: SCN10A; (+) strand; PAM type: YTN; PAM sequence: TTA
gtttatagtttgtcttttgt

SEQ ID NO: 72341 - DNA, 20 bp, Artificial Sequence
  Description of Artificial Sequence: Synthetic oligonucleotide
  Target: SCN10A; (+) strand; PAM type: YTN; PAM sequence: TTT
atagtttgtcttttgtccaa

SEQ ID NO: 72342 - DNA, 20 bp, Artificial Sequence
  Description of Artificial Sequence: Synthetic oligonucleotide
  Target: SCN10A; (+) strand; PAM type: YTN; PAM sequence: TTA
tagtttgtcttttgtccaag

SEQ ID NO: 72343 - DNA, 20 bp, Artificial Sequence
  Description of Artificial Sequence: Synthetic oligonucleotide
  Target: SCN10A; (+) strand; PAM type: YTN; PAM sequence: TTT
gtcttttgtccaagaattct

SEQ ID NO: 72344 - DNA, 20 bp, Artificial Sequence
  Description of Artificial Sequence: Synthetic oligonucleotide
  Target: SCN10A; (+) strand; PAM type: YTN; PAM sequence: TTG
tcttttgtccaagaattctt

SEQ ID NO: 72345 - DNA, 20 bp, Artificial Sequence
  Description of Artificial Sequence: Synthetic oligonucleotide
  Target: SCN10A; (+) strand; PAM type: YTN; PAM sequence: CTT
ttgtccaagaattctttaag

SEQ ID NO: 72346 - DNA, 20 bp, Artificial Sequence
  Description of Artificial Sequence: Synthetic oligonucleotide
  Target: SCN10A; (+) strand; PAM type: YTN; PAM sequence: TTT
tgtccaagaattctttaaga

SEQ ID NO: 72347 - DNA, 20 bp, Artificial Sequence
  Description of Artificial Sequence: Synthetic oligonucleotide
  Target: SCN10A; (+) strand; PAM type: YTN; PAM sequence: TTT
gtccaagaattctttaagag

SEQ ID NO: 72348 - DNA, 20 bp, Artificial Sequence
  Description of Artificial Sequence: Synthetic oligonucleotide
  Target: SCN10A; (+) strand; PAM type: YTN; PAM sequence: TTG
tccaagaattctttaagaga

SEQ ID NO: 72349 - DNA, 20 bp, Artificial Sequence
  Description of Artificial Sequence: Synthetic oligonucleotide
  Target: SCN10A; (+) strand; PAM type: YTN; PAM sequence: TTC
tttaagagagatttttaaaa

SEQ ID NO: 72350 - DNA, 20 bp, Artificial Sequence
  Description of Artificial Sequence: Synthetic oligonucleotide
  Target: SCN10A; (+) strand; PAM type: YTN; PAM sequence: CTT
taagagagatttttaaaaat

SEQ ID NO: 72351 - DNA, 20 bp, Artificial Sequence
  Description of Artificial Sequence: Synthetic oligonucleotide
  Target: SCN10A; (+) strand; PAM type: YTN; PAM sequence: TTT
aagagagatttttaaaaatt

SEQ ID NO: 72352 - DNA, 20 bp, Artificial Sequence
  Description of Artificial Sequence: Synthetic oligonucleotide
  Target: SCN10A; (+) strand; PAM type: YTN; PAM sequence: TTA
agagagatttttaaaaatta

SEQ ID NO: 72353 - DNA, 20 bp, Artificial Sequence
  Description of Artificial Sequence: Synthetic oligonucleotide
  Target: SCN10A; (+) strand; PAM type: YTN; PAM sequence: TTT
ttaaaaattatcaagtggaa

SEQ ID NO: 72354 - DNA, 20 bp, Artificial Sequence
  Description of Artificial Sequence: Synthetic oligonucleotide
  Target: SCN10A; (+) strand; PAM type: YTN; PAM sequence: TTT
taaaaattatcaagtggaaa

SEQ ID NO: 72355 - DNA, 20 bp, Artificial Sequence
  Description of Artificial Sequence: Synthetic oligonucleotide
  Target: SCN10A; (+) strand; PAM type: YTN; PAM sequence: TTT
aaaaattatcaagtggaaag

SEQ ID NO: 72356 - DNA, 20 bp, Artificial Sequence
  Description of Artificial Sequence: Synthetic oligonucleotide
  Target: SCN10A; (+) strand; PAM type: YTN; PAM sequence: TTA
aaaattatcaagtggaaagt

SEQ ID NO: 72357 - DNA, 20 bp, Artificial Sequence
  Description of Artificial Sequence: Synthetic oligonucleotide
  Target: SCN10A; (+) strand; PAM type: YTN; PAM sequence: TTA
tcaagtggaaagtcctctca

SEQ ID NO: 72358 - DNA, 20 bp, Artificial Sequence
  Description of Artificial Sequence: Synthetic oligonucleotide
  Target: SCN10A; (+) strand; PAM type: YTN; PAM sequence: CTC
tcatttcattaaatttggtt

SEQ ID NO: 72359 - DNA, 20 bp, Artificial Sequence
  Description of Artificial Sequence: Synthetic oligonucleotide
  Target: SCN10A; (+) strand; PAM type: YTN; PAM sequence: CTC
atttcattaaatttggttat

SEQ ID NO: 72360 - DNA, 20 bp, Artificial Sequence
  Description of Artificial Sequence: Synthetic oligonucleotide
  Target: SCN10A; (+) strand; PAM type: YTN; PAM sequence: TTT
cattaaatttggttattttt

SEQ ID NO: 72361 - DNA, 20 bp, Artificial Sequence
  Description of Artificial Sequence: Synthetic oligonucleotide
  Target: SCN10A; (+) strand; PAM type: YTN; PAM sequence: TTC
attaaatttggttatttttt

SEQ ID NO: 72362 - DNA, 20 bp, Artificial Sequence
  Description of Artificial Sequence: Synthetic oligonucleotide
  Target: SCN10A; (+) strand; PAM type: YTN; PAM sequence: TTA
aatttggttattttttttaa

SEQ ID NO: 72363 - DNA, 20 bp, Artificial Sequence
  Description of Artificial Sequence: Synthetic oligonucleotide
  Target: SCN10A; (+) strand; PAM type: YTN; PAM sequence: TTT
ggttattttttttaactcta

SEQ ID NO: 72364 - DNA, 20 bp, Artificial Sequence
  Description of Artificial Sequence: Synthetic oligonucleotide
  Target: SCN10A; (+) strand; PAM type: YTN; PAM sequence: TTG
gttattttttttaactctat

SEQ ID NO: 72365 - DNA, 20 bp, Artificial Sequence
  Description of Artificial Sequence: Synthetic oligonucleotide
  Target: SCN10A; (+) strand; PAM type: YTN; PAM sequence: TTA
ttttttttaactctatttca

SEQ ID NO: 72366 - DNA, 20 bp, Artificial Sequence
  Description of Artificial Sequence: Synthetic oligonucleotide
  Target: SCN10A; (+) strand; PAM type: YTN; PAM sequence: TTT
tttttaactctatttcatta

SEQ ID NO: 72367 - DNA, 20 bp, Artificial Sequence
  Description of Artificial Sequence: Synthetic oligonucleotide
  Target: SCN10A; (+) strand; PAM type: YTN; PAM sequence: TTT
ttttaactctatttcattat

SEQ ID NO: 72368 - DNA, 20 bp, Artificial Sequence
  Description of Artificial Sequence: Synthetic oligonucleotide
  Target: SCN10A; (+) strand; PAM type: YTN; PAM sequence: TTT
tttaactctatttcattatg

SEQ ID NO: 72369 - DNA, 20 bp, Artificial Sequence
  Description of Artificial Sequence: Synthetic oligonucleotide
  Target: SCN10A; (+) strand; PAM type: YTN; PAM sequence: TTT
ttaactctatttcattatga

SEQ ID NO: 72370 - DNA, 20 bp, Artificial Sequence
  Description of Artificial Sequence: Synthetic oligonucleotide
  Target: SCN10A; (+) strand; PAM type: YTN; PAM sequence: TTT
taactctatttcattatgat

SEQ ID NO: 72371 - DNA, 20 bp, Artificial Sequence
  Description of Artificial Sequence: Synthetic oligonucleotide
  Target: SCN10A; (+) strand; PAM type: YTN; PAM sequence: TTT
aactctatttcattatgatc

SEQ ID NO: 72372 - DNA, 20 bp, Artificial Sequence
  Description of Artificial Sequence: Synthetic oligonucleotide
  Target: SCN10A; (+) strand; PAM type: YTN; PAM sequence: TTA
actctatttcattatgatca

SEQ ID NO: 72373 - DNA, 20 bp, Artificial Sequence
  Description of Artificial Sequence: Synthetic oligonucleotide
  Target: SCN10A; (+) strand; PAM type: YTN; PAM sequence: CTC
tatttcattatgatcagaga

SEQ ID NO: 72374 - DNA, 20 bp, Artificial Sequence
  Description of Artificial Sequence: Synthetic oligonucleotide
  Target: SCN10A; (+) strand; PAM type: YTN; PAM sequence: CTA
tttcattatgatcagagaat

SEQ ID NO: 72375 - DNA, 20 bp, Artificial Sequence
  Description of Artificial Sequence: Synthetic oligonucleotide
  Target: SCN10A; (+) strand; PAM type: YTN; PAM sequence: TTT
cattatgatcagagaatgtt

SEQ ID NO: 72376 - DNA, 20 bp, Artificial Sequence
  Description of Artificial Sequence: Synthetic oligonucleotide
  Target: SCN10A; (+) strand; PAM type: YTN; PAM sequence: TTC
attatgatcagagaatgttt

SEQ ID NO: 72377 - DNA, 20 bp, Artificial Sequence
  Description of Artificial Sequence: Synthetic oligonucleotide
  Target: SCN10A; (+) strand; PAM type: YTN; PAM sequence: TTA
tgatcagagaatgttttcta

SEQ ID NO: 72378 - DNA, 20 bp, Artificial Sequence
  Description of Artificial Sequence: Synthetic oligonucleotide
  Target: SCN10A; (+) strand; PAM type: YTN; PAM sequence: TTT
tctatattatttccactttc

SEQ ID NO: 72379 - DNA, 20 bp, Artificial Sequence
  Description of Artificial Sequence: Synthetic oligonucleotide
  Target: SCN10A; (+) strand; PAM type: YTN; PAM sequence: TTT
ctatattatttccactttct

SEQ ID NO: 72380 - DNA, 20 bp, Artificial Sequence
  Description of Artificial Sequence: Synthetic oligonucleotide
  Target: SCN10A; (+) strand; PAM type: YTN; PAM sequence: TTC
tatattatttccactttctg

SEQ ID NO: 72381 - DNA, 20 bp, Artificial Sequence
  Description of Artificial Sequence: Synthetic oligonucleotide
  Target: SCN10A; (+) strand; PAM type: YTN; PAM sequence: CTA
tattatttccactttctgga

SEQ ID NO: 72382 - DNA, 20 bp, Artificial Sequence
  Description of Artificial Sequence: Synthetic oligonucleotide
  Target: SCN10A; (+) strand; PAM type: YTN; PAM sequence: TTA
tttccactttctggagctta

SEQ ID NO: 72383 - DNA, 20 bp, Artificial Sequence
  Description of Artificial Sequence: Synthetic oligonucleotide
  Target: SCN10A; (+) strand; PAM type: YTN; PAM sequence: TTT
ccactttctggagcttattg

SEQ ID NO: 72384 - DNA, 20 bp, Artificial Sequence
  Description of Artificial Sequence: Synthetic oligonucleotide
  Target: SCN10A; (+) strand; PAM type: YTN; PAM sequence: TTC
cactttctggagcttattga

SEQ ID NO: 72385 - DNA, 20 bp, Artificial Sequence
  Description of Artificial Sequence: Synthetic oligonucleotide
  Target: SCN10A; (+) strand; PAM type: YTN; PAM sequence: CTT
tctggagcttattgaggttt

SEQ ID NO: 72386 - DNA, 20 bp, Artificial Sequence
  Description of Artificial Sequence: Synthetic oligonucleotide
  Target: SCN10A; (+) strand; PAM type: YTN; PAM sequence: TTT
ctggagcttattgaggtttt

SEQ ID NO: 72387 - DNA, 20 bp, Artificial Sequence
  Description of Artificial Sequence: Synthetic oligonucleotide
  Target: SCN10A; (+) strand; PAM type: YTN; PAM sequence: TTC
tggagcttattgaggttttt

SEQ ID NO: 72388 - DNA, 20 bp, Artificial Sequence
  Description of Artificial Sequence: Synthetic oligonucleotide
  Target: SCN10A; (+) strand; PAM type: YTN; PAM sequence: CTG
gagcttattgaggtttttgt

SEQ ID NO: 72389 - DNA, 20 bp, Artificial Sequence
  Description of Artificial Sequence: Synthetic oligonucleotide
  Target: SCN10A; (+) strand; PAM type: YTN; PAM sequence: CTT
attgaggtttttgtcatggc

SEQ ID NO: 72390 - DNA, 20 bp, Artificial Sequence
  Description of Artificial Sequence: Synthetic oligonucleotide
  Target: SCN10A; (+) strand; PAM type: YTN; PAM sequence: TTA
ttgaggtttttgtcatggct

SEQ ID NO: 72391 - DNA, 20 bp, Artificial Sequence
  Description of Artificial Sequence: Synthetic oligonucleotide
  Target: SCN10A; (+) strand; PAM type: YTN; PAM sequence: TTG
aggtttttgtcatggcttaa

SEQ ID NO: 72392 - DNA, 20 bp, Artificial Sequence
  Description of Artificial Sequence: Synthetic oligonucleotide
  Target: SCN10A; (+) strand; PAM type: YTN; PAM sequence: TTT
ttgtcatggcttaatatttg

SEQ ID NO: 72393 - DNA, 20 bp, Artificial Sequence
  Description of Artificial Sequence: Synthetic oligonucleotide
  Target: SCN10A; (+) strand; PAM type: YTN; PAM sequence: TTT
tgtcatggcttaatatttgg

SEQ ID NO: 72394 - DNA, 20 bp, Artificial Sequence
  Description of Artificial Sequence: Synthetic oligonucleotide
  Target: SCN10A; (+) strand; PAM type: YTN; PAM sequence: TTT
gtcatggcttaatatttggt

SEQ ID NO: 72395 - DNA, 20 bp, Artificial Sequence
  Description of Artificial Sequence: Synthetic oligonucleotide
  Target: SCN10A; (+) strand; PAM type: YTN; PAM sequence: TTG
tcatggcttaatatttggtt

SEQ ID NO: 72396 - DNA, 20 bp, Artificial Sequence
  Description of Artificial Sequence: Synthetic oligonucleotide
  Target: SCN10A; (+) strand; PAM type: YTN; PAM sequence: CTT
aatatttggtttgatatgtt

SEQ ID NO: 72397 - DNA, 20 bp, Artificial Sequence
  Description of Artificial Sequence: Synthetic oligonucleotide
  Target: SCN10A; (+) strand; PAM type: YTN; PAM sequence: TTA
atatttggtttgatatgttt

SEQ ID NO: 72398 - DNA, 20 bp, Artificial Sequence
  Description of Artificial Sequence: Synthetic oligonucleotide
  Target: SCN10A; (+) strand; PAM type: YTN; PAM sequence: TTT
ggtttgatatgtttggtttt

SEQ ID NO: 72399 - DNA, 20 bp, Artificial Sequence
  Description of Artificial Sequence: Synthetic oligonucleotide
  Target: SCN10A; (+) strand; PAM type: YTN; PAM sequence: TTG
gtttgatatgtttggttttt

SEQ ID NO: 72400 - DNA, 20 bp, Artificial Sequence
  Description of Artificial Sequence: Synthetic oligonucleotide
  Target: SCN10A; (+) strand; PAM type: YTN; PAM sequence: TTT
gatatgtttggttttttgaa

SEQ ID NO: 72401 - DNA, 20 bp, Artificial Sequence
  Description of Artificial Sequence: Synthetic oligonucleotide
  Target: SCN10A; (+) strand; PAM type: YTN; PAM sequence: TTG
atatgtttggttttttgaaa

SEQ ID NO: 72402 - DNA, 20 bp, Artificial Sequence
  Description of Artificial Sequence: Synthetic oligonucleotide
  Target: SCN10A; (+) strand; PAM type: YTN; PAM sequence: TTT
ggttttttgaaaaggaggtg

SEQ ID NO: 72403 - DNA, 20 bp, Artificial Sequence
  Description of Artificial Sequence: Synthetic oligonucleotide
  Target: SCN10A; (+) strand; PAM type: YTN; PAM sequence: TTG
gttttttgaaaaggaggtgc

SEQ ID NO: 72404 - DNA, 20 bp, Artificial Sequence
  Description of Artificial Sequence: Synthetic oligonucleotide
  Target: SCN10A; (+) strand; PAM type: YTN; PAM sequence: TTT
tttgaaaaggaggtgcattt

SEQ ID NO: 72405 - DNA, 20 bp, Artificial Sequence
  Description of Artificial Sequence: Synthetic oligonucleotide
  Target: SCN10A; (+) strand; PAM type: YTN; PAM sequence: TTT
ttgaaaaggaggtgcatttt

SEQ ID NO: 72406 - DNA, 20 bp, Artificial Sequence
  Description of Artificial Sequence: Synthetic oligonucleotide
  Target: SCN10A; (+) strand; PAM type: YTN; PAM sequence: TTT
tgaaaaggaggtgcattttc

SEQ ID NO: 72407 - DNA, 20 bp, Artificial Sequence
  Description of Artificial Sequence: Synthetic oligonucleotide
  Target: SCN10A; (+) strand; PAM type: YTN; PAM sequence: TTT
gaaaaggaggtgcattttct

SEQ ID NO: 72408 - DNA, 20 bp, Artificial Sequence
  Description of Artificial Sequence: Synthetic oligonucleotide
  Target: SCN10A; (+) strand; PAM type: YTN; PAM sequence: TTG
aaaaggaggtgcattttcta

SEQ ID NO: 72409 - DNA, 20 bp, Artificial Sequence
  Description of Artificial Sequence: Synthetic oligonucleotide
  Target: SCN10A; (+) strand; PAM type: YTN; PAM sequence: TTT
tctattgttagggaaggtag

SEQ ID NO: 72410 - DNA, 20 bp, Artificial Sequence
  Description of Artificial Sequence: Synthetic oligonucleotide
  Target: SCN10A; (+) strand; PAM type: YTN; PAM sequence: TTT
ctattgttagggaaggtagt

SEQ ID NO: 72411 - DNA, 20 bp, Artificial Sequence
  Description of Artificial Sequence: Synthetic oligonucleotide
  Target: SCN10A; (+) strand; PAM type: YTN; PAM sequence: TTC
tattgttagggaaggtagtt

SEQ ID NO: 72412 - DNA, 20 bp, Artificial Sequence
  Description of Artificial Sequence: Synthetic oligonucleotide
  Target: SCN10A; (+) strand; PAM type: YTN; PAM sequence: CTA
ttgttagggaaggtagtttg

SEQ ID NO: 72413 - DNA, 20 bp, Artificial Sequence
  Description of Artificial Sequence: Synthetic oligonucleotide
  Target: SCN10A; (+) strand; PAM type: YTN; PAM sequence: TTG
ttagggaaggtagtttgcta

SEQ ID NO: 72414 - DNA, 20 bp, Artificial Sequence
  Description of Artificial Sequence: Synthetic oligonucleotide
  Target: SCN10A; (+) strand; PAM type: YTN; PAM sequence: TTA
gggaaggtagtttgctatat

SEQ ID NO: 72415 - DNA, 20 bp, Artificial Sequence
  Description of Artificial Sequence: Synthetic oligonucleotide
  Target: SCN10A; (+) strand; PAM type: YTN; PAM sequence: TTT
gctatatattaatcagatac

SEQ ID NO: 72416 - DNA, 20 bp, Artificial Sequence
  Description of Artificial Sequence: Synthetic oligonucleotide
  Target: SCN10A; (+) strand; PAM type: YTN; PAM sequence: TTG
ctatatattaatcagataca

SEQ ID NO: 72417 - DNA, 20 bp, Artificial Sequence
  Description of Artificial Sequence: Synthetic oligonucleotide
  Target: SCN10A; (+) strand; PAM type: YTN; PAM sequence: CTA
tatattaatcagatacatta

SEQ ID NO: 72418 - DNA, 20 bp, Artificial Sequence
  Description of Artificial Sequence: Synthetic oligonucleotide
  Target: SCN10A; (+) strand; PAM type: YTN; PAM sequence: TTA
atcagatacattatattaat

SEQ ID NO: 72419 - DNA, 20 bp, Artificial Sequence
  Description of Artificial Sequence: Synthetic oligonucleotide
  Target: SCN10A; (+) strand; PAM type: YTN; PAM sequence: TTA
tattaattatattactaggt

SEQ ID NO: 72420 - DNA, 20 bp, Artificial Sequence
  Description of Artificial Sequence: Synthetic oligonucleotide
  Target: SCN10A; (+) strand; PAM type: YTN; PAM sequence: TTA
attatattactaggtcatct

SEQ ID NO: 72421 - DNA, 20 bp, Artificial Sequence
  Description of Artificial Sequence: Synthetic oligonucleotide
  Target: SCN10A; (+) strand; PAM type: YTN; PAM sequence: TTA
tattactaggtcatctataa

SEQ ID NO: 72422 - DNA, 20 bp, Artificial Sequence
  Description of Artificial Sequence: Synthetic oligonucleotide
  Target: SCN10A; (+) strand; PAM type: YTN; PAM sequence: TTA
ctaggtcatctataatttta

SEQ ID NO: 72423 - DNA, 20 bp, Artificial Sequence
  Description of Artificial Sequence: Synthetic oligonucleotide
  Target: SCN10A; (+) strand; PAM type: YTN; PAM sequence: CTA
ggtcatctataattttacat

SEQ ID NO: 72424 - DNA, 20 bp, Artificial Sequence
  Description of Artificial Sequence: Synthetic oligonucleotide
  Target: SCN10A; (+) strand; PAM type: YTN; PAM sequence: CTA
taattttacatactttttaa

SEQ ID NO: 72425 - DNA, 20 bp, Artificial Sequence
  Description of Artificial Sequence: Synthetic oligonucleotide
  Target: SCN10A; (+) strand; PAM type: YTN; PAM sequence: TTT
tacatactttttaatacatt

SEQ ID NO: 72426 - DNA, 20 bp, Artificial Sequence
  Description of Artificial Sequence: Synthetic oligonucleotide
  Target: SCN10A; (+) strand; PAM type: YTN; PAM sequence: TTT
acatactttttaatacattt

SEQ ID NO: 72427 - DNA, 20 bp, Artificial Sequence
  Description of Artificial Sequence: Synthetic oligonucleotide
  Target: SCN10A; (+) strand; PAM type: YTN; PAM sequence: TTA
catactttttaatacatttg

SEQ ID NO: 72428 - DNA, 20 bp, Artificial Sequence
  Description of Artificial Sequence: Synthetic oligonucleotide
  Target: SCN10A; (+) strand; PAM type: YTN; PAM sequence: CTT
tttaatacatttgatctgtt

SEQ ID NO: 72429 - DNA, 20 bp, Artificial Sequence
  Description of Artificial Sequence: Synthetic oligonucleotide
  Target: SCN10A; (+) strand; PAM type: YTN; PAM sequence: TTT
ttaatacatttgatctgtta

SEQ ID NO: 72430 - DNA, 20 bp, Artificial Sequence
  Description of Artificial Sequence: Synthetic oligonucleotide
  Target: SCN10A; (+) strand; PAM type: YTN; PAM sequence: TTT
taatacatttgatctgttat

SEQ ID NO: 72431 - DNA, 20 bp, Artificial Sequence
  Description of Artificial Sequence: Synthetic oligonucleotide
  Target: SCN10A; (+) strand; PAM type: YTN; PAM sequence: TTT
aatacatttgatctgttatt

SEQ ID NO: 72432 - DNA, 20 bp, Artificial Sequence
  Description of Artificial Sequence: Synthetic oligonucleotide
  Target: SCN10A; (+) strand; PAM type: YTN; PAM sequence: TTA
atacatttgatctgttattg

SEQ ID NO: 72433 - DNA, 20 bp, Artificial Sequence
  Description of Artificial Sequence: Synthetic oligonucleotide
  Target: SCN10A; (+) strand; PAM type: YTN; PAM sequence: TTT
gatctgttattggctaaaat

SEQ ID NO: 72434 - DNA, 20 bp, Artificial Sequence
  Description of Artificial Sequence: Synthetic oligonucleotide
  Target: SCN10A; (+) strand; PAM type: YTN; PAM sequence: TTG
atctgttattggctaaaatt

SEQ ID NO: 72435 - DNA, 20 bp, Artificial Sequence
  Description of Artificial Sequence: Synthetic oligonucleotide
  Target: SCN10A; (+) strand; PAM type: YTN; PAM sequence: CTG
ttattggctaaaattaattg

SEQ ID NO: 72436 - DNA, 20 bp, Artificial Sequence
  Description of Artificial Sequence: Synthetic oligonucleotide
  Target: SCN10A; (+) strand; PAM type: YTN; PAM sequence: TTA
ttggctaaaattaattgaaa

SEQ ID NO: 72437 - DNA, 20 bp, Artificial Sequence
  Description of Artificial Sequence: Synthetic oligonucleotide
  Target: SCN10A; (+) strand; PAM type: YTN; PAM sequence: TTG
gctaaaattaattgaaaatt

SEQ ID NO: 72438 - DNA, 20 bp, Artificial Sequence
  Description of Artificial Sequence: Synthetic oligonucleotide
  Target: SCN10A; (+) strand; PAM type: YTN; PAM sequence: CTA
aaattaattgaaaatttcta

SEQ ID NO: 72439 - DNA, 20 bp, Artificial Sequence
  Description of Artificial Sequence: Synthetic oligonucleotide
  Target: SCN10A; (+) strand; PAM type: YTN; PAM sequence: TTA
attgaaaatttctattccta

SEQ ID NO: 72440 - DNA, 20 bp, Artificial Sequence
  Description of Artificial Sequence: Synthetic oligonucleotide
  Target: SCN10A; (+) strand; PAM type: YTN; PAM sequence: TTG
aaaatttctattcctacaat

SEQ ID NO: 72441 - DNA, 20 bp, Artificial Sequence
  Description of Artificial Sequence: Synthetic oligonucleotide
  Target: SCN10A; (+) strand; PAM type: YTN; PAM sequence: TTT
ctattcctacaatgttttta

SEQ ID NO: 72442 - DNA, 20 bp, Artificial Sequence
  Description of Artificial Sequence: Synthetic oligonucleotide
  Target: SCN10A; (+) strand; PAM type: YTN; PAM sequence: TTC
tattcctacaatgtttttat

SEQ ID NO: 72443 - DNA, 20 bp, Artificial Sequence
  Description of Artificial Sequence: Synthetic oligonucleotide
  Target: SCN10A; (+) strand; PAM type: YTN; PAM sequence: CTA
ttcctacaatgtttttattt

SEQ ID NO: 72444 - DNA, 20 bp, Artificial Sequence
  Description of Artificial Sequence: Synthetic oligonucleotide
  Target: SCN10A; (+) strand; PAM type: YTN; PAM sequence: TTC
ctacaatgtttttatttatc

SEQ ID NO: 72445 - DNA, 20 bp, Artificial Sequence
  Description of Artificial Sequence: Synthetic oligonucleotide
  Target: SCN10A; (+) strand; PAM type: YTN; PAM sequence: CTA
caatgtttttatttatcctc

SEQ ID NO: 72446 - DNA, 20 bp, Artificial Sequence
  Description of Artificial Sequence: Synthetic oligonucleotide
  Target: SCN10A; (+) strand; PAM type: YTN; PAM sequence: TTT
ttatttatcctcctactcta

SEQ ID NO: 72447 - DNA, 20 bp, Artificial Sequence
  Description of Artificial Sequence: Synthetic oligonucleotide
  Target: SCN10A; (+) strand; PAM type: YTN; PAM sequence: TTT
tatttatcctcctactctaa

SEQ ID NO: 72448 - DNA, 20 bp, Artificial Sequence
  Description of Artificial Sequence: Synthetic oligonucleotide
  Target: SCN10A; (+) strand; PAM type: YTN; PAM sequence: TTT
atttatcctcctactctaat

SEQ ID NO: 72449 - DNA, 20 bp, Artificial Sequence
  Description of Artificial Sequence: Synthetic oligonucleotide
  Target: SCN10A; (+) strand; PAM type: YTN; PAM sequence: TTA
tttatcctcctactctaata

SEQ ID NO: 72450 - DNA, 20 bp, Artificial Sequence
  Description of Artificial Sequence: Synthetic oligonucleotide
  Target: SCN10A; (+) strand; PAM type: YTN; PAM sequence: TTT
atcctcctactctaataatt

SEQ ID NO: 72451 - DNA, 20 bp, Artificial Sequence
  Description of Artificial Sequence: Synthetic oligonucleotide
  Target: SCN10A; (+) strand; PAM type: YTN; PAM sequence: TTA
tcctcctactctaataattt

SEQ ID NO: 72452 - DNA, 20 bp, Artificial Sequence
  Description of Artificial Sequence: Synthetic oligonucleotide
  Target: SCN10A; (+) strand; PAM type: YTN; PAM sequence: CTC
ctactctaataatttctgat

SEQ ID NO: 72453 - DNA, 20 bp, Artificial Sequence
  Description of Artificial Sequence: Synthetic oligonucleotide
  Target: SCN10A; (+) strand; PAM type: YTN; PAM sequence: CTA
ctctaataatttctgattta

SEQ ID NO: 72454 - DNA, 20 bp, Artificial Sequence
  Description of Artificial Sequence: Synthetic oligonucleotide
  Target: SCN10A; (+) strand; PAM type: YTN; PAM sequence: CTC
taataatttctgatttataa

SEQ ID NO: 72455 - DNA, 20 bp, Artificial Sequence
  Description of Artificial Sequence: Synthetic oligonucleotide
  Target: SCN10A; (+) strand; PAM type: YTN; PAM sequence: CTA
ataatttctgatttataaat

SEQ ID NO: 72456 - DNA, 20 bp, Artificial Sequence
  Description of Artificial Sequence: Synthetic oligonucleotide
  Target: SCN10A; (+) strand; PAM type: YTN; PAM sequence: TTT
ctgatttataaatattgttg

SEQ ID NO: 72457 - DNA, 20 bp, Artificial Sequence
  Description of Artificial Sequence: Synthetic oligonucleotide
  Target: SCN10A; (+) strand; PAM type: YTN; PAM sequence: TTC
tgatttataaatattgttgc

SEQ ID NO: 72458 - DNA, 20 bp, Artificial Sequence
  Description of Artificial Sequence: Synthetic oligonucleotide
  Target: SCN10A; (+) strand; PAM type: YTN; PAM sequence: CTG
atttataaatattgttgcca

SEQ ID NO: 72459 - DNA, 20 bp, Artificial Sequence
  Description of Artificial Sequence: Synthetic oligonucleotide
  Target: SCN10A; (+) strand; PAM type: YTN; PAM sequence: TTT
ataaatattgttgccatctt

SEQ ID NO: 72460 - DNA, 20 bp, Artificial Sequence
  Description of Artificial Sequence: Synthetic oligonucleotide
  Target: SCN10A; (+) strand; PAM type: YTN; PAM sequence: TTA
taaatattgttgccatctta

SEQ ID NO: 72461 - DNA, 20 bp, Artificial Sequence
  Description of Artificial Sequence: Synthetic oligonucleotide
  Target: SCN10A; (+) strand; PAM type: YTN; PAM sequence: TTG
ttgccatcttatttgttgca

SEQ ID NO: 72462 - DNA, 20 bp, Artificial Sequence
  Description of Artificial Sequence: Synthetic oligonucleotide
  Target: SCN10A; (+) strand; PAM type: YTN; PAM sequence: TTG
ccatcttatttgttgcaaag

SEQ ID NO: 72463 - DNA, 20 bp, Artificial Sequence
  Description of Artificial Sequence: Synthetic oligonucleotide
  Target: SCN10A; (+) strand; PAM type: YTN; PAM sequence: CTT
atttgttgcaaagatataga

SEQ ID NO: 72464 - DNA, 20 bp, Artificial Sequence
  Description of Artificial Sequence: Synthetic oligonucleotide
  Target: SCN10A; (+) strand; PAM type: YTN; PAM sequence: TTA
tttgttgcaaagatatagat

SEQ ID NO: 72465 - DNA, 20 bp, Artificial Sequence
  Description of Artificial Sequence: Synthetic oligonucleotide
  Target: SCN10A; (+) strand; PAM type: YTN; PAM sequence: TTT
gttgcaaagatatagattac

SEQ ID NO: 72466 - DNA, 20 bp, Artificial Sequence
  Description of Artificial Sequence: Synthetic oligonucleotide
  Target: SCN10A; (+) strand; PAM type: YTN; PAM sequence: TTG
ttgcaaagatatagattact

SEQ ID NO: 72467 - DNA, 20 bp, Artificial Sequence
  Description of Artificial Sequence: Synthetic oligonucleotide
  Target: SCN10A; (+) strand; PAM type: YTN; PAM sequence: TTG
caaagatatagattactatc

SEQ ID NO: 72468 - DNA, 20 bp, Artificial Sequence
  Description of Artificial Sequence: Synthetic oligonucleotide
  Target: SCN10A; (+) strand; PAM type: YTN; PAM sequence: TTA
ctatcgtctttaatattaat

SEQ ID NO: 72469 - DNA, 20 bp, Artificial Sequence
  Description of Artificial Sequence: Synthetic oligonucleotide
  Target: SCN10A; (+) strand; PAM type: YTN; PAM sequence: CTA
tcgtctttaatattaatatg

SEQ ID NO: 72470 - DNA, 20 bp, Artificial Sequence
  Description of Artificial Sequence: Synthetic oligonucleotide
  Target: SCN10A; (+) strand; PAM type: YTN; PAM sequence: CTT
taatattaatatgtctgtgc

SEQ ID NO: 72471 - DNA, 20 bp, Artificial Sequence
  Description of Artificial Sequence: Synthetic oligonucleotide
  Target: SCN10A; (+) strand; PAM type: YTN; PAM sequence: TTT
aatattaatatgtctgtgca

SEQ ID NO: 72472 - DNA, 20 bp, Artificial Sequence
  Description of Artificial Sequence: Synthetic oligonucleotide
  Target: SCN10A; (+) strand; PAM type: YTN; PAM sequence: TTA
atattaatatgtctgtgcaa

SEQ ID NO: 72473 - DNA, 20 bp, Artificial Sequence
  Description of Artificial Sequence: Synthetic oligonucleotide
  Target: SCN10A; (+) strand; PAM type: YTN; PAM sequence: TTA
atatgtctgtgcaatttttg

SEQ ID NO: 72474 - DNA, 20 bp, Artificial Sequence
  Description of Artificial Sequence: Synthetic oligonucleotide
  Target: SCN10A; (+) strand; PAM type: YTN; PAM sequence: CTG
tgcaatttttgtcctatttc

SEQ ID NO: 72475 - DNA, 20 bp, Artificial Sequence
  Description of Artificial Sequence: Synthetic oligonucleotide
  Target: SCN10A; (+) strand; PAM type: YTN; PAM sequence: TTT
ttgtcctatttcatgctttt

SEQ ID NO: 72476 - DNA, 20 bp, Artificial Sequence
  Description of Artificial Sequence: Synthetic oligonucleotide
  Target: SCN10A; (+) strand; PAM type: YTN; PAM sequence: TTT
tgtcctatttcatgcttttt

SEQ ID NO: 72477 - DNA, 20 bp, Artificial Sequence
  Description of Artificial Sequence: Synthetic oligonucleotide
  Target: SCN10A; (+) strand; PAM type: YTN; PAM sequence: TTT
gtcctatttcatgctttttg

SEQ ID NO: 72478 - DNA, 20 bp, Artificial Sequence
  Description of Artificial Sequence: Synthetic oligonucleotide
  Target: SCN10A; (+) strand; PAM type: YTN; PAM sequence: TTG
tcctatttcatgctttttga

SEQ ID NO: 72479 - DNA, 20 bp, Artificial Sequence
  Description of Artificial Sequence: Synthetic oligonucleotide
  Target: SCN10A; (+) strand; PAM type: YTN; PAM sequence: CTA
tttcatgctttttgaccgag

SEQ ID NO: 72480 - DNA, 20 bp, Artificial Sequence
  Description of Artificial Sequence: Synthetic oligonucleotide
  Target: SCN10A; (+) strand; PAM type: YTN; PAM sequence: TTT
catgctttttgaccgagatt

SEQ ID NO: 72481 - DNA, 20 bp, Artificial Sequence
  Description of Artificial Sequence: Synthetic oligonucleotide
  Target: SCN10A; (+) strand; PAM type: YTN; PAM sequence: TTC
atgctttttgaccgagattc

SEQ ID NO: 72482 - DNA, 20 bp, Artificial Sequence
  Description of Artificial Sequence: Synthetic oligonucleotide
  Target: SCN10A; (+) strand; PAM type: YTN; PAM sequence: CTT
tttgaccgagattccacttt

SEQ ID NO: 72483 - DNA, 20 bp, Artificial Sequence
  Description of Artificial Sequence: Synthetic oligonucleotide
  Target: SCN10A; (+) strand; PAM type: YTN; PAM sequence: TTT
ttgaccgagattccactttc

SEQ ID NO: 72484 - DNA, 20 bp, Artificial Sequence
  Description of Artificial Sequence: Synthetic oligonucleotide
  Target: SCN10A; (+) strand; PAM type: YTN; PAM sequence: TTT
tgaccgagattccactttct

SEQ ID NO: 72485 - DNA, 20 bp, Artificial Sequence
  Description of Artificial Sequence: Synthetic oligonucleotide
  Target: SCN10A; (+) strand; PAM type: YTN; PAM sequence: TTT
gaccgagattccactttctc

SEQ ID NO: 72486 - DNA, 20 bp, Artificial Sequence
  Description of Artificial Sequence: Synthetic oligonucleotide
  Target: SCN10A; (+) strand; PAM type: YTN; PAM sequence: TTG
accgagattccactttctct

SEQ ID NO: 72487 - DNA, 20 bp, Artificial Sequence
  Description of Artificial Sequence: Synthetic oligonucleotide
  Target: SCN10A; (+) strand; PAM type: YTN; PAM sequence: TTC
cactttctctgatattaaaa

SEQ ID NO: 72488 - DNA, 20 bp, Artificial Sequence
  Description of Artificial Sequence: Synthetic oligonucleotide
  Target: SCN10A; (+) strand; PAM type: YTN; PAM sequence: CTT
tctctgatattaaaatcatg

SEQ ID NO: 72489 - DNA, 20 bp, Artificial Sequence
  Description of Artificial Sequence: Synthetic oligonucleotide
  Target: SCN10A; (+) strand; PAM type: YTN; PAM sequence: TTT
ctctgatattaaaatcatgg

SEQ ID NO: 72490 - DNA, 20 bp, Artificial Sequence
  Description of Artificial Sequence: Synthetic oligonucleotide
  Target: SCN10A; (+) strand; PAM type: YTN; PAM sequence: TTC
tctgatattaaaatcatgga

SEQ ID NO: 72491 - DNA, 20 bp, Artificial Sequence
  Description of Artificial Sequence: Synthetic oligonucleotide
  Target: SCN10A; (+) strand; PAM type: YTN; PAM sequence: CTC
tgatattaaaatcatggatc

SEQ ID NO: 72492 - DNA, 20 bp, Artificial Sequence
  Description of Artificial Sequence: Synthetic oligonucleotide
  Target: SCN10A; (+) strand; PAM type: YTN; PAM sequence: CTG
atattaaaatcatggatcct

SEQ ID NO: 72493 - DNA, 20 bp, Artificial Sequence
  Description of Artificial Sequence: Synthetic oligonucleotide
  Target: SCN10A; (+) strand; PAM type: YTN; PAM sequence: TTA
aaatcatggatcctgctttc

SEQ ID NO: 72494 - DNA, 20 bp, Artificial Sequence
  Description of Artificial Sequence: Synthetic oligonucleotide
  Target: SCN10A; (+) strand; PAM type: YTN; PAM sequence: CTG
ctttctttgtttgcctttgc

SEQ ID NO: 72495 - DNA, 20 bp, Artificial Sequence
  Description of Artificial Sequence: Synthetic oligonucleotide
  Target: SCN10A; (+) strand; PAM type: YTN; PAM sequence: CTT
tctttgtttgcctttgctta

SEQ ID NO: 72496 - DNA, 20 bp, Artificial Sequence
  Description of Artificial Sequence: Synthetic oligonucleotide
  Target: SCN10A; (+) strand; PAM type: YTN; PAM sequence: TTT
ctttgtttgcctttgcttat

SEQ ID NO: 72497 - DNA, 20 bp, Artificial Sequence
  Description of Artificial Sequence: Synthetic oligonucleotide
  Target: SCN10A; (+) strand; PAM type: YTN; PAM sequence: TTC
tttgtttgcctttgcttatg

SEQ ID NO: 72498 - DNA, 20 bp, Artificial Sequence
  Description of Artificial Sequence: Synthetic oligonucleotide
  Target: SCN10A; (+) strand; PAM type: YTN; PAM sequence: CTT
tgtttgcctttgcttatgtc

SEQ ID NO: 72499 - DNA, 20 bp, Artificial Sequence
  Description of Artificial Sequence: Synthetic oligonucleotide
  Target: SCN10A; (+) strand; PAM type: YTN; PAM sequence: TTT
gtttgcctttgcttatgtct

SEQ ID NO: 72500 - DNA, 20 bp, Artificial Sequence
  Description of Artificial Sequence: Synthetic oligonucleotide
  Target: SCN10A; (+) strand; PAM type: YTN; PAM sequence: TTG
tttgcctttgcttatgtctt

SEQ ID NO: 72501 - DNA, 20 bp, Artificial Sequence
  Description of Artificial Sequence: Synthetic oligonucleotide
  Target: SCN10A; (+) strand; PAM type: YTN; PAM sequence: TTT
gcctttgcttatgtcttttg

SEQ ID NO: 72502 - DNA, 20 bp, Artificial Sequence
  Description of Artificial Sequence: Synthetic oligonucleotide
  Target: SCN10A; (+) strand; PAM type: YTN; PAM sequence: TTG
cctttgcttatgtcttttga

SEQ ID NO: 72503 - DNA, 20 bp, Artificial Sequence
  Description of Artificial Sequence: Synthetic oligonucleotide
  Target: SCN10A; (+) strand; PAM type: YTN; PAM sequence: CTT
tgcttatgtcttttgaattc

SEQ ID NO: 72504 - DNA, 20 bp, Artificial Sequence
  Description of Artificial Sequence: Synthetic oligonucleotide
  Target: SCN10A; (+) strand; PAM type: YTN; PAM sequence: TTT
gcttatgtcttttgaattct

SEQ ID NO: 72505 - DNA, 20 bp, Artificial Sequence
  Description of Artificial Sequence: Synthetic oligonucleotide
  Target: SCN10A; (+) strand; PAM type: YTN; PAM sequence: TTG
cttatgtcttttgaattcta

SEQ ID NO: 72506 - DNA, 20 bp, Artificial Sequence
  Description of Artificial Sequence: Synthetic oligonucleotide
  Target: SCN10A; (+) strand; PAM type: YTN; PAM sequence: CTT
atgtcttttgaattctataa

SEQ ID NO: 72507 - DNA, 20 bp, Artificial Sequence
  Description of Artificial Sequence: Synthetic oligonucleotide
  Target: SCN10A; (+) strand; PAM type: YTN; PAM sequence: TTA
tgtcttttgaattctataat

SEQ ID NO: 72508 - DNA, 20 bp, Artificial Sequence
  Description of Artificial Sequence: Synthetic oligonucleotide
  Target: SCN10A; (+) strand; PAM type: YTN; PAM sequence: CTT
ttgaattctataattttagc

SEQ ID NO: 72509 - DNA, 20 bp, Artificial Sequence
  Description of Artificial Sequence: Synthetic oligonucleotide
  Target: SCN10A; (+) strand; PAM type: YTN; PAM sequence: TTT
tgaattctataattttagcc

SEQ ID NO: 72510 - DNA, 20 bp, Artificial Sequence
  Description of Artificial Sequence: Synthetic oligonucleotide
  Target: SCN10A; (+) strand; PAM type: YTN; PAM sequence: TTT
gaattctataattttagcct

SEQ ID NO: 72511 - DNA, 20 bp, Artificial Sequence
  Description of Artificial Sequence: Synthetic oligonucleotide
  Target: SCN10A; (+) strand; PAM type: YTN; PAM sequence: TTG
aattctataattttagcctt

SEQ ID NO: 72512 - DNA, 20 bp, Artificial Sequence
  Description of Artificial Sequence: Synthetic oligonucleotide
  Target: SCN10A; (+) strand; PAM type: YTN; PAM sequence: TTC
tataattttagcctttctgt

SEQ ID NO: 72513 - DNA, 20 bp, Artificial Sequence
  Description of Artificial Sequence: Synthetic oligonucleotide
  Target: SCN10A; (+) strand; PAM type: YTN; PAM sequence: CTA
taattttagcctttctgtat

SEQ ID NO: 72514 - DNA, 20 bp, Artificial Sequence
  Description of Artificial Sequence: Synthetic oligonucleotide
  Target: SCN10A; (+) strand; PAM type: YTN; PAM sequence: TTT
tagcctttctgtatcaccgt

SEQ ID NO: 72515 - DNA, 20 bp, Artificial Sequence
  Description of Artificial Sequence: Synthetic oligonucleotide
  Target: SCN10A; (+) strand; PAM type: YTN; PAM sequence: TTT
agcctttctgtatcaccgtg

SEQ ID NO: 72516 - DNA, 20 bp, Artificial Sequence
  Description of Artificial Sequence: Synthetic oligonucleotide
  Target: SCN10A; (+) strand; PAM type: YTN; PAM sequence: TTA
gcctttctgtatcaccgtga

SEQ ID NO: 72517 - DNA, 20 bp, Artificial Sequence
  Description of Artificial Sequence: Synthetic oligonucleotide
  Target: SCN10A; (+) strand; PAM type: YTN; PAM sequence: CTT
tctgtatcaccgtgaggagt

SEQ ID NO: 72518 - DNA, 20 bp, Artificial Sequence
  Description of Artificial Sequence: Synthetic oligonucleotide
  Target: SCN10A; (+) strand; PAM type: YTN; PAM sequence: TTT
ctgtatcaccgtgaggagta

SEQ ID NO: 72519 - DNA, 20 bp, Artificial Sequence
  Description of Artificial Sequence: Synthetic oligonucleotide
  Target: SCN10A; (+) strand; PAM type: YTN; PAM sequence: TTC
tgtatcaccgtgaggagtat

SEQ ID NO: 72520 - DNA, 20 bp, Artificial Sequence
  Description of Artificial Sequence: Synthetic oligonucleotide
  Target: SCN10A; (+) strand; PAM type: YTN; PAM sequence: CTG
tatcaccgtgaggagtattt

SEQ ID NO: 72521 - DNA, 20 bp, Artificial Sequence
  Description of Artificial Sequence: Synthetic oligonucleotide
  Target: SCN10A; (+) strand; PAM type: YTN; PAM sequence: TTT
tttttattcaacatagagtt

SEQ ID NO: 72522 - DNA, 20 bp, Artificial Sequence
  Description of Artificial Sequence: Synthetic oligonucleotide
  Target: SCN10A; (+) strand; PAM type: YTN; PAM sequence: TTT
ttttattcaacatagagttg

SEQ ID NO: 72523 - DNA, 20 bp, Artificial Sequence
  Description of Artificial Sequence: Synthetic oligonucleotide
  Target: SCN10A; (+) strand; PAM type: YTN; PAM sequence: TTT
tttattcaacatagagttgg

SEQ ID NO: 72524 - DNA, 20 bp, Artificial Sequence
  Description of Artificial Sequence: Synthetic oligonucleotide
  Target: SCN10A; (+) strand; PAM type: YTN; PAM sequence: TTT
ttattcaacatagagttggg

SEQ ID NO: 72525 - DNA, 20 bp, Artificial Sequence
  Description of Artificial Sequence: Synthetic oligonucleotide
  Target: SCN10A; (+) strand; PAM type: YTN; PAM sequence: TTT
tattcaacatagagttgggt

SEQ ID NO: 72526 - DNA, 20 bp, Artificial Sequence
  Description of Artificial Sequence: Synthetic oligonucleotide
  Target: SCN10A; (+) strand; PAM type: YTN; PAM sequence: TTT
attcaacatagagttgggta

SEQ ID NO: 72527 - DNA, 20 bp, Artificial Sequence
  Description of Artificial Sequence: Synthetic oligonucleotide
  Target: SCN10A; (+) strand; PAM type: YTN; PAM sequence: TTA
ttcaacatagagttgggtat

SEQ ID NO: 72528 - DNA, 20 bp, Artificial Sequence
  Description of Artificial Sequence: Synthetic oligonucleotide
  Target: SCN10A; (+) strand; PAM type: YTN; PAM sequence: TTC
aacatagagttgggtattgc

SEQ ID NO: 72529 - DNA, 20 bp, Artificial Sequence
  Description of Artificial Sequence: Synthetic oligonucleotide
  Target: SCN10A; (+) strand; PAM type: YTN; PAM sequence: TTG
ggtattgctttgtaatgtaa

SEQ ID NO: 72530 - DNA, 20 bp, Artificial Sequence
  Description of Artificial Sequence: Synthetic oligonucleotide
  Target: SCN10A; (+) strand; PAM type: YTN; PAM sequence: TTG
ctttgtaatgtaataggcat

SEQ ID NO: 72531 - DNA, 20 bp, Artificial Sequence
  Description of Artificial Sequence: Synthetic oligonucleotide
  Target: SCN10A; (+) strand; PAM type: YTN; PAM sequence: CTT
tgtaatgtaataggcatttt

SEQ ID NO: 72532 - DNA, 20 bp, Artificial Sequence
  Description of Artificial Sequence: Synthetic oligonucleotide
  Target: SCN10A; (+) strand; PAM type: YTN; PAM sequence: TTT
gtaatgtaataggcattttt

SEQ ID NO: 72533 - DNA, 20 bp, Artificial Sequence
  Description of Artificial Sequence: Synthetic oligonucleotide
  Target: SCN10A; (+) strand; PAM type: YTN; PAM sequence: TTG
taatgtaataggcattttta

SEQ ID NO: 72534 - DNA, 20 bp, Artificial Sequence
  Description of Artificial Sequence: Synthetic oligonucleotide
  Target: SCN10A; (+) strand; PAM type: YTN; PAM sequence: TTT
ttaaaaataggtgagtaaaa

SEQ ID NO: 72535 - DNA, 20 bp, Artificial Sequence
  Description of Artificial Sequence: Synthetic oligonucleotide
  Target: SCN10A; (+) strand; PAM type: YTN; PAM sequence: TTT
taaaaataggtgagtaaaat

SEQ ID NO: 72536 - DNA, 20 bp, Artificial Sequence
  Description of Artificial Sequence: Synthetic oligonucleotide
  Target: SCN10A; (+) strand; PAM type: YTN; PAM sequence: TTT
aaaaataggtgagtaaaatc

SEQ ID NO: 72537 - DNA, 20 bp, Artificial Sequence
  Description of Artificial Sequence: Synthetic oligonucleotide
  Target: SCN10A; (+) strand; PAM type: YTN; PAM sequence: TTA
aaaataggtgagtaaaatcc

SEQ ID NO: 72538 - DNA, 20 bp, Artificial Sequence
  Description of Artificial Sequence: Synthetic oligonucleotide
  Target: SCN10A; (+) strand; PAM type: YTN; PAM sequence: TTT
atatttagtgacatgacaga

SEQ ID NO: 72539 - DNA, 20 bp, Artificial Sequence
  Description of Artificial Sequence: Synthetic oligonucleotide
  Target: SCN10A; (+) strand; PAM type: YTN; PAM sequence: TTA
tatttagtgacatgacagat

SEQ ID NO: 72540 - DNA, 20 bp, Artificial Sequence
  Description of Artificial Sequence: Synthetic oligonucleotide
  Target: SCN10A; (+) strand; PAM type: YTN; PAM sequence: TTT
agtgacatgacagatttgct

SEQ ID NO: 72541 - DNA, 20 bp, Artificial Sequence
  Description of Artificial Sequence: Synthetic oligonucleotide
  Target: SCN10A; (+) strand; PAM type: YTN; PAM sequence: TTA
gtgacatgacagatttgctt

SEQ ID NO: 72542 - DNA, 20 bp, Artificial Sequence
  Description of Artificial Sequence: Synthetic oligonucleotide
  Target: SCN10A; (+) strand; PAM type: YTN; PAM sequence: TTT
gcttagtcttagcttgttta

SEQ ID NO: 72543 - DNA, 20 bp, Artificial Sequence
  Description of Artificial Sequence: Synthetic oligonucleotide
  Target: SCN10A; (+) strand; PAM type: YTN; PAM sequence: TTG
cttagtcttagcttgtttat

SEQ ID NO: 72544 - DNA, 20 bp, Artificial Sequence
  Description of Artificial Sequence: Synthetic oligonucleotide
  Target: SCN10A; (+) strand; PAM type: YTN; PAM sequence: CTT
agtcttagcttgtttatatt

SEQ ID NO: 72545 - DNA, 20 bp, Artificial Sequence
  Description of Artificial Sequence: Synthetic oligonucleotide
  Target: SCN10A; (+) strand; PAM type: YTN; PAM sequence: TTA
gtcttagcttgtttatatta

SEQ ID NO: 72546 - DNA, 20 bp, Artificial Sequence
  Description of Artificial Sequence: Synthetic oligonucleotide
  Target: SCN10A; (+) strand; PAM type: YTN; PAM sequence: CTT
agcttgtttatattatttca

SEQ ID NO: 72547 - DNA, 20 bp, Artificial Sequence
  Description of Artificial Sequence: Synthetic oligonucleotide
  Target: SCN10A; (+) strand; PAM type: YTN; PAM sequence: TTA
gcttgtttatattatttcat

SEQ ID NO: 72548 - DNA, 20 bp, Artificial Sequence
  Description of Artificial Sequence: Synthetic oligonucleotide
  Target: SCN10A; (+) strand; PAM type: YTN; PAM sequence: CTT
gtttatattatttcatatga

SEQ ID NO: 72549 - DNA, 20 bp, Artificial Sequence
  Description of Artificial Sequence: Synthetic oligonucleotide
  Target: SCN10A; (+) strand; PAM type: YTN; PAM sequence: TTG
tttatattatttcatatgac

SEQ ID NO: 72550 - DNA, 20 bp, Artificial Sequence
  Description of Artificial Sequence: Synthetic oligonucleotide
  Target: SCN10A; (+) strand; PAM type: YTN; PAM sequence: TTT
atattatttcatatgacgta

SEQ ID NO: 72551 - DNA, 20 bp, Artificial Sequence
  Description of Artificial Sequence: Synthetic oligonucleotide
  Target: SCN10A; (+) strand; PAM type: YTN; PAM sequence: TTA
tattatttcatatgacgtat

SEQ ID NO: 72552 - DNA, 20 bp, Artificial Sequence
  Description of Artificial Sequence: Synthetic oligonucleotide
  Target: SCN10A; (+) strand; PAM type: YTN; PAM sequence: TTA
tttcatatgacgtatttagt

SEQ ID NO: 72553 - DNA, 20 bp, Artificial Sequence
  Description of Artificial Sequence: Synthetic oligonucleotide
  Target: SCN10A; (+) strand; PAM type: YTN; PAM sequence: TTT
catatgacgtatttagtttt

SEQ ID NO: 72554 - DNA, 20 bp, Artificial Sequence
  Description of Artificial Sequence: Synthetic oligonucleotide
  Target: SCN10A; (+) strand; PAM type: YTN; PAM sequence: TTC
atatgacgtatttagttttt

SEQ ID NO: 72555 - DNA, 20 bp, Artificial Sequence
  Description of Artificial Sequence: Synthetic oligonucleotide
  Target: SCN10A; (+) strand; PAM type: YTN; PAM sequence: TTT
agtttttaaaatattaggtt

SEQ ID NO: 72556 - DNA, 20 bp, Artificial Sequence
  Description of Artificial Sequence: Synthetic oligonucleotide
  Target: SCN10A; (+) strand; PAM type: YTN; PAM sequence: TTA
gtttttaaaatattaggttg

SEQ ID NO: 72557 - DNA, 20 bp, Artificial Sequence
  Description of Artificial Sequence: Synthetic oligonucleotide
  Target: SCN10A; (+) strand; PAM type: YTN; PAM sequence: TTT
ttaaaatattaggttggtac

SEQ ID NO: 72558 - DNA, 20 bp, Artificial Sequence
  Description of Artificial Sequence: Synthetic oligonucleotide
  Target: SCN10A; (+) strand; PAM type: YTN; PAM sequence: TTT
taaaatattaggttggtaca

SEQ ID NO: 72559 - DNA, 20 bp, Artificial Sequence
  Description of Artificial Sequence: Synthetic oligonucleotide
  Target: SCN10A; (+) strand; PAM type: YTN; PAM sequence: TTT
aaaatattaggttggtacaa

SEQ ID NO: 72560 - DNA, 20 bp, Artificial Sequence
  Description of Artificial Sequence: Synthetic oligonucleotide
  Target: SCN10A; (+) strand; PAM type: YTN; PAM sequence: TTA
aaatattaggttggtacaaa

SEQ ID NO: 72561 - DNA, 20 bp, Artificial Sequence
  Description of Artificial Sequence: Synthetic oligonucleotide
  Target: SCN10A; (+) strand; PAM type: YTN; PAM sequence: TTA
ggttggtacaaaagtaattg

SEQ ID NO: 72562 - DNA, 20 bp, Artificial Sequence
  Description of Artificial Sequence: Synthetic oligonucleotide
  Target: SCN10A; (+) strand; PAM type: YTN; PAM sequence: TTG
gtacaaaagtaattgtggtt

SEQ ID NO: 72563 - DNA, 20 bp, Artificial Sequence
  Description of Artificial Sequence: Synthetic oligonucleotide
  Target: SCN10A; (+) strand; PAM type: YTN; PAM sequence: TTG
tggtttttgcattgttgaaa

SEQ ID NO: 72564 - DNA, 20 bp, Artificial Sequence
  Description of Artificial Sequence: Synthetic oligonucleotide
  Target: SCN10A; (+) strand; PAM type: YTN; PAM sequence: TTT
ttgcattgttgaaatttgcc

SEQ ID NO: 72565 - DNA, 20 bp, Artificial Sequence
  Description of Artificial Sequence: Synthetic oligonucleotide
  Target: SCN10A; (+) strand; PAM type: YTN; PAM sequence: TTT
tgcattgttgaaatttgccg

SEQ ID NO: 72566 - DNA, 20 bp, Artificial Sequence
  Description of Artificial Sequence: Synthetic oligonucleotide
  Target: SCN10A; (+) strand; PAM type: YTN; PAM sequence: TTT
gcattgttgaaatttgccgt

SEQ ID NO: 72567 - DNA, 20 bp, Artificial Sequence
  Description of Artificial Sequence: Synthetic oligonucleotide
  Target: SCN10A; (+) strand; PAM type: YTN; PAM sequence: TTG
cattgttgaaatttgccgtt

SEQ ID NO: 72568 - DNA, 20 bp, Artificial Sequence
  Description of Artificial Sequence: Synthetic oligonucleotide
  Target: SCN10A; (+) strand; PAM type: YTN; PAM sequence: TTG
ttgaaatttgccgtttgata

SEQ ID NO: 72569 - DNA, 20 bp, Artificial Sequence
  Description of Artificial Sequence: Synthetic oligonucleotide
  Target: SCN10A; (+) strand; PAM type: YTN; PAM sequence: TTG
aaatttgccgtttgatattg

SEQ ID NO: 72570 - DNA, 20 bp, Artificial Sequence
  Description of Artificial Sequence: Synthetic oligonucleotide
  Target: SCN10A; (+) strand; PAM type: YTN; PAM sequence: TTT
gccgtttgatattggaatac

SEQ ID NO: 72571 - DNA, 20 bp, Artificial Sequence
  Description of Artificial Sequence: Synthetic oligonucleotide
  Target: SCN10A; (+) strand; PAM type: YTN; PAM sequence: TTG
ccgtttgatattggaataca

SEQ ID NO: 72572 - DNA, 20 bp, Artificial Sequence
  Description of Artificial Sequence: Synthetic oligonucleotide
  Target: SCN10A; (+) strand; PAM type: YTN; PAM sequence: TTT
gatattggaatacattctta

SEQ ID NO: 72573 - DNA, 20 bp, Artificial Sequence
  Description of Artificial Sequence: Synthetic oligonucleotide
  Target: SCN10A; (+) strand; PAM type: YTN; PAM sequence: TTG
atattggaatacattcttaa

SEQ ID NO: 72574 - DNA, 20 bp, Artificial Sequence
  Description of Artificial Sequence: Synthetic oligonucleotide
  Target: SCN10A; (+) strand; PAM type: YTN; PAM sequence: TTG
gaatacattcttaaataaat

SEQ ID NO: 72575 - DNA, 20 bp, Artificial Sequence
  Description of Artificial Sequence: Synthetic oligonucleotide
  Target: SCN10A; (+) strand; PAM type: YTN; PAM sequence: TTC
ttaaataaatgtgaccatgt

SEQ ID NO: 72576 - DNA, 20 bp, Artificial Sequence
  Description of Artificial Sequence: Synthetic oligonucleotide
  Target: SCN10A; (+) strand; PAM type: YTN; PAM sequence: CTT
aaataaatgtgaccatgtta

SEQ ID NO: 72577 - DNA, 20 bp, Artificial Sequence
  Description of Artificial Sequence: Synthetic oligonucleotide
  Target: SCN10A; (+) strand; PAM type: YTN; PAM sequence: TTA
aataaatgtgaccatgttat

SEQ ID NO: 72578 - DNA, 20 bp, Artificial Sequence
  Description of Artificial Sequence: Synthetic oligonucleotide
  Target: SCN10A; (+) strand; PAM type: YTN; PAM sequence: TTA
tacatcattttaatgtgcat

SEQ ID NO: 72579 - DNA, 20 bp, Artificial Sequence
  Description of Artificial Sequence: Synthetic oligonucleotide
  Target: SCN10A; (+) strand; PAM type: YTN; PAM sequence: TTT
taatgtgcatttctcacttt

SEQ ID NO: 72580 - DNA, 20 bp, Artificial Sequence
  Description of Artificial Sequence: Synthetic oligonucleotide
  Target: SCN10A; (+) strand; PAM type: YTN; PAM sequence: TTT
aatgtgcatttctcactttt

SEQ ID NO: 72581 - DNA, 20 bp, Artificial Sequence
  Description of Artificial Sequence: Synthetic oligonucleotide
  Target: SCN10A; (+) strand; PAM type: YTN; PAM sequence: TTA
atgtgcatttctcacttttt

SEQ ID NO: 72582 - DNA, 20 bp, Artificial Sequence
  Description of Artificial Sequence: Synthetic oligonucleotide
  Target: SCN10A; (+) strand; PAM type: YTN; PAM sequence: TTT
ctcacttttttttttgctaa

SEQ ID NO: 72583 - DNA, 20 bp, Artificial Sequence
  Description of Artificial Sequence: Synthetic oligonucleotide
  Target: SCN10A; (+) strand; PAM type: YTN; PAM sequence: TTC
tcacttttttttttgctaat

SEQ ID NO: 72584 - DNA, 20 bp, Artificial Sequence
  Description of Artificial Sequence: Synthetic oligonucleotide
  Target: SCN10A; (+) strand; PAM type: YTN; PAM sequence: CTC
acttttttttttgctaatga

SEQ ID NO: 72585 - DNA, 20 bp, Artificial Sequence
  Description of Artificial Sequence: Synthetic oligonucleotide
  Target: SCN10A; (+) strand; PAM type: YTN; PAM sequence: CTT
ttttttttgctaatgactta

SEQ ID NO: 72586 - DNA, 20 bp, Artificial Sequence
  Description of Artificial Sequence: Synthetic oligonucleotide
  Target: SCN10A; (+) strand; PAM type: YTN; PAM sequence: TTT
tttttttgctaatgacttat

SEQ ID NO: 72587 - DNA, 20 bp, Artificial Sequence
  Description of Artificial Sequence: Synthetic oligonucleotide
  Target: SCN10A; (+) strand; PAM type: YTN; PAM sequence: TTT
ttttttgctaatgacttatt

SEQ ID NO: 72588 - DNA, 20 bp, Artificial Sequence
  Description of Artificial Sequence: Synthetic oligonucleotide
  Target: SCN10A; (+) strand; PAM type: YTN; PAM sequence: TTT
tttttgctaatgacttatta

SEQ ID NO: 72589 - DNA, 20 bp, Artificial Sequence
  Description of Artificial Sequence: Synthetic oligonucleotide
  Target: SCN10A; (+) strand; PAM type: YTN; PAM sequence: TTT
ttttgctaatgacttattac

SEQ ID NO: 72590 - DNA, 20 bp, Artificial Sequence
  Description of Artificial Sequence: Synthetic oligonucleotide
  Target: SCN10A; (+) strand; PAM type: YTN; PAM sequence: TTT
tttgctaatgacttattact

SEQ ID NO: 72591 - DNA, 20 bp, Artificial Sequence
  Description of Artificial Sequence: Synthetic oligonucleotide
  Target: SCN10A; (+) strand; PAM type: YTN; PAM sequence: TTT
ttgctaatgacttattactt

SEQ ID NO: 72592 - DNA, 20 bp, Artificial Sequence
  Description of Artificial Sequence: Synthetic oligonucleotide
  Target: SCN10A; (+) strand; PAM type: YTN; PAM sequence: TTT
tgctaatgacttattacttg

SEQ ID NO: 72593 - DNA, 20 bp, Artificial Sequence
  Description of Artificial Sequence: Synthetic oligonucleotide
  Target: SCN10A; (+) strand; PAM type: YTN; PAM sequence: TTT
gctaatgacttattacttgc

SEQ ID NO: 72594 - DNA, 20 bp, Artificial Sequence
  Description of Artificial Sequence: Synthetic oligonucleotide
  Target: SCN10A; (+) strand; PAM type: YTN; PAM sequence: TTG
ctaatgacttattacttgct

SEQ ID NO: 72595 - DNA, 20 bp, Artificial Sequence
  Description of Artificial Sequence: Synthetic oligonucleotide
  Target: SCN10A; (+) strand; PAM type: YTN; PAM sequence: CTA
atgacttattacttgctgtt

SEQ ID NO: 72596 - DNA, 20 bp, Artificial Sequence
  Description of Artificial Sequence: Synthetic oligonucleotide
  Target: SCN10A; (+) strand; PAM type: YTN; PAM sequence: CTT
attacttgctgtttatttta

SEQ ID NO: 72597 - DNA, 20 bp, Artificial Sequence
  Description of Artificial Sequence: Synthetic oligonucleotide
  Target: SCN10A; (+) strand; PAM type: YTN; PAM sequence: TTA
ttacttgctgtttattttat

SEQ ID NO: 72598 - DNA, 20 bp, Artificial Sequence
  Description of Artificial Sequence: Synthetic oligonucleotide
  Target: SCN10A; (+) strand; PAM type: YTN; PAM sequence: TTA
cttgctgtttattttatatt

SEQ ID NO: 72599 - DNA, 20 bp, Artificial Sequence
  Description of Artificial Sequence: Synthetic oligonucleotide
  Target: SCN10A; (+) strand; PAM type: YTN; PAM sequence: CTT
gctgtttattttatatttat

SEQ ID NO: 72600 - DNA, 20 bp, Artificial Sequence
  Description of Artificial Sequence: Synthetic oligonucleotide
  Target: SCN10A; (+) strand; PAM type: YTN; PAM sequence: TTG
ctgtttattttatatttatt

SEQ ID NO: 72601 - DNA, 20 bp, Artificial Sequence
  Description of Artificial Sequence: Synthetic oligonucleotide
  Target: SCN10A; (+) strand; PAM type: YTN; PAM sequence: CTG
tttattttatatttatttta

SEQ ID NO: 72602 - DNA, 20 bp, Artificial Sequence
  Description of Artificial Sequence: Synthetic oligonucleotide
  Target: SCN10A; (+) strand; PAM type: YTN; PAM sequence: TTT
attttatatttattttagac

SEQ ID NO: 72603 - DNA, 20 bp, Artificial Sequence
  Description of Artificial Sequence: Synthetic oligonucleotide
  Target: SCN10A; (+) strand; PAM type: YTN; PAM sequence: TTA
ttttatatttattttagact

SEQ ID NO: 72604 - DNA, 20 bp, Artificial Sequence
  Description of Artificial Sequence: Synthetic oligonucleotide
  Target: SCN10A; (+) strand; PAM type: YTN; PAM sequence: TTT
tatatttattttagactatg

SEQ ID NO: 72605 - DNA, 20 bp, Artificial Sequence
  Description of Artificial Sequence: Synthetic oligonucleotide
  Target: SCN10A; (+) strand; PAM type: YTN; PAM sequence: TTT
atatttattttagactatgg

SEQ ID NO: 72606 - DNA, 20 bp, Artificial Sequence
  Description of Artificial Sequence: Synthetic oligonucleotide
  Target: SCN10A; (+) strand; PAM type: YTN; PAM sequence: TTA
tatttattttagactatgga

SEQ ID NO: 72607 - DNA, 20 bp, Artificial Sequence
  Description of Artificial Sequence: Synthetic oligonucleotide
  Target: SCN10A; (+) strand; PAM type: YTN; PAM sequence: TTT
attttagactatggaaatta

SEQ ID NO: 72608 - DNA, 20 bp, Artificial Sequence
  Description of Artificial Sequence: Synthetic oligonucleotide
  Target: SCN10A; (+) strand; PAM type: YTN; PAM sequence: TTA
ttttagactatggaaattat

SEQ ID NO: 72609 - DNA, 20 bp, Artificial Sequence
  Description of Artificial Sequence: Synthetic oligonucleotide
  Target: SCN10A; (+) strand; PAM type: YTN; PAM sequence: TTT
tagactatggaaattatgtt

SEQ ID NO: 72610 - DNA, 20 bp, Artificial Sequence
  Description of Artificial Sequence: Synthetic oligonucleotide
  Target: SCN10A; (+) strand; PAM type: YTN; PAM sequence: TTT
agactatggaaattatgtta

SEQ ID NO: 72611 - DNA, 20 bp, Artificial Sequence
  Description of Artificial Sequence: Synthetic oligonucleotide
  Target: SCN10A; (+) strand; PAM type: YTN; PAM sequence: TTA
gactatggaaattatgttat

SEQ ID NO: 72612 - DNA, 20 bp, Artificial Sequence
  Description of Artificial Sequence: Synthetic oligonucleotide
  Target: SCN10A; (+) strand; PAM type: YTN; PAM sequence: CTA
tggaaattatgttatacaaa

SEQ ID NO: 72613 - DNA, 20 bp, Artificial Sequence
  Description of Artificial Sequence: Synthetic oligonucleotide
  Target: SCN10A; (+) strand; PAM type: YTN; PAM sequence: TTA
tgttatacaaaaagcaaatt

SEQ ID NO: 72614 - DNA, 20 bp, Artificial Sequence
  Description of Artificial Sequence: Synthetic oligonucleotide
  Target: SCN10A; (+) strand; PAM type: YTN; PAM sequence: TTA
tacaaaaagcaaattcgagc

SEQ ID NO: 72615 - DNA, 20 bp, Artificial Sequence
  Description of Artificial Sequence: Synthetic oligonucleotide
  Target: SCN10A; (+) strand; PAM type: YTN; PAM sequence: TTC
gagcgattttcttatttgag

SEQ ID NO: 72616 - DNA, 20 bp, Artificial Sequence
  Description of Artificial Sequence: Synthetic oligonucleotide
  Target: SCN10A; (+) strand; PAM type: YTN; PAM sequence: TTT
tcttatttgagttcaaaatg

SEQ ID NO: 72617 - DNA, 20 bp, Artificial Sequence
  Description of Artificial Sequence: Synthetic oligonucleotide
  Target: SCN10A; (+) strand; PAM type: YTN; PAM sequence: TTT
cttatttgagttcaaaatgg

SEQ ID NO: 72618 - DNA, 20 bp, Artificial Sequence
  Description of Artificial Sequence: Synthetic oligonucleotide
  Target: SCN10A; (+) strand; PAM type: YTN; PAM sequence: TTC
ttatttgagttcaaaatggg

SEQ ID NO: 72619 - DNA, 20 bp, Artificial Sequence
  Description of Artificial Sequence: Synthetic oligonucleotide
  Target: SCN10A; (+) strand; PAM type: YTN; PAM sequence: CTT
atttgagttcaaaatgggtt

SEQ ID NO: 72620 - DNA, 20 bp, Artificial Sequence
  Description of Artificial Sequence: Synthetic oligonucleotide
  Target: SCN10A; (+) strand; PAM type: YTN; PAM sequence: TTA
tttgagttcaaaatgggttg

SEQ ID NO: 72621 - DNA, 20 bp, Artificial Sequence
  Description of Artificial Sequence: Synthetic oligonucleotide
  Target: SCN10A; (+) strand; PAM type: YTN; PAM sequence: TTT
gagttcaaaatgggttgtaa

SEQ ID NO: 72622 - DNA, 20 bp, Artificial Sequence
  Description of Artificial Sequence: Synthetic oligonucleotide
  Target: SCN10A; (+) strand; PAM type: YTN; PAM sequence: TTG
agttcaaaatgggttgtaaa

SEQ ID NO: 72623 - DNA, 20 bp, Artificial Sequence
  Description of Artificial Sequence: Synthetic oligonucleotide
  Target: SCN10A; (+) strand; PAM type: YTN; PAM sequence: TTC
aaaatgggttgtaaagcagc

SEQ ID NO: 72624 - DNA, 20 bp, Artificial Sequence
  Description of Artificial Sequence: Synthetic oligonucleotide
  Target: SCN10A; (+) strand; PAM type: YTN; PAM sequence: TTG
taaagcagcagagacaactc

SEQ ID NO: 72625 - DNA, 20 bp, Artificial Sequence
  Description of Artificial Sequence: Synthetic oligonucleotide
  Target: SCN10A; (+) strand; PAM type: YTN; PAM sequence: CTC
aacatcaacaacgcatttgg

SEQ ID NO: 72626 - DNA, 20 bp, Artificial Sequence
  Description of Artificial Sequence: Synthetic oligonucleotide
  Target: SCN10A; (+) strand; PAM type: YTN; PAM sequence: TTT
ggcccagggattgctaacaa

SEQ ID NO: 72627 - DNA, 20 bp, Artificial Sequence
  Description of Artificial Sequence: Synthetic oligonucleotide
  Target: SCN10A; (+) strand; PAM type: YTN; PAM sequence: TTG
gcccagggattgctaacaaa

SEQ ID NO: 72628 - DNA, 20 bp, Artificial Sequence
  Description of Artificial Sequence: Synthetic oligonucleotide
  Target: SCN10A; (+) strand; PAM type: YTN; PAM sequence: TTG
ctaacaaaggtacagtgcag

SEQ ID NO: 72629 - DNA, 20 bp, Artificial Sequence
  Description of Artificial Sequence: Synthetic oligonucleotide
  Target: SCN10A; (+) strand; PAM type: YTN; PAM sequence: CTA
acaaaggtacagtgcagtgg

SEQ ID NO: 72630 - DNA, 20 bp, Artificial Sequence
  Description of Artificial Sequence: Synthetic oligonucleotide
  Target: SCN10A; (+) strand; PAM type: YTN; PAM sequence: TTC
aagaagttttgcaaaggaga

SEQ ID NO: 72631 - DNA, 20 bp, Artificial Sequence
  Description of Artificial Sequence: Synthetic oligonucleotide
  Target: SCN10A; (+) strand; PAM type: YTN; PAM sequence: TTT
tgcaaaggagatgagaacct

SEQ ID NO: 72632 - DNA, 20 bp, Artificial Sequence
  Description of Artificial Sequence: Synthetic oligonucleotide
  Target: SCN10A; (+) strand; PAM type: YTN; PAM sequence: TTT
gcaaaggagatgagaacctt

SEQ ID NO: 72633 - DNA, 20 bp, Artificial Sequence
  Description of Artificial Sequence: Synthetic oligonucleotide
  Target: SCN10A; (+) strand; PAM type: YTN; PAM sequence: TTG
caaaggagatgagaaccttg

SEQ ID NO: 72634 - DNA, 20 bp, Artificial Sequence
  Description of Artificial Sequence: Synthetic oligonucleotide
  Target: SCN10A; (+) strand; PAM type: YTN; PAM sequence: CTT
gaagatgaggagagtagtgg

SEQ ID NO: 72635 - DNA, 20 bp, Artificial Sequence
  Description of Artificial Sequence: Synthetic oligonucleotide
  Target: SCN10A; (+) strand; PAM type: YTN; PAM sequence: TTG
aagatgaggagagtagtggc

SEQ ID NO: 72636 - DNA, 20 bp, Artificial Sequence
  Description of Artificial Sequence: Synthetic oligonucleotide
  Target: SCN10A; (+) strand; PAM type: YTN; PAM sequence: CTG
gccattggaagttgacaatg

SEQ ID NO: 72637 - DNA, 20 bp, Artificial Sequence
  Description of Artificial Sequence: Synthetic oligonucleotide
  Target: SCN10A; (+) strand; PAM type: YTN; PAM sequence: TTG
gaagttgacaatgaccaatt

SEQ ID NO: 72638 - DNA, 20 bp, Artificial Sequence
  Description of Artificial Sequence: Synthetic oligonucleotide
  Target: SCN10A; (+) strand; PAM type: YTN; PAM sequence: TTG
acaatgaccaattgagagca

SEQ ID NO: 72639 - DNA, 20 bp, Artificial Sequence
  Description of Artificial Sequence: Synthetic oligonucleotide
  Target: SCN10A; (+) strand; PAM type: YTN; PAM sequence: TTG
agagcaatcatcgaagttga

SEQ ID NO: 72640 - DNA, 20 bp, Artificial Sequence
  Description of Artificial Sequence: Synthetic oligonucleotide
  Target: SCN10A; (+) strand; PAM type: YTN; PAM sequence: TTG
atcctcttacaactgcacaa

SEQ ID NO: 72641 - DNA, 20 bp, Artificial Sequence
  Description of Artificial Sequence: Synthetic oligonucleotide
  Target: SCN10A; (+) strand; PAM type: YTN; PAM sequence: CTC
ttacaactgcacaagaagct

SEQ ID NO: 72642 - DNA, 20 bp, Artificial Sequence
  Description of Artificial Sequence: Synthetic oligonucleotide
  Target: SCN10A; (+) strand; PAM type: YTN; PAM sequence: CTT
acaactgcacaagaagctga

SEQ ID NO: 72643 - DNA, 20 bp, Artificial Sequence
  Description of Artificial Sequence: Synthetic oligonucleotide
  Target: SCN10A; (+) strand; PAM type: YTN; PAM sequence: TTA
caactgcacaagaagctgag

SEQ ID NO: 72644 - DNA, 20 bp, Artificial Sequence
  Description of Artificial Sequence: Synthetic oligonucleotide
  Target: SCN10A; (+) strand; PAM type: YTN; PAM sequence: CTG
cacaagaagctgaggaagaa

SEQ ID NO: 72645 - DNA, 20 bp, Artificial Sequence
  Description of Artificial Sequence: Synthetic oligonucleotide
  Target: SCN10A; (+) strand; PAM type: YTN; PAM sequence: CTG
aggaagaactcatcgttgac

SEQ ID NO: 72646 - DNA, 20 bp, Artificial Sequence
  Description of Artificial Sequence: Synthetic oligonucleotide
  Target: SCN10A; (+) strand; PAM type: YTN; PAM sequence: CTC
atcgttgaccattctacggt

SEQ ID NO: 72647 - DNA, 20 bp, Artificial Sequence
  Description of Artificial Sequence: Synthetic oligonucleotide
  Target: SCN10A; (+) strand; PAM type: YTN; PAM sequence: TTG
accattctacggtcattcgg

SEQ ID NO: 72648 - DNA, 20 bp, Artificial Sequence
  Description of Artificial Sequence: Synthetic oligonucleotide
  Target: SCN10A; (+) strand; PAM type: YTN; PAM sequence: TTC
tacggtcattcggcagttga

SEQ ID NO: 72649 - DNA, 20 bp, Artificial Sequence
  Description of Artificial Sequence: Synthetic oligonucleotide
  Target: SCN10A; (+) strand; PAM type: YTN; PAM sequence: CTA
cggtcattcggcagttgaag

SEQ ID NO: 72650 - DNA, 20 bp, Artificial Sequence
  Description of Artificial Sequence: Synthetic oligonucleotide
  Target: SCN10A; (+) strand; PAM type: YTN; PAM sequence: TTC
ggcagttgaagcaaattgga

SEQ ID NO: 72651 - DNA, 20 bp, Artificial Sequence
  Description of Artificial Sequence: Synthetic oligonucleotide
  Target: SCN10A; (+) strand; PAM type: YTN; PAM sequence: TTG
aagcaaattggaaaggtgaa

SEQ ID NO: 72652 - DNA, 20 bp, Artificial Sequence
  Description of Artificial Sequence: Synthetic oligonucleotide
  Target: SCN10A; (+) strand; PAM type: YTN; PAM sequence: TTG
gaaaggtgaaacagctccat

SEQ ID NO: 72653 - DNA, 20 bp, Artificial Sequence
  Description of Artificial Sequence: Synthetic oligonucleotide
  Target: SCN10A; (+) strand; PAM type: YTN; PAM sequence: CTC
cataaatgggtgcctcataa

SEQ ID NO: 72654 - DNA, 20 bp, Artificial Sequence
  Description of Artificial Sequence: Synthetic oligonucleotide
  Target: SCN10A; (+) strand; PAM type: YTN; PAM sequence: CTC
ataagctaaggaaaaatgtt

SEQ ID NO: 72655 - DNA, 20 bp, Artificial Sequence
  Description of Artificial Sequence: Synthetic oligonucleotide
  Target: SCN10A; (+) strand; PAM type: YTN; PAM sequence: CTA
aggaaaaatgtttaaaaaat

SEQ ID NO: 72656 - DNA, 20 bp, Artificial Sequence
  Description of Artificial Sequence: Synthetic oligonucleotide
  Target: SCN10A; (+) strand; PAM type: YTN; PAM sequence: TTT
aaaaaatcgtcattttgaag

SEQ ID NO: 72657 - DNA, 20 bp, Artificial Sequence
  Description of Artificial Sequence: Synthetic oligonucleotide
  Target: SCN10A; (+) strand; PAM type: YTN; PAM sequence: TTA
aaaaatcgtcattttgaagt

SEQ ID NO: 72658 - DNA, 20 bp, Artificial Sequence
  Description of Artificial Sequence: Synthetic oligonucleotide
  Target: SCN10A; (+) strand; PAM type: YTN; PAM sequence: TTT
tgaagtgttgtcgtctctta

SEQ ID NO: 72659 - DNA, 20 bp, Artificial Sequence
  Description of Artificial Sequence: Synthetic oligonucleotide
  Target: SCN10A; (+) strand; PAM type: YTN; PAM sequence: TTT
gaagtgttgtcgtctcttat

SEQ ID NO: 72660 - DNA, 20 bp, Artificial Sequence
  Description of Artificial Sequence: Synthetic oligonucleotide
  Target: SCN10A; (+) strand; PAM type: YTN; PAM sequence: TTG
aagtgttgtcgtctcttatt

SEQ ID NO: 72661 - DNA, 20 bp, Artificial Sequence
  Description of Artificial Sequence: Synthetic oligonucleotide
  Target: SCN10A; (+) strand; PAM type: YTN; PAM sequence: TTG
tcgtctcttattctatgcaa

SEQ ID NO: 72662 - DNA, 20 bp, Artificial Sequence
  Description of Artificial Sequence: Synthetic oligonucleotide
  Target: SCN10A; (+) strand; PAM type: YTN; PAM sequence: CTC
ttattctatgcaacaaaaat

SEQ ID NO: 72663 - DNA, 20 bp, Artificial Sequence
  Description of Artificial Sequence: Synthetic oligonucleotide
  Target: SCN10A; (+) strand; PAM type: YTN; PAM sequence: CTT
attctatgcaacaaaaatga

SEQ ID NO: 72664 - DNA, 20 bp, Artificial Sequence
  Description of Artificial Sequence: Synthetic oligonucleotide
  Target: SCN10A; (+) strand; PAM type: YTN; PAM sequence: TTA
ttctatgcaacaaaaatgaa

SEQ ID NO: 72665 - DNA, 20 bp, Artificial Sequence
  Description of Artificial Sequence: Synthetic oligonucleotide
  Target: SCN10A; (+) strand; PAM type: YTN; PAM sequence: TTC
tatgcaacaaaaatgaacta

SEQ ID NO: 72666 - DNA, 20 bp, Artificial Sequence
  Description of Artificial Sequence: Synthetic oligonucleotide
  Target: SCN10A; (+) strand; PAM type: YTN; PAM sequence: CTA
tgcaacaaaaatgaactatt

SEQ ID NO: 72667 - DNA, 20 bp, Artificial Sequence
  Description of Artificial Sequence: Synthetic oligonucleotide
  Target: SCN10A; (+) strand; PAM type: YTN; PAM sequence: CTA
tttcttaatcagattgtgat

SEQ ID NO: 72668 - DNA, 20 bp, Artificial Sequence
  Description of Artificial Sequence: Synthetic oligonucleotide
  Target: SCN10A; (+) strand; PAM type: YTN; PAM sequence: TTT
cttaatcagattgtgatgtg

SEQ ID NO: 72669 - DNA, 20 bp, Artificial Sequence
  Description of Artificial Sequence: Synthetic oligonucleotide
  Target: SCN10A; (+) strand; PAM type: YTN; PAM sequence: TTC
ttaatcagattgtgatgtgc

SEQ ID NO: 72670 - DNA, 20 bp, Artificial Sequence
  Description of Artificial Sequence: Synthetic oligonucleotide
  Target: SCN10A; (+) strand; PAM type: YTN; PAM sequence: CTT
aatcagattgtgatgtgcga

SEQ ID NO: 72671 - DNA, 20 bp, Artificial Sequence
  Description of Artificial Sequence: Synthetic oligonucleotide
  Target: SCN10A; (+) strand; PAM type: YTN; PAM sequence: TTA
atcagattgtgatgtgcgat

SEQ ID NO: 72672 - DNA, 20 bp, Artificial Sequence
  Description of Artificial Sequence: Synthetic oligonucleotide
  Target: SCN10A; (+) strand; PAM type: YTN; PAM sequence: TTG
tgatgtgcgataaaaagtga

SEQ ID NO: 72673 - DNA, 20 bp, Artificial Sequence
  Description of Artificial Sequence: Synthetic oligonucleotide
  Target: SCN10A; (+) strand; PAM type: YTN; PAM sequence: TTT
tacttgacaactggcaatga

SEQ ID NO: 72674 - DNA, 20 bp, Artificial Sequence
  Description of Artificial Sequence: Synthetic oligonucleotide
  Target: SCN10A; (+) strand; PAM type: YTN; PAM sequence: TTT
acttgacaactggcaatgac

SEQ ID NO: 72675 - DNA, 20 bp, Artificial Sequence
  Description of Artificial Sequence: Synthetic oligonucleotide
  Target: SCN10A; (+) strand; PAM type: YTN; PAM sequence: TTA
cttgacaactggcaatgacc

SEQ ID NO: 72676 - DNA, 20 bp, Artificial Sequence
  Description of Artificial Sequence: Synthetic oligonucleotide
  Target: SCN10A; (+) strand; PAM type: YTN; PAM sequence: CTT
gacaactggcaatgaccagc

SEQ ID NO: 72677 - DNA, 20 bp, Artificial Sequence
  Description of Artificial Sequence: Synthetic oligonucleotide
  Target: SCN10A; (+) strand; PAM type: YTN; PAM sequence: TTG
acaactggcaatgaccagct

SEQ ID NO: 72678 - DNA, 20 bp, Artificial Sequence
  Description of Artificial Sequence: Synthetic oligonucleotide
  Target: SCN10A; (+) strand; PAM type: YTN; PAM sequence: CTG
gcaatgaccagcttggtggc

SEQ ID NO: 72679 - DNA, 20 bp, Artificial Sequence
  Description of Artificial Sequence: Synthetic oligonucleotide
  Target: SCN10A; (+) strand; PAM type: YTN; PAM sequence: CTT
ggtggctggactgagaagaa

SEQ ID NO: 72680 - DNA, 20 bp, Artificial Sequence
  Description of Artificial Sequence: Synthetic oligonucleotide
  Target: SCN10A; (+) strand; PAM type: YTN; PAM sequence: TTG
gtggctggactgagaagaag

SEQ ID NO: 72681 - DNA, 20 bp, Artificial Sequence
  Description of Artificial Sequence: Synthetic oligonucleotide
  Target: SCN10A; (+) strand; PAM type: YTN; PAM sequence: CTG
gactgagaagaagctccaaa

SEQ ID NO: 72682 - DNA, 20 bp, Artificial Sequence
  Description of Artificial Sequence: Synthetic oligonucleotide
  Target: SCN10A; (+) strand; PAM type: YTN; PAM sequence: CTG
agaagaagctccaaagcact

SEQ ID NO: 72683 - DNA, 20 bp, Artificial Sequence
  Description of Artificial Sequence: Synthetic oligonucleotide
  Target: SCN10A; (+) strand; PAM type: YTN; PAM sequence: CTC
caaagcacttcccaaaaccc

SEQ ID NO: 72684 - DNA, 20 bp, Artificial Sequence
  Description of Artificial Sequence: Synthetic oligonucleotide
  Target: SCN10A; (+) strand; PAM type: YTN; PAM sequence: CTT
cccaaaacccaacttgcacc

SEQ ID NO: 72685 - DNA, 20 bp, Artificial Sequence
  Description of Artificial Sequence: Synthetic oligonucleotide
  Target: SCN10A; (+) strand; PAM type: YTN; PAM sequence: TTC
ccaaaacccaacttgcacca

SEQ ID NO: 72686 - DNA, 20 bp, Artificial Sequence
  Description of Artificial Sequence: Synthetic oligonucleotide
  Target: SCN10A; (+) strand; PAM type: YTN; PAM sequence: CTT
gcaccaaaaaaagtcgtggt

SEQ ID NO: 72687 - DNA, 20 bp, Artificial Sequence
  Description of Artificial Sequence: Synthetic oligonucleotide
  Target: SCN10A; (+) strand; PAM type: YTN; PAM sequence: TTG
caccaaaaaaagtcgtggtc

SEQ ID NO: 72688 - DNA, 20 bp, Artificial Sequence
  Description of Artificial Sequence: Synthetic oligonucleotide
  Target: SCN10A; (+) strand; PAM type: YTN; PAM sequence: CTG
cttggtggtctgctgccggt

SEQ ID NO: 72689 - DNA, 20 bp, Artificial Sequence
  Description of Artificial Sequence: Synthetic oligonucleotide
  Target: SCN10A; (+) strand; PAM type: YTN; PAM sequence: CTT
ggtggtctgctgccggtctg

SEQ ID NO: 72690 - DNA, 20 bp, Artificial Sequence
  Description of Artificial Sequence: Synthetic oligonucleotide
  Target: SCN10A; (+) strand; PAM type: YTN; PAM sequence: TTG
gtggtctgctgccggtctga

SEQ ID NO: 72691 - DNA, 20 bp, Artificial Sequence
  Description of Artificial Sequence: Synthetic oligonucleotide
  Target: SCN10A; (+) strand; PAM type: YTN; PAM sequence: CTG
ctgccggtctgatctactac

SEQ ID NO: 72692 - DNA, 20 bp, Artificial Sequence
  Description of Artificial Sequence: Synthetic oligonucleotide
  Target: SCN10A; (+) strand; PAM type: YTN; PAM sequence: CTG
ccggtctgatctactacagc

SEQ ID NO: 72693 - DNA, 20 bp, Artificial Sequence
  Description of Artificial Sequence: Synthetic oligonucleotide
  Target: SCN10A; (+) strand; PAM type: YTN; PAM sequence: CTG
atctactacagctttctgaa

SEQ ID NO: 72694 - DNA, 20 bp, Artificial Sequence
  Description of Artificial Sequence: Synthetic oligonucleotide
  Target: SCN10A; (+) strand; PAM type: YTN; PAM sequence: CTA
ctacagctttctgaatccca

SEQ ID NO: 72695 - DNA, 20 bp, Artificial Sequence
  Description of Artificial Sequence: Synthetic oligonucleotide
  Target: SCN10A; (+) strand; PAM type: YTN; PAM sequence: CTA
cagctttctgaatcccagca

SEQ ID NO: 72696 - DNA, 20 bp, Artificial Sequence
  Description of Artificial Sequence: Synthetic oligonucleotide
  Target: SCN10A; (+) strand; PAM type: YTN; PAM sequence: CTT
tctgaatcccagcaaagcca

SEQ ID NO: 72697 - DNA, 20 bp, Artificial Sequence
  Description of Artificial Sequence: Synthetic oligonucleotide
  Target: SCN10A; (+) strand; PAM type: YTN; PAM sequence: TTT
ctgaatcccagcaaagccat

SEQ ID NO: 72698 - DNA, 20 bp, Artificial Sequence
  Description of Artificial Sequence: Synthetic oligonucleotide
  Target: SCN10A; (+) strand; PAM type: YTN; PAM sequence: TTC
tgaatcccagcaaagccatt

SEQ ID NO: 72699 - DNA, 20 bp, Artificial Sequence
  Description of Artificial Sequence: Synthetic oligonucleotide
  Target: SCN10A; (+) strand; PAM type: YTN; PAM sequence: CTG
aatcccagcaaagccattac

SEQ ID NO: 72700 - DNA, 20 bp, Artificial Sequence
  Description of Artificial Sequence: Synthetic oligonucleotide
  Target: SCN10A; (+) strand; PAM type: YTN; PAM sequence: TTA
catctgagaaatatgttcag

SEQ ID NO: 72701 - DNA, 20 bp, Artificial Sequence
  Description of Artificial Sequence: Synthetic oligonucleotide
  Target: SCN10A; (+) strand; PAM type: YTN; PAM sequence: CTG
agaaatatgttcagcaaatc

SEQ ID NO: 72702 - DNA, 20 bp, Artificial Sequence
  Description of Artificial Sequence: Synthetic oligonucleotide
  Target: SCN10A; (+) strand; PAM type: YTN; PAM sequence: TTC
agcaaatcgatgagatgcac

SEQ ID NO: 72703 - DNA, 20 bp, Artificial Sequence
  Description of Artificial Sequence: Synthetic oligonucleotide
  Target: SCN10A; (+) strand; PAM type: YTN; PAM sequence: CTG
caaggcctgcagctggcatt

SEQ ID NO: 72704 - DNA, 20 bp, Artificial Sequence
  Description of Artificial Sequence: Synthetic oligonucleotide
  Target: SCN10A; (+) strand; PAM type: YTN; PAM sequence: CTG
cagctggcattggtcaacag

SEQ ID NO: 72705 - DNA, 20 bp, Artificial Sequence
  Description of Artificial Sequence: Synthetic oligonucleotide
  Target: SCN10A; (+) strand; PAM type: YTN; PAM sequence: CTG
gcattggtcaacagaaaggg

SEQ ID NO: 72706 - DNA, 20 bp, Artificial Sequence
  Description of Artificial Sequence: Synthetic oligonucleotide
  Target: SCN10A; (+) strand; PAM type: YTN; PAM sequence: TTG
gtcaacagaaagggcccaat

SEQ ID NO: 72707 - DNA, 20 bp, Artificial Sequence
  Description of Artificial Sequence: Synthetic oligonucleotide
  Target: SCN10A; (+) strand; PAM type: YTN; PAM sequence: TTC
ttctccacaacaaccgactg

SEQ ID NO: 72708 - DNA, 20 bp, Artificial Sequence
  Description of Artificial Sequence: Synthetic oligonucleotide
  Target: SCN10A; (+) strand; PAM type: YTN; PAM sequence: CTT
ctccacaacaaccgactgca

SEQ ID NO: 72709 - DNA, 20 bp, Artificial Sequence
  Description of Artificial Sequence: Synthetic oligonucleotide
  Target: SCN10A; (+) strand; PAM type: YTN; PAM sequence: TTC
tccacaacaaccgactgcat

SEQ ID NO: 72710 - DNA, 20 bp, Artificial Sequence
  Description of Artificial Sequence: Synthetic oligonucleotide
  Target: SCN10A; (+) strand; PAM type: YTN; PAM sequence: CTC
cacaacaaccgactgcatgt

SEQ ID NO: 72711 - DNA, 20 bp, Artificial Sequence
  Description of Artificial Sequence: Synthetic oligonucleotide
  Target: SCN10A; (+) strand; PAM type: YTN; PAM sequence: CTG
catgtcacacaaccaacagt

SEQ ID NO: 72712 - DNA, 20 bp, Artificial Sequence
  Description of Artificial Sequence: Synthetic oligonucleotide
  Target: SCN10A; (+) strand; PAM type: YTN; PAM sequence: TTA
cttcaaaagttgaatgaatt

SEQ ID NO: 72713 - DNA, 20 bp, Artificial Sequence
  Description of Artificial Sequence: Synthetic oligonucleotide
  Target: SCN10A; (+) strand; PAM type: YTN; PAM sequence: CTT
caaaagttgaatgaattggg

SEQ ID NO: 72714 - DNA, 20 bp, Artificial Sequence
  Description of Artificial Sequence: Synthetic oligonucleotide
  Target: SCN10A; (+) strand; PAM type: YTN; PAM sequence: TTC
aaaagttgaatgaattgggc

SEQ ID NO: 72715 - DNA, 20 bp, Artificial Sequence
  Description of Artificial Sequence: Synthetic oligonucleotide
  Target: SCN10A; (+) strand; PAM type: YTN; PAM sequence: TTG
aatgaattgggctatgaagt

SEQ ID NO: 72716 - DNA, 20 bp, Artificial Sequence
  Description of Artificial Sequence: Synthetic oligonucleotide
  Target: SCN10A; (+) strand; PAM type: YTN; PAM sequence: TTG
ggctatgaagttttgcctca

SEQ ID NO: 72717 - DNA, 20 bp, Artificial Sequence
  Description of Artificial Sequence: Synthetic oligonucleotide
  Target: SCN10A; (+) strand; PAM type: YTN; PAM sequence: CTA
tgaagttttgcctcatccac

SEQ ID NO: 72718 - DNA, 20 bp, Artificial Sequence
  Description of Artificial Sequence: Synthetic oligonucleotide
  Target: SCN10A; (+) strand; PAM type: YTN; PAM sequence: TTT
tgcctcatccaccatattca

SEQ ID NO: 72719 - DNA, 20 bp, Artificial Sequence
  Description of Artificial Sequence: Synthetic oligonucleotide
  Target: SCN10A; (+) strand; PAM type: YTN; PAM sequence: TTT
gcctcatccaccatattcac

SEQ ID NO: 72720 - DNA, 20 bp, Artificial Sequence
  Description of Artificial Sequence: Synthetic oligonucleotide
  Target: SCN10A; (+) strand; PAM type: YTN; PAM sequence: TTG
cctcatccaccatattcacc

SEQ ID NO: 72721 - DNA, 20 bp, Artificial Sequence
  Description of Artificial Sequence: Synthetic oligonucleotide
  Target: SCN10A; (+) strand; PAM type: YTN; PAM sequence: CTC
atccaccatattcacctgac

SEQ ID NO: 72722 - DNA, 20 bp, Artificial Sequence
  Description of Artificial Sequence: Synthetic oligonucleotide
  Target: SCN10A; (+) strand; PAM type: YTN; PAM sequence: TTC
acctgacctctcaccaacca

SEQ ID NO: 72723 - DNA, 20 bp, Artificial Sequence
  Description of Artificial Sequence: Synthetic oligonucleotide
  Target: SCN10A; (+) strand; PAM type: YTN; PAM sequence: CTG
acctctcaccaaccaactac

SEQ ID NO: 72724 - DNA, 20 bp, Artificial Sequence
  Description of Artificial Sequence: Synthetic oligonucleotide
  Target: SCN10A; (+) strand; PAM type: YTN; PAM sequence: CTC
tcaccaaccaactaccactt

SEQ ID NO: 72725 - DNA, 20 bp, Artificial Sequence
  Description of Artificial Sequence: Synthetic oligonucleotide
  Target: SCN10A; (+) strand; PAM type: YTN; PAM sequence: CTC
accaaccaactaccacttct

SEQ ID NO: 72726 - DNA, 20 bp, Artificial Sequence
  Description of Artificial Sequence: Synthetic oligonucleotide
  Target: SCN10A; (+) strand; PAM type: YTN; PAM sequence: CTA
ccacttcttcaagcatctga

SEQ ID NO: 72727 - DNA, 20 bp, Artificial Sequence
  Description of Artificial Sequence: Synthetic oligonucleotide
  Target: SCN10A; (+) strand; PAM type: YTN; PAM sequence: CTT
cttcaagcatctgaacaact

SEQ ID NO: 72728 - DNA, 20 bp, Artificial Sequence
  Description of Artificial Sequence: Synthetic oligonucleotide
  Target: SCN10A; (+) strand; PAM type: YTN; PAM sequence: TTC
ttcaagcatctgaacaactt

SEQ ID NO: 72729 - DNA, 20 bp, Artificial Sequence
  Description of Artificial Sequence: Synthetic oligonucleotide
  Target: SCN10A; (+) strand; PAM type: YTN; PAM sequence: CTT
caagcatctgaacaactttt

SEQ ID NO: 72730 - DNA, 20 bp, Artificial Sequence
  Description of Artificial Sequence: Synthetic oligonucleotide
  Target: SCN10A; (+) strand; PAM type: YTN; PAM sequence: TTC
aagcatctgaacaacttttt

SEQ ID NO: 72731 - DNA, 20 bp, Artificial Sequence
  Description of Artificial Sequence: Synthetic oligonucleotide
  Target: SCN10A; (+) strand; PAM type: YTN; PAM sequence: CTG
aacaactttttgcaggtgaa

SEQ ID NO: 72732 - DNA, 20 bp, Artificial Sequence
  Description of Artificial Sequence: Synthetic oligonucleotide
  Target: SCN10A; (+) strand; PAM type: YTN; PAM sequence: CTT
tttgcaggtgaaacacttcc

SEQ ID NO: 72733 - DNA, 20 bp, Artificial Sequence
  Description of Artificial Sequence: Synthetic oligonucleotide
  Target: SCN10A; (+) strand; PAM type: YTN; PAM sequence: TTT
ttgcaggtgaaacacttcca

SEQ ID NO: 72734 - DNA, 20 bp, Artificial Sequence
  Description of Artificial Sequence: Synthetic oligonucleotide
  Target: SCN10A; (+) strand; PAM type: YTN; PAM sequence: TTT
tgcaggtgaaacacttccat

SEQ ID NO: 72735 - DNA, 20 bp, Artificial Sequence
  Description of Artificial Sequence: Synthetic oligonucleotide
  Target: SCN10A; (+) strand; PAM type: YTN; PAM sequence: TTT
gcaggtgaaacacttccata

SEQ ID NO: 72736 - DNA, 20 bp, Artificial Sequence
  Description of Artificial Sequence: Synthetic oligonucleotide
  Target: SCN10A; (+) strand; PAM type: YTN; PAM sequence: TTG
caggtgaaacacttccataa

SEQ ID NO: 72737 - DNA, 20 bp, Artificial Sequence
  Description of Artificial Sequence: Synthetic oligonucleotide
  Target: SCN10A; (+) strand; PAM type: YTN; PAM sequence: CTT
ccataaccagcgggatgcag

SEQ ID NO: 72738 - DNA, 20 bp, Artificial Sequence
  Description of Artificial Sequence: Synthetic oligonucleotide
  Target: SCN10A; (+) strand; PAM type: YTN; PAM sequence: TTC
cataaccagcgggatgcaga

SEQ ID NO: 72739 - DNA, 20 bp, Artificial Sequence
  Description of Artificial Sequence: Synthetic oligonucleotide
  Target: SCN10A; (+) strand; PAM type: YTN; PAM sequence: CTT
ccaagagttcattgaatccc

SEQ ID NO: 72740 - DNA, 20 bp, Artificial Sequence
  Description of Artificial Sequence: Synthetic oligonucleotide
  Target: SCN10A; (+) strand; PAM type: YTN; PAM sequence: TTC
caagagttcattgaatccca

SEQ ID NO: 72741 - DNA, 20 bp, Artificial Sequence
  Description of Artificial Sequence: Synthetic oligonucleotide
  Target: SCN10A; (+) strand; PAM type: YTN; PAM sequence: TTC
attgaatcccaaagcatgga

SEQ ID NO: 72742 - DNA, 20 bp, Artificial Sequence
  Description of Artificial Sequence: Synthetic oligonucleotide
  Target: SCN10A; (+) strand; PAM type: YTN; PAM sequence: TTG
aatcccaaagcatggatttt

SEQ ID NO: 72743 - DNA, 20 bp, Artificial Sequence
  Description of Artificial Sequence: Synthetic oligonucleotide
  Target: SCN10A; (+) strand; PAM type: YTN; PAM sequence: TTT
ttatgctacaggaataaaca

SEQ ID NO: 72744 - DNA, 20 bp, Artificial Sequence
  Description of Artificial Sequence: Synthetic oligonucleotide
  Target: SCN10A; (+) strand; PAM type: YTN; PAM sequence: TTT
tatgctacaggaataaacaa

SEQ ID NO: 72745 - DNA, 20 bp, Artificial Sequence
  Description of Artificial Sequence: Synthetic oligonucleotide
  Target: SCN10A; (+) strand; PAM type: YTN; PAM sequence: TTT
atgctacaggaataaacaaa

SEQ ID NO: 72746 - DNA, 20 bp, Artificial Sequence
  Description of Artificial Sequence: Synthetic oligonucleotide
  Target: SCN10A; (+) strand; PAM type: YTN; PAM sequence: TTA
tgctacaggaataaacaaac

SEQ ID NO: 72747 - DNA, 20 bp, Artificial Sequence
  Description of Artificial Sequence: Synthetic oligonucleotide
  Target: SCN10A; (+) strand; PAM type: YTN; PAM sequence: CTA
caggaataaacaaactcatt

SEQ ID NO: 72748 - DNA, 20 bp, Artificial Sequence
  Description of Artificial Sequence: Synthetic oligonucleotide
  Target: SCN10A; (+) strand; PAM type: YTN; PAM sequence: CTC
atttctcattggcaaaaatg

SEQ ID NO: 72749 - DNA, 20 bp, Artificial Sequence
  Description of Artificial Sequence: Synthetic oligonucleotide
  Target: SCN10A; (+) strand; PAM type: YTN; PAM sequence: TTT
ctcattggcaaaaatgtgtt

SEQ ID NO: 72750 - DNA, 20 bp, Artificial Sequence
  Description of Artificial Sequence: Synthetic oligonucleotide
  Target: SCN10A; (+) strand; PAM type: YTN; PAM sequence: TTC
tcattggcaaaaatgtgttg

SEQ ID NO: 72751 - DNA, 20 bp, Artificial Sequence
  Description of Artificial Sequence: Synthetic oligonucleotide
  Target: SCN10A; (+) strand; PAM type: YTN; PAM sequence: CTC
attggcaaaaatgtgttgat

SEQ ID NO: 72752 - DNA, 20 bp, Artificial Sequence
  Description of Artificial Sequence: Synthetic oligonucleotide
  Target: SCN10A; (+) strand; PAM type: YTN; PAM sequence: TTG
gcaaaaatgtgttgattgta

SEQ ID NO: 72753 - DNA, 20 bp, Artificial Sequence
  Description of Artificial Sequence: Synthetic oligonucleotide
  Target: SCN10A; (+) strand; PAM type: YTN; PAM sequence: TTG
attgtaatggttcctacttt

SEQ ID NO: 72754 - DNA, 20 bp, Artificial Sequence
  Description of Artificial Sequence: Synthetic oligonucleotide
  Target: SCN10A; (+) strand; PAM type: YTN; PAM sequence: TTG
taatggttcctactttgatt

SEQ ID NO: 72755 - DNA, 20 bp, Artificial Sequence
  Description of Artificial Sequence: Synthetic oligonucleotide
  Target: SCN10A; (+) strand; PAM type: YTN; PAM sequence: TTC
ctactttgattaataaagat

SEQ ID NO: 72756 - DNA, 20 bp, Artificial Sequence
  Description of Artificial Sequence: Synthetic oligonucleotide
  Target: SCN10A; (+) strand; PAM type: YTN; PAM sequence: CTA
ctttgattaataaagatgtg

SEQ ID NO: 72757 - DNA, 20 bp, Artificial Sequence
  Description of Artificial Sequence: Synthetic oligonucleotide
  Target: SCN10A; (+) strand; PAM type: YTN; PAM sequence: CTT
tgattaataaagatgtgttt

SEQ ID NO: 72758 - DNA, 20 bp, Artificial Sequence
  Description of Artificial Sequence: Synthetic oligonucleotide
  Target: SCN10A; (+) strand; PAM type: YTN; PAM sequence: TTT
gattaataaagatgtgtttg

SEQ ID NO: 72759 - DNA, 20 bp, Artificial Sequence
  Description of Artificial Sequence: Synthetic oligonucleotide
  Target: SCN10A; (+) strand; PAM type: YTN; PAM sequence: TTG
attaataaagatgtgtttga

SEQ ID NO: 72760 - DNA, 20 bp, Artificial Sequence
  Description of Artificial Sequence: Synthetic oligonucleotide
  Target: SCN10A; (+) strand; PAM type: YTN; PAM sequence: TTA
ataaagatgtgtttgagcct

SEQ ID NO: 72761 - DNA, 20 bp, Artificial Sequence
  Description of Artificial Sequence: Synthetic oligonucleotide
  Target: SCN10A; (+) strand; PAM type: YTN; PAM sequence: TTT
gagcctagttataatgattt

SEQ ID NO: 72762 - DNA, 20 bp, Artificial Sequence
  Description of Artificial Sequence: Synthetic oligonucleotide
  Target: SCN10A; (+) strand; PAM type: YTN; PAM sequence: TTG
agcctagttataatgattta

SEQ ID NO: 72763 - DNA, 20 bp, Artificial Sequence
  Description of Artificial Sequence: Synthetic oligonucleotide
  Target: SCN10A; (+) strand; PAM type: YTN; PAM sequence: CTA
gttataatgatttaatattt

SEQ ID NO: 72764 - DNA, 20 bp, Artificial Sequence
  Description of Artificial Sequence: Synthetic oligonucleotide
  Target: SCN10A; (+) strand; PAM type: YTN; PAM sequence: TTA
taatgatttaatatttatgg

SEQ ID NO: 72765 - DNA, 20 bp, Artificial Sequence
  Description of Artificial Sequence: Synthetic oligonucleotide
  Target: SCN10A; (+) strand; PAM type: YTN; PAM sequence: TTT
aatatttatggtctgaaacc

SEQ ID NO: 72766 - DNA, 20 bp, Artificial Sequence
  Description of Artificial Sequence: Synthetic oligonucleotide
  Target: SCN10A; (+) strand; PAM type: YTN; PAM sequence: TTA
atatttatggtctgaaaccc

SEQ ID NO: 72767 - DNA, 20 bp, Artificial Sequence
  Description of Artificial Sequence: Synthetic oligonucleotide
  Target: SCN10A; (+) strand; PAM type: YTN; PAM sequence: TTT
atggtctgaaaccccaatta

SEQ ID NO: 72768 - DNA, 20 bp, Artificial Sequence
  Description of Artificial Sequence: Synthetic oligonucleotide
  Target: SCN10A; (+) strand; PAM type: YTN; PAM sequence: TTA
tggtctgaaaccccaattac

SEQ ID NO: 72769 - DNA, 20 bp, Artificial Sequence
  Description of Artificial Sequence: Synthetic oligonucleotide
  Target: SCN10A; (+) strand; PAM type: YTN; PAM sequence: CTG
aaaccccaattacttttgta

SEQ ID NO: 72770 - DNA, 20 bp, Artificial Sequence
  Description of Artificial Sequence: Synthetic oligonucleotide
  Target: SCN10A; (+) strand; PAM type: YTN; PAM sequence: TTA
cttttgtaccttttcattat

SEQ ID NO: 72771 - DNA, 20 bp, Artificial Sequence
  Description of Artificial Sequence: Synthetic oligonucleotide
  Target: SCN10A; (+) strand; PAM type: YTN; PAM sequence: CTT
ttgtaccttttcattatttg

SEQ ID NO: 72772 - DNA, 20 bp, Artificial Sequence
  Description of Artificial Sequence: Synthetic oligonucleotide
  Target: SCN10A; (+) strand; PAM type: YTN; PAM sequence: TTT
tgtaccttttcattatttgg

SEQ ID NO: 72773 - DNA, 20 bp, Artificial Sequence
  Description of Artificial Sequence: Synthetic oligonucleotide
  Target: SCN10A; (+) strand; PAM type: YTN; PAM sequence: TTT
gtaccttttcattatttggc

SEQ ID NO: 72774 - DNA, 20 bp, Artificial Sequence
  Description of Artificial Sequence: Synthetic oligonucleotide
  Target: SCN10A; (+) strand; PAM type: YTN; PAM sequence: TTG
taccttttcattatttggca

SEQ ID NO: 72775 - DNA, 20 bp, Artificial Sequence
  Description of Artificial Sequence: Synthetic oligonucleotide
  Target: SCN10A; (+) strand; PAM type: YTN; PAM sequence: CTT
ttcattatttggcatctctt

SEQ ID NO: 72776 - DNA, 20 bp, Artificial Sequence
  Description of Artificial Sequence: Synthetic oligonucleotide
  Target: SCN10A; (+) strand; PAM type: YTN; PAM sequence: TTT
tcattatttggcatctctta

SEQ ID NO: 72777 - DNA, 20 bp, Artificial Sequence
  Description of Artificial Sequence: Synthetic oligonucleotide
  Target: SCN10A; (+) strand; PAM type: YTN; PAM sequence: TTT
cattatttggcatctcttat

SEQ ID NO: 72778 - DNA, 20 bp, Artificial Sequence
  Description of Artificial Sequence: Synthetic oligonucleotide
  Target: SCN10A; (+) strand; PAM type: YTN; PAM sequence: TTC
attatttggcatctcttatt

SEQ ID NO: 72779 - DNA, 20 bp, Artificial Sequence
  Description of Artificial Sequence: Synthetic oligonucleotide
  Target: SCN10A; (+) strand; PAM type: YTN; PAM sequence: TTA
tttggcatctcttatttgct

SEQ ID NO: 72780 - DNA, 20 bp, Artificial Sequence
  Description of Artificial Sequence: Synthetic oligonucleotide
  Target: SCN10A; (+) strand; PAM type: YTN; PAM sequence: TTT
ggcatctcttatttgctttt

SEQ ID NO: 72781 - DNA, 20 bp, Artificial Sequence
  Description of Artificial Sequence: Synthetic oligonucleotide
  Target: SCN10A; (+) strand; PAM type: YTN; PAM sequence: TTG
gcatctcttatttgcttttt

SEQ ID NO: 72782 - DNA, 20 bp, Artificial Sequence
  Description of Artificial Sequence: Synthetic oligonucleotide
  Target: SCN10A; (+) strand; PAM type: YTN; PAM sequence: CTC
ttatttgctttttatttttt

SEQ ID NO: 72783 - DNA, 20 bp, Artificial Sequence
  Description of Artificial Sequence: Synthetic oligonucleotide
  Target: SCN10A; (+) strand; PAM type: YTN; PAM sequence: CTT
atttgctttttattttttga

SEQ ID NO: 72784 - DNA, 20 bp, Artificial Sequence
  Description of Artificial Sequence: Synthetic oligonucleotide
  Target: SCN10A; (+) strand; PAM type: YTN; PAM sequence: TTA
tttgctttttattttttgat

SEQ ID NO: 72785 - DNA, 20 bp, Artificial Sequence
  Description of Artificial Sequence: Synthetic oligonucleotide
  Target: SCN10A; (+) strand; PAM type: YTN; PAM sequence: TTT
gctttttattttttgatgta

SEQ ID NO: 72786 - DNA, 20 bp, Artificial Sequence
  Description of Artificial Sequence: Synthetic oligonucleotide
  Target: SCN10A; (+) strand; PAM type: YTN; PAM sequence: TTG
ctttttattttttgatgtac

SEQ ID NO: 72787 - DNA, 20 bp, Artificial Sequence
  Description of Artificial Sequence: Synthetic oligonucleotide
  Target: SCN10A; (+) strand; PAM type: YTN; PAM sequence: CTT
tttattttttgatgtacaat

SEQ ID NO: 72788 - DNA, 20 bp, Artificial Sequence
  Description of Artificial Sequence: Synthetic oligonucleotide
  Target: SCN10A; (+) strand; PAM type: YTN; PAM sequence: TTT
ttattttttgatgtacaatt

SEQ ID NO: 72789 - DNA, 20 bp, Artificial Sequence
  Description of Artificial Sequence: Synthetic oligonucleotide
  Target: SCN10A; (+) strand; PAM type: YTN; PAM sequence: TTT
tattttttgatgtacaattc

SEQ ID NO: 72790 - DNA, 20 bp, Artificial Sequence
  Description of Artificial Sequence: Synthetic oligonucleotide
  Target: SCN10A; (+) strand; PAM type: YTN; PAM sequence: TTT
attttttgatgtacaattct

SEQ ID NO: 72791 - DNA, 20 bp, Artificial Sequence
  Description of Artificial Sequence: Synthetic oligonucleotide
  Target: SCN10A; (+) strand; PAM type: YTN; PAM sequence: TTA
ttttttgatgtacaattctt

SEQ ID NO: 72792 - DNA, 20 bp, Artificial Sequence
  Description of Artificial Sequence: Synthetic oligonucleotide
  Target: SCN10A; (+) strand; PAM type: YTN; PAM sequence: TTT
tttgatgtacaattcttcca

SEQ ID NO: 72793 - DNA, 20 bp, Artificial Sequence
  Description of Artificial Sequence: Synthetic oligonucleotide
  Target: SCN10A; (+) strand; PAM type: YTN; PAM sequence: TTT
ttgatgtacaattcttccag

SEQ ID NO: 72794 - DNA, 20 bp, Artificial Sequence
  Description of Artificial Sequence: Synthetic oligonucleotide
  Target: SCN10A; (+) strand; PAM type: YTN; PAM sequence: TTT
tgatgtacaattcttccagt

SEQ ID NO: 72795 - DNA, 20 bp, Artificial Sequence
  Description of Artificial Sequence: Synthetic oligonucleotide
  Target: SCN10A; (+) strand; PAM type: YTN; PAM sequence: TTT
gatgtacaattcttccagta

SEQ ID NO: 72796 - DNA, 20 bp, Artificial Sequence
  Description of Artificial Sequence: Synthetic oligonucleotide
  Target: SCN10A; (+) strand; PAM type: YTN; PAM sequence: TTG
atgtacaattcttccagtat

SEQ ID NO: 72797 - DNA, 20 bp, Artificial Sequence
  Description of Artificial Sequence: Synthetic oligonucleotide
  Target: SCN10A; (+) strand; PAM type: YTN; PAM sequence: TTC
ttccagtatttagagtttgt

SEQ ID NO: 72798 - DNA, 20 bp, Artificial Sequence
  Description of Artificial Sequence: Synthetic oligonucleotide
  Target: SCN10A; (+) strand; PAM type: YTN; PAM sequence: CTT
ccagtatttagagtttgtca

SEQ ID NO: 72799 - DNA, 20 bp, Artificial Sequence
  Description of Artificial Sequence: Synthetic oligonucleotide
  Target: SCN10A; (+) strand; PAM type: YTN; PAM sequence: TTC
cagtatttagagtttgtcat

SEQ ID NO: 72800 - DNA, 20 bp, Artificial Sequence
  Description of Artificial Sequence: Synthetic oligonucleotide
  Target: SCN10A; (+) strand; PAM type: YTN; PAM sequence: TTT
agagtttgtcatattatttg

SEQ ID NO: 72801 - DNA, 20 bp, Artificial Sequence
  Description of Artificial Sequence: Synthetic oligonucleotide
  Target: SCN10A; (+) strand; PAM type: YTN; PAM sequence: TTA
gagtttgtcatattatttgt

SEQ ID NO: 72802 - DNA, 20 bp, Artificial Sequence
  Description of Artificial Sequence: Synthetic oligonucleotide
  Target: SCN10A; (+) strand; PAM type: YTN; PAM sequence: TTT
gtcatattatttgttacaaa

SEQ ID NO: 72803 - DNA, 20 bp, Artificial Sequence
  Description of Artificial Sequence: Synthetic oligonucleotide
  Target: SCN10A; (+) strand; PAM type: YTN; PAM sequence: TTG
tcatattatttgttacaaat

SEQ ID NO: 72804 - DNA, 20 bp, Artificial Sequence
  Description of Artificial Sequence: Synthetic oligonucleotide
  Target: SCN10A; (+) strand; PAM type: YTN; PAM sequence: TTA
tttgttacaaatatatagat

SEQ ID NO: 72805 - DNA, 20 bp, Artificial Sequence
  Description of Artificial Sequence: Synthetic oligonucleotide
  Target: SCN10A; (+) strand; PAM type: YTN; PAM sequence: TTT
gttacaaatatatagattac

SEQ ID NO: 72806 - DNA, 20 bp, Artificial Sequence
  Description of Artificial Sequence: Synthetic oligonucleotide
  Target: SCN10A; (+) strand; PAM type: YTN; PAM sequence: TTG
ttacaaatatatagattact

SEQ ID NO: 72807 - DNA, 20 bp, Artificial Sequence
  Description of Artificial Sequence: Synthetic oligonucleotide
  Target: SCN10A; (+) strand; PAM type: YTN; PAM sequence: TTA
caaatatatagattactaaa

SEQ ID NO: 72808 - DNA, 20 bp, Artificial Sequence
  Description of Artificial Sequence: Synthetic oligonucleotide
  Target: SCN10A; (+) strand; PAM type: YTN; PAM sequence: TTA
ctaaagagtttgtatcttta

SEQ ID NO: 72809 - DNA, 20 bp, Artificial Sequence
  Description of Artificial Sequence: Synthetic oligonucleotide
  Target: SCN10A; (+) strand; PAM type: YTN; PAM sequence: CTA
aagagtttgtatctttatcc

SEQ ID NO: 72810 - DNA, 20 bp, Artificial Sequence
  Description of Artificial Sequence: Synthetic oligonucleotide
  Target: SCN10A; (+) strand; PAM type: YTN; PAM sequence: TTT
gtatctttatcctagtggtt

SEQ ID NO: 72811 - DNA, 20 bp, Artificial Sequence
  Description of Artificial Sequence: Synthetic oligonucleotide
  Target: SCN10A; (+) strand; PAM type: YTN; PAM sequence: TTG
tatctttatcctagtggttg

SEQ ID NO: 72812 - DNA, 20 bp, Artificial Sequence
  Description of Artificial Sequence: Synthetic oligonucleotide
  Target: SCN10A; (+) strand; PAM type: YTN; PAM sequence: CTT
tatcctagtggttgtcttta

SEQ ID NO: 72813 - DNA, 20 bp, Artificial Sequence
  Description of Artificial Sequence: Synthetic oligonucleotide
  Target: SCN10A; (+) strand; PAM type: YTN; PAM sequence: TTT
atcctagtggttgtctttat

SEQ ID NO: 72814 - DNA, 20 bp, Artificial Sequence
  Description of Artificial Sequence: Synthetic oligonucleotide
  Target: SCN10A; (+) strand; PAM type: YTN; PAM sequence: TTA
tcctagtggttgtctttata

SEQ ID NO: 72815 - DNA, 20 bp, Artificial Sequence
  Description of Artificial Sequence: Synthetic oligonucleotide
  Target: SCN10A; (+) strand; PAM type: YTN; PAM sequence: CTA
gtggttgtctttataagtaa

SEQ ID NO: 72816 - DNA, 20 bp, Artificial Sequence
  Description of Artificial Sequence: Synthetic oligonucleotide
  Target: SCN10A; (+) strand; PAM type: YTN; PAM sequence: TTG
tctttataagtaaaaactta

SEQ ID NO: 72817 - DNA, 20 bp, Artificial Sequence
  Description of Artificial Sequence: Synthetic oligonucleotide
  Target: SCN10A; (+) strand; PAM type: YTN; PAM sequence: CTT
tataagtaaaaacttattat

SEQ ID NO: 72818 - DNA, 20 bp, Artificial Sequence
  Description of Artificial Sequence: Synthetic oligonucleotide
  Target: SCN10A; (+) strand; PAM type: YTN; PAM sequence: TTT
ataagtaaaaacttattata

SEQ ID NO: 72819 - DNA, 20 bp, Artificial Sequence
  Description of Artificial Sequence: Synthetic oligonucleotide
  Target: SCN10A; (+) strand; PAM type: YTN; PAM sequence: TTA
taagtaaaaacttattataa

SEQ ID NO: 72820 - DNA, 20 bp, Artificial Sequence
  Description of Artificial Sequence: Synthetic oligonucleotide
  Target: SCN10A; (+) strand; PAM type: YTN; PAM sequence: CTT
attataaatttataattata

SEQ ID NO: 72821 - DNA, 20 bp, Artificial Sequence
  Description of Artificial Sequence: Synthetic oligonucleotide
  Target: SCN10A; (+) strand; PAM type: YTN; PAM sequence: TTA
ttataaatttataattataa

SEQ ID NO: 72822 - DNA, 20 bp, Artificial Sequence
  Description of Artificial Sequence: Synthetic oligonucleotide
  Target: SCN10A; (+) strand; PAM type: YTN; PAM sequence: TTA
taaatttataattataatta

SEQ ID NO: 72823 - DNA, 20 bp, Artificial Sequence
  Description of Artificial Sequence: Synthetic oligonucleotide
  Target: SCN10A; (+) strand; PAM type: YTN; PAM sequence: TTT
ataattataattaaaaccgt

SEQ ID NO: 72824 - DNA, 20 bp, Artificial Sequence
  Description of Artificial Sequence: Synthetic oligonucleotide
  Target: SCN10A; (+) strand; PAM type: YTN; PAM sequence: TTA
taattataattaaaaccgtg

SEQ ID NO: 72825 - DNA, 20 bp, Artificial Sequence
  Description of Artificial Sequence: Synthetic oligonucleotide
  Target: SCN10A; (+) strand; PAM type: YTN; PAM sequence: TTA
taattaaaaccgtgtaatac

SEQ ID NO: 72826 - DNA, 20 bp, Artificial Sequence
  Description of Artificial Sequence: Synthetic oligonucleotide
  Target: SCN10A; (+) strand; PAM type: YTN; PAM sequence: TTA
aaaccgtgtaatacattgtc

SEQ ID NO: 72827 - DNA, 20 bp, Artificial Sequence
  Description of Artificial Sequence: Synthetic oligonucleotide
  Target: SCN10A; (+) strand; PAM type: YTN; PAM sequence: TTG
tccttagtgtactatttctt

SEQ ID NO: 72828 - DNA, 20 bp, Artificial Sequence
  Description of Artificial Sequence: Synthetic oligonucleotide
  Target: SCN10A; (+) strand; PAM type: YTN; PAM sequence: CTT
agtgtactatttctttaatc

SEQ ID NO: 72829 - DNA, 20 bp, Artificial Sequence
  Description of Artificial Sequence: Synthetic oligonucleotide
  Target: SCN10A; (+) strand; PAM type: YTN; PAM sequence: TTA
gtgtactatttctttaatca

SEQ ID NO: 72830 - DNA, 20 bp, Artificial Sequence
  Description of Artificial Sequence: Synthetic oligonucleotide
  Target: SCN10A; (+) strand; PAM type: YTN; PAM sequence: CTA
tttctttaatcaaaatctct

SEQ ID NO: 72831 - DNA, 20 bp, Artificial Sequence
  Description of Artificial Sequence: Synthetic oligonucleotide
  Target: SCN10A; (+) strand; PAM type: YTN; PAM sequence: TTT
ctttaatcaaaatctctcat

SEQ ID NO: 72832 - DNA, 20 bp, Artificial Sequence
  Description of Artificial Sequence: Synthetic oligonucleotide
  Target: SCN10A; (+) strand; PAM type: YTN; PAM sequence: TTC
tttaatcaaaatctctcatt

SEQ ID NO: 72833 - DNA, 20 bp, Artificial Sequence
  Description of Artificial Sequence: Synthetic oligonucleotide
  Target: SCN10A; (+) strand; PAM type: YTN; PAM sequence: CTT
taatcaaaatctctcatttc

SEQ ID NO: 72834 - DNA, 20 bp, Artificial Sequence
  Description of Artificial Sequence: Synthetic oligonucleotide
  Target: SCN10A; (+) strand; PAM type: YTN; PAM sequence: TTT
aatcaaaatctctcatttcc

SEQ ID NO: 72835 - DNA, 20 bp, Artificial Sequence
  Description of Artificial Sequence: Synthetic oligonucleotide
  Target: SCN10A; (+) strand; PAM type: YTN; PAM sequence: TTA
atcaaaatctctcatttcca

SEQ ID NO: 72836 - DNA, 20 bp, Artificial Sequence
  Description of Artificial Sequence: Synthetic oligonucleotide
  Target: SCN10A; (+) strand; PAM type: YTN; PAM sequence: CTC
tcatttccatttggtgattc

SEQ ID NO: 72837 - DNA, 20 bp, Artificial Sequence
  Description of Artificial Sequence: Synthetic oligonucleotide
  Target: SCN10A; (+) strand; PAM type: YTN; PAM sequence: CTC
atttccatttggtgattcct

SEQ ID NO: 72838 - DNA, 20 bp, Artificial Sequence
  Description of Artificial Sequence: Synthetic oligonucleotide
  Target: SCN10A; (+) strand; PAM type: YTN; PAM sequence: TTT
ccatttggtgattcctttcc

SEQ ID NO: 72839 - DNA, 20 bp, Artificial Sequence
  Description of Artificial Sequence: Synthetic oligonucleotide
  Target: SCN10A; (+) strand; PAM type: YTN; PAM sequence: TTC
catttggtgattcctttcct

SEQ ID NO: 72840 - DNA, 20 bp, Artificial Sequence
  Description of Artificial Sequence: Synthetic oligonucleotide
  Target: SCN10A; (+) strand; PAM type: YTN; PAM sequence: TTT
ggtgattcctttcctctctg

SEQ ID NO: 72841 - DNA, 20 bp, Artificial Sequence
  Description of Artificial Sequence: Synthetic oligonucleotide
  Target: SCN10A; (+) strand; PAM type: YTN; PAM sequence: TTG
gtgattcctttcctctctgt

SEQ ID NO: 72842 - DNA, 20 bp, Artificial Sequence
  Description of Artificial Sequence: Synthetic oligonucleotide
  Target: SCN10A; (+) strand; PAM type: YTN; PAM sequence: TTC
ctttcctctctgttttatcc

SEQ ID NO: 72843 - DNA, 20 bp, Artificial Sequence
  Description of Artificial Sequence: Synthetic oligonucleotide
  Target: SCN10A; (+) strand; PAM type: YTN; PAM sequence: CTT
tcctctctgttttatccatt

SEQ ID NO: 72844 - DNA, 20 bp, Artificial Sequence
  Description of Artificial Sequence: Synthetic oligonucleotide
  Target: SCN10A; (+) strand; PAM type: YTN; PAM sequence: TTT
cctctctgttttatccatta

SEQ ID NO: 72845 - DNA, 20 bp, Artificial Sequence
  Description of Artificial Sequence: Synthetic oligonucleotide
  Target: SCN10A; (+) strand; PAM type: YTN; PAM sequence: TTC
ctctctgttttatccattat

SEQ ID NO: 72846 - DNA, 20 bp, Artificial Sequence
  Description of Artificial Sequence: Synthetic oligonucleotide
  Target: SCN10A; (+) strand; PAM type: YTN; PAM sequence: CTC
tctgttttatccattatctg

SEQ ID NO: 72847 - DNA, 20 bp, Artificial Sequence
  Description of Artificial Sequence: Synthetic oligonucleotide
  Target: SCN10A; (+) strand; PAM type: YTN; PAM sequence: CTC
tgttttatccattatctgac

SEQ ID NO: 72848 - DNA, 20 bp, Artificial Sequence
  Description of Artificial Sequence: Synthetic oligonucleotide
  Target: SCN10A; (+) strand; PAM type: YTN; PAM sequence: CTG
ttttatccattatctgactg

SEQ ID NO: 72849 - DNA, 20 bp, Artificial Sequence
  Description of Artificial Sequence: Synthetic oligonucleotide
  Target: SCN10A; (+) strand; PAM type: YTN; PAM sequence: TTT
tatccattatctgactgtat

SEQ ID NO: 72850 - DNA, 20 bp, Artificial Sequence
  Description of Artificial Sequence: Synthetic oligonucleotide
  Target: SCN10A; (+) strand; PAM type: YTN; PAM sequence: TTT
atccattatctgactgtatt

SEQ ID NO: 72851 - DNA, 20 bp, Artificial Sequence
  Description of Artificial Sequence: Synthetic oligonucleotide
  Target: SCN10A; (+) strand; PAM type: YTN; PAM sequence: TTA
tccattatctgactgtattt

SEQ ID NO: 72852 - DNA, 20 bp, Artificial Sequence
  Description of Artificial Sequence: Synthetic oligonucleotide
  Target: SCN10A; (+) strand; PAM type: YTN; PAM sequence: TTA
tctgactgtatttaataata

SEQ ID NO: 72853 - DNA, 20 bp, Artificial Sequence
  Description of Artificial Sequence: Synthetic oligonucleotide
  Target: SCN10A; (+) strand; PAM type: YTN; PAM sequence: CTG
actgtatttaataatatctt

SEQ ID NO: 72854 - DNA, 20 bp, Artificial Sequence
  Description of Artificial Sequence: Synthetic oligonucleotide
  Target: SCN10A; (+) strand; PAM type: YTN; PAM sequence: CTG
tatttaataatatctttttg

SEQ ID NO: 72855 - DNA, 20 bp, Artificial Sequence
  Description of Artificial Sequence: Synthetic oligonucleotide
  Target: SCN10A; (+) strand; PAM type: YTN; PAM sequence: TTT
aataatatctttttgtgctt

SEQ ID NO: 72856 - DNA, 20 bp, Artificial Sequence
  Description of Artificial Sequence: Synthetic oligonucleotide
  Target: SCN10A; (+) strand; PAM type: YTN; PAM sequence: TTA
ataatatctttttgtgctta

SEQ ID NO: 72857 - DNA, 20 bp, Artificial Sequence
  Description of Artificial Sequence: Synthetic oligonucleotide
  Target: SCN10A; (+) strand; PAM type: YTN; PAM sequence: CTT
tttgtgcttacctttgtact

SEQ ID NO: 72858 - DNA, 20 bp, Artificial Sequence
  Description of Artificial Sequence: Synthetic oligonucleotide
  Target: SCN10A; (+) strand; PAM type: YTN; PAM sequence: TTT
ttgtgcttacctttgtactg

SEQ ID NO: 72859 - DNA, 20 bp, Artificial Sequence
  Description of Artificial Sequence: Synthetic oligonucleotide
  Target: SCN10A; (+) strand; PAM type: YTN; PAM sequence: TTT
tgtgcttacctttgtactgt

SEQ ID NO: 72860 - DNA, 20 bp, Artificial Sequence
  Description of Artificial Sequence: Synthetic oligonucleotide
  Target: SCN10A; (+) strand; PAM type: YTN; PAM sequence: TTT
gtgcttacctttgtactgtc

SEQ ID NO: 72861 - DNA, 20 bp, Artificial Sequence
  Description of Artificial Sequence: Synthetic oligonucleotide
  Target: SCN10A; (+) strand; PAM type: YTN; PAM sequence: TTG
tgcttacctttgtactgtca

SEQ ID NO: 72862 - DNA, 20 bp, Artificial Sequence
  Description of Artificial Sequence: Synthetic oligonucleotide
  Target: SCN10A; (+) strand; PAM type: YTN; PAM sequence: CTT
acctttgtactgtcaagtgt

SEQ ID NO: 72863 - DNA, 20 bp, Artificial Sequence
  Description of Artificial Sequence: Synthetic oligonucleotide
  Target: SCN10A; (+) strand; PAM type: YTN; PAM sequence: TTA
cctttgtactgtcaagtgta

SEQ ID NO: 72864 - DNA, 20 bp, Artificial Sequence
  Description of Artificial Sequence: Synthetic oligonucleotide
  Target: SCN10A; (+) strand; PAM type: YTN; PAM sequence: CTT
tgtactgtcaagtgtaatta

SEQ ID NO: 72865 - DNA, 20 bp, Artificial Sequence
  Description of Artificial Sequence: Synthetic oligonucleotide
  Target: SCN10A; (+) strand; PAM type: YTN; PAM sequence: TTT
gtactgtcaagtgtaattat

SEQ ID NO: 72866 - DNA, 20 bp, Artificial Sequence
  Description of Artificial Sequence: Synthetic oligonucleotide
  Target: SCN10A; (+) strand; PAM type: YTN; PAM sequence: TTG
tactgtcaagtgtaattatt

SEQ ID NO: 72867 - DNA, 20 bp, Artificial Sequence
  Description of Artificial Sequence: Synthetic oligonucleotide
  Target: SCN10A; (+) strand; PAM type: YTN; PAM sequence: CTG
tcaagtgtaattattttgtc

SEQ ID NO: 72868 - DNA, 20 bp, Artificial Sequence
  Description of Artificial Sequence: Synthetic oligonucleotide
  Target: SCN10A; (+) strand; PAM type: YTN; PAM sequence: TTA
ttttgtccatttctttattt

SEQ ID NO: 72869 - DNA, 20 bp, Artificial Sequence
  Description of Artificial Sequence: Synthetic oligonucleotide
  Target: SCN10A; (+) strand; PAM type: YTN; PAM sequence: TTT
tgtccatttctttatttgtc

SEQ ID NO: 72870 - DNA, 20 bp, Artificial Sequence
  Description of Artificial Sequence: Synthetic oligonucleotide
  Target: SCN10A; (+) strand; PAM type: YTN; PAM sequence: TTT
gtccatttctttatttgtca

SEQ ID NO: 72871 - DNA, 20 bp, Artificial Sequence
  Description of Artificial Sequence: Synthetic oligonucleotide
  Target: SCN10A; (+) strand; PAM type: YTN; PAM sequence: TTG
tccatttctttatttgtcaa

SEQ ID NO: 72872 - DNA, 20 bp, Artificial Sequence
  Description of Artificial Sequence: Synthetic oligonucleotide
  Target: SCN10A; (+) strand; PAM type: YTN; PAM sequence: TTT
ctttatttgtcaactttaaa

SEQ ID NO: 72873 - DNA, 20 bp, Artificial Sequence
  Description of Artificial Sequence: Synthetic oligonucleotide
  Target: SCN10A; (+) strand; PAM type: YTN; PAM sequence: TTC
tttatttgtcaactttaaat

SEQ ID NO: 72874 - DNA, 20 bp, Artificial Sequence
  Description of Artificial Sequence: Synthetic oligonucleotide
  Target: SCN10A; (+) strand; PAM type: YTN; PAM sequence: CTT
tatttgtcaactttaaataa

SEQ ID NO: 72875 - DNA, 20 bp, Artificial Sequence
  Description of Artificial Sequence: Synthetic oligonucleotide
  Target: SCN10A; (+) strand; PAM type: YTN; PAM sequence: TTT
atttgtcaactttaaataat

SEQ ID NO: 72876 - DNA, 20 bp, Artificial Sequence
  Description of Artificial Sequence: Synthetic oligonucleotide
  Target: SCN10A; (+) strand; PAM type: YTN; PAM sequence: TTA
tttgtcaactttaaataata

SEQ ID NO: 72877 - DNA, 20 bp, Artificial Sequence
  Description of Artificial Sequence: Synthetic oligonucleotide
  Target: SCN10A; (+) strand; PAM type: YTN; PAM sequence: TTT
gtcaactttaaataatactc

SEQ ID NO: 72878 - DNA, 20 bp, Artificial Sequence
  Description of Artificial Sequence: Synthetic oligonucleotide
  Target: SCN10A; (+) strand; PAM type: YTN; PAM sequence: TTG
tcaactttaaataatactct

SEQ ID NO: 72879 - DNA, 20 bp, Artificial Sequence
  Description of Artificial Sequence: Synthetic oligonucleotide
  Target: SCN10A; (+) strand; PAM type: YTN; PAM sequence: CTT
taaataatactctttaactt

SEQ ID NO: 72880 - DNA, 20 bp, Artificial Sequence
  Description of Artificial Sequence: Synthetic oligonucleotide
  Target: SCN10A; (+) strand; PAM type: YTN; PAM sequence: TTT
aaataatactctttaacttc

SEQ ID NO: 72881 - DNA, 20 bp, Artificial Sequence
  Description of Artificial Sequence: Synthetic oligonucleotide
  Target: SCN10A; (+) strand; PAM type: YTN; PAM sequence: TTA
aataatactctttaacttct

SEQ ID NO: 72882 - DNA, 20 bp, Artificial Sequence
  Description of Artificial Sequence: Synthetic oligonucleotide
  Target: SCN10A; (+) strand; PAM type: YTN; PAM sequence: CTC
tttaacttcttgttattata

SEQ ID NO: 72883 - DNA, 20 bp, Artificial Sequence
  Description of Artificial Sequence: Synthetic oligonucleotide
  Target: SCN10A; (+) strand; PAM type: YTN; PAM sequence: CTT
taacttcttgttattataga

SEQ ID NO: 72884 - DNA, 20 bp, Artificial Sequence
  Description of Artificial Sequence: Synthetic oligonucleotide
  Target: SCN10A; (+) strand; PAM type: YTN; PAM sequence: TTT
aacttcttgttattatagaa

SEQ ID NO: 72885 - DNA, 20 bp, Artificial Sequence
  Description of Artificial Sequence: Synthetic oligonucleotide
  Target: SCN10A; (+) strand; PAM type: YTN; PAM sequence: TTA
acttcttgttattatagaag

SEQ ID NO: 72886 - DNA, 20 bp, Artificial Sequence
  Description of Artificial Sequence: Synthetic oligonucleotide
  Target: SCN10A; (+) strand; PAM type: YTN; PAM sequence: CTT
cttgttattatagaagcagc

SEQ ID NO: 72887 - DNA, 20 bp, Artificial Sequence
  Description of Artificial Sequence: Synthetic oligonucleotide
  Target: SCN10A; (+) strand; PAM type: YTN; PAM sequence: TTC
ttgttattatagaagcagca

SEQ ID NO: 72888 - DNA, 20 bp, Artificial Sequence
  Description of Artificial Sequence: Synthetic oligonucleotide
  Target: SCN10A; (+) strand; PAM type: YTN; PAM sequence: CTT
gttattatagaagcagcagt

SEQ ID NO: 72889 - DNA, 20 bp, Artificial Sequence
  Description of Artificial Sequence: Synthetic oligonucleotide
  Target: SCN10A; (+) strand; PAM type: YTN; PAM sequence: TTG
ttattatagaagcagcagta

SEQ ID NO: 72890 - DNA, 20 bp, Artificial Sequence
  Description of Artificial Sequence: Synthetic oligonucleotide
  Target: SCN10A; (+) strand; PAM type: YTN; PAM sequence: TTA
ttatagaagcagcagtaagt

SEQ ID NO: 72891 - DNA, 20 bp, Artificial Sequence
  Description of Artificial Sequence: Synthetic oligonucleotide
  Target: SCN10A; (+) strand; PAM type: YTN; PAM sequence: TTA
tagaagcagcagtaagtgaa

SEQ ID NO: 72892 - DNA, 20 bp, Artificial Sequence
  Description of Artificial Sequence: Synthetic oligonucleotide
  Target: SCN10A; (+) strand; PAM type: YTN; PAM sequence: CTC
tgctcacatgttctttcctc

SEQ ID NO: 72893 - DNA, 20 bp, Artificial Sequence
  Description of Artificial Sequence: Synthetic oligonucleotide
  Target: SCN10A; (+) strand; PAM type: YTN; PAM sequence: CTG
ctcacatgttctttcctctt

SEQ ID NO: 72894 - DNA, 20 bp, Artificial Sequence
  Description of Artificial Sequence: Synthetic oligonucleotide
  Target: SCN10A; (+) strand; PAM type: YTN; PAM sequence: CTC
acatgttctttcctctttct

SEQ ID NO: 72895 - DNA, 20 bp, Artificial Sequence
  Description of Artificial Sequence: Synthetic oligonucleotide
  Target: SCN10A; (+) strand; PAM type: YTN; PAM sequence: TTC
tttcctctttctgcttccat

SEQ ID NO: 72896 - DNA, 20 bp, Artificial Sequence
  Description of Artificial Sequence: Synthetic oligonucleotide
  Target: SCN10A; (+) strand; PAM type: YTN; PAM sequence: CTT
tcctctttctgcttccattt

SEQ ID NO: 72897 - DNA, 20 bp, Artificial Sequence
  Description of Artificial Sequence: Synthetic oligonucleotide
  Target: SCN10A; (+) strand; PAM type: YTN; PAM sequence: TTT
cctctttctgcttccatttc

SEQ ID NO: 72898 - DNA, 20 bp, Artificial Sequence
  Description of Artificial Sequence: Synthetic oligonucleotide
  Target: SCN10A; (+) strand; PAM type: YTN; PAM sequence: TTC
ctctttctgcttccatttct

SEQ ID NO: 72899 - DNA, 20 bp, Artificial Sequence
  Description of Artificial Sequence: Synthetic oligonucleotide
  Target: SCN10A; (+) strand; PAM type: YTN; PAM sequence: CTC
tttctgcttccatttcttgc

SEQ ID NO: 72900 - DNA, 20 bp, Artificial Sequence
  Description of Artificial Sequence: Synthetic oligonucleotide
  Target: SCN10A; (+) strand; PAM type: YTN; PAM sequence: CTT
tctgcttccatttcttgcta

SEQ ID NO: 72901 - DNA, 20 bp, Artificial Sequence
  Description of Artificial Sequence: Synthetic oligonucleotide
  Target: SCN10A; (+) strand; PAM type: YTN; PAM sequence: TTT
ctgcttccatttcttgctat

SEQ ID NO: 72902 - DNA, 20 bp, Artificial Sequence
  Description of Artificial Sequence: Synthetic oligonucleotide
  Target: SCN10A; (+) strand; PAM type: YTN; PAM sequence: TTC
tgcttccatttcttgctatt

SEQ ID NO: 72903 - DNA, 20 bp, Artificial Sequence
  Description of Artificial Sequence: Synthetic oligonucleotide
  Target: SCN10A; (+) strand; PAM type: YTN; PAM sequence: CTG
cttccatttcttgctatttg

SEQ ID NO: 72904 - DNA, 20 bp, Artificial Sequence
  Description of Artificial Sequence: Synthetic oligonucleotide
  Target: SCN10A; (+) strand; PAM type: YTN; PAM sequence: CTT
ccatttcttgctatttgtat

SEQ ID NO: 72905 - DNA, 20 bp, Artificial Sequence
  Description of Artificial Sequence: Synthetic oligonucleotide
  Target: SCN10A; (+) strand; PAM type: YTN; PAM sequence: TTC
catttcttgctatttgtatc

SEQ ID NO: 72906 - DNA, 20 bp, Artificial Sequence
  Description of Artificial Sequence: Synthetic oligonucleotide
  Target: SCN10A; (+) strand; PAM type: YTN; PAM sequence: TTT
cttgctatttgtatcatgtc

SEQ ID NO: 72907 - DNA, 20 bp, Artificial Sequence
  Description of Artificial Sequence: Synthetic oligonucleotide
  Target: SCN10A; (+) strand; PAM type: YTN; PAM sequence: TTC
ttgctatttgtatcatgtca

SEQ ID NO: 72908 - DNA, 20 bp, Artificial Sequence
  Description of Artificial Sequence: Synthetic oligonucleotide
  Target: SCN10A; (+) strand; PAM type: YTN; PAM sequence: CTT
gctatttgtatcatgtcaac

SEQ ID NO: 72909 - DNA, 20 bp, Artificial Sequence
  Description of Artificial Sequence: Synthetic oligonucleotide
  Target: SCN10A; (+) strand; PAM type: YTN; PAM sequence: TTG
ctatttgtatcatgtcaaca

SEQ ID NO: 72910 - DNA, 20 bp, Artificial Sequence
  Description of Artificial Sequence: Synthetic oligonucleotide
  Target: SCN10A; (+) strand; PAM type: YTN; PAM sequence: CTA
tttgtatcatgtcaacactt

SEQ ID NO: 72911 - DNA, 20 bp, Artificial Sequence
  Description of Artificial Sequence: Synthetic oligonucleotide
  Target: SCN10A; (+) strand; PAM type: YTN; PAM sequence: TTT
gtatcatgtcaacacttgca

SEQ ID NO: 72912 - DNA, 20 bp, Artificial Sequence
  Description of Artificial Sequence: Synthetic oligonucleotide
  Target: SCN10A; (+) strand; PAM type: YTN; PAM sequence: TTG
tatcatgtcaacacttgcag

SEQ ID NO: 72913 - DNA, 20 bp, Artificial Sequence
  Description of Artificial Sequence: Synthetic oligonucleotide
  Target: SCN10A; (+) strand; PAM type: YTN; PAM sequence: CTT
gcagggcctctggggcttgt

SEQ ID NO: 72914 - DNA, 20 bp, Artificial Sequence
  Description of Artificial Sequence: Synthetic oligonucleotide
  Target: SCN10A; (+) strand; PAM type: YTN; PAM sequence: TTG
cagggcctctggggcttgtt

SEQ ID NO: 72915 - DNA, 20 bp, Artificial Sequence
  Description of Artificial Sequence: Synthetic oligonucleotide
  Target: SCN10A; (+) strand; PAM type: YTN; PAM sequence: CTC
tggggcttgttgggcagcgg

SEQ ID NO: 72916 - DNA, 20 bp, Artificial Sequence
  Description of Artificial Sequence: Synthetic oligonucleotide
  Target: SCN10A; (+) strand; PAM type: YTN; PAM sequence: CTG
gggcttgttgggcagcgggg

SEQ ID NO: 72917 - DNA, 20 bp, Artificial Sequence
  Description of Artificial Sequence: Synthetic oligonucleotide
  Target: SCN10A; (+) strand; PAM type: YTN; PAM sequence: CTT
gttgggcagcgggggcggta

SEQ ID NO: 72918 - DNA, 20 bp, Artificial Sequence
  Description of Artificial Sequence: Synthetic oligonucleotide
  Target: SCN10A; (+) strand; PAM type: YTN; PAM sequence: TTG
ttgggcagcgggggcggtaa

SEQ ID NO: 72919 - DNA, 20 bp, Artificial Sequence
  Description of Artificial Sequence: Synthetic oligonucleotide
  Target: SCN10A; (+) strand; PAM type: YTN; PAM sequence: TTG
ggcagcgggggcggtaaaat

SEQ ID NO: 72920 - DNA, 20 bp, Artificial Sequence
  Description of Artificial Sequence: Synthetic oligonucleotide
  Target: SCN10A; (+) strand; PAM type: YTN; PAM sequence: CTT
tattctcatttttatccccc

SEQ ID NO: 72921 - DNA, 20 bp, Artificial Sequence
  Description of Artificial Sequence: Synthetic oligonucleotide
  Target: SCN10A; (+) strand; PAM type: YTN; PAM sequence: TTT
attctcatttttatccccct

SEQ ID NO: 72922 - DNA, 20 bp, Artificial Sequence
  Description of Artificial Sequence: Synthetic oligonucleotide
  Target: SCN10A; (+) strand; PAM type: YTN; PAM sequence: TTA
ttctcatttttatccccctc

SEQ ID NO: 72923 - DNA, 20 bp, Artificial Sequence
  Description of Artificial Sequence: Synthetic oligonucleotide
  Target: SCN10A; (+) strand; PAM type: YTN; PAM sequence: TTC
tcatttttatccccctctgg

SEQ ID NO: 72924 - DNA, 20 bp, Artificial Sequence
  Description of Artificial Sequence: Synthetic oligonucleotide
  Target: SCN10A; (+) strand; PAM type: YTN; PAM sequence: CTC
atttttatccccctctggag

SEQ ID NO: 72925 - DNA, 20 bp, Artificial Sequence
  Description of Artificial Sequence: Synthetic oligonucleotide
  Target: SCN10A; (+) strand; PAM type: YTN; PAM sequence: TTT
ttatccccctctggaggcac

SEQ ID NO: 72926 - DNA, 20 bp, Artificial Sequence
  Description of Artificial Sequence: Synthetic oligonucleotide
  Target: SCN10A; (+) strand; PAM type: YTN; PAM sequence: TTT
tatccccctctggaggcacc

SEQ ID NO: 72927 - DNA, 20 bp, Artificial Sequence
  Description of Artificial Sequence: Synthetic oligonucleotide
  Target: SCN10A; (+) strand; PAM type: YTN; PAM sequence: TTT
atccccctctggaggcaccg

SEQ ID NO: 72928 - DNA, 20 bp, Artificial Sequence
  Description of Artificial Sequence: Synthetic oligonucleotide
  Target: SCN10A; (+) strand; PAM type: YTN; PAM sequence: TTA
tccccctctggaggcaccgt

SEQ ID NO: 72929 - DNA, 20 bp, Artificial Sequence
  Description of Artificial Sequence: Synthetic oligonucleotide
  Target: SCN10A; (+) strand; PAM type: YTN; PAM sequence: CTC
tggaggcaccgtggtttaac

SEQ ID NO: 72930 - DNA, 20 bp, Artificial Sequence
  Description of Artificial Sequence: Synthetic oligonucleotide
  Target: SCN10A; (+) strand; PAM type: YTN; PAM sequence: CTG
gaggcaccgtggtttaacaa

SEQ ID NO: 72931 - DNA, 20 bp, Artificial Sequence
  Description of Artificial Sequence: Synthetic oligonucleotide
  Target: SCN10A; (+) strand; PAM type: YTN; PAM sequence: TTT
aacaaaccctgatctgctaa

SEQ ID NO: 72932 - DNA, 20 bp, Artificial Sequence
  Description of Artificial Sequence: Synthetic oligonucleotide
  Target: SCN10A; (+) strand; PAM type: YTN; PAM sequence: TTA
acaaaccctgatctgctaag

SEQ ID NO: 72933 - DNA, 20 bp, Artificial Sequence
  Description of Artificial Sequence: Synthetic oligonucleotide
  Target: SCN10A; (+) strand; PAM type: YTN; PAM sequence: CTG
atctgctaagtgatttacca

SEQ ID NO: 72934 - DNA, 20 bp, Artificial Sequence
  Description of Artificial Sequence: Synthetic oligonucleotide
  Target: SCN10A; (+) strand; PAM type: YTN; PAM sequence: CTG
ctaagtgatttaccacttct

SEQ ID NO: 72935 - DNA, 20 bp, Artificial Sequence
  Description of Artificial Sequence: Synthetic oligonucleotide
  Target: SCN10A; (+) strand; PAM type: YTN; PAM sequence: CTA
agtgatttaccacttctcca

SEQ ID NO: 72936 - DNA, 20 bp, Artificial Sequence
  Description of Artificial Sequence: Synthetic oligonucleotide
  Target: SCN10A; (+) strand; PAM type: YTN; PAM sequence: TTT
accacttctccacccacttt

SEQ ID NO: 72937 - DNA, 20 bp, Artificial Sequence
  Description of Artificial Sequence: Synthetic oligonucleotide
  Target: SCN10A; (+) strand; PAM type: YTN; PAM sequence: TTA
ccacttctccacccactttt

SEQ ID NO: 72938 - DNA, 20 bp, Artificial Sequence
  Description of Artificial Sequence: Synthetic oligonucleotide
  Target: SCN10A; (+) strand; PAM type: YTN; PAM sequence: CTT
ctccacccacttttggtctt

SEQ ID NO: 72939 - DNA, 20 bp, Artificial Sequence
  Description of Artificial Sequence: Synthetic oligonucleotide
  Target: SCN10A; (+) strand; PAM type: YTN; PAM sequence: TTC
tccacccacttttggtcttc

SEQ ID NO: 72940 - DNA, 20 bp, Artificial Sequence
  Description of Artificial Sequence: Synthetic oligonucleotide
  Target: SCN10A; (+) strand; PAM type: YTN; PAM sequence: CTC
cacccacttttggtcttcca

SEQ ID NO: 72941 - DNA, 20 bp, Artificial Sequence
  Description of Artificial Sequence: Synthetic oligonucleotide
  Target: SCN10A; (+) strand; PAM type: YTN; PAM sequence: CTT
ttggtcttccaagtgttttg

SEQ ID NO: 72942 - DNA, 20 bp, Artificial Sequence
  Description of Artificial Sequence: Synthetic oligonucleotide
  Target: SCN10A; (+) strand; PAM type: YTN; PAM sequence: TTT
tggtcttccaagtgttttga

SEQ ID NO: 72943 - DNA, 20 bp, Artificial Sequence
  Description of Artificial Sequence: Synthetic oligonucleotide
  Target: SCN10A; (+) strand; PAM type: YTN; PAM sequence: TTT
ggtcttccaagtgttttgac

SEQ ID NO: 72944 - DNA, 20 bp, Artificial Sequence
  Description of Artificial Sequence: Synthetic oligonucleotide
  Target: SCN10A; (+) strand; PAM type: YTN; PAM sequence: TTG
gtcttccaagtgttttgaca

SEQ ID NO: 72945 - DNA, 20 bp, Artificial Sequence
  Description of Artificial Sequence: Synthetic oligonucleotide
  Target: SCN10A; (+) strand; PAM type: YTN; PAM sequence: CTT
ccaagtgttttgacatcatt

SEQ ID NO: 72946 - DNA, 20 bp, Artificial Sequence
  Description of Artificial Sequence: Synthetic oligonucleotide
  Target: SCN10A; (+) strand; PAM type: YTN; PAM sequence: TTC
caagtgttttgacatcattt

SEQ ID NO: 72947 - DNA, 20 bp, Artificial Sequence
  Description of Artificial Sequence: Synthetic oligonucleotide
  Target: SCN10A; (+) strand; PAM type: YTN; PAM sequence: TTT
tgacatcatttgtcctctgt

SEQ ID NO: 72948 - DNA, 20 bp, Artificial Sequence
  Description of Artificial Sequence: Synthetic oligonucleotide
  Target: SCN10A; (+) strand; PAM type: YTN; PAM sequence: TTT
gacatcatttgtcctctgtg

SEQ ID NO: 72949 - DNA, 20 bp, Artificial Sequence
  Description of Artificial Sequence: Synthetic oligonucleotide
  Target: SCN10A; (+) strand; PAM type: YTN; PAM sequence: TTG
acatcatttgtcctctgtgt

SEQ ID NO: 72950 - DNA, 20 bp, Artificial Sequence
  Description of Artificial Sequence: Synthetic oligonucleotide
  Target: SCN10A; (+) strand; PAM type: YTN; PAM sequence: TTT
gtcctctgtgttttccattc

SEQ ID NO: 72951 - DNA, 20 bp, Artificial Sequence
  Description of Artificial Sequence: Synthetic oligonucleotide
  Target: SCN10A; (+) strand; PAM type: YTN; PAM sequence: TTG
tcctctgtgttttccattct

SEQ ID NO: 72952 - DNA, 20 bp, Artificial Sequence
  Description of Artificial Sequence: Synthetic oligonucleotide
  Target: SCN10A; (+) strand; PAM type: YTN; PAM sequence: CTC
tgtgttttccattctctttc

SEQ ID NO: 72953 - DNA, 20 bp, Artificial Sequence
  Description of Artificial Sequence: Synthetic oligonucleotide
  Target: SCN10A; (+) strand; PAM type: YTN; PAM sequence: CTG
tgttttccattctctttctc

SEQ ID NO: 72954 - DNA, 20 bp, Artificial Sequence
  Description of Artificial Sequence: Synthetic oligonucleotide
  Target: SCN10A; (+) strand; PAM type: YTN; PAM sequence: TTT
tccattctctttctctttgt

SEQ ID NO: 72955 - DNA, 20 bp, Artificial Sequence
  Description of Artificial Sequence: Synthetic oligonucleotide
  Target: SCN10A; (+) strand; PAM type: YTN; PAM sequence: TTT
ccattctctttctctttgtt

SEQ ID NO: 72956 - DNA, 20 bp, Artificial Sequence
  Description of Artificial Sequence: Synthetic oligonucleotide
  Target: SCN10A; (+) strand; PAM type: YTN; PAM sequence: TTC
cattctctttctctttgttc

SEQ ID NO: 72957 - DNA, 20 bp, Artificial Sequence
  Description of Artificial Sequence: Synthetic oligonucleotide
  Target: SCN10A; (+) strand; PAM type: YTN; PAM sequence: TTC
tctttctctttgttcttgta

SEQ ID NO: 72958 - DNA, 20 bp, Artificial Sequence
  Description of Artificial Sequence: Synthetic oligonucleotide
  Target: SCN10A; (+) strand; PAM type: YTN; PAM sequence: CTC
tttctctttgttcttgtata

SEQ ID NO: 72959 - DNA, 20 bp, Artificial Sequence
  Description of Artificial Sequence: Synthetic oligonucleotide
  Target: SCN10A; (+) strand; PAM type: YTN; PAM sequence: CTT
tctctttgttcttgtatatt

SEQ ID NO: 72960 - DNA, 20 bp, Artificial Sequence
  Description of Artificial Sequence: Synthetic oligonucleotide
  Target: SCN10A; (+) strand; PAM type: YTN; PAM sequence: TTT
ctctttgttcttgtatattt

SEQ ID NO: 72961 - DNA, 20 bp, Artificial Sequence
  Description of Artificial Sequence: Synthetic oligonucleotide
  Target: SCN10A; (+) strand; PAM type: YTN; PAM sequence: TTC
tctttgttcttgtatattta

SEQ ID NO: 72962 - DNA, 20 bp, Artificial Sequence
  Description of Artificial Sequence: Synthetic oligonucleotide
  Target: SCN10A; (+) strand; PAM type: YTN; PAM sequence: CTC
tttgttcttgtatatttata

SEQ ID NO: 72963 - DNA, 20 bp, Artificial Sequence
  Description of Artificial Sequence: Synthetic oligonucleotide
  Target: SCN10A; (+) strand; PAM type: YTN; PAM sequence: CTT
tgttcttgtatatttatact

SEQ ID NO: 72964 - DNA, 20 bp, Artificial Sequence
  Description of Artificial Sequence: Synthetic oligonucleotide
  Target: SCN10A; (+) strand; PAM type: YTN; PAM sequence: TTT
gttcttgtatatttatactg

SEQ ID NO: 72965 - DNA, 20 bp, Artificial Sequence
  Description of Artificial Sequence: Synthetic oligonucleotide
  Target: SCN10A; (+) strand; PAM type: YTN; PAM sequence: TTG
ttcttgtatatttatactgt

SEQ ID NO: 72966 - DNA, 20 bp, Artificial Sequence
  Description of Artificial Sequence: Synthetic oligonucleotide
  Target: SCN10A; (+) strand; PAM type: YTN; PAM sequence: TTC
ttgtatatttatactgttct

SEQ ID NO: 72967 - DNA, 20 bp, Artificial Sequence
  Description of Artificial Sequence: Synthetic oligonucleotide
  Target: SCN10A; (+) strand; PAM type: YTN; PAM sequence: CTT
gtatatttatactgttcttt

SEQ ID NO: 72968 - DNA, 20 bp, Artificial Sequence
  Description of Artificial Sequence: Synthetic oligonucleotide
  Target: SCN10A; (+) strand; PAM type: YTN; PAM sequence: TTG
tatatttatactgttctttc

SEQ ID NO: 72969 - DNA, 20 bp, Artificial Sequence
  Description of Artificial Sequence: Synthetic oligonucleotide
  Target: SCN10A; (+) strand; PAM type: YTN; PAM sequence: TTT
atactgttctttcccccgtg

SEQ ID NO: 72970 - DNA, 20 bp, Artificial Sequence
  Description of Artificial Sequence: Synthetic oligonucleotide
  Target: SCN10A; (+) strand; PAM type: YTN; PAM sequence: TTA
tactgttctttcccccgtgc

SEQ ID NO: 72971 - DNA, 20 bp, Artificial Sequence
  Description of Artificial Sequence: Synthetic oligonucleotide
  Target: SCN10A; (+) strand; PAM type: YTN; PAM sequence: CTG
ttctttcccccgtgctgtca

SEQ ID NO: 72972 - DNA, 20 bp, Artificial Sequence
  Description of Artificial Sequence: Synthetic oligonucleotide
  Target: SCN10A; (+) strand; PAM type: YTN; PAM sequence: TTC
tttcccccgtgctgtcattc

SEQ ID NO: 72973 - DNA, 20 bp, Artificial Sequence
  Description of Artificial Sequence: Synthetic oligonucleotide
  Target: SCN10A; (+) strand; PAM type: YTN; PAM sequence: CTT
tcccccgtgctgtcattcta

SEQ ID NO: 72974 - DNA, 20 bp, Artificial Sequence
  Description of Artificial Sequence: Synthetic oligonucleotide
  Target: SCN10A; (+) strand; PAM type: YTN; PAM sequence: TTT
cccccgtgctgtcattctat

SEQ ID NO: 72975 - DNA, 20 bp, Artificial Sequence
  Description of Artificial Sequence: Synthetic oligonucleotide
  Target: SCN10A; (+) strand; PAM type: YTN; PAM sequence: TTC
ccccgtgctgtcattctatt

SEQ ID NO: 72976 - DNA, 20 bp, Artificial Sequence
  Description of Artificial Sequence: Synthetic oligonucleotide
  Target: SCN10A; (+) strand; PAM type: YTN; PAM sequence: CTG
tcattctattggcattttga

SEQ ID NO: 72977 - DNA, 20 bp, Artificial Sequence
  Description of Artificial Sequence: Synthetic oligonucleotide
  Target: SCN10A; (+) strand; PAM type: YTN; PAM sequence: TTC
tattggcattttgagagggt

SEQ ID NO: 72978 - DNA, 20 bp, Artificial Sequence
  Description of Artificial Sequence: Synthetic oligonucleotide
  Target: SCN10A; (+) strand; PAM type: YTN; PAM sequence: CTA
ttggcattttgagagggtgg

SEQ ID NO: 72979 - DNA, 20 bp, Artificial Sequence
  Description of Artificial Sequence: Synthetic oligonucleotide
  Target: SCN10A; (+) strand; PAM type: YTN; PAM sequence: TTG
gcattttgagagggtggggt

SEQ ID NO: 72980 - DNA, 20 bp, Artificial Sequence
  Description of Artificial Sequence: Synthetic oligonucleotide
  Target: SCN10A; (+) strand; PAM type: YTN; PAM sequence: TTT
tgagagggtggggtaaaaca

SEQ ID NO: 72981 - DNA, 20 bp, Artificial Sequence
  Description of Artificial Sequence: Synthetic oligonucleotide
  Target: SCN10A; (+) strand; PAM type: YTN; PAM sequence: TTT
gagagggtggggtaaaacat

SEQ ID NO: 72982 - DNA, 20 bp, Artificial Sequence
  Description of Artificial Sequence: Synthetic oligonucleotide
  Target: SCN10A; (+) strand; PAM type: YTN; PAM sequence: TTG
agagggtggggtaaaacata

SEQ ID NO: 72983 - DNA, 20 bp, Artificial Sequence
  Description of Artificial Sequence: Synthetic oligonucleotide
  Target: SCN10A; (+) strand; PAM type: YTN; PAM sequence: TTC
tatcttccatatttaaccac

SEQ ID NO: 72984 - DNA, 20 bp, Artificial Sequence
  Description of Artificial Sequence: Synthetic oligonucleotide
  Target: SCN10A; (+) strand; PAM type: YTN; PAM sequence: CTA
tcttccatatttaaccacaa

SEQ ID NO: 72985 - DNA, 20 bp, Artificial Sequence
  Description of Artificial Sequence: Synthetic oligonucleotide
  Target: SCN10A; (+) strand; PAM type: YTN; PAM sequence: CTT
ccatatttaaccacaatctc

SEQ ID NO: 72986 - DNA, 20 bp, Artificial Sequence
  Description of Artificial Sequence: Synthetic oligonucleotide
  Target: SCN10A; (+) strand; PAM type: YTN; PAM sequence: TTC
catatttaaccacaatctcc

SEQ ID NO: 72987 - DNA, 20 bp, Artificial Sequence
  Description of Artificial Sequence: Synthetic oligonucleotide
  Target: SCN10A; (+) strand; PAM type: YTN; PAM sequence: TTT
aaccacaatctccaaataac

SEQ ID NO: 72988 - DNA, 20 bp, Artificial Sequence
  Description of Artificial Sequence: Synthetic oligonucleotide
  Target: SCN10A; (+) strand; PAM type: YTN; PAM sequence: TTA
accacaatctccaaataact

SEQ ID NO: 72989 - DNA, 20 bp, Artificial Sequence
  Description of Artificial Sequence: Synthetic oligonucleotide
  Target: SCN10A; (+) strand; PAM type: YTN; PAM sequence: CTC
caaataactcccaaataact

SEQ ID NO: 72990 - DNA, 20 bp, Artificial Sequence
  Description of Artificial Sequence: Synthetic oligonucleotide
  Target: SCN10A; (+) strand; PAM type: YTN; PAM sequence: CTC
ccaaataactcattttgcaa

SEQ ID NO: 72991 - DNA, 20 bp, Artificial Sequence
  Description of Artificial Sequence: Synthetic oligonucleotide
  Target: SCN10A; (+) strand; PAM type: YTN; PAM sequence: CTC
attttgcaaaaaaatgtttt

SEQ ID NO: 72992 - DNA, 20 bp, Artificial Sequence
  Description of Artificial Sequence: Synthetic oligonucleotide
  Target: SCN10A; (+) strand; PAM type: YTN; PAM sequence: TTT
tgcaaaaaaatgttttacat

SEQ ID NO: 72993 - DNA, 20 bp, Artificial Sequence
  Description of Artificial Sequence: Synthetic oligonucleotide
  Target: SCN10A; (+) strand; PAM type: YTN; PAM sequence: TTT
gcaaaaaaatgttttacatt

SEQ ID NO: 72994 - DNA, 20 bp, Artificial Sequence
  Description of Artificial Sequence: Synthetic oligonucleotide
  Target: SCN10A; (+) strand; PAM type: YTN; PAM sequence: TTG
caaaaaaatgttttacatta

SEQ ID NO: 72995 - DNA, 20 bp, Artificial Sequence
  Description of Artificial Sequence: Synthetic oligonucleotide
  Target: SCN10A; (+) strand; PAM type: YTN; PAM sequence: TTT
tacattaaaactccaaaaga

SEQ ID NO: 72996 - DNA, 20 bp, Artificial Sequence
  Description of Artificial Sequence: Synthetic oligonucleotide
  Target: SCN10A; (+) strand; PAM type: YTN; PAM sequence: TTT
acattaaaactccaaaagaa

SEQ ID NO: 72997 - DNA, 20 bp, Artificial Sequence
  Description of Artificial Sequence: Synthetic oligonucleotide
  Target: SCN10A; (+) strand; PAM type: YTN; PAM sequence: TTA
cattaaaactccaaaagaag

SEQ ID NO: 72998 - DNA, 20 bp, Artificial Sequence
  Description of Artificial Sequence: Synthetic oligonucleotide
  Target: SCN10A; (+) strand; PAM type: YTN; PAM sequence: TTA
aaactccaaaagaagcatag

SEQ ID NO: 72999 - DNA, 20 bp, Artificial Sequence
  Description of Artificial Sequence: Synthetic oligonucleotide
  Target: SCN10A; (+) strand; PAM type: YTN; PAM sequence: CTC
caaaagaagcatagacattt

SEQ ID NO: 73000 - DNA, 20 bp, Artificial Sequence
  Description of Artificial Sequence: Synthetic oligonucleotide
  Target: SCN10A; (+) strand; PAM type: YTN; PAM sequence: TTT
tacatgctatatgatctcaa

SEQ ID NO: 73001 - DNA, 20 bp, Artificial Sequence
  Description of Artificial Sequence: Synthetic oligonucleotide
  Target: SCN10A; (+) strand; PAM type: YTN; PAM sequence: TTT
acatgctatatgatctcaac

SEQ ID NO: 73002 - DNA, 20 bp, Artificial Sequence
  Description of Artificial Sequence: Synthetic oligonucleotide
  Target: SCN10A; (+) strand; PAM type: YTN; PAM sequence: TTA
catgctatatgatctcaaca

SEQ ID NO: 73003 - DNA, 20 bp, Artificial Sequence
  Description of Artificial Sequence: Synthetic oligonucleotide
  Target: SCN10A; (+) strand; PAM type: YTN; PAM sequence: CTA
tatgatctcaacaatattaa

SEQ ID NO: 73004 - DNA, 20 bp, Artificial Sequence
  Description of Artificial Sequence: Synthetic oligonucleotide
  Target: SCN10A; (+) strand; PAM type: YTN; PAM sequence: CTC
aacaatattaaatataattt

SEQ ID NO: 73005 - DNA, 20 bp, Artificial Sequence
  Description of Artificial Sequence: Synthetic oligonucleotide
  Target: SCN10A; (+) strand; PAM type: YTN; PAM sequence: TTA
aatataatttcatgattttg

SEQ ID NO: 73006 - DNA, 20 bp, Artificial Sequence
  Description of Artificial Sequence: Synthetic oligonucleotide
  Target: SCN10A; (+) strand; PAM type: YTN; PAM sequence: TTT
catgattttgtgatttctct

SEQ ID NO: 73007 - DNA, 20 bp, Artificial Sequence
  Description of Artificial Sequence: Synthetic oligonucleotide
  Target: SCN10A; (+) strand; PAM type: YTN; PAM sequence: TTC
atgattttgtgatttctcta

SEQ ID NO: 73008 - DNA, 20 bp, Artificial Sequence
  Description of Artificial Sequence: Synthetic oligonucleotide
  Target: SCN10A; (+) strand; PAM type: YTN; PAM sequence: TTT
tgtgatttctctacttagta

SEQ ID NO: 73009 - DNA, 20 bp, Artificial Sequence
  Description of Artificial Sequence: Synthetic oligonucleotide
  Target: SCN10A; (+) strand; PAM type: YTN; PAM sequence: TTT
gtgatttctctacttagtaa

SEQ ID NO: 73010 - DNA, 20 bp, Artificial Sequence
  Description of Artificial Sequence: Synthetic oligonucleotide
  Target: SCN10A; (+) strand; PAM type: YTN; PAM sequence: TTG
tgatttctctacttagtaac

SEQ ID NO: 73011 - DNA, 20 bp, Artificial Sequence
  Description of Artificial Sequence: Synthetic oligonucleotide
  Target: SCN10A; (+) strand; PAM type: YTN; PAM sequence: TTT
ctctacttagtaaccatctt

SEQ ID NO: 73012 - DNA, 20 bp, Artificial Sequence
  Description of Artificial Sequence: Synthetic oligonucleotide
  Target: SCN10A; (+) strand; PAM type: YTN; PAM sequence: TTC
tctacttagtaaccatcttc

SEQ ID NO: 73013 - DNA, 20 bp, Artificial Sequence
  Description of Artificial Sequence: Synthetic oligonucleotide
  Target: SCN10A; (+) strand; PAM type: YTN; PAM sequence: CTC
tacttagtaaccatcttctg

SEQ ID NO: 73014 - DNA, 20 bp, Artificial Sequence
  Description of Artificial Sequence: Synthetic oligonucleotide
  Target: SCN10A; (+) strand; PAM type: YTN; PAM sequence: CTA
cttagtaaccatcttctgat

SEQ ID NO: 73015 - DNA, 20 bp, Artificial Sequence
  Description of Artificial Sequence: Synthetic oligonucleotide
  Target: SCN10A; (+) strand; PAM type: YTN; PAM sequence: CTT
agtaaccatcttctgattta

SEQ ID NO: 73016 - DNA, 20 bp, Artificial Sequence
  Description of Artificial Sequence: Synthetic oligonucleotide
  Target: SCN10A; (+) strand; PAM type: YTN; PAM sequence: TTA
gtaaccatcttctgatttat

SEQ ID NO: 73017 - DNA, 20 bp, Artificial Sequence
  Description of Artificial Sequence: Synthetic oligonucleotide
  Target: SCN10A; (+) strand; PAM type: YTN; PAM sequence: CTT
ctgatttatattttcagtgt

SEQ ID NO: 73018 - DNA, 20 bp, Artificial Sequence
  Description of Artificial Sequence: Synthetic oligonucleotide
  Target: SCN10A; (+) strand; PAM type: YTN; PAM sequence: TTC
tgatttatattttcagtgtt

SEQ ID NO: 73019 - DNA, 20 bp, Artificial Sequence
  Description of Artificial Sequence: Synthetic oligonucleotide
  Target: SCN10A; (+) strand; PAM type: YTN; PAM sequence: CTG
atttatattttcagtgttct

SEQ ID NO: 73020 - DNA, 20 bp, Artificial Sequence
  Description of Artificial Sequence: Synthetic oligonucleotide
  Target: SCN10A; (+) strand; PAM type: YTN; PAM sequence: TTT
atattttcagtgttctgcat

SEQ ID NO: 73021 - DNA, 20 bp, Artificial Sequence
  Description of Artificial Sequence: Synthetic oligonucleotide
  Target: SCN10A; (+) strand; PAM type: YTN; PAM sequence: TTA
tattttcagtgttctgcatt

SEQ ID NO: 73022 - DNA, 20 bp, Artificial Sequence
  Description of Artificial Sequence: Synthetic oligonucleotide
  Target: SCN10A; (+) strand; PAM type: YTN; PAM sequence: TTT
tcagtgttctgcattttttg

SEQ ID NO: 73023 - DNA, 20 bp, Artificial Sequence
  Description of Artificial Sequence: Synthetic oligonucleotide
  Target: SCN10A; (+) strand; PAM type: YTN; PAM sequence: TTT
cagtgttctgcattttttgc

SEQ ID NO: 73024 - DNA, 20 bp, Artificial Sequence
  Description of Artificial Sequence: Synthetic oligonucleotide
  Target: SCN10A; (+) strand; PAM type: YTN; PAM sequence: TTC
agtgttctgcattttttgca

SEQ ID NO: 73025 - DNA, 20 bp, Artificial Sequence
  Description of Artificial Sequence: Synthetic oligonucleotide
  Target: SCN10A; (+) strand; PAM type: YTN; PAM sequence: TTC
tgcattttttgcaatggtca

SEQ ID NO: 73026 - DNA, 20 bp, Artificial Sequence
  Description of Artificial Sequence: Synthetic oligonucleotide
  Target: SCN10A; (+) strand; PAM type: YTN; PAM sequence: CTG
cattttttgcaatggtcatt

SEQ ID NO: 73027 - DNA, 20 bp, Artificial Sequence
  Description of Artificial Sequence: Synthetic oligonucleotide
  Target: SCN10A; (+) strand; PAM type: YTN; PAM sequence: TTT
tttgcaatggtcatttattt

SEQ ID NO: 73028 - DNA, 20 bp, Artificial Sequence
  Description of Artificial Sequence: Synthetic oligonucleotide
  Target: SCN10A; (+) strand; PAM type: YTN; PAM sequence: TTT
ttgcaatggtcatttatttt

SEQ ID NO: 73029 - DNA, 20 bp, Artificial Sequence
  Description of Artificial Sequence: Synthetic oligonucleotide
  Target: SCN10A; (+) strand; PAM type: YTN; PAM sequence: TTT
tgcaatggtcatttatttta

SEQ ID NO: 73030 - DNA, 20 bp, Artificial Sequence
  Description of Artificial Sequence: Synthetic oligonucleotide
  Target: SCN10A; (+) strand; PAM type: YTN; PAM sequence: TTT
gcaatggtcatttattttaa

SEQ ID NO: 73031 - DNA, 20 bp, Artificial Sequence
  Description of Artificial Sequence: Synthetic oligonucleotide
  Target: SCN10A; (+) strand; PAM type: YTN; PAM sequence: TTG
caatggtcatttattttaaa

SEQ ID NO: 73032 - DNA, 20 bp, Artificial Sequence
  Description of Artificial Sequence: Synthetic oligonucleotide
  Target: SCN10A; (+) strand; PAM type: YTN; PAM sequence: TTT
attttaaaaaattattgggt

SEQ ID NO: 73033 - DNA, 20 bp, Artificial Sequence
  Description of Artificial Sequence: Synthetic oligonucleotide
  Target: SCN10A; (+) strand; PAM type: YTN; PAM sequence: TTA
ttttaaaaaattattgggtt

SEQ ID NO: 73034 - DNA, 20 bp, Artificial Sequence
  Description of Artificial Sequence: Synthetic oligonucleotide
  Target: SCN10A; (+) strand; PAM type: YTN; PAM sequence: TTT
taaaaaattattgggttttt

SEQ ID NO: 73035 - DNA, 20 bp, Artificial Sequence
  Description of Artificial Sequence: Synthetic oligonucleotide
  Target: SCN10A; (+) strand; PAM type: YTN; PAM sequence: TTT
aaaaaattattgggttttta

SEQ ID NO: 73036 - DNA, 20 bp, Artificial Sequence
  Description of Artificial Sequence: Synthetic oligonucleotide
  Target: SCN10A; (+) strand; PAM type: YTN; PAM sequence: TTA
aaaaattattgggtttttat

SEQ ID NO: 73037 - DNA, 20 bp, Artificial Sequence
  Description of Artificial Sequence: Synthetic oligonucleotide
  Target: SCN10A; (+) strand; PAM type: YTN; PAM sequence: TTA
ttgggtttttattatgatat

SEQ ID NO: 73038 - DNA, 20 bp, Artificial Sequence
  Description of Artificial Sequence: Synthetic oligonucleotide
  Target: SCN10A; (+) strand; PAM type: YTN; PAM sequence: TTG
ggtttttattatgatatgta

SEQ ID NO: 73039 - DNA, 20 bp, Artificial Sequence
  Description of Artificial Sequence: Synthetic oligonucleotide
  Target: SCN10A; (+) strand; PAM type: YTN; PAM sequence: TTT
ttattatgatatgtaacatg

SEQ ID NO: 73040 - DNA, 20 bp, Artificial Sequence
  Description of Artificial Sequence: Synthetic oligonucleotide
  Target: SCN10A; (+) strand; PAM type: YTN; PAM sequence: TTT
tattatgatatgtaacatgc

SEQ ID NO: 73041 - DNA, 20 bp, Artificial Sequence
  Description of Artificial Sequence: Synthetic oligonucleotide
  Target: SCN10A; (+) strand; PAM type: YTN; PAM sequence: TTT
attatgatatgtaacatgca

SEQ ID NO: 73042 - DNA, 20 bp, Artificial Sequence
  Description of Artificial Sequence: Synthetic oligonucleotide
  Target: SCN10A; (+) strand; PAM type: YTN; PAM sequence: TTA
ttatgatatgtaacatgcat

SEQ ID NO: 73043 - DNA, 20 bp, Artificial Sequence
  Description of Artificial Sequence: Synthetic oligonucleotide
  Target: SCN10A; (+) strand; PAM type: YTN; PAM sequence: TTA
tgatatgtaacatgcataat

SEQ ID NO: 73044 - DNA, 20 bp, Artificial Sequence
  Description of Artificial Sequence: Synthetic oligonucleotide
  Target: SCN10A; (+) strand; PAM type: YTN; PAM sequence: TTA
attattttaaaacaaatgtt

SEQ ID NO: 73045 - DNA, 20 bp, Artificial Sequence
  Description of Artificial Sequence: Synthetic oligonucleotide
  Target: SCN10A; (+) strand; PAM type: YTN; PAM sequence: TTA
ttttaaaacaaatgtttgtg

SEQ ID NO: 73046 - DNA, 20 bp, Artificial Sequence
  Description of Artificial Sequence: Synthetic oligonucleotide
  Target: SCN10A; (+) strand; PAM type: YTN; PAM sequence: TTT
taaaacaaatgtttgtgtat

SEQ ID NO: 73047 - DNA, 20 bp, Artificial Sequence
  Description of Artificial Sequence: Synthetic oligonucleotide
  Target: SCN10A; (+) strand; PAM type: YTN; PAM sequence: TTT
aaaacaaatgtttgtgtatt

SEQ ID NO: 73048 - DNA, 20 bp, Artificial Sequence
  Description of Artificial Sequence: Synthetic oligonucleotide
  Target: SCN10A; (+) strand; PAM type: YTN; PAM sequence: TTA
aaacaaatgtttgtgtatta

SEQ ID NO: 73049 - DNA, 20 bp, Artificial Sequence
  Description of Artificial Sequence: Synthetic oligonucleotide
  Target: SCN10A; (+) strand; PAM type: YTN; PAM sequence: TTT
gtgtattagtcagcctttgt

SEQ ID NO: 73050 - DNA, 20 bp, Artificial Sequence
  Description of Artificial Sequence: Synthetic oligonucleotide
  Target: SCN10A; (+) strand; PAM type: YTN; PAM sequence: TTG
tgtattagtcagcctttgtt

SEQ ID NO: 73051 - DNA, 20 bp, Artificial Sequence
  Description of Artificial Sequence: Synthetic oligonucleotide
  Target: SCN10A; (+) strand; PAM type: YTN; PAM sequence: TTA
gtcagcctttgttgccttaa

SEQ ID NO: 73052 - DNA, 20 bp, Artificial Sequence
  Description of Artificial Sequence: Synthetic oligonucleotide
  Target: SCN10A; (+) strand; PAM type: YTN; PAM sequence: CTT
tgttgccttaacaaaatacc

SEQ ID NO: 73053 - DNA, 20 bp, Artificial Sequence
  Description of Artificial Sequence: Synthetic oligonucleotide
  Target: SCN10A; (+) strand; PAM type: YTN; PAM sequence: TTT
gttgccttaacaaaatacca

SEQ ID NO: 73054 - DNA, 20 bp, Artificial Sequence
  Description of Artificial Sequence: Synthetic oligonucleotide
  Target: SCN10A; (+) strand; PAM type: YTN; PAM sequence: TTG
ttgccttaacaaaataccat

SEQ ID NO: 73055 - DNA, 20 bp, Artificial Sequence
  Description of Artificial Sequence: Synthetic oligonucleotide
  Target: SCN10A; (+) strand; PAM type: YTN; PAM sequence: TTG
ccttaacaaaataccataga

SEQ ID NO: 73056 - DNA, 20 bp, Artificial Sequence
  Description of Artificial Sequence: Synthetic oligonucleotide
  Target: SCN10A; (+) strand; PAM type: YTN; PAM sequence: CTT
aacaaaataccatagactgg

SEQ ID NO: 73057 - DNA, 20 bp, Artificial Sequence
  Description of Artificial Sequence: Synthetic oligonucleotide
  Target: SCN10A; (+) strand; PAM type: YTN; PAM sequence: TTA
acaaaataccatagactggg

SEQ ID NO: 73058 - DNA, 20 bp, Artificial Sequence
  Description of Artificial Sequence: Synthetic oligonucleotide
  Target: SCN10A; (+) strand; PAM type: YTN; PAM sequence: CTG
ggtggcttatgcaacagaaa

SEQ ID NO: 73059 - DNA, 20 bp, Artificial Sequence
  Description of Artificial Sequence: Synthetic oligonucleotide
  Target: SCN10A; (+) strand; PAM type: YTN; PAM sequence: CTT
atgcaacagaaatttatttt

SEQ ID NO: 73060 - DNA, 20 bp, Artificial Sequence
  Description of Artificial Sequence: Synthetic oligonucleotide
  Target: SCN10A; (+) strand; PAM type: YTN; PAM sequence: TTA
tgcaacagaaatttattttc

SEQ ID NO: 73061 - DNA, 20 bp, Artificial Sequence
  Description of Artificial Sequence: Synthetic oligonucleotide
  Target: SCN10A; (+) strand; PAM type: YTN; PAM sequence: TTT
attttctcacaaatctggag

SEQ ID NO: 73062 - DNA, 20 bp, Artificial Sequence
  Description of Artificial Sequence: Synthetic oligonucleotide
  Target: SCN10A; (+) strand; PAM type: YTN; PAM sequence: TTA
ttttctcacaaatctggagg

SEQ ID NO: 73063 - DNA, 20 bp, Artificial Sequence
  Description of Artificial Sequence: Synthetic oligonucleotide
  Target: SCN10A; (+) strand; PAM type: YTN; PAM sequence: TTT
tctcacaaatctggaggttg

SEQ ID NO: 73064 - DNA, 20 bp, Artificial Sequence
  Description of Artificial Sequence: Synthetic oligonucleotide
  Target: SCN10A; (+) strand; PAM type: YTN; PAM sequence: TTT
ctcacaaatctggaggttga

SEQ ID NO: 73065 - DNA, 20 bp, Artificial Sequence
  Description of Artificial Sequence: Synthetic oligonucleotide
  Target: SCN10A; (+) strand; PAM type: YTN; PAM sequence: TTC
tcacaaatctggaggttgaa

SEQ ID NO: 73066 - DNA, 20 bp, Artificial Sequence
  Description of Artificial Sequence: Synthetic oligonucleotide
  Target: SCN10A; (+) strand; PAM type: YTN; PAM sequence: CTC
acaaatctggaggttgaagc

SEQ ID NO: 73067 - DNA, 20 bp, Artificial Sequence
  Description of Artificial Sequence: Synthetic oligonucleotide
  Target: SCN10A; (+) strand; PAM type: YTN; PAM sequence: CTG
gaggttgaagcctgagattg

SEQ ID NO: 73068 - DNA, 20 bp, Artificial Sequence
  Description of Artificial Sequence: Synthetic oligonucleotide
  Target: SCN10A; (+) strand; PAM type: YTN; PAM sequence: TTG
aagcctgagattgggatgtc

SEQ ID NO: 73069 - DNA, 20 bp, Artificial Sequence
  Description of Artificial Sequence: Synthetic oligonucleotide
  Target: SCN10A; (+) strand; PAM type: YTN; PAM sequence: CTG
agattgggatgtcagcatag

SEQ ID NO: 73070 - DNA, 20 bp, Artificial Sequence
  Description of Artificial Sequence: Synthetic oligonucleotide
  Target: SCN10A; (+) strand; PAM type: YTN; PAM sequence: TTG
ggatgtcagcatagttgggt

SEQ ID NO: 73071 - DNA, 20 bp, Artificial Sequence
  Description of Artificial Sequence: Synthetic oligonucleotide
  Target: SCN10A; (+) strand; PAM type: YTN; PAM sequence: TTG
ggtctgggaaagactctctt

SEQ ID NO: 73072 - DNA, 20 bp, Artificial Sequence
  Description of Artificial Sequence: Synthetic oligonucleotide
  Target: SCN10A; (+) strand; PAM type: YTN; PAM sequence: CTG
ggaaagactctctttctagc

SEQ ID NO: 73073 - DNA, 20 bp, Artificial Sequence
  Description of Artificial Sequence: Synthetic oligonucleotide
  Target: SCN10A; (+) strand; PAM type: YTN; PAM sequence: CTC
tctttctagcttatagatgt

SEQ ID NO: 73074 - DNA, 20 bp, Artificial Sequence
  Description of Artificial Sequence: Synthetic oligonucleotide
  Target: SCN10A; (+) strand; PAM type: YTN; PAM sequence: CTC
tttctagcttatagatgtct

SEQ ID NO: 73075 - DNA, 20 bp, Artificial Sequence
  Description of Artificial Sequence: Synthetic oligonucleotide
  Target: SCN10A; (+) strand; PAM type: YTN; PAM sequence: CTT
tctagcttatagatgtctac

SEQ ID NO: 73076 - DNA, 20 bp, Artificial Sequence
  Description of Artificial Sequence: Synthetic oligonucleotide
  Target: SCN10A; (+) strand; PAM type: YTN; PAM sequence: TTT
ctagcttatagatgtctacc

SEQ ID NO: 73077 - DNA, 20 bp, Artificial Sequence
  Description of Artificial Sequence: Synthetic oligonucleotide
  Target: SCN10A; (+) strand; PAM type: YTN; PAM sequence: TTC
tagcttatagatgtctacct

SEQ ID NO: 73078 - DNA, 20 bp, Artificial Sequence
  Description of Artificial Sequence: Synthetic oligonucleotide
  Target: SCN10A; (+) strand; PAM type: YTN; PAM sequence: CTA
gcttatagatgtctaccttg

SEQ ID NO: 73079 - DNA, 20 bp, Artificial Sequence
  Description of Artificial Sequence: Synthetic oligonucleotide
  Target: SCN10A; (+) strand; PAM type: YTN; PAM sequence: CTT
atagatgtctaccttgtcct

SEQ ID NO: 73080 - DNA, 20 bp, Artificial Sequence
  Description of Artificial Sequence: Synthetic oligonucleotide
  Target: SCN10A; (+) strand; PAM type: YTN; PAM sequence: TTA
tagatgtctaccttgtcctt

SEQ ID NO: 73081 - DNA, 20 bp, Artificial Sequence
  Description of Artificial Sequence: Synthetic oligonucleotide
  Target: SCN10A; (+) strand; PAM type: YTN; PAM sequence: CTA
ccttgtccttgtgttctcac

SEQ ID NO: 73082 - DNA, 20 bp, Artificial Sequence
  Description of Artificial Sequence: Synthetic oligonucleotide
  Target: SCN10A; (+) strand; PAM type: YTN; PAM sequence: CTT
gtccttgtgttctcacacaa

SEQ ID NO: 73083 - DNA, 20 bp, Artificial Sequence
  Description of Artificial Sequence: Synthetic oligonucleotide
  Target: SCN10A; (+) strand; PAM type: YTN; PAM sequence: TTG
tccttgtgttctcacacaaa

SEQ ID NO: 73084 - DNA, 20 bp, Artificial Sequence
  Description of Artificial Sequence: Synthetic oligonucleotide
  Target: SCN10A; (+) strand; PAM type: YTN; PAM sequence: CTT
gtgttctcacacaaagggga

SEQ ID NO: 73085 - DNA, 20 bp, Artificial Sequence
  Description of Artificial Sequence: Synthetic oligonucleotide
  Target: SCN10A; (+) strand; PAM type: YTN; PAM sequence: TTG
tgttctcacacaaaggggag

SEQ ID NO: 73086 - DNA, 20 bp, Artificial Sequence
  Description of Artificial Sequence: Synthetic oligonucleotide
  Target: SCN10A; (+) strand; PAM type: YTN; PAM sequence: TTC
tcacacaaaggggagaaagc

SEQ ID NO: 73087 - DNA, 20 bp, Artificial Sequence
  Description of Artificial Sequence: Synthetic oligonucleotide
  Target: SCN10A; (+) strand; PAM type: YTN; PAM sequence: CTC
acacaaaggggagaaagctg

SEQ ID NO: 73088 - DNA, 20 bp, Artificial Sequence
  Description of Artificial Sequence: Synthetic oligonucleotide
  Target: SCN10A; (+) strand; PAM type: YTN; PAM sequence: CTG
tctctttctcttataaggac

SEQ ID NO: 73089 - DNA, 20 bp, Artificial Sequence
  Description of Artificial Sequence: Synthetic oligonucleotide
  Target: SCN10A; (+) strand; PAM type: YTN; PAM sequence: CTC
tttctcttataaggacacca

SEQ ID NO: 73090 - DNA, 20 bp, Artificial Sequence
  Description of Artificial Sequence: Synthetic oligonucleotide
  Target: SCN10A; (+) strand; PAM type: YTN; PAM sequence: CTT
tctcttataaggacaccagt

SEQ ID NO: 73091 - DNA, 20 bp, Artificial Sequence
  Description of Artificial Sequence: Synthetic oligonucleotide
  Target: SCN10A; (+) strand; PAM type: YTN; PAM sequence: TTT
ctcttataaggacaccagtt

SEQ ID NO: 73092 - DNA, 20 bp, Artificial Sequence
  Description of Artificial Sequence: Synthetic oligonucleotide
  Target: SCN10A; (+) strand; PAM type: YTN; PAM sequence: TTC
tcttataaggacaccagttc

SEQ ID NO: 73093 - DNA, 20 bp, Artificial Sequence
  Description of Artificial Sequence: Synthetic oligonucleotide
  Target: SCN10A; (+) strand; PAM type: YTN; PAM sequence: CTC
ttataaggacaccagttcta

SEQ ID NO: 73094 - DNA, 20 bp, Artificial Sequence
  Description of Artificial Sequence: Synthetic oligonucleotide
  Target: SCN10A; (+) strand; PAM type: YTN; PAM sequence: CTT
ataaggacaccagttctacc

SEQ ID NO: 73095 - DNA, 20 bp, Artificial Sequence
  Description of Artificial Sequence: Synthetic oligonucleotide
  Target: SCN10A; (+) strand; PAM type: YTN; PAM sequence: TTA
taaggacaccagttctacca

SEQ ID NO: 73096 - DNA, 20 bp, Artificial Sequence
  Description of Artificial Sequence: Synthetic oligonucleotide
  Target: SCN10A; (+) strand; PAM type: YTN; PAM sequence: TTC
taccacttaagggctctact

SEQ ID NO: 73097 - DNA, 20 bp, Artificial Sequence
  Description of Artificial Sequence: Synthetic oligonucleotide
  Target: SCN10A; (+) strand; PAM type: YTN; PAM sequence: CTA
ccacttaagggctctactct

SEQ ID NO: 73098 - DNA, 20 bp, Artificial Sequence
  Description of Artificial Sequence: Synthetic oligonucleotide
  Target: SCN10A; (+) strand; PAM type: YTN; PAM sequence: CTT
aagggctctactcttgtgac

SEQ ID NO: 73099 - DNA, 20 bp, Artificial Sequence
  Description of Artificial Sequence: Synthetic oligonucleotide
  Target: SCN10A; (+) strand; PAM type: YTN; PAM sequence: TTA
agggctctactcttgtgact

SEQ ID NO: 73100 - DNA, 20 bp, Artificial Sequence
  Description of Artificial Sequence: Synthetic oligonucleotide
  Target: SCN10A; (+) strand; PAM type: YTN; PAM sequence: CTC
tactcttgtgacttcattta

SEQ ID NO: 73101 - DNA, 20 bp, Artificial Sequence
  Description of Artificial Sequence: Synthetic oligonucleotide
  Target: SCN10A; (+) strand; PAM type: YTN; PAM sequence: CTA
ctcttgtgacttcatttaac

SEQ ID NO: 73102 - DNA, 20 bp, Artificial Sequence
  Description of Artificial Sequence: Synthetic oligonucleotide
  Target: SCN10A; (+) strand; PAM type: YTN; PAM sequence: CTC
ttgtgacttcatttaaccca

SEQ ID NO: 73103 - DNA, 20 bp, Artificial Sequence
  Description of Artificial Sequence: Synthetic oligonucleotide
  Target: SCN10A; (+) strand; PAM type: YTN; PAM sequence: CTT
gtgacttcatttaacccaat

SEQ ID NO: 73104 - DNA, 20 bp, Artificial Sequence
  Description of Artificial Sequence: Synthetic oligonucleotide
  Target: SCN10A; (+) strand; PAM type: YTN; PAM sequence: TTG
tgacttcatttaacccaatc

SEQ ID NO: 73105 - DNA, 20 bp, Artificial Sequence
  Description of Artificial Sequence: Synthetic oligonucleotide
  Target: SCN10A; (+) strand; PAM type: YTN; PAM sequence: CTT
catttaacccaatcacctcc

SEQ ID NO: 73106 - DNA, 20 bp, Artificial Sequence
  Description of Artificial Sequence: Synthetic oligonucleotide
  Target: SCN10A; (+) strand; PAM type: YTN; PAM sequence: TTC
atttaacccaatcacctcct

SEQ ID NO: 73107 - DNA, 20 bp, Artificial Sequence
  Description of Artificial Sequence: Synthetic oligonucleotide
  Target: SCN10A; (+) strand; PAM type: YTN; PAM sequence: TTT
aacccaatcacctccttaga

SEQ ID NO: 73108 - DNA, 20 bp, Artificial Sequence
  Description of Artificial Sequence: Synthetic oligonucleotide
  Target: SCN10A; (+) strand; PAM type: YTN; PAM sequence: TTA
acccaatcacctccttagag

SEQ ID NO: 73109 - DNA, 20 bp, Artificial Sequence
  Description of Artificial Sequence: Synthetic oligonucleotide
  Target: SCN10A; (+) strand; PAM type: YTN; PAM sequence: CTC
cttagaggcccaatctccaa

SEQ ID NO: 73110 - DNA, 20 bp, Artificial Sequence
  Description of Artificial Sequence: Synthetic oligonucleotide
  Target: SCN10A; (+) strand; PAM type: YTN; PAM sequence: CTT
agaggcccaatctccaacat

SEQ ID NO: 73111 - DNA, 20 bp, Artificial Sequence
  Description of Artificial Sequence: Synthetic oligonucleotide
  Target: SCN10A; (+) strand; PAM type: YTN; PAM sequence: TTA
gaggcccaatctccaacata

SEQ ID NO: 73112 - DNA, 20 bp, Artificial Sequence
  Description of Artificial Sequence: Synthetic oligonucleotide
  Target: SCN10A; (+) strand; PAM type: YTN; PAM sequence: CTC
caacatagcaacatgggggg

SEQ ID NO: 73113 - DNA, 20 bp, Artificial Sequence
  Description of Artificial Sequence: Synthetic oligonucleotide
  Target: SCN10A; (+) strand; PAM type: YTN; PAM sequence: TTT
gtttcaacatttgaattttg

SEQ ID NO: 73114 - DNA, 20 bp, Artificial Sequence
  Description of Artificial Sequence: Synthetic oligonucleotide
  Target: SCN10A; (+) strand; PAM type: YTN; PAM sequence: TTG
tttcaacatttgaattttga

SEQ ID NO: 73115 - DNA, 20 bp, Artificial Sequence
  Description of Artificial Sequence: Synthetic oligonucleotide
  Target: SCN10A; (+) strand; PAM type: YTN; PAM sequence: TTT
caacatttgaattttgaggg

SEQ ID NO: 73116 - DNA, 20 bp, Artificial Sequence
  Description of Artificial Sequence: Synthetic oligonucleotide
  Target: SCN10A; (+) strand; PAM type: YTN; PAM sequence: TTC
aacatttgaattttgagggg

SEQ ID NO: 73117 - DNA, 20 bp, Artificial Sequence
  Description of Artificial Sequence: Synthetic oligonucleotide
  Target: SCN10A; (+) strand; PAM type: YTN; PAM sequence: TTT
gaattttgaggggacaaaat

SEQ ID NO: 73118 - DNA, 20 bp, Artificial Sequence
  Description of Artificial Sequence: Synthetic oligonucleotide
  Target: SCN10A; (+) strand; PAM type: YTN; PAM sequence: TTG
aattttgaggggacaaaatt

SEQ ID NO: 73119 - DNA, 20 bp, Artificial Sequence
  Description of Artificial Sequence: Synthetic oligonucleotide
  Target: SCN10A; (+) strand; PAM type: YTN; PAM sequence: TTT
tgaggggacaaaattcactc

SEQ ID NO: 73120 - DNA, 20 bp, Artificial Sequence
  Description of Artificial Sequence: Synthetic oligonucleotide
  Target: SCN10A; (+) strand; PAM type: YTN; PAM sequence: TTT
gaggggacaaaattcactcc

SEQ ID NO: 73121 - DNA, 20 bp, Artificial Sequence
  Description of Artificial Sequence: Synthetic oligonucleotide
  Target: SCN10A; (+) strand; PAM type: YTN; PAM sequence: TTG
aggggacaaaattcactcca

SEQ ID NO: 73122 - DNA, 20 bp, Artificial Sequence
  Description of Artificial Sequence: Synthetic oligonucleotide
  Target: SCN10A; (+) strand; PAM type: YTN; PAM sequence: TTC
actccatagcagcttgtgtg

SEQ ID NO: 73123 - DNA, 20 bp, Artificial Sequence
  Description of Artificial Sequence: Synthetic oligonucleotide
  Target: SCN10A; (+) strand; PAM type: YTN; PAM sequence: CTC
catagcagcttgtgtgacaa

SEQ ID NO: 73124 - DNA, 20 bp, Artificial Sequence
  Description of Artificial Sequence: Synthetic oligonucleotide
  Target: SCN10A; (+) strand; PAM type: YTN; PAM sequence: CTT
gtgtgacaactacccatgcc

SEQ ID NO: 73125 - DNA, 20 bp, Artificial Sequence
  Description of Artificial Sequence: Synthetic oligonucleotide
  Target: SCN10A; (+) strand; PAM type: YTN; PAM sequence: TTG
tgtgacaactacccatgcca

SEQ ID NO: 73126 - DNA, 20 bp, Artificial Sequence
  Description of Artificial Sequence: Synthetic oligonucleotide
  Target: SCN10A; (+) strand; PAM type: YTN; PAM sequence: CTA
cccatgccataaaatggaac

SEQ ID NO: 73127 - DNA, 20 bp, Artificial Sequence
  Description of Artificial Sequence: Synthetic oligonucleotide
  Target: SCN10A; (+) strand; PAM type: YTN; PAM sequence: CTT
caccagctccttcccaatta

SEQ ID NO: 73128 - DNA, 20 bp, Artificial Sequence
  Description of Artificial Sequence: Synthetic oligonucleotide
  Target: SCN10A; (+) strand; PAM type: YTN; PAM sequence: TTC
accagctccttcccaattac

SEQ ID NO: 73129 - DNA, 20 bp, Artificial Sequence
  Description of Artificial Sequence: Synthetic oligonucleotide
  Target: SCN10A; (+) strand; PAM type: YTN; PAM sequence: CTC
cttcccaattacatcctccc

SEQ ID NO: 73130 - DNA, 20 bp, Artificial Sequence
  Description of Artificial Sequence: Synthetic oligonucleotide
  Target: SCN10A; (+) strand; PAM type: YTN; PAM sequence: CTT
cccaattacatcctccctct

SEQ ID NO: 73131 - DNA, 20 bp, Artificial Sequence
  Description of Artificial Sequence: Synthetic oligonucleotide
  Target: SCN10A; (+) strand; PAM type: YTN; PAM sequence: TTC
ccaattacatcctccctctt

SEQ ID NO: 73132 - DNA, 20 bp, Artificial Sequence
  Description of Artificial Sequence: Synthetic oligonucleotide
  Target: SCN10A; (+) strand; PAM type: YTN; PAM sequence: TTA
catcctccctcttctgccct

SEQ ID NO: 73133 - DNA, 20 bp, Artificial Sequence
  Description of Artificial Sequence: Synthetic oligonucleotide
  Target: SCN10A; (+) strand; PAM type: YTN; PAM sequence: CTC
cctcttctgccctggaggcc

SEQ ID NO: 73134 - DNA, 20 bp, Artificial Sequence
  Description of Artificial Sequence: Synthetic oligonucleotide
  Target: SCN10A; (+) strand; PAM type: YTN; PAM sequence: CTC
ttctgccctggaggccacta

SEQ ID NO: 73135 - DNA, 20 bp, Artificial Sequence
  Description of Artificial Sequence: Synthetic oligonucleotide
  Target: SCN10A; (+) strand; PAM type: YTN; PAM sequence: CTT
ctgccctggaggccactatt

SEQ ID NO: 73136 - DNA, 20 bp, Artificial Sequence
  Description of Artificial Sequence: Synthetic oligonucleotide
  Target: SCN10A; (+) strand; PAM type: YTN; PAM sequence: TTC
tgccctggaggccactattc

SEQ ID NO: 73137 - DNA, 20 bp, Artificial Sequence
  Description of Artificial Sequence: Synthetic oligonucleotide
  Target: SCN10A; (+) strand; PAM type: YTN; PAM sequence: CTG
ccctggaggccactattctc

SEQ ID NO: 73138 - DNA, 20 bp, Artificial Sequence
  Description of Artificial Sequence: Synthetic oligonucleotide
  Target: SCN10A; (+) strand; PAM type: YTN; PAM sequence: CTG
gaggccactattctcctaat

SEQ ID NO: 73139 - DNA, 20 bp, Artificial Sequence
  Description of Artificial Sequence: Synthetic oligonucleotide
  Target: SCN10A; (+) strand; PAM type: YTN; PAM sequence: CTA
ttctcctaatttttggtact

SEQ ID NO: 73140 - DNA, 20 bp, Artificial Sequence
  Description of Artificial Sequence: Synthetic oligonucleotide
  Target: SCN10A; (+) strand; PAM type: YTN; PAM sequence: TTC
tcctaatttttggtactttt

SEQ ID NO: 73141 - DNA, 20 bp, Artificial Sequence
  Description of Artificial Sequence: Synthetic oligonucleotide
  Target: SCN10A; (+) strand; PAM type: YTN; PAM sequence: CTC
ctaatttttggtactttttc

SEQ ID NO: 73142 - DNA, 20 bp, Artificial Sequence
  Description of Artificial Sequence: Synthetic oligonucleotide
  Target: SCN10A; (+) strand; PAM type: YTN; PAM sequence: CTA
atttttggtactttttcttg

SEQ ID NO: 73143 - DNA, 20 bp, Artificial Sequence
  Description of Artificial Sequence: Synthetic oligonucleotide
  Target: SCN10A; (+) strand; PAM type: YTN; PAM sequence: TTT
ttggtactttttcttgcctt

SEQ ID NO: 73144 - DNA, 20 bp, Artificial Sequence
  Description of Artificial Sequence: Synthetic oligonucleotide
  Target: SCN10A; (+) strand; PAM type: YTN; PAM sequence: TTT
tggtactttttcttgcctta

SEQ ID NO: 73145 - DNA, 20 bp, Artificial Sequence
  Description of Artificial Sequence: Synthetic oligonucleotide
  Target: SCN10A; (+) strand; PAM type: YTN; PAM sequence: TTT
ggtactttttcttgccttac

SEQ ID NO: 73146 - DNA, 20 bp, Artificial Sequence
  Description of Artificial Sequence: Synthetic oligonucleotide
  Target: SCN10A; (+) strand; PAM type: YTN; PAM sequence: TTG
gtactttttcttgccttact

SEQ ID NO: 73147 - DNA, 20 bp, Artificial Sequence
  Description of Artificial Sequence: Synthetic oligonucleotide
  Target: SCN10A; (+) strand; PAM type: YTN; PAM sequence: CTT
tttcttgccttactttattg

SEQ ID NO: 73148 - DNA, 20 bp, Artificial Sequence
  Description of Artificial Sequence: Synthetic oligonucleotide
  Target: SCN10A; (+) strand; PAM type: YTN; PAM sequence: TTT
ttcttgccttactttattga

SEQ ID NO: 73149 - DNA, 20 bp, Artificial Sequence
  Description of Artificial Sequence: Synthetic oligonucleotide
  Target: SCN10A; (+) strand; PAM type: YTN; PAM sequence: TTT
tcttgccttactttattgat

SEQ ID NO: 73150 - DNA, 20 bp, Artificial Sequence
  Description of Artificial Sequence: Synthetic oligonucleotide
  Target: SCN10A; (+) strand; PAM type: YTN; PAM sequence: TTT
cttgccttactttattgatg

SEQ ID NO: 73151 - DNA, 20 bp, Artificial Sequence
  Description of Artificial Sequence: Synthetic oligonucleotide
  Target: SCN10A; (+) strand; PAM type: YTN; PAM sequence: TTC
ttgccttactttattgatgc

SEQ ID NO: 73152 - DNA, 20 bp, Artificial Sequence
  Description of Artificial Sequence: Synthetic oligonucleotide
  Target: SCN10A; (+) strand; PAM type: YTN; PAM sequence: CTT
gccttactttattgatgctt

SEQ ID NO: 73153 - DNA, 20 bp, Artificial Sequence
  Description of Artificial Sequence: Synthetic oligonucleotide
  Target: SCN10A; (+) strand; PAM type: YTN; PAM sequence: TTG
ccttactttattgatgcttt

SEQ ID NO: 73154 - DNA, 20 bp, Artificial Sequence
  Description of Artificial Sequence: Synthetic oligonucleotide
  Target: SCN10A; (+) strand; PAM type: YTN; PAM sequence: CTT
actttattgatgctttttac

SEQ ID NO: 73155 - DNA, 20 bp, Artificial Sequence
  Description of Artificial Sequence: Synthetic oligonucleotide
  Target: SCN10A; (+) strand; PAM type: YTN; PAM sequence: TTA
ctttattgatgctttttact

SEQ ID NO: 73156 - DNA, 20 bp, Artificial Sequence
  Description of Artificial Sequence: Synthetic oligonucleotide
  Target: SCN10A; (+) strand; PAM type: YTN; PAM sequence: CTT
tattgatgctttttacttca

SEQ ID NO: 73157 - DNA, 20 bp, Artificial Sequence
  Description of Artificial Sequence: Synthetic oligonucleotide
  Target: SCN10A; (+) strand; PAM type: YTN; PAM sequence: TTT
attgatgctttttacttcat

SEQ ID NO: 73158 - DNA, 20 bp, Artificial Sequence
  Description of Artificial Sequence: Synthetic oligonucleotide
  Target: SCN10A; (+) strand; PAM type: YTN; PAM sequence: TTA
ttgatgctttttacttcata

SEQ ID NO: 73159 - DNA, 20 bp, Artificial Sequence
  Description of Artificial Sequence: Synthetic oligonucleotide
  Target: SCN10A; (+) strand; PAM type: YTN; PAM sequence: TTG
atgctttttacttcataagt

SEQ ID NO: 73160 - DNA, 20 bp, Artificial Sequence
  Description of Artificial Sequence: Synthetic oligonucleotide
  Target: SCN10A; (+) strand; PAM type: YTN; PAM sequence: CTT
tttacttcataagtatgcat

SEQ ID NO: 73161 - DNA, 20 bp, Artificial Sequence
  Description of Artificial Sequence: Synthetic oligonucleotide
  Target: SCN10A; (+) strand; PAM type: YTN; PAM sequence: TTT
ttacttcataagtatgcatt

SEQ ID NO: 73162 - DNA, 20 bp, Artificial Sequence
  Description of Artificial Sequence: Synthetic oligonucleotide
  Target: SCN10A; (+) strand; PAM type: YTN; PAM sequence: TTT
tacttcataagtatgcattc

SEQ ID NO: 73163 - DNA, 20 bp, Artificial Sequence
  Description of Artificial Sequence: Synthetic oligonucleotide
  Target: SCN10A; (+) strand; PAM type: YTN; PAM sequence: TTT
acttcataagtatgcattcc

SEQ ID NO: 73164 - DNA, 20 bp, Artificial Sequence
  Description of Artificial Sequence: Synthetic oligonucleotide
  Target: SCN10A; (+) strand; PAM type: YTN; PAM sequence: TTA
cttcataagtatgcattcct

SEQ ID NO: 73165 - DNA, 20 bp, Artificial Sequence
  Description of Artificial Sequence: Synthetic oligonucleotide
  Target: SCN10A; (+) strand; PAM type: YTN; PAM sequence: CTT
cataagtatgcattcctaaa

SEQ ID NO: 73166 - DNA, 20 bp, Artificial Sequence
  Description of Artificial Sequence: Synthetic oligonucleotide
  Target: SCN10A; (+) strand; PAM type: YTN; PAM sequence: TTC
ataagtatgcattcctaaac

SEQ ID NO: 73167 - DNA, 20 bp, Artificial Sequence
  Description of Artificial Sequence: Synthetic oligonucleotide
  Target: SCN10A; (+) strand; PAM type: YTN; PAM sequence: TTC
ctaaacaaaatagtttagtt

SEQ ID NO: 73168 - DNA, 20 bp, Artificial Sequence
  Description of Artificial Sequence: Synthetic oligonucleotide
  Target: SCN10A; (+) strand; PAM type: YTN; PAM sequence: CTA
aacaaaatagtttagttttg

SEQ ID NO: 73169 - DNA, 20 bp, Artificial Sequence
  Description of Artificial Sequence: Synthetic oligonucleotide
  Target: SCN10A; (+) strand; PAM type: YTN; PAM sequence: TTT
agttttgcttgatttcaaac

SEQ ID NO: 73170 - DNA, 20 bp, Artificial Sequence
  Description of Artificial Sequence: Synthetic oligonucleotide
  Target: SCN10A; (+) strand; PAM type: YTN; PAM sequence: TTA
gttttgcttgatttcaaact

SEQ ID NO: 73171 - DNA, 20 bp, Artificial Sequence
  Description of Artificial Sequence: Synthetic oligonucleotide
  Target: SCN10A; (+) strand; PAM type: YTN; PAM sequence: TTT
tgcttgatttcaaactttat

SEQ ID NO: 73172 - DNA, 20 bp, Artificial Sequence
  Description of Artificial Sequence: Synthetic oligonucleotide
  Target: SCN10A; (+) strand; PAM type: YTN; PAM sequence: TTT
gcttgatttcaaactttata

SEQ ID NO: 73173 - DNA, 20 bp, Artificial Sequence
  Description of Artificial Sequence: Synthetic oligonucleotide
  Target: SCN10A; (+) strand; PAM type: YTN; PAM sequence: TTG
cttgatttcaaactttatat

SEQ ID NO: 73174 - DNA, 20 bp, Artificial Sequence
  Description of Artificial Sequence: Synthetic oligonucleotide
  Target: SCN10A; (+) strand; PAM type: YTN; PAM sequence: CTT
gatttcaaactttatataaa

SEQ ID NO: 73175 - DNA, 20 bp, Artificial Sequence
  Description of Artificial Sequence: Synthetic oligonucleotide
  Target: SCN10A; (+) strand; PAM type: YTN; PAM sequence: TTG
atttcaaactttatataaat

SEQ ID NO: 73176 - DNA, 20 bp, Artificial Sequence
  Description of Artificial Sequence: Synthetic oligonucleotide
  Target: SCN10A; (+) strand; PAM type: YTN; PAM sequence: TTT
caaactttatataaatgaac

SEQ ID NO: 73177 - DNA, 20 bp, Artificial Sequence
  Description of Artificial Sequence: Synthetic oligonucleotide
  Target: SCN10A; (+) strand; PAM type: YTN; PAM sequence: TTC
aaactttatataaatgaacc

SEQ ID NO: 73178 - DNA, 20 bp, Artificial Sequence
  Description of Artificial Sequence: Synthetic oligonucleotide
  Target: SCN10A; (+) strand; PAM type: YTN; PAM sequence: CTT
tatataaatgaaccttgttt

SEQ ID NO: 73179 - DNA, 20 bp, Artificial Sequence
  Description of Artificial Sequence: Synthetic oligonucleotide
  Target: SCN10A; (+) strand; PAM type: YTN; PAM sequence: TTT
atataaatgaaccttgttta

SEQ ID NO: 73180 - DNA, 20 bp, Artificial Sequence
  Description of Artificial Sequence: Synthetic oligonucleotide
  Target: SCN10A; (+) strand; PAM type: YTN; PAM sequence: TTA
tataaatgaaccttgtttat

SEQ ID NO: 73181 - DNA, 20 bp, Artificial Sequence
  Description of Artificial Sequence: Synthetic oligonucleotide
  Target: SCN10A; (+) strand; PAM type: YTN; PAM sequence: CTT
gtttatgtaatcctttgcat

SEQ ID NO: 73182 - DNA, 20 bp, Artificial Sequence
  Description of Artificial Sequence: Synthetic oligonucleotide
  Target: SCN10A; (+) strand; PAM type: YTN; PAM sequence: TTG
tttatgtaatcctttgcatt

SEQ ID NO: 73183 - DNA, 20 bp, Artificial Sequence
  Description of Artificial Sequence: Synthetic oligonucleotide
  Target: SCN10A; (+) strand; PAM type: YTN; PAM sequence: TTT
atgtaatcctttgcatttgg

SEQ ID NO: 73184 - DNA, 20 bp, Artificial Sequence
  Description of Artificial Sequence: Synthetic oligonucleotide
  Target: SCN10A; (+) strand; PAM type: YTN; PAM sequence: TTA
tgtaatcctttgcatttggc

SEQ ID NO: 73185 - DNA, 20 bp, Artificial Sequence
  Description of Artificial Sequence: Synthetic oligonucleotide
  Target: SCN10A; (+) strand; PAM type: YTN; PAM sequence: CTT
tgcatttggctttttttgtt

SEQ ID NO: 73186 - DNA, 20 bp, Artificial Sequence
  Description of Artificial Sequence: Synthetic oligonucleotide
  Target: SCN10A; (+) strand; PAM type: YTN; PAM sequence: TTT
gcatttggctttttttgttc

SEQ ID NO: 73187 - DNA, 20 bp, Artificial Sequence
  Description of Artificial Sequence: Synthetic oligonucleotide
  Target: SCN10A; (+) strand; PAM type: YTN; PAM sequence: TTG
catttggctttttttgttca

SEQ ID NO: 73188 - DNA, 20 bp, Artificial Sequence
  Description of Artificial Sequence: Synthetic oligonucleotide
  Target: SCN10A; (+) strand; PAM type: YTN; PAM sequence: TTT
ggctttttttgttcaatatt

SEQ ID NO: 73189 - DNA, 20 bp, Artificial Sequence
  Description of Artificial Sequence: Synthetic oligonucleotide
  Target: SCN10A; (+) strand; PAM type: YTN; PAM sequence: TTG
gctttttttgttcaatatta

SEQ ID NO: 73190 - DNA, 20 bp, Artificial Sequence
  Description of Artificial Sequence: Synthetic oligonucleotide
  Target: SCN10A; (+) strand; PAM type: YTN; PAM sequence: CTT
tttttgttcaatattacttt

SEQ ID NO: 73191 - DNA, 20 bp, Artificial Sequence
  Description of Artificial Sequence: Synthetic oligonucleotide
  Target: SCN10A; (+) strand; PAM type: YTN; PAM sequence: TTT
ttttgttcaatattactttc

SEQ ID NO: 73192 - DNA, 20 bp, Artificial Sequence
  Description of Artificial Sequence: Synthetic oligonucleotide
  Target: SCN10A; (+) strand; PAM type: YTN; PAM sequence: TTT
tttgttcaatattactttct

SEQ ID NO: 73193 - DNA, 20 bp, Artificial Sequence
  Description of Artificial Sequence: Synthetic oligonucleotide
  Target: SCN10A; (+) strand; PAM type: YTN; PAM sequence: TTT
ttgttcaatattactttctt

SEQ ID NO: 73194 - DNA, 20 bp, Artificial Sequence
  Description of Artificial Sequence: Synthetic oligonucleotide
  Target: SCN10A; (+) strand; PAM type: YTN; PAM sequence: TTT
tgttcaatattactttctta

SEQ ID NO: 73195 - DNA, 20 bp, Artificial Sequence
  Description of Artificial Sequence: Synthetic oligonucleotide
  Target: SCN10A; (+) strand; PAM type: YTN; PAM sequence: TTT
gttcaatattactttcttaa

SEQ ID NO: 73196 - DNA, 20 bp, Artificial Sequence
  Description of Artificial Sequence: Synthetic oligonucleotide
  Target: SCN10A; (+) strand; PAM type: YTN; PAM sequence: TTG
ttcaatattactttcttaag

SEQ ID NO: 73197 - DNA, 20 bp, Artificial Sequence
  Description of Artificial Sequence: Synthetic oligonucleotide
  Target: SCN10A; (+) strand; PAM type: YTN; PAM sequence: TTC
aatattactttcttaagact

SEQ ID NO: 73198 - DNA, 20 bp, Artificial Sequence
  Description of Artificial Sequence: Synthetic oligonucleotide
  Target: SCN10A; (+) strand; PAM type: YTN; PAM sequence: TTA
ctttcttaagactcatcctt

SEQ ID NO: 73199 - DNA, 20 bp, Artificial Sequence
  Description of Artificial Sequence: Synthetic oligonucleotide
  Target: SCN10A; (+) strand; PAM type: YTN; PAM sequence: CTT
tcttaagactcatccttatt

SEQ ID NO: 73200 - DNA, 20 bp, Artificial Sequence
  Description of Artificial Sequence: Synthetic oligonucleotide
  Target: SCN10A; (+) strand; PAM type: YTN; PAM sequence: TTT
cttaagactcatccttattg

SEQ ID NO: 73201 - DNA, 20 bp, Artificial Sequence
  Description of Artificial Sequence: Synthetic oligonucleotide
  Target: SCN10A; (+) strand; PAM type: YTN; PAM sequence: TTC
ttaagactcatccttattgt

SEQ ID NO: 73202 - DNA, 20 bp, Artificial Sequence
  Description of Artificial Sequence: Synthetic oligonucleotide
  Target: SCN10A; (+) strand; PAM type: YTN; PAM sequence: CTT
aagactcatccttattgttg

SEQ ID NO: 73203 - DNA, 20 bp, Artificial Sequence
  Description of Artificial Sequence: Synthetic oligonucleotide
  Target: SCN10A; (+) strand; PAM type: YTN; PAM sequence: TTA
agactcatccttattgttgt

SEQ ID NO: 73204 - DNA, 20 bp, Artificial Sequence
  Description of Artificial Sequence: Synthetic oligonucleotide
  Target: SCN10A; (+) strand; PAM type: YTN; PAM sequence: CTC
atccttattgttgtgcagca

SEQ ID NO: 73205 - DNA, 20 bp, Artificial Sequence
  Description of Artificial Sequence: Synthetic oligonucleotide
  Target: SCN10A; (+) strand; PAM type: YTN; PAM sequence: CTT
attgttgtgcagcactaaag

SEQ ID NO: 73206 - DNA, 20 bp, Artificial Sequence
  Description of Artificial Sequence: Synthetic oligonucleotide
  Target: SCN10A; (+) strand; PAM type: YTN; PAM sequence: TTA
ttgttgtgcagcactaaagt

SEQ ID NO: 73207 - DNA, 20 bp, Artificial Sequence
  Description of Artificial Sequence: Synthetic oligonucleotide
  Target: SCN10A; (+) strand; PAM type: YTN; PAM sequence: TTG
ttgtgcagcactaaagttta

SEQ ID NO: 73208 - DNA, 20 bp, Artificial Sequence
  Description of Artificial Sequence: Synthetic oligonucleotide
  Target: SCN10A; (+) strand; PAM type: YTN; PAM sequence: TTG
tgcagcactaaagtttatta

SEQ ID NO: 73209 - DNA, 20 bp, Artificial Sequence
  Description of Artificial Sequence: Synthetic oligonucleotide
  Target: SCN10A; (+) strand; PAM type: YTN; PAM sequence: CTA
aagtttattaatttttattg

SEQ ID NO: 73210 - DNA, 20 bp, Artificial Sequence
  Description of Artificial Sequence: Synthetic oligonucleotide
  Target: SCN10A; (+) strand; PAM type: YTN; PAM sequence: TTT
attaatttttattgctgtaa

SEQ ID NO: 73211 - DNA, 20 bp, Artificial Sequence
  Description of Artificial Sequence: Synthetic oligonucleotide
  Target: SCN10A; (+) strand; PAM type: YTN; PAM sequence: TTA
ttaatttttattgctgtaag

SEQ ID NO: 73212 - DNA, 20 bp, Artificial Sequence
  Description of Artificial Sequence: Synthetic oligonucleotide
  Target: SCN10A; (+) strand; PAM type: YTN; PAM sequence: TTA
atttttattgctgtaagttt

SEQ ID NO: 73213 - DNA, 20 bp, Artificial Sequence
  Description of Artificial Sequence: Synthetic oligonucleotide
  Target: SCN10A; (+) strand; PAM type: YTN; PAM sequence: TTT
ttattgctgtaagttttctc

SEQ ID NO: 73214 - DNA, 20 bp, Artificial Sequence
  Description of Artificial Sequence: Synthetic oligonucleotide
  Target: SCN10A; (+) strand; PAM type: YTN; PAM sequence: TTT
tattgctgtaagttttctca

SEQ ID NO: 73215 - DNA, 20 bp, Artificial Sequence
  Description of Artificial Sequence: Synthetic oligonucleotide
  Target: SCN10A; (+) strand; PAM type: YTN; PAM sequence: TTT
attgctgtaagttttctcat

SEQ ID NO: 73216 - DNA, 20 bp, Artificial Sequence
  Description of Artificial Sequence: Synthetic oligonucleotide
  Target: SCN10A; (+) strand; PAM type: YTN; PAM sequence: TTA
ttgctgtaagttttctcatt

SEQ ID NO: 73217 - DNA, 20 bp, Artificial Sequence
  Description of Artificial Sequence: Synthetic oligonucleotide
  Target: SCN10A; (+) strand; PAM type: YTN; PAM sequence: TTG
ctgtaagttttctcatttta

SEQ ID NO: 73218 - DNA, 20 bp, Artificial Sequence
  Description of Artificial Sequence: Synthetic oligonucleotide
  Target: SCN10A; (+) strand; PAM type: YTN; PAM sequence: CTG
taagttttctcattttagaa

SEQ ID NO: 73219 - DNA, 20 bp, Artificial Sequence
  Description of Artificial Sequence: Synthetic oligonucleotide
  Target: SCN10A; (+) strand; PAM type: YTN; PAM sequence: TTT
tctcattttagaatataaca

SEQ ID NO: 73220 - DNA, 20 bp, Artificial Sequence
  Description of Artificial Sequence: Synthetic oligonucleotide
  Target: SCN10A; (+) strand; PAM type: YTN; PAM sequence: TTT
ctcattttagaatataacag

SEQ ID NO: 73221 - DNA, 20 bp, Artificial Sequence
  Description of Artificial Sequence: Synthetic oligonucleotide
  Target: SCN10A; (+) strand; PAM type: YTN; PAM sequence: TTC
tcattttagaatataacaga

SEQ ID NO: 73222 - DNA, 20 bp, Artificial Sequence
  Description of Artificial Sequence: Synthetic oligonucleotide
  Target: SCN10A; (+) strand; PAM type: YTN; PAM sequence: CTC
attttagaatataacagaaa

SEQ ID NO: 73223 - DNA, 20 bp, Artificial Sequence
  Description of Artificial Sequence: Synthetic oligonucleotide
  Target: SCN10A; (+) strand; PAM type: YTN; PAM sequence: TTT
tagaatataacagaaatagt

SEQ ID NO: 73224 - DNA, 20 bp, Artificial Sequence
  Description of Artificial Sequence: Synthetic oligonucleotide
  Target: SCN10A; (+) strand; PAM type: YTN; PAM sequence: TTT
agaatataacagaaatagtt

SEQ ID NO: 73225 - DNA, 20 bp, Artificial Sequence
  Description of Artificial Sequence: Synthetic oligonucleotide
  Target: SCN10A; (+) strand; PAM type: YTN; PAM sequence: TTA
gaatataacagaaatagtta

SEQ ID NO: 73226 - DNA, 20 bp, Artificial Sequence
  Description of Artificial Sequence: Synthetic oligonucleotide
  Target: SCN10A; (+) strand; PAM type: YTN; PAM sequence: TTA
atgtactcaaagtttatgga

SEQ ID NO: 73227 - DNA, 20 bp, Artificial Sequence
  Description of Artificial Sequence: Synthetic oligonucleotide
  Target: SCN10A; (+) strand; PAM type: YTN; PAM sequence: CTC
aaagtttatggacatttgag

SEQ ID NO: 73228 - DNA, 20 bp, Artificial Sequence
  Description of Artificial Sequence: Synthetic oligonucleotide
  Target: SCN10A; (+) strand; PAM type: YTN; PAM sequence: TTT
atggacatttgagtggtttc

SEQ ID NO: 73229 - DNA, 20 bp, Artificial Sequence
  Description of Artificial Sequence: Synthetic oligonucleotide
  Target: SCN10A; (+) strand; PAM type: YTN; PAM sequence: TTA
tggacatttgagtggtttcc

SEQ ID NO: 73230 - DNA, 20 bp, Artificial Sequence
  Description of Artificial Sequence: Synthetic oligonucleotide
  Target: SCN10A; (+) strand; PAM type: YTN; PAM sequence: TTT
gagtggtttccggtttgggg

SEQ ID NO: 73231 - DNA, 20 bp, Artificial Sequence
  Description of Artificial Sequence: Synthetic oligonucleotide
  Target: SCN10A; (+) strand; PAM type: YTN; PAM sequence: TTG
agtggtttccggtttggggt

SEQ ID NO: 73232 - DNA, 20 bp, Artificial Sequence
  Description of Artificial Sequence: Synthetic oligonucleotide
  Target: SCN10A; (+) strand; PAM type: YTN; PAM sequence: TTT
ccggtttggggtttttatgg

SEQ ID NO: 73233 - DNA, 20 bp, Artificial Sequence
  Description of Artificial Sequence: Synthetic oligonucleotide
  Target: SCN10A; (+) strand; PAM type: YTN; PAM sequence: TTC
cggtttggggtttttatggg

SEQ ID NO: 73234 - DNA, 20 bp, Artificial Sequence
  Description of Artificial Sequence: Synthetic oligonucleotide
  Target: SCN10A; (+) strand; PAM type: YTN; PAM sequence: TTT
ggggtttttatgggcaaatg

SEQ ID NO: 73235 - DNA, 20 bp, Artificial Sequence
  Description of Artificial Sequence: Synthetic oligonucleotide
  Target: SCN10A; (+) strand; PAM type: YTN; PAM sequence: TTG
gggtttttatgggcaaatgt

SEQ ID NO: 73236 - DNA, 20 bp, Artificial Sequence
  Description of Artificial Sequence: Synthetic oligonucleotide
  Target: SCN10A; (+) strand; PAM type: YTN; PAM sequence: TTT
ttatgggcaaatgttcataa

SEQ ID NO: 73237 - DNA, 20 bp, Artificial Sequence
  Description of Artificial Sequence: Synthetic oligonucleotide
  Target: SCN10A; (+) strand; PAM type: YTN; PAM sequence: TTT
tatgggcaaatgttcataaa

SEQ ID NO: 73238 - DNA, 20 bp, Artificial Sequence
  Description of Artificial Sequence: Synthetic oligonucleotide
  Target: SCN10A; (+) strand; PAM type: YTN; PAM sequence: TTT
atgggcaaatgttcataaac

SEQ ID NO: 73239 - DNA, 20 bp, Artificial Sequence
  Description of Artificial Sequence: Synthetic oligonucleotide
  Target: SCN10A; (+) strand; PAM type: YTN; PAM sequence: TTA
tgggcaaatgttcataaact

SEQ ID NO: 73240 - DNA, 20 bp, Artificial Sequence
  Description of Artificial Sequence: Synthetic oligonucleotide
  Target: SCN10A; (+) strand; PAM type: YTN; PAM sequence: TTC
ataaactttcttgtagctgt

SEQ ID NO: 73241 - DNA, 20 bp, Artificial Sequence
  Description of Artificial Sequence: Synthetic oligonucleotide
  Target: SCN10A; (+) strand; PAM type: YTN; PAM sequence: CTT
tcttgtagctgtaatctggt

SEQ ID NO: 73242 - DNA, 20 bp, Artificial Sequence
  Description of Artificial Sequence: Synthetic oligonucleotide
  Target: SCN10A; (+) strand; PAM type: YTN; PAM sequence: TTT
cttgtagctgtaatctggtg

SEQ ID NO: 73243 - DNA, 20 bp, Artificial Sequence
  Description of Artificial Sequence: Synthetic oligonucleotide
  Target: SCN10A; (+) strand; PAM type: YTN; PAM sequence: TTC
ttgtagctgtaatctggtgt

SEQ ID NO: 73244 - DNA, 20 bp, Artificial Sequence
  Description of Artificial Sequence: Synthetic oligonucleotide
  Target: SCN10A; (+) strand; PAM type: YTN; PAM sequence: CTT
gtagctgtaatctggtgtcc

SEQ ID NO: 73245 - DNA, 20 bp, Artificial Sequence
  Description of Artificial Sequence: Synthetic oligonucleotide
  Target: SCN10A; (+) strand; PAM type: YTN; PAM sequence: TTG
tagctgtaatctggtgtcca

SEQ ID NO: 73246 - DNA, 20 bp, Artificial Sequence
  Description of Artificial Sequence: Synthetic oligonucleotide
  Target: SCN10A; (+) strand; PAM type: YTN; PAM sequence: CTG
taatctggtgtccacaagta

SEQ ID NO: 73247 - DNA, 20 bp, Artificial Sequence
  Description of Artificial Sequence: Synthetic oligonucleotide
  Target: SCN10A; (+) strand; PAM type: YTN; PAM sequence: CTG
gtgtccacaagtacatattt

SEQ ID NO: 73248 - DNA, 20 bp, Artificial Sequence
  Description of Artificial Sequence: Synthetic oligonucleotide
  Target: SCN10A; (+) strand; PAM type: YTN; PAM sequence: TTT
ctgttaaacataggtaccta

SEQ ID NO: 73249 - DNA, 20 bp, Artificial Sequence
  Description of Artificial Sequence: Synthetic oligonucleotide
  Target: SCN10A; (+) strand; PAM type: YTN; PAM sequence: TTC
tgttaaacataggtacctaa

SEQ ID NO: 73250 - DNA, 20 bp, Artificial Sequence
  Description of Artificial Sequence: Synthetic oligonucleotide
  Target: SCN10A; (+) strand; PAM type: YTN; PAM sequence: CTG
ttaaacataggtacctaagg

SEQ ID NO: 73251 - DNA, 20 bp, Artificial Sequence
  Description of Artificial Sequence: Synthetic oligonucleotide
  Target: SCN10A; (+) strand; PAM type: YTN; PAM sequence: TTA
aacataggtacctaagggtg

SEQ ID NO: 73252 - DNA, 20 bp, Artificial Sequence
  Description of Artificial Sequence: Synthetic oligonucleotide
  Target: SCN10A; (+) strand; PAM type: YTN; PAM sequence: CTA
agggtgtaatagaagaatac

SEQ ID NO: 73253 - DNA, 20 bp, Artificial Sequence
  Description of Artificial Sequence: Synthetic oligonucleotide
  Target: SCN10A; (+) strand; PAM type: YTN; PAM sequence: CTT
acacctttactagataatac

SEQ ID NO: 73254 - DNA, 20 bp, Artificial Sequence
  Description of Artificial Sequence: Synthetic oligonucleotide
  Target: SCN10A; (+) strand; PAM type: YTN; PAM sequence: TTA
cacctttactagataatacc

SEQ ID NO: 73255 - DNA, 20 bp, Artificial Sequence
  Description of Artificial Sequence: Synthetic oligonucleotide
  Target: SCN10A; (+) strand; PAM type: YTN; PAM sequence: CTT
tactagataataccccttgc

SEQ ID NO: 73256 - DNA, 20 bp, Artificial Sequence
  Description of Artificial Sequence: Synthetic oligonucleotide
  Target: SCN10A; (+) strand; PAM type: YTN; PAM sequence: TTT
actagataataccccttgct

SEQ ID NO: 73257 - DNA, 20 bp, Artificial Sequence
  Description of Artificial Sequence: Synthetic oligonucleotide
  Target: SCN10A; (+) strand; PAM type: YTN; PAM sequence: TTA
ctagataataccccttgctt

SEQ ID NO: 73258 - DNA, 20 bp, Artificial Sequence
  Description of Artificial Sequence: Synthetic oligonucleotide
  Target: SCN10A; (+) strand; PAM type: YTN; PAM sequence: CTA
gataataccccttgctttcc

SEQ ID NO: 73259 - DNA, 20 bp, Artificial Sequence
  Description of Artificial Sequence: Synthetic oligonucleotide
  Target: SCN10A; (+) strand; PAM type: YTN; PAM sequence: CTT
gctttccaaagaggttgtcc

SEQ ID NO: 73260 - DNA, 20 bp, Artificial Sequence
  Description of Artificial Sequence: Synthetic oligonucleotide
  Target: SCN10A; (+) strand; PAM type: YTN; PAM sequence: TTG
ctttccaaagaggttgtcca

SEQ ID NO: 73261 - DNA, 20 bp, Artificial Sequence
  Description of Artificial Sequence: Synthetic oligonucleotide
  Target: SCN10A; (+) strand; PAM type: YTN; PAM sequence: CTT
tccaaagaggttgtccaaat

SEQ ID NO: 73262 - DNA, 20 bp, Artificial Sequence
  Description of Artificial Sequence: Synthetic oligonucleotide
  Target: SCN10A; (+) strand; PAM type: YTN; PAM sequence: TTT
ccaaagaggttgtccaaatt

SEQ ID NO: 73263 - DNA, 20 bp, Artificial Sequence
  Description of Artificial Sequence: Synthetic oligonucleotide
  Target: SCN10A; (+) strand; PAM type: YTN; PAM sequence: TTC
caaagaggttgtccaaattt

SEQ ID NO: 73264 - DNA, 20 bp, Artificial Sequence
  Description of Artificial Sequence: Synthetic oligonucleotide
  Target: SCN10A; (+) strand; PAM type: YTN; PAM sequence: TTG
tccaaatttacactcccacc

SEQ ID NO: 73265 - DNA, 20 bp, Artificial Sequence
  Description of Artificial Sequence: Synthetic oligonucleotide
  Target: SCN10A; (+) strand; PAM type: YTN; PAM sequence: TTT
acactcccaccagcagtgtg

SEQ ID NO: 73266 - DNA, 20 bp, Artificial Sequence
  Description of Artificial Sequence: Synthetic oligonucleotide
  Target: SCN10A; (+) strand; PAM type: YTN; PAM sequence: TTA
cactcccaccagcagtgtgt

SEQ ID NO: 73267 - DNA, 20 bp, Artificial Sequence
  Description of Artificial Sequence: Synthetic oligonucleotide
  Target: SCN10A; (+) strand; PAM type: YTN; PAM sequence: CTC
ccaccagcagtgtgtgagtt

SEQ ID NO: 73268 - DNA, 20 bp, Artificial Sequence
  Description of Artificial Sequence: Synthetic oligonucleotide
  Target: SCN10A; (+) strand; PAM type: YTN; PAM sequence: TTT
ctgttgctccatgtcattcc

SEQ ID NO: 73269 - DNA, 20 bp, Artificial Sequence
  Description of Artificial Sequence: Synthetic oligonucleotide
  Target: SCN10A; (+) strand; PAM type: YTN; PAM sequence: TTC
tgttgctccatgtcattccc

SEQ ID NO: 73270 - DNA, 20 bp, Artificial Sequence
  Description of Artificial Sequence: Synthetic oligonucleotide
  Target: SCN10A; (+) strand; PAM type: YTN; PAM sequence: CTG
ttgctccatgtcattcccaa

SEQ ID NO: 73271 - DNA, 20 bp, Artificial Sequence
  Description of Artificial Sequence: Synthetic oligonucleotide
  Target: SCN10A; (+) strand; PAM type: YTN; PAM sequence: TTG
ctccatgtcattcccaatac

SEQ ID NO: 73272 - DNA, 20 bp, Artificial Sequence
  Description of Artificial Sequence: Synthetic oligonucleotide
  Target: SCN10A; (+) strand; PAM type: YTN; PAM sequence: CTC
catgtcattcccaatacttg

SEQ ID NO: 73273 - DNA, 20 bp, Artificial Sequence
  Description of Artificial Sequence: Synthetic oligonucleotide
  Target: SCN10A; (+) strand; PAM type: YTN; PAM sequence: TTC
ccaatacttggtattgtgac

SEQ ID NO: 73274 - DNA, 20 bp, Artificial Sequence
  Description of Artificial Sequence: Synthetic oligonucleotide
  Target: SCN10A; (+) strand; PAM type: YTN; PAM sequence: CTT
ggtattgtgacactttaaaa

SEQ ID NO: 73275 - DNA, 20 bp, Artificial Sequence
  Description of Artificial Sequence: Synthetic oligonucleotide
  Target: SCN10A; (+) strand; PAM type: YTN; PAM sequence: TTG
gtattgtgacactttaaaaa

SEQ ID NO: 73276 - DNA, 20 bp, Artificial Sequence
  Description of Artificial Sequence: Synthetic oligonucleotide
  Target: SCN10A; (+) strand; PAM type: YTN; PAM sequence: TTG
tgacactttaaaaaatttcc

SEQ ID NO: 73277 - DNA, 20 bp, Artificial Sequence
  Description of Artificial Sequence: Synthetic oligonucleotide
  Target: SCN10A; (+) strand; PAM type: YTN; PAM sequence: CTT
taaaaaatttcccttctatg

SEQ ID NO: 73278 - DNA, 20 bp, Artificial Sequence
  Description of Artificial Sequence: Synthetic oligonucleotide
  Target: SCN10A; (+) strand; PAM type: YTN; PAM sequence: TTT
aaaaaatttcccttctatga

SEQ ID NO: 73279 - DNA, 20 bp, Artificial Sequence
  Description of Artificial Sequence: Synthetic oligonucleotide
  Target: SCN10A; (+) strand; PAM type: YTN; PAM sequence: TTA
aaaaatttcccttctatgat

SEQ ID NO: 73280 - DNA, 20 bp, Artificial Sequence
  Description of Artificial Sequence: Synthetic oligonucleotide
  Target: SCN10A; (+) strand; PAM type: YTN; PAM sequence: TTT
cccttctatgatgaacatgt

SEQ ID NO: 73281 - DNA, 20 bp, Artificial Sequence
  Description of Artificial Sequence: Synthetic oligonucleotide
  Target: SCN10A; (+) strand; PAM type: YTN; PAM sequence: TTC
ccttctatgatgaacatgta

SEQ ID NO: 73282 - DNA, 20 bp, Artificial Sequence
  Description of Artificial Sequence: Synthetic oligonucleotide
  Target: SCN10A; (+) strand; PAM type: YTN; PAM sequence: CTT
ctatgatgaacatgtaataa

SEQ ID NO: 73283 - DNA, 20 bp, Artificial Sequence
  Description of Artificial Sequence: Synthetic oligonucleotide
  Target: SCN10A; (+) strand; PAM type: YTN; PAM sequence: TTC
tatgatgaacatgtaataaa

SEQ ID NO: 73284 - DNA, 20 bp, Artificial Sequence
  Description of Artificial Sequence: Synthetic oligonucleotide
  Target: SCN10A; (+) strand; PAM type: YTN; PAM sequence: CTA
tgatgaacatgtaataaaat

SEQ ID NO: 73285 - DNA, 20 bp, Artificial Sequence
  Description of Artificial Sequence: Synthetic oligonucleotide
  Target: SCN10A; (+) strand; PAM type: YTN; PAM sequence: CTC
agtgtgattttaatttgcaa

SEQ ID NO: 73286 - DNA, 20 bp, Artificial Sequence
  Description of Artificial Sequence: Synthetic oligonucleotide
  Target: SCN10A; (+) strand; PAM type: YTN; PAM sequence: TTT
taatttgcaactctttgatt

SEQ ID NO: 73287 - DNA, 20 bp, Artificial Sequence
  Description of Artificial Sequence: Synthetic oligonucleotide
  Target: SCN10A; (+) strand; PAM type: YTN; PAM sequence: TTT
aatttgcaactctttgattt

SEQ ID NO: 73288 - DNA, 20 bp, Artificial Sequence
  Description of Artificial Sequence: Synthetic oligonucleotide
  Target: SCN10A; (+) strand; PAM type: YTN; PAM sequence: TTA
atttgcaactctttgattta

SEQ ID NO: 73289 - DNA, 20 bp, Artificial Sequence
  Description of Artificial Sequence: Synthetic oligonucleotide
  Target: SCN10A; (+) strand; PAM type: YTN; PAM sequence: TTT
gcaactctttgatttaaaaa

SEQ ID NO: 73290 - DNA, 20 bp, Artificial Sequence
  Description of Artificial Sequence: Synthetic oligonucleotide
  Target: SCN10A; (+) strand; PAM type: YTN; PAM sequence: TTG
caactctttgatttaaaaaa

SEQ ID NO: 73291 - DNA, 20 bp, Artificial Sequence
  Description of Artificial Sequence: Synthetic oligonucleotide
  Target: SCN10A; (+) strand; PAM type: YTN; PAM sequence: CTC
tttgatttaaaaaaaggtta

SEQ ID NO: 73292 - DNA, 20 bp, Artificial Sequence
  Description of Artificial Sequence: Synthetic oligonucleotide
  Target: SCN10A; (+) strand; PAM type: YTN; PAM sequence: CTT
tgatttaaaaaaaggttaag

SEQ ID NO: 73293 - DNA, 20 bp, Artificial Sequence
  Description of Artificial Sequence: Synthetic oligonucleotide
  Target: SCN10A; (+) strand; PAM type: YTN; PAM sequence: TTT
gatttaaaaaaaggttaaga

SEQ ID NO: 73294 - DNA, 20 bp, Artificial Sequence
  Description of Artificial Sequence: Synthetic oligonucleotide
  Target: SCN10A; (+) strand; PAM type: YTN; PAM sequence: TTG
atttaaaaaaaggttaagaa

SEQ ID NO: 73295 - DNA, 20 bp, Artificial Sequence
  Description of Artificial Sequence: Synthetic oligonucleotide
  Target: SCN10A; (+) strand; PAM type: YTN; PAM sequence: TTT
aaaaaaaggttaagaatact

SEQ ID NO: 73296 - DNA, 20 bp, Artificial Sequence
  Description of Artificial Sequence: Synthetic oligonucleotide
  Target: SCN10A; (+) strand; PAM type: YTN; PAM sequence: TTA
aaaaaaggttaagaatactt

SEQ ID NO: 73297 - DNA, 20 bp, Artificial Sequence
  Description of Artificial Sequence: Synthetic oligonucleotide
  Target: SCN10A; (+) strand; PAM type: YTN; PAM sequence: TTA
agaatactttcatatgttta

SEQ ID NO: 73298 - DNA, 20 bp, Artificial Sequence
  Description of Artificial Sequence: Synthetic oligonucleotide
  Target: SCN10A; (+) strand; PAM type: YTN; PAM sequence: CTT
tcatatgtttatggccattt

SEQ ID NO: 73299 - DNA, 20 bp, Artificial Sequence
  Description of Artificial Sequence: Synthetic oligonucleotide
  Target: SCN10A; (+) strand; PAM type: YTN; PAM sequence: TTT
catatgtttatggccatttg

SEQ ID NO: 73300 - DNA, 20 bp, Artificial Sequence
  Description of Artificial Sequence: Synthetic oligonucleotide
  Target: SCN10A; (+) strand; PAM type: YTN; PAM sequence: TTC
atatgtttatggccatttgg

SEQ ID NO: 73301 - DNA, 20 bp, Artificial Sequence
  Description of Artificial Sequence: Synthetic oligonucleotide
  Target: SCN10A; (+) strand; PAM type: YTN; PAM sequence: TTT
atggccatttggatttccac

SEQ ID NO: 73302 - DNA, 20 bp, Artificial Sequence
  Description of Artificial Sequence: Synthetic oligonucleotide
  Target: SCN10A; (+) strand; PAM type: YTN; PAM sequence: TTA
tggccatttggatttccact

SEQ ID NO: 73303 - DNA, 20 bp, Artificial Sequence
  Description of Artificial Sequence: Synthetic oligonucleotide
  Target: SCN10A; (+) strand; PAM type: YTN; PAM sequence: TTT
ggatttccacttttgtaaag

SEQ ID NO: 73304 - DNA, 20 bp, Artificial Sequence
  Description of Artificial Sequence: Synthetic oligonucleotide
  Target: SCN10A; (+) strand; PAM type: YTN; PAM sequence: TTG
gatttccacttttgtaaagt

SEQ ID NO: 73305 - DNA, 20 bp, Artificial Sequence
  Description of Artificial Sequence: Synthetic oligonucleotide
  Target: SCN10A; (+) strand; PAM type: YTN; PAM sequence: TTT
ccacttttgtaaagtgccta

SEQ ID NO: 73306 - DNA, 20 bp, Artificial Sequence
  Description of Artificial Sequence: Synthetic oligonucleotide
  Target: SCN10A; (+) strand; PAM type: YTN; PAM sequence: TTC
cacttttgtaaagtgcctat

SEQ ID NO: 73307 - DNA, 20 bp, Artificial Sequence
  Description of Artificial Sequence: Synthetic oligonucleotide
  Target: SCN10A; (+) strand; PAM type: YTN; PAM sequence: CTT
ttgtaaagtgcctattcaaa

SEQ ID NO: 73308 - DNA, 20 bp, Artificial Sequence
  Description of Artificial Sequence: Synthetic oligonucleotide
  Target: SCN10A; (+) strand; PAM type: YTN; PAM sequence: TTT
tgtaaagtgcctattcaaat

SEQ ID NO: 73309 - DNA, 20 bp, Artificial Sequence
  Description of Artificial Sequence: Synthetic oligonucleotide
  Target: SCN10A; (+) strand; PAM type: YTN; PAM sequence: TTT
gtaaagtgcctattcaaatt

SEQ ID NO: 73310 - DNA, 20 bp, Artificial Sequence
  Description of Artificial Sequence: Synthetic oligonucleotide
  Target: SCN10A; (+) strand; PAM type: YTN; PAM sequence: TTG
taaagtgcctattcaaattt

SEQ ID NO: 73311 - DNA, 20 bp, Artificial Sequence
  Description of Artificial Sequence: Synthetic oligonucleotide
  Target: SCN10A; (+) strand; PAM type: YTN; PAM sequence: CTA
ttcaaattttgtgctatttt

SEQ ID NO: 73312 - DNA, 20 bp, Artificial Sequence
  Description of Artificial Sequence: Synthetic oligonucleotide
  Target: SCN10A; (+) strand; PAM type: YTN; PAM sequence: TTC
aaattttgtgctattttaca

SEQ ID NO: 73313 - DNA, 20 bp, Artificial Sequence
  Description of Artificial Sequence: Synthetic oligonucleotide
  Target: SCN10A; (+) strand; PAM type: YTN; PAM sequence: TTT
tgtgctattttacaagtggt

SEQ ID NO: 73314 - DNA, 20 bp, Artificial Sequence
  Description of Artificial Sequence: Synthetic oligonucleotide
  Target: SCN10A; (+) strand; PAM type: YTN; PAM sequence: TTT
gtgctattttacaagtggtt

SEQ ID NO: 73315 - DNA, 20 bp, Artificial Sequence
  Description of Artificial Sequence: Synthetic oligonucleotide
  Target: SCN10A; (+) strand; PAM type: YTN; PAM sequence: TTG
tgctattttacaagtggttg

SEQ ID NO: 73316 - DNA, 20 bp, Artificial Sequence
  Description of Artificial Sequence: Synthetic oligonucleotide
  Target: SCN10A; (+) strand; PAM type: YTN; PAM sequence: CTA
ttttacaagtggttgttctg

SEQ ID NO: 73317 - DNA, 20 bp, Artificial Sequence
  Description of Artificial Sequence: Synthetic oligonucleotide
  Target: SCN10A; (+) strand; PAM type: YTN; PAM sequence: TTT
tacaagtggttgttctgaca

SEQ ID NO: 73318 - DNA, 20 bp, Artificial Sequence
  Description of Artificial Sequence: Synthetic oligonucleotide
  Target: SCN10A; (+) strand; PAM type: YTN; PAM sequence: TTT
acaagtggttgttctgacat

SEQ ID NO: 73319 - DNA, 20 bp, Artificial Sequence
  Description of Artificial Sequence: Synthetic oligonucleotide
  Target: SCN10A; (+) strand; PAM type: YTN; PAM sequence: TTA
caagtggttgttctgacatt

SEQ ID NO: 73320 - DNA, 20 bp, Artificial Sequence
  Description of Artificial Sequence: Synthetic oligonucleotide
  Target: SCN10A; (+) strand; PAM type: YTN; PAM sequence: TTG
ttctgacatttttctaattg

SEQ ID NO: 73321 - DNA, 20 bp, Artificial Sequence
  Description of Artificial Sequence: Synthetic oligonucleotide
  Target: SCN10A; (+) strand; PAM type: YTN; PAM sequence: TTC
tgacatttttctaattgatt

SEQ ID NO: 73322 - DNA, 20 bp, Artificial Sequence
  Description of Artificial Sequence: Synthetic oligonucleotide
  Target: SCN10A; (+) strand; PAM type: YTN; PAM sequence: CTG
acatttttctaattgatttg

SEQ ID NO: 73323 - DNA, 20 bp, Artificial Sequence
  Description of Artificial Sequence: Synthetic oligonucleotide
  Target: SCN10A; (+) strand; PAM type: YTN; PAM sequence: TTT
ttctaattgatttgtagagt

SEQ ID NO: 73324 - DNA, 20 bp, Artificial Sequence
  Description of Artificial Sequence: Synthetic oligonucleotide
  Target: SCN10A; (+) strand; PAM type: YTN; PAM sequence: TTT
tctaattgatttgtagagtt

SEQ ID NO: 73325 - DNA, 20 bp, Artificial Sequence
  Description of Artificial Sequence: Synthetic oligonucleotide
  Target: SCN10A; (+) strand; PAM type: YTN; PAM sequence: TTT
ctaattgatttgtagagttc

SEQ ID NO: 73326 - DNA, 20 bp, Artificial Sequence
  Description of Artificial Sequence: Synthetic oligonucleotide
  Target: SCN10A; (+) strand; PAM type: YTN; PAM sequence: TTC
taattgatttgtagagttca

SEQ ID NO: 73327 - DNA, 20 bp, Artificial Sequence
  Description of Artificial Sequence: Synthetic oligonucleotide
  Target: SCN10A; (+) strand; PAM type: YTN; PAM sequence: CTA
attgatttgtagagttcatt

SEQ ID NO: 73328 - DNA, 20 bp, Artificial Sequence
  Description of Artificial Sequence: Synthetic oligonucleotide
  Target: SCN10A; (+) strand; PAM type: YTN; PAM sequence: TTG
atttgtagagttcattactc

SEQ ID NO: 73329 - DNA, 20 bp, Artificial Sequence
  Description of Artificial Sequence: Synthetic oligonucleotide
  Target: SCN10A; (+) strand; PAM type: YTN; PAM sequence: TTT
gtagagttcattactctgaa

SEQ ID NO: 73330 - DNA, 20 bp, Artificial Sequence
  Description of Artificial Sequence: Synthetic oligonucleotide
  Target: SCN10A; (+) strand; PAM type: YTN; PAM sequence: TTG
tagagttcattactctgaat

SEQ ID NO: 73331 - DNA, 20 bp, Artificial Sequence
  Description of Artificial Sequence: Synthetic oligonucleotide
  Target: SCN10A; (+) strand; PAM type: YTN; PAM sequence: TTC
attactctgaatataagcac

SEQ ID NO: 73332 - DNA, 20 bp, Artificial Sequence
  Description of Artificial Sequence: Synthetic oligonucleotide
  Target: SCN10A; (+) strand; PAM type: YTN; PAM sequence: TTA
ctctgaatataagcacttgc

SEQ ID NO: 73333 - DNA, 20 bp, Artificial Sequence
  Description of Artificial Sequence: Synthetic oligonucleotide
  Target: SCN10A; (+) strand; PAM type: YTN; PAM sequence: CTC
tgaatataagcacttgcttt

SEQ ID NO: 73334 - DNA, 20 bp, Artificial Sequence
  Description of Artificial Sequence: Synthetic oligonucleotide
  Target: SCN10A; (+) strand; PAM type: YTN; PAM sequence: CTG
aatataagcacttgcttttt

SEQ ID NO: 73335 - DNA, 20 bp, Artificial Sequence
  Description of Artificial Sequence: Synthetic oligonucleotide
  Target: SCN10A; (+) strand; PAM type: YTN; PAM sequence: CTT
gctttttcatgctcttaaag

SEQ ID NO: 73336 - DNA, 20 bp, Artificial Sequence
  Description of Artificial Sequence: Synthetic oligonucleotide
  Target: SCN10A; (+) strand; PAM type: YTN; PAM sequence: TTG
ctttttcatgctcttaaagt

SEQ ID NO: 73337 - DNA, 20 bp, Artificial Sequence
  Description of Artificial Sequence: Synthetic oligonucleotide
  Target: SCN10A; (+) strand; PAM type: YTN; PAM sequence: CTT
tttcatgctcttaaagttgt

SEQ ID NO: 73338 - DNA, 20 bp, Artificial Sequence
  Description of Artificial Sequence: Synthetic oligonucleotide
  Target: SCN10A; (+) strand; PAM type: YTN; PAM sequence: TTT
ttcatgctcttaaagttgtc

SEQ ID NO: 73339 - DNA, 20 bp, Artificial Sequence
  Description of Artificial Sequence: Synthetic oligonucleotide
  Target: SCN10A; (+) strand; PAM type: YTN; PAM sequence: TTT
tcatgctcttaaagttgtct

SEQ ID NO: 73340 - DNA, 20 bp, Artificial Sequence
  Description of Artificial Sequence: Synthetic oligonucleotide
  Target: SCN10A; (+) strand; PAM type: YTN; PAM sequence: TTT
catgctcttaaagttgtctt

SEQ ID NO: 73341 - DNA, 20 bp, Artificial Sequence
  Description of Artificial Sequence: Synthetic oligonucleotide
  Target: SCN10A; (+) strand; PAM type: YTN; PAM sequence: TTC
atgctcttaaagttgtcttc

SEQ ID NO: 73342 - DNA, 20 bp, Artificial Sequence
  Description of Artificial Sequence: Synthetic oligonucleotide
  Target: SCN10A; (+) strand; PAM type: YTN; PAM sequence: CTC
ttaaagttgtcttctgatga

SEQ ID NO: 73343 - DNA, 20 bp, Artificial Sequence
  Description of Artificial Sequence: Synthetic oligonucleotide
  Target: SCN10A; (+) strand; PAM type: YTN; PAM sequence: CTT
aaagttgtcttctgatgaac

SEQ ID NO: 73344 - DNA, 20 bp, Artificial Sequence
  Description of Artificial Sequence: Synthetic oligonucleotide
  Target: SCN10A; (+) strand; PAM type: YTN; PAM sequence: TTA
aagttgtcttctgatgaaca

SEQ ID NO: 73345 - DNA, 20 bp, Artificial Sequence
  Description of Artificial Sequence: Synthetic oligonucleotide
  Target: SCN10A; (+) strand; PAM type: YTN; PAM sequence: TTG
tcttctgatgaacattctta

SEQ ID NO: 73346 - DNA, 20 bp, Artificial Sequence
  Description of Artificial Sequence: Synthetic oligonucleotide
  Target: SCN10A; (+) strand; PAM type: YTN; PAM sequence: CTT
ctgatgaacattcttaatta

SEQ ID NO: 73347 - DNA, 20 bp, Artificial Sequence
  Description of Artificial Sequence: Synthetic oligonucleotide
  Target: SCN10A; (+) strand; PAM type: YTN; PAM sequence: TTC
tgatgaacattcttaattat

SEQ ID NO: 73348 - DNA, 20 bp, Artificial Sequence
  Description of Artificial Sequence: Synthetic oligonucleotide
  Target: SCN10A; (+) strand; PAM type: YTN; PAM sequence: CTG
atgaacattcttaattatag

SEQ ID NO: 73349 - DNA, 20 bp, Artificial Sequence
  Description of Artificial Sequence: Synthetic oligonucleotide
  Target: SCN10A; (+) strand; PAM type: YTN; PAM sequence: TTC
ttaattatagtatactaaaa

SEQ ID NO: 73350 - DNA, 20 bp, Artificial Sequence
  Description of Artificial Sequence: Synthetic oligonucleotide
  Target: SCN10A; (+) strand; PAM type: YTN; PAM sequence: CTT
aattatagtatactaaaatg

SEQ ID NO: 73351 - DNA, 20 bp, Artificial Sequence
  Description of Artificial Sequence: Synthetic oligonucleotide
  Target: SCN10A; (+) strand; PAM type: YTN; PAM sequence: TTA
attatagtatactaaaatgt

SEQ ID NO: 73352 - DNA, 20 bp, Artificial Sequence
  Description of Artificial Sequence: Synthetic oligonucleotide
  Target: SCN10A; (+) strand; PAM type: YTN; PAM sequence: TTA
tagtatactaaaatgtatca

SEQ ID NO: 73353 - DNA, 20 bp, Artificial Sequence
  Description of Artificial Sequence: Synthetic oligonucleotide
  Target: SCN10A; (+) strand; PAM type: YTN; PAM sequence: CTA
aaatgtatcagttttttcct

SEQ ID NO: 73354 - DNA, 20 bp, Artificial Sequence
  Description of Artificial Sequence: Synthetic oligonucleotide
  Target: SCN10A; (+) strand; PAM type: YTN; PAM sequence: TTT
tttcctgtatagttagtgct

SEQ ID NO: 73355 - DNA, 20 bp, Artificial Sequence
  Description of Artificial Sequence: Synthetic oligonucleotide
  Target: SCN10A; (+) strand; PAM type: YTN; PAM sequence: TTT
ttcctgtatagttagtgctt

SEQ ID NO: 73356 - DNA, 20 bp, Artificial Sequence
  Description of Artificial Sequence: Synthetic oligonucleotide
  Target: SCN10A; (+) strand; PAM type: YTN; PAM sequence: TTT
tcctgtatagttagtgcttc

SEQ ID NO: 73357 - DNA, 20 bp, Artificial Sequence
  Description of Artificial Sequence: Synthetic oligonucleotide
  Target: SCN10A; (+) strand; PAM type: YTN; PAM sequence: TTT
cctgtatagttagtgcttct

SEQ ID NO: 73358 - DNA, 20 bp, Artificial Sequence
  Description of Artificial Sequence: Synthetic oligonucleotide
  Target: SCN10A; (+) strand; PAM type: YTN; PAM sequence: TTC
ctgtatagttagtgcttctt

SEQ ID NO: 73359 - DNA, 20 bp, Artificial Sequence
  Description of Artificial Sequence: Synthetic oligonucleotide
  Target: SCN10A; (+) strand; PAM type: YTN; PAM sequence: CTG
tatagttagtgcttcttgtg

SEQ ID NO: 73360 - DNA, 20 bp, Artificial Sequence
  Description of Artificial Sequence: Synthetic oligonucleotide
  Target: SCN10A; (+) strand; PAM type: YTN; PAM sequence: TTA
gtgcttcttgtgtcatatgt

SEQ ID NO: 73361 - DNA, 20 bp, Artificial Sequence
  Description of Artificial Sequence: Synthetic oligonucleotide
  Target: SCN10A; (+) strand; PAM type: YTN; PAM sequence: CTT
cttgtgtcatatgtaataaa

SEQ ID NO: 73362 - DNA, 20 bp, Artificial Sequence
  Description of Artificial Sequence: Synthetic oligonucleotide
  Target: SCN10A; (+) strand; PAM type: YTN; PAM sequence: TTC
ttgtgtcatatgtaataaag

SEQ ID NO: 73363 - DNA, 20 bp, Artificial Sequence
  Description of Artificial Sequence: Synthetic oligonucleotide
  Target: SCN10A; (+) strand; PAM type: YTN; PAM sequence: CTT
gtgtcatatgtaataaagtt

SEQ ID NO: 73364 - DNA, 20 bp, Artificial Sequence
  Description of Artificial Sequence: Synthetic oligonucleotide
  Target: SCN10A; (+) strand; PAM type: YTN; PAM sequence: TTG
tgtcatatgtaataaagttt

SEQ ID NO: 73365 - DNA, 20 bp, Artificial Sequence
  Description of Artificial Sequence: Synthetic oligonucleotide
  Target: SCN10A; (+) strand; PAM type: YTN; PAM sequence: TTT
ttcttagtctgaggtcataa

SEQ ID NO: 73366 - DNA, 20 bp, Artificial Sequence
  Description of Artificial Sequence: Synthetic oligonucleotide
  Target: SCN10A; (+) strand; PAM type: YTN; PAM sequence: TTT
tcttagtctgaggtcataaa

SEQ ID NO: 73367 - DNA, 20 bp, Artificial Sequence
  Description of Artificial Sequence: Synthetic oligonucleotide
  Target: SCN10A; (+) strand; PAM type: YTN; PAM sequence: TTT
cttagtctgaggtcataaag

SEQ ID NO: 73368 - DNA, 20 bp, Artificial Sequence
  Description of Artificial Sequence: Synthetic oligonucleotide
  Target: SCN10A; (+) strand; PAM type: YTN; PAM sequence: TTC
ttagtctgaggtcataaaga

SEQ ID NO: 73369 - DNA, 20 bp, Artificial Sequence
  Description of Artificial Sequence: Synthetic oligonucleotide
  Target: SCN10A; (+) strand; PAM type: YTN; PAM sequence: CTT
agtctgaggtcataaagata

SEQ ID NO: 73370 - DNA, 20 bp, Artificial Sequence
  Description of Artificial Sequence: Synthetic oligonucleotide
  Target: SCN10A; (+) strand; PAM type: YTN; PAM sequence: TTA
gtctgaggtcataaagatat

SEQ ID NO: 73371 - DNA, 20 bp, Artificial Sequence
  Description of Artificial Sequence: Synthetic oligonucleotide
  Target: SCN10A; (+) strand; PAM type: YTN; PAM sequence: CTG
aggtcataaagatattcctc

SEQ ID NO: 73372 - DNA, 20 bp, Artificial Sequence
  Description of Artificial Sequence: Synthetic oligonucleotide
  Target: SCN10A; (+) strand; PAM type: YTN; PAM sequence: TTC
ctctttgttttttcctttca

SEQ ID NO: 73373 - DNA, 20 bp, Artificial Sequence
  Description of Artificial Sequence: Synthetic oligonucleotide
  Target: SCN10A; (+) strand; PAM type: YTN; PAM sequence: CTC
tttgttttttcctttcaaaa

SEQ ID NO: 73374 - DNA, 20 bp, Artificial Sequence
  Description of Artificial Sequence: Synthetic oligonucleotide
  Target: SCN10A; (+) strand; PAM type: YTN; PAM sequence: CTT
tgttttttcctttcaaaaag

SEQ ID NO: 73375 - DNA, 20 bp, Artificial Sequence
  Description of Artificial Sequence: Synthetic oligonucleotide
  Target: SCN10A; (+) strand; PAM type: YTN; PAM sequence: TTT
gttttttcctttcaaaaagc

SEQ ID NO: 73376 - DNA, 20 bp, Artificial Sequence
  Description of Artificial Sequence: Synthetic oligonucleotide
  Target: SCN10A; (+) strand; PAM type: YTN; PAM sequence: TTG
ttttttcctttcaaaaagct

SEQ ID NO: 73377 - DNA, 20 bp, Artificial Sequence
  Description of Artificial Sequence: Synthetic oligonucleotide
  Target: SCN10A; (+) strand; PAM type: YTN; PAM sequence: TTT
tttcctttcaaaaagcttat

SEQ ID NO: 73378 - DNA, 20 bp, Artificial Sequence
  Description of Artificial Sequence: Synthetic oligonucleotide
  Target: SCN10A; (+) strand; PAM type: YTN; PAM sequence: TTT
ttcctttcaaaaagcttatc

SEQ ID NO: 73379 - DNA, 20 bp, Artificial Sequence
  Description of Artificial Sequence: Synthetic oligonucleotide
  Target: SCN10A; (+) strand; PAM type: YTN; PAM sequence: TTT
tcctttcaaaaagcttatcc

SEQ ID NO: 73380 - DNA, 20 bp, Artificial Sequence
  Description of Artificial Sequence: Synthetic oligonucleotide
  Target: SCN10A; (+) strand; PAM type: YTN; PAM sequence: TTT
cctttcaaaaagcttatcca

SEQ ID NO: 73381 - DNA, 20 bp, Artificial Sequence
  Description of Artificial Sequence: Synthetic oligonucleotide
  Target: SCN10A; (+) strand; PAM type: YTN; PAM sequence: TTC
ctttcaaaaagcttatccac

SEQ ID NO: 73382 - DNA, 20 bp, Artificial Sequence
  Description of Artificial Sequence: Synthetic oligonucleotide
  Target: SCN10A; (+) strand; PAM type: YTN; PAM sequence: CTT
tcaaaaagcttatccaccac

SEQ ID NO: 73383 - DNA, 20 bp, Artificial Sequence
  Description of Artificial Sequence: Synthetic oligonucleotide
  Target: SCN10A; (+) strand; PAM type: YTN; PAM sequence: TTT
caaaaagcttatccaccacg

SEQ ID NO: 73384 - DNA, 20 bp, Artificial Sequence
  Description of Artificial Sequence: Synthetic oligonucleotide
  Target: SCN10A; (+) strand; PAM type: YTN; PAM sequence: TTC
aaaaagcttatccaccacga

SEQ ID NO: 73385 - DNA, 20 bp, Artificial Sequence
  Description of Artificial Sequence: Synthetic oligonucleotide
  Target: SCN10A; (+) strand; PAM type: YTN; PAM sequence: CTT
atccaccacgatcaagtcgg

SEQ ID NO: 73386 - DNA, 20 bp, Artificial Sequence
  Description of Artificial Sequence: Synthetic oligonucleotide
  Target: SCN10A; (+) strand; PAM type: YTN; PAM sequence: TTA
tccaccacgatcaagtcggc

SEQ ID NO: 73387 - DNA, 20 bp, Artificial Sequence
  Description of Artificial Sequence: Synthetic oligonucleotide
  Target: SCN10A; (+) strand; PAM type: YTN; PAM sequence: CTT
catacctgggatcaaagctg

SEQ ID NO: 73388 - DNA, 20 bp, Artificial Sequence
  Description of Artificial Sequence: Synthetic oligonucleotide
  Target: SCN10A; (+) strand; PAM type: YTN; PAM sequence: TTC
atacctgggatcaaagctgg

SEQ ID NO: 73389 - DNA, 20 bp, Artificial Sequence
  Description of Artificial Sequence: Synthetic oligonucleotide
  Target: SCN10A; (+) strand; PAM type: YTN; PAM sequence: CTG
ggatcaaagctggttcaaca

SEQ ID NO: 73390 - DNA, 20 bp, Artificial Sequence
  Description of Artificial Sequence: Synthetic oligonucleotide
  Target: SCN10A; (+) strand; PAM type: YTN; PAM sequence: CTG
gttcaacatacgcaagtcaa

SEQ ID NO: 73391 - DNA, 20 bp, Artificial Sequence
  Description of Artificial Sequence: Synthetic oligonucleotide
  Target: SCN10A; (+) strand; PAM type: YTN; PAM sequence: TTC
aacatacgcaagtcaataaa

SEQ ID NO: 73392 - DNA, 20 bp, Artificial Sequence
  Description of Artificial Sequence: Synthetic oligonucleotide
  Target: SCN10A; (+) strand; PAM type: YTN; PAM sequence: TTA
tctcaatagatgcagaaaag

SEQ ID NO: 73393 - DNA, 20 bp, Artificial Sequence
  Description of Artificial Sequence: Synthetic oligonucleotide
  Target: SCN10A; (+) strand; PAM type: YTN; PAM sequence: CTC
aatagatgcagaaaaggtct

SEQ ID NO: 73394 - DNA, 20 bp, Artificial Sequence
  Description of Artificial Sequence: Synthetic oligonucleotide
  Target: SCN10A; (+) strand; PAM type: YTN; PAM sequence: CTT
cgacaaaattcaacacccat

SEQ ID NO: 73395 - DNA, 20 bp, Artificial Sequence
  Description of Artificial Sequence: Synthetic oligonucleotide
  Target: SCN10A; (+) strand; PAM type: YTN; PAM sequence: TTC
gacaaaattcaacacccatt

SEQ ID NO: 73396 - DNA, 20 bp, Artificial Sequence
  Description of Artificial Sequence: Synthetic oligonucleotide
  Target: SCN10A; (+) strand; PAM type: YTN; PAM sequence: TTC
aacacccattcatgctaaaa

SEQ ID NO: 73397 - DNA, 20 bp, Artificial Sequence
  Description of Artificial Sequence: Synthetic oligonucleotide
  Target: SCN10A; (+) strand; PAM type: YTN; PAM sequence: TTC
atgctaaaagctctcaataa

SEQ ID NO: 73398 - DNA, 20 bp, Artificial Sequence
  Description of Artificial Sequence: Synthetic oligonucleotide
  Target: SCN10A; (+) strand; PAM type: YTN; PAM sequence: CTA
aaagctctcaataaactagg

SEQ ID NO: 73399 - DNA, 20 bp, Artificial Sequence
  Description of Artificial Sequence: Synthetic oligonucleotide
  Target: SCN10A; (+) strand; PAM type: YTN; PAM sequence: CTC
tcaataaactaggtattgat

SEQ ID NO: 73400 - DNA, 20 bp, Artificial Sequence
  Description of Artificial Sequence: Synthetic oligonucleotide
  Target: SCN10A; (+) strand; PAM type: YTN; PAM sequence: CTC
aataaactaggtattgatgg

SEQ ID NO: 73401 - DNA, 20 bp, Artificial Sequence
  Description of Artificial Sequence: Synthetic oligonucleotide
  Target: SCN10A; (+) strand; PAM type: YTN; PAM sequence: CTA
ggtattgatggaatgtatct

SEQ ID NO: 73402 - DNA, 20 bp, Artificial Sequence
  Description of Artificial Sequence: Synthetic oligonucleotide
  Target: SCN10A; (+) strand; PAM type: YTN; PAM sequence: TTG
atggaatgtatctcaaaata

SEQ ID NO: 73403 - DNA, 20 bp, Artificial Sequence
  Description of Artificial Sequence: Synthetic oligonucleotide
  Target: SCN10A; (+) strand; PAM type: YTN; PAM sequence: CTC
aaaataataagaactattta

SEQ ID NO: 73404 - DNA, 20 bp, Artificial Sequence
  Description of Artificial Sequence: Synthetic oligonucleotide
  Target: SCN10A; (+) strand; PAM type: YTN; PAM sequence: CTA
tttatgacaagcccccagcc

SEQ ID NO: 73405 - DNA, 20 bp, Artificial Sequence
  Description of Artificial Sequence: Synthetic oligonucleotide
  Target: SCN10A; (+) strand; PAM type: YTN; PAM sequence: TTT
atgacaagcccccagccaat

SEQ ID NO: 73406 - DNA, 20 bp, Artificial Sequence
  Description of Artificial Sequence: Synthetic oligonucleotide
  Target: SCN10A; (+) strand; PAM type: YTN; PAM sequence: TTA
tgacaagcccccagccaata

SEQ ID NO: 73407 - DNA, 20 bp, Artificial Sequence
  Description of Artificial Sequence: Synthetic oligonucleotide
  Target: SCN10A; (+) strand; PAM type: YTN; PAM sequence: CTG
aatgggcaaaaactggaagc

SEQ ID NO: 73408 - DNA, 20 bp, Artificial Sequence
  Description of Artificial Sequence: Synthetic oligonucleotide
  Target: SCN10A; (+) strand; PAM type: YTN; PAM sequence: CTG
gaagcatttcctttgaaaac

SEQ ID NO: 73409 - DNA, 20 bp, Artificial Sequence
  Description of Artificial Sequence: Synthetic oligonucleotide
  Target: SCN10A; (+) strand; PAM type: YTN; PAM sequence: TTT
cctttgaaaaccagcacaag

SEQ ID NO: 73410 - DNA, 20 bp, Artificial Sequence
  Description of Artificial Sequence: Synthetic oligonucleotide
  Target: SCN10A; (+) strand; PAM type: YTN; PAM sequence: TTC
ctttgaaaaccagcacaaga

SEQ ID NO: 73411 - DNA, 20 bp, Artificial Sequence
  Description of Artificial Sequence: Synthetic oligonucleotide
  Target: SCN10A; (+) strand; PAM type: YTN; PAM sequence: CTT
tgaaaaccagcacaagacaa

SEQ ID NO: 73412 - DNA, 20 bp, Artificial Sequence
  Description of Artificial Sequence: Synthetic oligonucleotide
  Target: SCN10A; (+) strand; PAM type: YTN; PAM sequence: TTT
gaaaaccagcacaagacaag

SEQ ID NO: 73413 - DNA, 20 bp, Artificial Sequence
  Description of Artificial Sequence: Synthetic oligonucleotide
  Target: SCN10A; (+) strand; PAM type: YTN; PAM sequence: TTG
aaaaccagcacaagacaaga

SEQ ID NO: 73414 - DNA, 20 bp, Artificial Sequence
  Description of Artificial Sequence: Synthetic oligonucleotide
  Target: SCN10A; (+) strand; PAM type: YTN; PAM sequence: CTA
tctcaccactcttattcaac

SEQ ID NO: 73415 - DNA, 20 bp, Artificial Sequence
  Description of Artificial Sequence: Synthetic oligonucleotide
  Target: SCN10A; (+) strand; PAM type: YTN; PAM sequence: CTC
accactcttattcaacatag

SEQ ID NO: 73416 - DNA, 20 bp, Artificial Sequence
  Description of Artificial Sequence: Synthetic oligonucleotide
  Target: SCN10A; (+) strand; PAM type: YTN; PAM sequence: CTC
ttattcaacatagtattgga

SEQ ID NO: 73417 - DNA, 20 bp, Artificial Sequence
  Description of Artificial Sequence: Synthetic oligonucleotide
  Target: SCN10A; (+) strand; PAM type: YTN; PAM sequence: CTT
attcaacatagtattggaag

SEQ ID NO: 73418 - DNA, 20 bp, Artificial Sequence
  Description of Artificial Sequence: Synthetic oligonucleotide
  Target: SCN10A; (+) strand; PAM type: YTN; PAM sequence: TTA
ttcaacatagtattggaagt

SEQ ID NO: 73419 - DNA, 20 bp, Artificial Sequence
  Description of Artificial Sequence: Synthetic oligonucleotide
  Target: SCN10A; (+) strand; PAM type: YTN; PAM sequence: TTC
aacatagtattggaagttct

SEQ ID NO: 73420 - DNA, 20 bp, Artificial Sequence
  Description of Artificial Sequence: Synthetic oligonucleotide
  Target: SCN10A; (+) strand; PAM type: YTN; PAM sequence: TTG
gaagttctggccagggcgat

SEQ ID NO: 73421 - DNA, 20 bp, Artificial Sequence
  Description of Artificial Sequence: Synthetic oligonucleotide
  Target: SCN10A; (+) strand; PAM type: YTN; PAM sequence: TTC
tggccagggcgatcaggcaa

SEQ ID NO: 73422 - DNA, 20 bp, Artificial Sequence
  Description of Artificial Sequence: Synthetic oligonucleotide
  Target: SCN10A; (+) strand; PAM type: YTN; PAM sequence: CTG
gccagggcgatcaggcaaga

SEQ ID NO: 73423 - DNA, 20 bp, Artificial Sequence
  Description of Artificial Sequence: Synthetic oligonucleotide
  Target: SCN10A; (+) strand; PAM type: YTN; PAM sequence: TTC
aaataggaaaagaggaagtc

SEQ ID NO: 73424 - DNA, 20 bp, Artificial Sequence
  Description of Artificial Sequence: Synthetic oligonucleotide
  Target: SCN10A; (+) strand; PAM type: YTN; PAM sequence: TTG
tctctgtttgcagatgacat

SEQ ID NO: 73425 - DNA, 20 bp, Artificial Sequence
  Description of Artificial Sequence: Synthetic oligonucleotide
  Target: SCN10A; (+) strand; PAM type: YTN; PAM sequence: CTC
tgtttgcagatgacatgact

SEQ ID NO: 73426 - DNA, 20 bp, Artificial Sequence
  Description of Artificial Sequence: Synthetic oligonucleotide
  Target: SCN10A; (+) strand; PAM type: YTN; PAM sequence: CTG
tttgcagatgacatgactgt

SEQ ID NO: 73427 - DNA, 20 bp, Artificial Sequence
  Description of Artificial Sequence: Synthetic oligonucleotide
  Target: SCN10A; (+) strand; PAM type: YTN; PAM sequence: TTT
gcagatgacatgactgtata

SEQ ID NO: 73428 - DNA, 20 bp, Artificial Sequence
  Description of Artificial Sequence: Synthetic oligonucleotide
  Target: SCN10A; (+) strand; PAM type: YTN; PAM sequence: TTG
cagatgacatgactgtatat

SEQ ID NO: 73429 - DNA, 20 bp, Artificial Sequence
  Description of Artificial Sequence: Synthetic oligonucleotide
  Target: SCN10A; (+) strand; PAM type: YTN; PAM sequence: CTG
tatatttagaaaaccccatc

SEQ ID NO: 73430 - DNA, 20 bp, Artificial Sequence
  Description of Artificial Sequence: Synthetic oligonucleotide
  Target: SCN10A; (+) strand; PAM type: YTN; PAM sequence: TTT
agaaaaccccatcatctcag

SEQ ID NO: 73431 - DNA, 20 bp, Artificial Sequence
  Description of Artificial Sequence: Synthetic oligonucleotide
  Target: SCN10A; (+) strand; PAM type: YTN; PAM sequence: TTA
gaaaaccccatcatctcagc

SEQ ID NO: 73432 - DNA, 20 bp, Artificial Sequence
  Description of Artificial Sequence: Synthetic oligonucleotide
  Target: SCN10A; (+) strand; PAM type: YTN; PAM sequence: CTC
agcccaaaatctccttaagc

SEQ ID NO: 73433 - DNA, 20 bp, Artificial Sequence
  Description of Artificial Sequence: Synthetic oligonucleotide
  Target: SCN10A; (+) strand; PAM type: YTN; PAM sequence: CTC
cttaagctgataagcaactt

SEQ ID NO: 73434 - DNA, 20 bp, Artificial Sequence
  Description of Artificial Sequence: Synthetic oligonucleotide
  Target: SCN10A; (+) strand; PAM type: YTN; PAM sequence: CTT
aagctgataagcaacttcag

SEQ ID NO: 73435 - DNA, 20 bp, Artificial Sequence
  Description of Artificial Sequence: Synthetic oligonucleotide
  Target: SCN10A; (+) strand; PAM type: YTN; PAM sequence: TTA
agctgataagcaacttcagc

SEQ ID NO: 73436 - DNA, 20 bp, Artificial Sequence
  Description of Artificial Sequence: Synthetic oligonucleotide
  Target: SCN10A; (+) strand; PAM type: YTN; PAM sequence: CTG
ataagcaacttcagcaaagt

SEQ ID NO: 73437 - DNA, 20 bp, Artificial Sequence
  Description of Artificial Sequence: Synthetic oligonucleotide
  Target: SCN10A; (+) strand; PAM type: YTN; PAM sequence: CTT
cagcaaagtctcaggataca

SEQ ID NO: 73438 - DNA, 20 bp, Artificial Sequence
  Description of Artificial Sequence: Synthetic oligonucleotide
  Target: SCN10A; (+) strand; PAM type: YTN; PAM sequence: TTC
agcaaagtctcaggatacaa

SEQ ID NO: 73439 - DNA, 20 bp, Artificial Sequence
  Description of Artificial Sequence: Synthetic oligonucleotide
  Target: SCN10A; (+) strand; PAM type: YTN; PAM sequence: CTC
aggatacaaaatcaatgtgc

SEQ ID NO: 73440 - DNA, 20 bp, Artificial Sequence
  Description of Artificial Sequence: Synthetic oligonucleotide
  Target: SCN10A; (+) strand; PAM type: YTN; PAM sequence: TTC
ccatacaccaataacagaca

SEQ ID NO: 73441 - DNA, 20 bp, Artificial Sequence
  Description of Artificial Sequence: Synthetic oligonucleotide
  Target: SCN10A; (+) strand; PAM type: YTN; PAM sequence: CTC
ccattcacaattgcaacaaa

SEQ ID NO: 73442 - DNA, 20 bp, Artificial Sequence
  Description of Artificial Sequence: Synthetic oligonucleotide
  Target: SCN10A; (+) strand; PAM type: YTN; PAM sequence: TTC
acaattgcaacaaagagaat

SEQ ID NO: 73443 - DNA, 20 bp, Artificial Sequence
  Description of Artificial Sequence: Synthetic oligonucleotide
  Target: SCN10A; (+) strand; PAM type: YTN; PAM sequence: TTG
caacaaagagaataaaatat

SEQ ID NO: 73444 - DNA, 20 bp, Artificial Sequence
  Description of Artificial Sequence: Synthetic oligonucleotide
  Target: SCN10A; (+) strand; PAM type: YTN; PAM sequence: CTA
gaaatacaacttacaaggga

SEQ ID NO: 73445 - DNA, 20 bp, Artificial Sequence
  Description of Artificial Sequence: Synthetic oligonucleotide
  Target: SCN10A; (+) strand; PAM type: YTN; PAM sequence: CTT
acaagggatgtgaaggacct

SEQ ID NO: 73446 - DNA, 20 bp, Artificial Sequence
  Description of Artificial Sequence: Synthetic oligonucleotide
  Target: SCN10A; (+) strand; PAM type: YTN; PAM sequence: TTA
caagggatgtgaaggacctc

SEQ ID NO: 73447 - DNA, 20 bp, Artificial Sequence
  Description of Artificial Sequence: Synthetic oligonucleotide
  Target: SCN10A; (+) strand; PAM type: YTN; PAM sequence: CTC
ttcaaggagaactaaaaatc

SEQ ID NO: 73448 - DNA, 20 bp, Artificial Sequence
  Description of Artificial Sequence: Synthetic oligonucleotide
  Target: SCN10A; (+) strand; PAM type: YTN; PAM sequence: CTT
caaggagaactaaaaatcac

SEQ ID NO: 73449 - DNA, 20 bp, Artificial Sequence
  Description of Artificial Sequence: Synthetic oligonucleotide
  Target: SCN10A; (+) strand; PAM type: YTN; PAM sequence: TTC
aaggagaactaaaaatcact

SEQ ID NO: 73450 - DNA, 20 bp, Artificial Sequence
  Description of Artificial Sequence: Synthetic oligonucleotide
  Target: SCN10A; (+) strand; PAM type: YTN; PAM sequence: CTA
aaaatcactgctcaaggaaa

SEQ ID NO: 73451 - DNA, 20 bp, Artificial Sequence
  Description of Artificial Sequence: Synthetic oligonucleotide
  Target: SCN10A; (+) strand; PAM type: YTN; PAM sequence: CTG
ctcaaggaaataagagagga

SEQ ID NO: 73452 - DNA, 20 bp, Artificial Sequence
  Description of Artificial Sequence: Synthetic oligonucleotide
  Target: SCN10A; (+) strand; PAM type: YTN; PAM sequence: CTC
aaggaaataagagaggacac

SEQ ID NO: 73453 - DNA, 20 bp, Artificial Sequence
  Description of Artificial Sequence: Synthetic oligonucleotide
  Target: SCN10A; (+) strand; PAM type: YTN; PAM sequence: TTC
catgctcatggataggaaaa

SEQ ID NO: 73454 - DNA, 20 bp, Artificial Sequence
  Description of Artificial Sequence: Synthetic oligonucleotide
  Target: SCN10A; (+) strand; PAM type: YTN; PAM sequence: CTC
atggataggaaaaatcaata

SEQ ID NO: 73455 - DNA, 20 bp, Artificial Sequence
  Description of Artificial Sequence: Synthetic oligonucleotide
  Target: SCN10A; (+) strand; PAM type: YTN; PAM sequence: TTG
tgaaaatggccatactgccc

SEQ ID NO: 73456 - DNA, 20 bp, Artificial Sequence
  Description of Artificial Sequence: Synthetic oligonucleotide
  Target: SCN10A; (+) strand; PAM type: YTN; PAM sequence: CTG
cccaaagtaatttatagatt

SEQ ID NO: 73457 - DNA, 20 bp, Artificial Sequence
  Description of Artificial Sequence: Synthetic oligonucleotide
  Target: SCN10A; (+) strand; PAM type: YTN; PAM sequence: TTT
atagattcaatgttatcccc

SEQ ID NO: 73458 - DNA, 20 bp, Artificial Sequence
  Description of Artificial Sequence: Synthetic oligonucleotide
  Target: SCN10A; (+) strand; PAM type: YTN; PAM sequence: TTA
tagattcaatgttatcccca

SEQ ID NO: 73459 - DNA, 20 bp, Artificial Sequence
  Description of Artificial Sequence: Synthetic oligonucleotide
  Target: SCN10A; (+) strand; PAM type: YTN; PAM sequence: TTC
aatgttatccccatcaagct

SEQ ID NO: 73460 - DNA, 20 bp, Artificial Sequence
  Description of Artificial Sequence: Synthetic oligonucleotide
  Target: SCN10A; (+) strand; PAM type: YTN; PAM sequence: TTA
tccccatcaagctaccactg

SEQ ID NO: 73461 - DNA, 20 bp, Artificial Sequence
  Description of Artificial Sequence: Synthetic oligonucleotide
  Target: SCN10A; (+) strand; PAM type: YTN; PAM sequence: CTA
ccactgactttcttcacaga

SEQ ID NO: 73462 - DNA, 20 bp, Artificial Sequence
  Description of Artificial Sequence: Synthetic oligonucleotide
  Target: SCN10A; (+) strand; PAM type: YTN; PAM sequence: CTG
actttcttcacagaattaga

SEQ ID NO: 73463 - DNA, 20 bp, Artificial Sequence
  Description of Artificial Sequence: Synthetic oligonucleotide
  Target: SCN10A; (+) strand; PAM type: YTN; PAM sequence: CTT
tcttcacagaattagaaaaa

SEQ ID NO: 73464 - DNA, 20 bp, Artificial Sequence
  Description of Artificial Sequence: Synthetic oligonucleotide
  Target: SCN10A; (+) strand; PAM type: YTN; PAM sequence: TTT
cttcacagaattagaaaaat

SEQ ID NO: 73465 - DNA, 20 bp, Artificial Sequence
  Description of Artificial Sequence: Synthetic oligonucleotide
  Target: SCN10A; (+) strand; PAM type: YTN; PAM sequence: TTC
ttcacagaattagaaaaatc

SEQ ID NO: 73466 - DNA, 20 bp, Artificial Sequence
  Description of Artificial Sequence: Synthetic oligonucleotide
  Target: SCN10A; (+) strand; PAM type: YTN; PAM sequence: CTT
cacagaattagaaaaatcta

SEQ ID NO: 73467 - DNA, 20 bp, Artificial Sequence
  Description of Artificial Sequence: Synthetic oligonucleotide
  Target: SCN10A; (+) strand; PAM type: YTN; PAM sequence: TTC
acagaattagaaaaatctac

SEQ ID NO: 73468 - DNA, 20 bp, Artificial Sequence
  Description of Artificial Sequence: Synthetic oligonucleotide
  Target: SCN10A; (+) strand; PAM type: YTN; PAM sequence: TTA
gaaaaatctactttaaattt

SEQ ID NO: 73469 - DNA, 20 bp, Artificial Sequence
  Description of Artificial Sequence: Synthetic oligonucleotide
  Target: SCN10A; (+) strand; PAM type: YTN; PAM sequence: CTA
ctttaaatttcatgtggaac

SEQ ID NO: 73470 - DNA, 20 bp, Artificial Sequence
  Description of Artificial Sequence: Synthetic oligonucleotide
  Target: SCN10A; (+) strand; PAM type: YTN; PAM sequence: CTT
taaatttcatgtggaacaaa

SEQ ID NO: 73471 - DNA, 20 bp, Artificial Sequence
  Description of Artificial Sequence: Synthetic oligonucleotide
  Target: SCN10A; (+) strand; PAM type: YTN; PAM sequence: TTT
aaatttcatgtggaacaaaa

SEQ ID NO: 73472 - DNA, 20 bp, Artificial Sequence
  Description of Artificial Sequence: Synthetic oligonucleotide
  Target: SCN10A; (+) strand; PAM type: YTN; PAM sequence: TTA
aatttcatgtggaacaaaaa

SEQ ID NO: 73473 - DNA, 20 bp, Artificial Sequence
  Description of Artificial Sequence: Synthetic oligonucleotide
  Target: SCN10A; (+) strand; PAM type: YTN; PAM sequence: TTT
catgtggaacaaaaaagagc

SEQ ID NO: 73474 - DNA, 20 bp, Artificial Sequence
  Description of Artificial Sequence: Synthetic oligonucleotide
  Target: SCN10A; (+) strand; PAM type: YTN; PAM sequence: TTC
atgtggaacaaaaaagagcc

SEQ ID NO: 73475 - DNA, 20 bp, Artificial Sequence
  Description of Artificial Sequence: Synthetic oligonucleotide
  Target: SCN10A; (+) strand; PAM type: YTN; PAM sequence: TTC
taagcaaaaagaagaaagtt

SEQ ID NO: 73476 - DNA, 20 bp, Artificial Sequence
  Description of Artificial Sequence: Synthetic oligonucleotide
  Target: SCN10A; (+) strand; PAM type: YTN; PAM sequence: CTA
agcaaaaagaagaaagttgg

SEQ ID NO: 73477 - DNA, 20 bp, Artificial Sequence
  Description of Artificial Sequence: Synthetic oligonucleotide
  Target: SCN10A; (+) strand; PAM type: YTN; PAM sequence: TTG
gaggcatcacgctacctgac

SEQ ID NO: 73478 - DNA, 20 bp, Artificial Sequence
  Description of Artificial Sequence: Synthetic oligonucleotide
  Target: SCN10A; (+) strand; PAM type: YTN; PAM sequence: CTA
cctgacttcaagctatacta

SEQ ID NO: 73479 - DNA, 20 bp, Artificial Sequence
  Description of Artificial Sequence: Synthetic oligonucleotide
  Target: SCN10A; (+) strand; PAM type: YTN; PAM sequence: CTG
acttcaagctatactacaaa

SEQ ID NO: 73480 - DNA, 20 bp, Artificial Sequence
  Description of Artificial Sequence: Synthetic oligonucleotide
  Target: SCN10A; (+) strand; PAM type: YTN; PAM sequence: CTT
caagctatactacaaagcta

SEQ ID NO: 73481 - DNA, 20 bp, Artificial Sequence
  Description of Artificial Sequence: Synthetic oligonucleotide
  Target: SCN10A; (+) strand; PAM type: YTN; PAM sequence: TTC
aagctatactacaaagctac

SEQ ID NO: 73482 - DNA, 20 bp, Artificial Sequence
  Description of Artificial Sequence: Synthetic oligonucleotide
  Target: SCN10A; (+) strand; PAM type: YTN; PAM sequence: CTA
tactacaaagctacagtaac

SEQ ID NO: 73483 - DNA, 20 bp, Artificial Sequence
  Description of Artificial Sequence: Synthetic oligonucleotide
  Target: SCN10A; (+) strand; PAM type: YTN; PAM sequence: CTA
caaagctacagtaaccaaaa

SEQ ID NO: 73484 - DNA, 20 bp, Artificial Sequence
  Description of Artificial Sequence: Synthetic oligonucleotide
  Target: SCN10A; (+) strand; PAM type: YTN; PAM sequence: CTA
cagtaaccaaaacagcgagg

SEQ ID NO: 73485 - DNA, 20 bp, Artificial Sequence
  Description of Artificial Sequence: Synthetic oligonucleotide
  Target: SCN10A; (+) strand; PAM type: YTN; PAM sequence: CTG
gtaccaaaacagatatctag

SEQ ID NO: 73486 - DNA, 20 bp, Artificial Sequence
  Description of Artificial Sequence: Synthetic oligonucleotide
  Target: SCN10A; (+) strand; PAM type: YTN; PAM sequence: CTA
gaccaatggaacagaacaga

SEQ ID NO: 73487 - DNA, 20 bp, Artificial Sequence
  Description of Artificial Sequence: Synthetic oligonucleotide
  Target: SCN10A; (+) strand; PAM type: YTN; PAM sequence: CTC
agaagtaacaccgcatatct

SEQ ID NO: 73488 - DNA, 20 bp, Artificial Sequence
  Description of Artificial Sequence: Synthetic oligonucleotide
  Target: SCN10A; (+) strand; PAM type: YTN; PAM sequence: CTA
caaccatctgatctttgaca

SEQ ID NO: 73489 - DNA, 20 bp, Artificial Sequence
  Description of Artificial Sequence: Synthetic oligonucleotide
  Target: SCN10A; (+) strand; PAM type: YTN; PAM sequence: CTG
atctttgacaaacttgacaa

SEQ ID NO: 73490 - DNA, 20 bp, Artificial Sequence
  Description of Artificial Sequence: Synthetic oligonucleotide
  Target: SCN10A; (+) strand; PAM type: YTN; PAM sequence: CTT
tgacaaacttgacaaaagca

SEQ ID NO: 73491 - DNA, 20 bp, Artificial Sequence
  Description of Artificial Sequence: Synthetic oligonucleotide
  Target: SCN10A; (+) strand; PAM type: YTN; PAM sequence: TTT
gacaaacttgacaaaagcaa

SEQ ID NO: 73492 - DNA, 20 bp, Artificial Sequence
  Description of Artificial Sequence: Synthetic oligonucleotide
  Target: SCN10A; (+) strand; PAM type: YTN; PAM sequence: TTG
acaaacttgacaaaagcaag

SEQ ID NO: 73493 - DNA, 20 bp, Artificial Sequence
  Description of Artificial Sequence: Synthetic oligonucleotide
  Target: SCN10A; (+) strand; PAM type: YTN; PAM sequence: CTT
gacaaaagcaagcaatgggg

SEQ ID NO: 73494 - DNA, 20 bp, Artificial Sequence
  Description of Artificial Sequence: Synthetic oligonucleotide
  Target: SCN10A; (+) strand; PAM type: YTN; PAM sequence: TTG
acaaaagcaagcaatgggga

SEQ ID NO: 73495 - DNA, 20 bp, Artificial Sequence
  Description of Artificial Sequence: Synthetic oligonucleotide
  Target: SCN10A; (+) strand; PAM type: YTN; PAM sequence: TTC
cctatttaataaatggtgtg

SEQ ID NO: 73496 - DNA, 20 bp, Artificial Sequence
  Description of Artificial Sequence: Synthetic oligonucleotide
  Target: SCN10A; (+) strand; PAM type: YTN; PAM sequence: CTA
tttaataaatggtgtgggga

SEQ ID NO: 73497 - DNA, 20 bp, Artificial Sequence
  Description of Artificial Sequence: Synthetic oligonucleotide
  Target: SCN10A; (+) strand; PAM type: YTN; PAM sequence: TTT
aataaatggtgtggggaaaa

SEQ ID NO: 73498 - DNA, 20 bp, Artificial Sequence
  Description of Artificial Sequence: Synthetic oligonucleotide
  Target: SCN10A; (+) strand; PAM type: YTN; PAM sequence: TTA
ataaatggtgtggggaaaac

SEQ ID NO: 73499 - DNA, 20 bp, Artificial Sequence
  Description of Artificial Sequence: Synthetic oligonucleotide
  Target: SCN10A; (+) strand; PAM type: YTN; PAM sequence: CTG
gctagccttaggcagaaaat

SEQ ID NO: 73500 - DNA, 20 bp, Artificial Sequence
  Description of Artificial Sequence: Synthetic oligonucleotide
  Target: SCN10A; (+) strand; PAM type: YTN; PAM sequence: CTA
gccttaggcagaaaattgaa

SEQ ID NO: 73501 - DNA, 20 bp, Artificial Sequence
  Description of Artificial Sequence: Synthetic oligonucleotide
  Target: SCN10A; (+) strand; PAM type: YTN; PAM sequence: CTT
aggcagaaaattgaaactag

SEQ ID NO: 73502 - DNA, 20 bp, Artificial Sequence
  Description of Artificial Sequence: Synthetic oligonucleotide
  Target: SCN10A; (+) strand; PAM type: YTN; PAM sequence: TTA
ggcagaaaattgaaactaga

SEQ ID NO: 73503 - DNA, 20 bp, Artificial Sequence
  Description of Artificial Sequence: Synthetic oligonucleotide
  Target: SCN10A; (+) strand; PAM type: YTN; PAM sequence: TTG
aaactagatcccttccttat

SEQ ID NO: 73504 - DNA, 20 bp, Artificial Sequence
  Description of Artificial Sequence: Synthetic oligonucleotide
  Target: SCN10A; (+) strand; PAM type: YTN; PAM sequence: CTA
gatcccttccttatacctta

SEQ ID NO: 73505 - DNA, 20 bp, Artificial Sequence
  Description of Artificial Sequence: Synthetic oligonucleotide
  Target: SCN10A; (+) strand; PAM type: YTN; PAM sequence: CTT
ccttataccttacacaaaaa

SEQ ID NO: 73506 - DNA, 20 bp, Artificial Sequence
  Description of Artificial Sequence: Synthetic oligonucleotide
  Target: SCN10A; (+) strand; PAM type: YTN; PAM sequence: TTC
cttataccttacacaaaaat

SEQ ID NO: 73507 - DNA, 20 bp, Artificial Sequence
  Description of Artificial Sequence: Synthetic oligonucleotide
  Target: SCN10A; (+) strand; PAM type: YTN; PAM sequence: CTT
ataccttacacaaaaattaa

SEQ ID NO: 73508 - DNA, 20 bp, Artificial Sequence
  Description of Artificial Sequence: Synthetic oligonucleotide
  Target: SCN10A; (+) strand; PAM type: YTN; PAM sequence: TTA
taccttacacaaaaattaac

SEQ ID NO: 73509 - DNA, 20 bp, Artificial Sequence
  Description of Artificial Sequence: Synthetic oligonucleotide
  Target: SCN10A; (+) strand; PAM type: YTN; PAM sequence: CTT
acacaaaaattaactcaaga

SEQ ID NO: 73510 - DNA, 20 bp, Artificial Sequence
  Description of Artificial Sequence: Synthetic oligonucleotide
  Target: SCN10A; (+) strand; PAM type: YTN; PAM sequence: TTA
cacaaaaattaactcaagat

SEQ ID NO: 73511 - DNA, 20 bp, Artificial Sequence
  Description of Artificial Sequence: Synthetic oligonucleotide
  Target: SCN10A; (+) strand; PAM type: YTN; PAM sequence: TTA
actcaagatagattaaagac

SEQ ID NO: 73512 - DNA, 20 bp, Artificial Sequence
  Description of Artificial Sequence: Synthetic oligonucleotide
  Target: SCN10A; (+) strand; PAM type: YTN; PAM sequence: CTC
aagatagattaaagacttaa

SEQ ID NO: 73513 - DNA, 20 bp, Artificial Sequence
  Description of Artificial Sequence: Synthetic oligonucleotide
  Target: SCN10A; (+) strand; PAM type: YTN; PAM sequence: TTA
aagacttaaacataagacct

SEQ ID NO: 73514 - DNA, 20 bp, Artificial Sequence
  Description of Artificial Sequence: Synthetic oligonucleotide
  Target: SCN10A; (+) strand; PAM type: YTN; PAM sequence: CTT
aaacataagacctaaaacca

SEQ ID NO: 73515 - DNA, 20 bp, Artificial Sequence
  Description of Artificial Sequence: Synthetic oligonucleotide
  Target: SCN10A; (+) strand; PAM type: YTN; PAM sequence: TTA
aacataagacctaaaaccat

SEQ ID NO: 73516 - DNA, 20 bp, Artificial Sequence
  Description of Artificial Sequence: Synthetic oligonucleotide
  Target: SCN10A; (+) strand; PAM type: YTN; PAM sequence: CTA
aaaccataaaaaccctagaa

SEQ ID NO: 73517 - DNA, 20 bp, Artificial Sequence
  Description of Artificial Sequence: Synthetic oligonucleotide
  Target: SCN10A; (+) strand; PAM type: YTN; PAM sequence: CTA
gaagaaaacctaggcaatac

SEQ ID NO: 73518 - DNA, 20 bp, Artificial Sequence
  Description of Artificial Sequence: Synthetic oligonucleotide
  Target: SCN10A; (+) strand; PAM type: YTN; PAM sequence: CTA
ggcaatacccttcaggacat

SEQ ID NO: 73519 - DNA, 20 bp, Artificial Sequence
  Description of Artificial Sequence: Synthetic oligonucleotide
  Target: SCN10A; (+) strand; PAM type: YTN; PAM sequence: CTT
caggacataggcatgggcaa

SEQ ID NO: 73520 - DNA, 20 bp, Artificial Sequence
  Description of Artificial Sequence: Synthetic oligonucleotide
  Target: SCN10A; (+) strand; PAM type: YTN; PAM sequence: TTC
aggacataggcatgggcaaa

SEQ ID NO: 73521 - DNA, 20 bp, Artificial Sequence
  Description of Artificial Sequence: Synthetic oligonucleotide
  Target: SCN10A; (+) strand; PAM type: YTN; PAM sequence: CTT
tatgactaacacatcaaaag

SEQ ID NO: 73522 - DNA, 20 bp, Artificial Sequence
  Description of Artificial Sequence: Synthetic oligonucleotide
  Target: SCN10A; (+) strand; PAM type: YTN; PAM sequence: TTT
atgactaacacatcaaaagc

SEQ ID NO: 73523 - DNA, 20 bp, Artificial Sequence
  Description of Artificial Sequence: Synthetic oligonucleotide
  Target: SCN10A; (+) strand; PAM type: YTN; PAM sequence: TTA
tgactaacacatcaaaagca

SEQ ID NO: 73524 - DNA, 20 bp, Artificial Sequence
  Description of Artificial Sequence: Synthetic oligonucleotide
  Target: SCN10A; (+) strand; PAM type: YTN; PAM sequence: CTA
acacatcaaaagcaatggtg

SEQ ID NO: 73525 - DNA, 20 bp, Artificial Sequence
  Description of Artificial Sequence: Synthetic oligonucleotide
  Target: SCN10A; (+) strand; PAM type: YTN; PAM sequence: TTG
acaaatggaatccaattaaa

SEQ ID NO: 73526 - DNA, 20 bp, Artificial Sequence
  Description of Artificial Sequence: Synthetic oligonucleotide
  Target: SCN10A; (+) strand; PAM type: YTN; PAM sequence: TTA
aactaaagagcttctgcaca

SEQ ID NO: 73527 - DNA, 20 bp, Artificial Sequence
  Description of Artificial Sequence: Synthetic oligonucleotide
  Target: SCN10A; (+) strand; PAM type: YTN; PAM sequence: CTA
aagagcttctgcacagcaaa

SEQ ID NO: 73528 - DNA, 20 bp, Artificial Sequence
  Description of Artificial Sequence: Synthetic oligonucleotide
  Target: SCN10A; (+) strand; PAM type: YTN; PAM sequence: CTT
ctgcacagcaaaagaaacta

SEQ ID NO: 73529 - DNA, 20 bp, Artificial Sequence
  Description of Artificial Sequence: Synthetic oligonucleotide
  Target: SCN10A; (+) strand; PAM type: YTN; PAM sequence: TTC
tgcacagcaaaagaaactat

SEQ ID NO: 73530 - DNA, 20 bp, Artificial Sequence
  Description of Artificial Sequence: Synthetic oligonucleotide
  Target: SCN10A; (+) strand; PAM type: YTN; PAM sequence: CTG
cacagcaaaagaaactatca

SEQ ID NO: 73531 - DNA, 20 bp, Artificial Sequence
  Description of Artificial Sequence: Synthetic oligonucleotide
  Target: SCN10A; (+) strand; PAM type: YTN; PAM sequence: CTA
tcatcagagtgaataggtaa

SEQ ID NO: 73532 - DNA, 20 bp, Artificial Sequence
  Description of Artificial Sequence: Synthetic oligonucleotide
  Target: SCN10A; (+) strand; PAM type: YTN; PAM sequence: CTA
cagaatgggagaaaattttt

SEQ ID NO: 73533 - DNA, 20 bp, Artificial Sequence
  Description of Artificial Sequence: Synthetic oligonucleotide
  Target: SCN10A; (+) strand; PAM type: YTN; PAM sequence: TTT
ttgcaatctatcaatctgac

SEQ ID NO: 73534 - DNA, 20 bp, Artificial Sequence
  Description of Artificial Sequence: Synthetic oligonucleotide
  Target: SCN10A; (+) strand; PAM type: YTN; PAM sequence: TTT
tgcaatctatcaatctgaca

SEQ ID NO: 73535 - DNA, 20 bp, Artificial Sequence
  Description of Artificial Sequence: Synthetic oligonucleotide
  Target: SCN10A; (+) strand; PAM type: YTN; PAM sequence: TTT
gcaatctatcaatctgacaa

SEQ ID NO: 73536 - DNA, 20 bp, Artificial Sequence
  Description of Artificial Sequence: Synthetic oligonucleotide
  Target: SCN10A; (+) strand; PAM type: YTN; PAM sequence: TTG
caatctatcaatctgacaaa

SEQ ID NO: 73537 - DNA, 20 bp, Artificial Sequence
  Description of Artificial Sequence: Synthetic oligonucleotide
  Target: SCN10A; (+) strand; PAM type: YTN; PAM sequence: CTA
tcaatctgacaaagggctaa

SEQ ID NO: 73538 - DNA, 20 bp, Artificial Sequence
  Description of Artificial Sequence: Synthetic oligonucleotide
  Target: SCN10A; (+) strand; PAM type: YTN; PAM sequence: CTG
acaaagggctaatatccaga

SEQ ID NO: 73539 - DNA, 20 bp, Artificial Sequence
  Description of Artificial Sequence: Synthetic oligonucleotide
  Target: SCN10A; (+) strand; PAM type: YTN; PAM sequence: CTA
atatccagaatctacaaaaa

SEQ ID NO: 73540 - DNA, 20 bp, Artificial Sequence
  Description of Artificial Sequence: Synthetic oligonucleotide
  Target: SCN10A; (+) strand; PAM type: YTN; PAM sequence: CTA
caaaaaacttaaacaaattt

SEQ ID NO: 73541 - DNA, 20 bp, Artificial Sequence
  Description of Artificial Sequence: Synthetic oligonucleotide
  Target: SCN10A; (+) strand; PAM type: YTN; PAM sequence: CTT
aaacaaatttacaagaaaaa

SEQ ID NO: 73542 - DNA, 20 bp, Artificial Sequence
  Description of Artificial Sequence: Synthetic oligonucleotide
  Target: SCN10A; (+) strand; PAM type: YTN; PAM sequence: TTA
aacaaatttacaagaaaaaa

SEQ ID NO: 73543 - DNA, 20 bp, Artificial Sequence
  Description of Artificial Sequence: Synthetic oligonucleotide
  Target: SCN10A; (+) strand; PAM type: YTN; PAM sequence: TTT
acaagaaaaaacaactccat

SEQ ID NO: 73544 - DNA, 20 bp, Artificial Sequence
  Description of Artificial Sequence: Synthetic oligonucleotide
  Target: SCN10A; (+) strand; PAM type: YTN; PAM sequence: TTA
caagaaaaaacaactccatc

SEQ ID NO: 73545 - DNA, 20 bp, Artificial Sequence
  Description of Artificial Sequence: Synthetic oligonucleotide
  Target: SCN10A; (+) strand; PAM type: YTN; PAM sequence: CTC
catcaaaaagtgggcaaagg

SEQ ID NO: 73546 - DNA, 20 bp, Artificial Sequence
  Description of Artificial Sequence: Synthetic oligonucleotide
  Target: SCN10A; (+) strand; PAM type: YTN; PAM sequence: CTT
ctcaaaagaagacatttatg

SEQ ID NO: 73547 - DNA, 20 bp, Artificial Sequence
  Description of Artificial Sequence: Synthetic oligonucleotide
  Target: SCN10A; (+) strand; PAM type: YTN; PAM sequence: TTC
tcaaaagaagacatttatgc

SEQ ID NO: 73548 - DNA, 20 bp, Artificial Sequence
  Description of Artificial Sequence: Synthetic oligonucleotide
  Target: SCN10A; (+) strand; PAM type: YTN; PAM sequence: CTC
aaaagaagacatttatgcag

SEQ ID NO: 73549 - DNA, 20 bp, Artificial Sequence
  Description of Artificial Sequence: Synthetic oligonucleotide
  Target: SCN10A; (+) strand; PAM type: YTN; PAM sequence: TTT
atgcagccaataaacatatg

SEQ ID NO: 73550 - DNA, 20 bp, Artificial Sequence
  Description of Artificial Sequence: Synthetic oligonucleotide
  Target: SCN10A; (+) strand; PAM type: YTN; PAM sequence: TTA
tgcagccaataaacatatga

SEQ ID NO: 73551 - DNA, 20 bp, Artificial Sequence
  Description of Artificial Sequence: Synthetic oligonucleotide
  Target: SCN10A; (+) strand; PAM type: YTN; PAM sequence: CTC
atcatcactggtcattagag

SEQ ID NO: 73552 - DNA, 20 bp, Artificial Sequence
  Description of Artificial Sequence: Synthetic oligonucleotide
  Target: SCN10A; (+) strand; PAM type: YTN; PAM sequence: CTG
gtcattagagaaatgccagt

SEQ ID NO: 73553 - DNA, 20 bp, Artificial Sequence
  Description of Artificial Sequence: Synthetic oligonucleotide
  Target: SCN10A; (+) strand; PAM type: YTN; PAM sequence: TTA
gagaaatgccagtcaaaacc

SEQ ID NO: 73554 - DNA, 20 bp, Artificial Sequence
  Description of Artificial Sequence: Synthetic oligonucleotide
  Target: SCN10A; (+) strand; PAM type: YTN; PAM sequence: CTC
ataccagttagaatggagat

SEQ ID NO: 73555 - DNA, 20 bp, Artificial Sequence
  Description of Artificial Sequence: Synthetic oligonucleotide
  Target: SCN10A; (+) strand; PAM type: YTN; PAM sequence: TTA
gaatggagatcattaaaaag

SEQ ID NO: 73556 - DNA, 20 bp, Artificial Sequence
  Description of Artificial Sequence: Synthetic oligonucleotide
  Target: SCN10A; (+) strand; PAM type: YTN; PAM sequence: TTA
aaaagtcaggaaacaacaga

SEQ ID NO: 73557 - DNA, 20 bp, Artificial Sequence
  Description of Artificial Sequence: Synthetic oligonucleotide
  Target: SCN10A; (+) strand; PAM type: YTN; PAM sequence: CTG
gagaggatgtggagagatag

SEQ ID NO: 73558 - DNA, 20 bp, Artificial Sequence
  Description of Artificial Sequence: Synthetic oligonucleotide
  Target: SCN10A; (+) strand; PAM type: YTN; PAM sequence: CTT
ttacactgttggtgggagtg

SEQ ID NO: 73559 - DNA, 20 bp, Artificial Sequence
  Description of Artificial Sequence: Synthetic oligonucleotide
  Target: SCN10A; (+) strand; PAM type: YTN; PAM sequence: TTT
tacactgttggtgggagtgt

SEQ ID NO: 73560 - DNA, 20 bp, Artificial Sequence
  Description of Artificial Sequence: Synthetic oligonucleotide
  Target: SCN10A; (+) strand; PAM type: YTN; PAM sequence: TTT
acactgttggtgggagtgta

SEQ ID NO: 73561 - DNA, 20 bp, Artificial Sequence
  Description of Artificial Sequence: Synthetic oligonucleotide
  Target: SCN10A; (+) strand; PAM type: YTN; PAM sequence: TTA
cactgttggtgggagtgtaa

SEQ ID NO: 73562 - DNA, 20 bp, Artificial Sequence
  Description of Artificial Sequence: Synthetic oligonucleotide
  Target: SCN10A; (+) strand; PAM type: YTN; PAM sequence: CTG
ttggtgggagtgtaaattag

SEQ ID NO: 73563 - DNA, 20 bp, Artificial Sequence
  Description of Artificial Sequence: Synthetic oligonucleotide
  Target: SCN10A; (+) strand; PAM type: YTN; PAM sequence: TTG
gtgggagtgtaaattagttc

SEQ ID NO: 73564 - DNA, 20 bp, Artificial Sequence
  Description of Artificial Sequence: Synthetic oligonucleotide
  Target: SCN10A; (+) strand; PAM type: YTN; PAM sequence: TTA
gttcaaccattgtggaagac

SEQ ID NO: 73565 - DNA, 20 bp, Artificial Sequence
  Description of Artificial Sequence: Synthetic oligonucleotide
  Target: SCN10A; (+) strand; PAM type: YTN; PAM sequence: TTC
aaccattgtggaagacagtg

SEQ ID NO: 73566 - DNA, 20 bp, Artificial Sequence
  Description of Artificial Sequence: Synthetic oligonucleotide
  Target: SCN10A; (+) strand; PAM type: YTN; PAM sequence: TTG
tggaagacagtgtggtgatt

SEQ ID NO: 73567 - DNA, 20 bp, Artificial Sequence
  Description of Artificial Sequence: Synthetic oligonucleotide
  Target: SCN10A; (+) strand; PAM type: YTN; PAM sequence: TTC
ctcaaggatctagaaccaga

SEQ ID NO: 73568 - DNA, 20 bp, Artificial Sequence
  Description of Artificial Sequence: Synthetic oligonucleotide
  Target: SCN10A; (+) strand; PAM type: YTN; PAM sequence: CTC
aaggatctagaaccagaaac

SEQ ID NO: 73569 - DNA, 20 bp, Artificial Sequence
  Description of Artificial Sequence: Synthetic oligonucleotide
  Target: SCN10A; (+) strand; PAM type: YTN; PAM sequence: CTA
gaaccagaaacaccatttga

SEQ ID NO: 73570 - DNA, 20 bp, Artificial Sequence
  Description of Artificial Sequence: Synthetic oligonucleotide
  Target: SCN10A; (+) strand; PAM type: YTN; PAM sequence: TTT
gacccagcaattccattact

SEQ ID NO: 73571 - DNA, 20 bp, Artificial Sequence
  Description of Artificial Sequence: Synthetic oligonucleotide
  Target: SCN10A; (+) strand; PAM type: YTN; PAM sequence: TTG
acccagcaattccattactg

SEQ ID NO: 73572 - DNA, 20 bp, Artificial Sequence
  Description of Artificial Sequence: Synthetic oligonucleotide
  Target: SCN10A; (+) strand; PAM type: YTN; PAM sequence: TTC
cattactgggtatataccca

SEQ ID NO: 73573 - DNA, 20 bp, Artificial Sequence
  Description of Artificial Sequence: Synthetic oligonucleotide
  Target: SCN10A; (+) strand; PAM type: YTN; PAM sequence: TTA
ctgggtatatacccaaagga

SEQ ID NO: 73574 - DNA, 20 bp, Artificial Sequence
  Description of Artificial Sequence: Synthetic oligonucleotide
  Target: SCN10A; (+) strand; PAM type: YTN; PAM sequence: CTG
ggtatatacccaaaggatta

SEQ ID NO: 73575 - DNA, 20 bp, Artificial Sequence
  Description of Artificial Sequence: Synthetic oligonucleotide
  Target: SCN10A; (+) strand; PAM type: YTN; PAM sequence: TTA
taaattattctactataaag

SEQ ID NO: 73576 - DNA, 20 bp, Artificial Sequence
  Description of Artificial Sequence: Synthetic oligonucleotide
  Target: SCN10A; (+) strand; PAM type: YTN; PAM sequence: TTA
ttctactataaagatacaag

SEQ ID NO: 73577 - DNA, 20 bp, Artificial Sequence
  Description of Artificial Sequence: Synthetic oligonucleotide
  Target: SCN10A; (+) strand; PAM type: YTN; PAM sequence: TTC
tactataaagatacaagcat

SEQ ID NO: 73578 - DNA, 20 bp, Artificial Sequence
  Description of Artificial Sequence: Synthetic oligonucleotide
  Target: SCN10A; (+) strand; PAM type: YTN; PAM sequence: CTA
ctataaagatacaagcatgc

SEQ ID NO: 73579 - DNA, 20 bp, Artificial Sequence
  Description of Artificial Sequence: Synthetic oligonucleotide
  Target: SCN10A; (+) strand; PAM type: YTN; PAM sequence: CTA
taaagatacaagcatgcgta

SEQ ID NO: 73580 - DNA, 20 bp, Artificial Sequence
  Description of Artificial Sequence: Synthetic oligonucleotide
  Target: SCN10A; (+) strand; PAM type: YTN; PAM sequence: TTT
attgtggcactattgacaat

SEQ ID NO: 73581 - DNA, 20 bp, Artificial Sequence
  Description of Artificial Sequence: Synthetic oligonucleotide
  Target: SCN10A; (+) strand; PAM type: YTN; PAM sequence: TTA
ttgtggcactattgacaata

SEQ ID NO: 73582 - DNA, 20 bp, Artificial Sequence
  Description of Artificial Sequence: Synthetic oligonucleotide
  Target: SCN10A; (+) strand; PAM type: YTN; PAM sequence: TTG
tggcactattgacaatagca

SEQ ID NO: 73583 - DNA, 20 bp, Artificial Sequence
  Description of Artificial Sequence: Synthetic oligonucleotide
  Target: SCN10A; (+) strand; PAM type: YTN; PAM sequence: CTA
ttgacaatagcaaagacttg

SEQ ID NO: 73584 - DNA, 20 bp, Artificial Sequence
  Description of Artificial Sequence: Synthetic oligonucleotide
  Target: SCN10A; (+) strand; PAM type: YTN; PAM sequence: TTG
acaatagcaaagacttggaa

SEQ ID NO: 73585 - DNA, 20 bp, Artificial Sequence
  Description of Artificial Sequence: Synthetic oligonucleotide
  Target: SCN10A; (+) strand; PAM type: YTN; PAM sequence: CTT
ggaactaacccaaacgccca

SEQ ID NO: 73586 - DNA, 20 bp, Artificial Sequence
  Description of Artificial Sequence: Synthetic oligonucleotide
  Target: SCN10A; (+) strand; PAM type: YTN; PAM sequence: TTG
gaactaacccaaacgcccat

SEQ ID NO: 73587 - DNA, 20 bp, Artificial Sequence
  Description of Artificial Sequence: Synthetic oligonucleotide
  Target: SCN10A; (+) strand; PAM type: YTN; PAM sequence: CTA
acccaaacgcccatcagtga

SEQ ID NO: 73588 - DNA, 20 bp, Artificial Sequence
  Description of Artificial Sequence: Synthetic oligonucleotide
  Target: SCN10A; (+) strand; PAM type: YTN; PAM sequence: CTG
gataaagaaaatatggcaca

SEQ ID NO: 73589 - DNA, 20 bp, Artificial Sequence
  Description of Artificial Sequence: Synthetic oligonucleotide
  Target: SCN10A; (+) strand; PAM type: YTN; PAM sequence: CTA
tgcagccataaaaaagggtg

SEQ ID NO: 73590 - DNA, 20 bp, Artificial Sequence
  Description of Artificial Sequence: Synthetic oligonucleotide
  Target: SCN10A; (+) strand; PAM type: YTN; PAM sequence: TTC
atgttctttgcagggacatg

SEQ ID NO: 73591 - DNA, 20 bp, Artificial Sequence
  Description of Artificial Sequence: Synthetic oligonucleotide
  Target: SCN10A; (+) strand; PAM type: YTN; PAM sequence: TTC
tttgcagggacatggatgaa

SEQ ID NO: 73592 - DNA, 20 bp, Artificial Sequence
  Description of Artificial Sequence: Synthetic oligonucleotide
  Target: SCN10A; (+) strand; PAM type: YTN; PAM sequence: CTT
tgcagggacatggatgaagc

SEQ ID NO: 73593 - DNA, 20 bp, Artificial Sequence
  Description of Artificial Sequence: Synthetic oligonucleotide
  Target: SCN10A; (+) strand; PAM type: YTN; PAM sequence: TTT
gcagggacatggatgaagct

SEQ ID NO: 73594 - DNA, 20 bp, Artificial Sequence
  Description of Artificial Sequence: Synthetic oligonucleotide
  Target: SCN10A; (+) strand; PAM type: YTN; PAM sequence: TTG
cagggacatggatgaagctg

SEQ ID NO: 73595 - DNA, 20 bp, Artificial Sequence
  Description of Artificial Sequence: Synthetic oligonucleotide
  Target: SCN10A; (+) strand; PAM type: YTN; PAM sequence: CTG
gaaaccatcattctcagcaa

SEQ ID NO: 73596 - DNA, 20 bp, Artificial Sequence
  Description of Artificial Sequence: Synthetic oligonucleotide
  Target: SCN10A; (+) strand; PAM type: YTN; PAM sequence: TTC
tcagcaaactgacataagaa

SEQ ID NO: 73597 - DNA, 20 bp, Artificial Sequence
  Description of Artificial Sequence: Synthetic oligonucleotide
  Target: SCN10A; (+) strand; PAM type: YTN; PAM sequence: CTC
agcaaactgacataagaaca

SEQ ID NO: 73598 - DNA, 20 bp, Artificial Sequence
  Description of Artificial Sequence: Synthetic oligonucleotide
  Target: SCN10A; (+) strand; PAM type: YTN; PAM sequence: CTG
acataagaacagaaaaccaa

SEQ ID NO: 73599 - DNA, 20 bp, Artificial Sequence
  Description of Artificial Sequence: Synthetic oligonucleotide
  Target: SCN10A; (+) strand; PAM type: YTN; PAM sequence: TTC
tcactcataggtgggagatg

SEQ ID NO: 73600 - DNA, 20 bp, Artificial Sequence
  Description of Artificial Sequence: Synthetic oligonucleotide
  Target: SCN10A; (+) strand; PAM type: YTN; PAM sequence: CTC
actcataggtgggagatgaa

SEQ ID NO: 73601 - DNA, 20 bp, Artificial Sequence
  Description of Artificial Sequence: Synthetic oligonucleotide
  Target: SCN10A; (+) strand; PAM type: YTN; PAM sequence: CTC
ataggtgggagatgaacaat

SEQ ID NO: 73602 - DNA, 20 bp, Artificial Sequence
  Description of Artificial Sequence: Synthetic oligonucleotide
  Target: SCN10A; (+) strand; PAM type: YTN; PAM sequence: CTG
ttgaggggttgggggctagg

SEQ ID NO: 73603 - DNA, 20 bp, Artificial Sequence
  Description of Artificial Sequence: Synthetic oligonucleotide
  Target: SCN10A; (+) strand; PAM type: YTN; PAM sequence: TTG
aggggttgggggctagggga

SEQ ID NO: 73604 - DNA, 20 bp, Artificial Sequence
  Description of Artificial Sequence: Synthetic oligonucleotide
  Target: SCN10A; (+) strand; PAM type: YTN; PAM sequence: TTG
ggggctaggggagggatagc

SEQ ID NO: 73605 - DNA, 20 bp, Artificial Sequence
  Description of Artificial Sequence: Synthetic oligonucleotide
  Target: SCN10A; (+) strand; PAM type: YTN; PAM sequence: CTA
ggggagggatagcattagga

SEQ ID NO: 73606 - DNA, 20 bp, Artificial Sequence
  Description of Artificial Sequence: Synthetic oligonucleotide
  Target: SCN10A; (+) strand; PAM type: YTN; PAM sequence: TTA
ggagaaatacctaatgtaga

SEQ ID NO: 73607 - DNA, 20 bp, Artificial Sequence
  Description of Artificial Sequence: Synthetic oligonucleotide
  Target: SCN10A; (+) strand; PAM type: YTN; PAM sequence: CTA
atgtagatgatgggttgatg

SEQ ID NO: 73608 - DNA, 20 bp, Artificial Sequence
  Description of Artificial Sequence: Synthetic oligonucleotide
  Target: SCN10A; (+) strand; PAM type: YTN; PAM sequence: TTG
atgggtgcagcaaaccacca

SEQ ID NO: 73609 - DNA, 20 bp, Artificial Sequence
  Description of Artificial Sequence: Synthetic oligonucleotide
  Target: SCN10A; (+) strand; PAM type: YTN; PAM sequence: CTA
tgtaacaaacctgcactttc

SEQ ID NO: 73610 - DNA, 20 bp, Artificial Sequence
  Description of Artificial Sequence: Synthetic oligonucleotide
  Target: SCN10A; (+) strand; PAM type: YTN; PAM sequence: CTG
cactttctgcacatgtaccc

SEQ ID NO: 73611 - DNA, 20 bp, Artificial Sequence
  Description of Artificial Sequence: Synthetic oligonucleotide
  Target: SCN10A; (+) strand; PAM type: YTN; PAM sequence: CTT
tctgcacatgtaccccagaa

SEQ ID NO: 73612 - DNA, 20 bp, Artificial Sequence
  Description of Artificial Sequence: Synthetic oligonucleotide
  Target: SCN10A; (+) strand; PAM type: YTN; PAM sequence: TTT
ctgcacatgtaccccagaac

SEQ ID NO: 73613 - DNA, 20 bp, Artificial Sequence
  Description of Artificial Sequence: Synthetic oligonucleotide
  Target: SCN10A; (+) strand; PAM type: YTN; PAM sequence: TTC
tgcacatgtaccccagaact

SEQ ID NO: 73614 - DNA, 20 bp, Artificial Sequence
  Description of Artificial Sequence: Synthetic oligonucleotide
  Target: SCN10A; (+) strand; PAM type: YTN; PAM sequence: CTG
cacatgtaccccagaactta

SEQ ID NO: 73615 - DNA, 20 bp, Artificial Sequence
  Description of Artificial Sequence: Synthetic oligonucleotide
  Target: SCN10A; (+) strand; PAM type: YTN; PAM sequence: CTT
aaagtaaaatttaaaaaagg

SEQ ID NO: 73616 - DNA, 20 bp, Artificial Sequence
  Description of Artificial Sequence: Synthetic oligonucleotide
  Target: SCN10A; (+) strand; PAM type: YTN; PAM sequence: TTA
aagtaaaatttaaaaaaggg

SEQ ID NO: 73617 - DNA, 20 bp, Artificial Sequence
  Description of Artificial Sequence: Synthetic oligonucleotide
  Target: SCN10A; (+) strand; PAM type: YTN; PAM sequence: TTT
aaaaaagggctttatatatt

SEQ ID NO: 73618 - DNA, 20 bp, Artificial Sequence
  Description of Artificial Sequence: Synthetic oligonucleotide
  Target: SCN10A; (+) strand; PAM type: YTN; PAM sequence: TTA
aaaaagggctttatatattt

SEQ ID NO: 73619 - DNA, 20 bp, Artificial Sequence
  Description of Artificial Sequence: Synthetic oligonucleotide
  Target: SCN10A; (+) strand; PAM type: YTN; PAM sequence: CTT
tatatatttgcatttcacaa

SEQ ID NO: 73620 - DNA, 20 bp, Artificial Sequence
  Description of Artificial Sequence: Synthetic oligonucleotide
  Target: SCN10A; (+) strand; PAM type: YTN; PAM sequence: TTT
atatatttgcatttcacaaa

SEQ ID NO: 73621 - DNA, 20 bp, Artificial Sequence
  Description of Artificial Sequence: Synthetic oligonucleotide
  Target: SCN10A; (+) strand; PAM type: YTN; PAM sequence: TTA
tatatttgcatttcacaaag

SEQ ID NO: 73622 - DNA, 20 bp, Artificial Sequence
  Description of Artificial Sequence: Synthetic oligonucleotide
  Target: SCN10A; (+) strand; PAM type: YTN; PAM sequence: TTT
gcatttcacaaagcaagtga

SEQ ID NO: 73623 - DNA, 20 bp, Artificial Sequence
  Description of Artificial Sequence: Synthetic oligonucleotide
  Target: SCN10A; (+) strand; PAM type: YTN; PAM sequence: TTG
catttcacaaagcaagtgag

SEQ ID NO: 73624 - DNA, 20 bp, Artificial Sequence
  Description of Artificial Sequence: Synthetic oligonucleotide
  Target: SCN10A; (+) strand; PAM type: YTN; PAM sequence: TTT
cacaaagcaagtgaggtgtt

SEQ ID NO: 73625 - DNA, 20 bp, Artificial Sequence
  Description of Artificial Sequence: Synthetic oligonucleotide
  Target: SCN10A; (+) strand; PAM type: YTN; PAM sequence: TTC
acaaagcaagtgaggtgttg

SEQ ID NO: 73626 - DNA, 20 bp, Artificial Sequence
  Description of Artificial Sequence: Synthetic oligonucleotide
  Target: SCN10A; (+) strand; PAM type: YTN; PAM sequence: TTG
atccacctagaattgattct

SEQ ID NO: 73627 - DNA, 20 bp, Artificial Sequence
  Description of Artificial Sequence: Synthetic oligonucleotide
  Target: SCN10A; (+) strand; PAM type: YTN; PAM sequence: CTA
gaattgattcttgtgtgtgg

SEQ ID NO: 73628 - DNA, 20 bp, Artificial Sequence
  Description of Artificial Sequence: Synthetic oligonucleotide
  Target: SCN10A; (+) strand; PAM type: YTN; PAM sequence: TTG
attcttgtgtgtggtgcaaa

SEQ ID NO: 73629 - DNA, 20 bp, Artificial Sequence
  Description of Artificial Sequence: Synthetic oligonucleotide
  Target: SCN10A; (+) strand; PAM type: YTN; PAM sequence: TTC
ttgtgtgtggtgcaaagttg

SEQ ID NO: 73630 - DNA, 20 bp, Artificial Sequence
  Description of Artificial Sequence: Synthetic oligonucleotide
  Target: SCN10A; (+) strand; PAM type: YTN; PAM sequence: CTT
gtgtgtggtgcaaagttgga

SEQ ID NO: 73631 - DNA, 20 bp, Artificial Sequence
  Description of Artificial Sequence: Synthetic oligonucleotide
  Target: SCN10A; (+) strand; PAM type: YTN; PAM sequence: TTG
tgtgtggtgcaaagttggat

SEQ ID NO: 73632 - DNA, 20 bp, Artificial Sequence
  Description of Artificial Sequence: Synthetic oligonucleotide
  Target: SCN10A; (+) strand; PAM type: YTN; PAM sequence: TTG
gatgtttaatgtagtttttc

SEQ ID NO: 73633 - DNA, 20 bp, Artificial Sequence
  Description of Artificial Sequence: Synthetic oligonucleotide
  Target: SCN10A; (+) strand; PAM type: YTN; PAM sequence: TTT
aatgtagtttttccagtgag

SEQ ID NO: 73634 - DNA, 20 bp, Artificial Sequence
  Description of Artificial Sequence: Synthetic oligonucleotide
  Target: SCN10A; (+) strand; PAM type: YTN; PAM sequence: TTA
atgtagtttttccagtgaga

SEQ ID NO: 73635 - DNA, 20 bp, Artificial Sequence
  Description of Artificial Sequence: Synthetic oligonucleotide
  Target: SCN10A; (+) strand; PAM type: YTN; PAM sequence: TTT
ttccagtgagattcctaatt

SEQ ID NO: 73636 - DNA, 20 bp, Artificial Sequence
  Description of Artificial Sequence: Synthetic oligonucleotide
  Target: SCN10A; (+) strand; PAM type: YTN; PAM sequence: TTT
tccagtgagattcctaattc

SEQ ID NO: 73637 - DNA, 20 bp, Artificial Sequence
  Description of Artificial Sequence: Synthetic oligonucleotide
  Target: SCN10A; (+) strand; PAM type: YTN; PAM sequence: TTT
ccagtgagattcctaattct

SEQ ID NO: 73638 - DNA, 20 bp, Artificial Sequence
  Description of Artificial Sequence: Synthetic oligonucleotide
  Target: SCN10A; (+) strand; PAM type: YTN; PAM sequence: TTC
cagtgagattcctaattctt

SEQ ID NO: 73639 - DNA, 20 bp, Artificial Sequence
  Description of Artificial Sequence: Synthetic oligonucleotide
  Target: SCN10A; (+) strand; PAM type: YTN; PAM sequence: TTC
ctaattcttcagcatcattt

SEQ ID NO: 73640 - DNA, 20 bp, Artificial Sequence
  Description of Artificial Sequence: Synthetic oligonucleotide
  Target: SCN10A; (+) strand; PAM type: YTN; PAM sequence: CTA
attcttcagcatcatttttt

SEQ ID NO: 73641 - DNA, 20 bp, Artificial Sequence
  Description of Artificial Sequence: Synthetic oligonucleotide
  Target: SCN10A; (+) strand; PAM type: YTN; PAM sequence: TTC
ttcagcatcattttttgaag

SEQ ID NO: 73642 - DNA, 20 bp, Artificial Sequence
  Description of Artificial Sequence: Synthetic oligonucleotide
  Target: SCN10A; (+) strand; PAM type: YTN; PAM sequence: CTT
cagcatcattttttgaagac

SEQ ID NO: 73643 - DNA, 20 bp, Artificial Sequence
  Description of Artificial Sequence: Synthetic oligonucleotide
  Target: SCN10A; (+) strand; PAM type: YTN; PAM sequence: TTC
agcatcattttttgaagacc

SEQ ID NO: 73644 - DNA, 20 bp, Artificial Sequence
  Description of Artificial Sequence: Synthetic oligonucleotide
  Target: SCN10A; (+) strand; PAM type: YTN; PAM sequence: TTT
tttgaagaccgccttttccc

SEQ ID NO: 73645 - DNA, 20 bp, Artificial Sequence
  Description of Artificial Sequence: Synthetic oligonucleotide
  Target: SCN10A; (+) strand; PAM type: YTN; PAM sequence: TTT
ttgaagaccgccttttccct

SEQ ID NO: 73646 - DNA, 20 bp, Artificial Sequence
  Description of Artificial Sequence: Synthetic oligonucleotide
  Target: SCN10A; (+) strand; PAM type: YTN; PAM sequence: TTT
tgaagaccgccttttccctg

SEQ ID NO: 73647 - DNA, 20 bp, Artificial Sequence
  Description of Artificial Sequence: Synthetic oligonucleotide
  Target: SCN10A; (+) strand; PAM type: YTN; PAM sequence: TTT
gaagaccgccttttccctgc

SEQ ID NO: 73648 - DNA, 20 bp, Artificial Sequence
  Description of Artificial Sequence: Synthetic oligonucleotide
  Target: SCN10A; (+) strand; PAM type: YTN; PAM sequence: TTG
aagaccgccttttccctgct

SEQ ID NO: 73649 - DNA, 20 bp, Artificial Sequence
  Description of Artificial Sequence: Synthetic oligonucleotide
  Target: SCN10A; (+) strand; PAM type: YTN; PAM sequence: CTT
ttccctgctgttctggggtg

SEQ ID NO: 73650 - DNA, 20 bp, Artificial Sequence
  Description of Artificial Sequence: Synthetic oligonucleotide
  Target: SCN10A; (+) strand; PAM type: YTN; PAM sequence: TTT
tccctgctgttctggggtgc

SEQ ID NO: 73651 - DNA, 20 bp, Artificial Sequence
  Description of Artificial Sequence: Synthetic oligonucleotide
  Target: SCN10A; (+) strand; PAM type: YTN; PAM sequence: TTT
ccctgctgttctggggtgcc

SEQ ID NO: 73652 - DNA, 20 bp, Artificial Sequence
  Description of Artificial Sequence: Synthetic oligonucleotide
  Target: SCN10A; (+) strand; PAM type: YTN; PAM sequence: TTC
cctgctgttctggggtgcca

SEQ ID NO: 73653 - DNA, 20 bp, Artificial Sequence
  Description of Artificial Sequence: Synthetic oligonucleotide
  Target: SCN10A; (+) strand; PAM type: YTN; PAM sequence: CTG
ctgttctggggtgccacctt

SEQ ID NO: 73654 - DNA, 20 bp, Artificial Sequence
  Description of Artificial Sequence: Synthetic oligonucleotide
  Target: SCN10A; (+) strand; PAM type: YTN; PAM sequence: CTG
ttctggggtgccaccttttc

SEQ ID NO: 73655 - DNA, 20 bp, Artificial Sequence
  Description of Artificial Sequence: Synthetic oligonucleotide
  Target: SCN10A; (+) strand; PAM type: YTN; PAM sequence: TTC
tggggtgccaccttttcaca

SEQ ID NO: 73656 - DNA, 20 bp, Artificial Sequence
  Description of Artificial Sequence: Synthetic oligonucleotide
  Target: SCN10A; (+) strand; PAM type: YTN; PAM sequence: CTG
gggtgccaccttttcacaca

SEQ ID NO: 73657 - DNA, 20 bp, Artificial Sequence
  Description of Artificial Sequence: Synthetic oligonucleotide
  Target: SCN10A; (+) strand; PAM type: YTN; PAM sequence: CTT
ttcacacattagatgtttac

SEQ ID NO: 73658 - DNA, 20 bp, Artificial Sequence
  Description of Artificial Sequence: Synthetic oligonucleotide
  Target: SCN10A; (+) strand; PAM type: YTN; PAM sequence: TTT
tcacacattagatgtttaca

SEQ ID NO: 73659 - DNA, 20 bp, Artificial Sequence
  Description of Artificial Sequence: Synthetic oligonucleotide
  Target: SCN10A; (+) strand; PAM type: YTN; PAM sequence: TTT
cacacattagatgtttacat

SEQ ID NO: 73660 - DNA, 20 bp, Artificial Sequence
  Description of Artificial Sequence: Synthetic oligonucleotide
  Target: SCN10A; (+) strand; PAM type: YTN; PAM sequence: TTC
acacattagatgtttacata

SEQ ID NO: 73661 - DNA, 20 bp, Artificial Sequence
  Description of Artificial Sequence: Synthetic oligonucleotide
  Target: SCN10A; (+) strand; PAM type: YTN; PAM sequence: TTA
gatgtttacatatgtgttgg

SEQ ID NO: 73662 - DNA, 20 bp, Artificial Sequence
  Description of Artificial Sequence: Synthetic oligonucleotide
  Target: SCN10A; (+) strand; PAM type: YTN; PAM sequence: TTT
acatatgtgttggtctgttt

SEQ ID NO: 73663 - DNA, 20 bp, Artificial Sequence
  Description of Artificial Sequence: Synthetic oligonucleotide
  Target: SCN10A; (+) strand; PAM type: YTN; PAM sequence: TTA
catatgtgttggtctgttta

SEQ ID NO: 73664 - DNA, 20 bp, Artificial Sequence
  Description of Artificial Sequence: Synthetic oligonucleotide
  Target: SCN10A; (+) strand; PAM type: YTN; PAM sequence: TTG
gtctgtttatggactgtcta

SEQ ID NO: 73665 - DNA, 20 bp, Artificial Sequence
  Description of Artificial Sequence: Synthetic oligonucleotide
  Target: SCN10A; (+) strand; PAM type: YTN; PAM sequence: CTG
tttatggactgtctatgctg

SEQ ID NO: 73666 - DNA, 20 bp, Artificial Sequence
  Description of Artificial Sequence: Synthetic oligonucleotide
  Target: SCN10A; (+) strand; PAM type: YTN; PAM sequence: TTT
atggactgtctatgctgtta

SEQ ID NO: 73667 - DNA, 20 bp, Artificial Sequence
  Description of Artificial Sequence: Synthetic oligonucleotide
  Target: SCN10A; (+) strand; PAM type: YTN; PAM sequence: TTA
tggactgtctatgctgttac

SEQ ID NO: 73668 - DNA, 20 bp, Artificial Sequence
  Description of Artificial Sequence: Synthetic oligonucleotide
  Target: SCN10A; (+) strand; PAM type: YTN; PAM sequence: CTG
tctatgctgttacattattc

SEQ ID NO: 73669 - DNA, 20 bp, Artificial Sequence
  Description of Artificial Sequence: Synthetic oligonucleotide
  Target: SCN10A; (+) strand; PAM type: YTN; PAM sequence: CTA
tgctgttacattattctgac

SEQ ID NO: 73670 - DNA, 20 bp, Artificial Sequence
  Description of Artificial Sequence: Synthetic oligonucleotide
  Target: SCN10A; (+) strand; PAM type: YTN; PAM sequence: CTG
ttacattattctgaccaatc

SEQ ID NO: 73671 - DNA, 20 bp, Artificial Sequence
  Description of Artificial Sequence: Synthetic oligonucleotide
  Target: SCN10A; (+) strand; PAM type: YTN; PAM sequence: TTA
cattattctgaccaatctta

SEQ ID NO: 73672 - DNA, 20 bp, Artificial Sequence
  Description of Artificial Sequence: Synthetic oligonucleotide
  Target: SCN10A; (+) strand; PAM type: YTN; PAM sequence: TTA
ttctgaccaatcttacacca

SEQ ID NO: 73673 - DNA, 20 bp, Artificial Sequence
  Description of Artificial Sequence: Synthetic oligonucleotide
  Target: SCN10A; (+) strand; PAM type: YTN; PAM sequence: TTC
tgaccaatcttacaccaatg

SEQ ID NO: 73674 - DNA, 20 bp, Artificial Sequence
  Description of Artificial Sequence: Synthetic oligonucleotide
  Target: SCN10A; (+) strand; PAM type: YTN; PAM sequence: CTG
accaatcttacaccaatggc

SEQ ID NO: 73675 - DNA, 20 bp, Artificial Sequence
  Description of Artificial Sequence: Synthetic oligonucleotide
  Target: SCN10A; (+) strand; PAM type: YTN; PAM sequence: CTT
acaccaatggcacactgctt

SEQ ID NO: 73676 - DNA, 20 bp, Artificial Sequence
  Description of Artificial Sequence: Synthetic oligonucleotide
  Target: SCN10A; (+) strand; PAM type: YTN; PAM sequence: TTA
caccaatggcacactgcttc

SEQ ID NO: 73677 - DNA, 20 bp, Artificial Sequence
  Description of Artificial Sequence: Synthetic oligonucleotide
  Target: SCN10A; (+) strand; PAM type: YTN; PAM sequence: CTG
cttcaattagagctttatag

SEQ ID NO: 73678 - DNA, 20 bp, Artificial Sequence
  Description of Artificial Sequence: Synthetic oligonucleotide
  Target: SCN10A; (+) strand; PAM type: YTN; PAM sequence: CTT
caattagagctttatagtaa

SEQ ID NO: 73679 - DNA, 20 bp, Artificial Sequence
  Description of Artificial Sequence: Synthetic oligonucleotide
  Target: SCN10A; (+) strand; PAM type: YTN; PAM sequence: TTC
aattagagctttatagtaaa

SEQ ID NO: 73680 - DNA, 20 bp, Artificial Sequence
  Description of Artificial Sequence: Synthetic oligonucleotide
  Target: SCN10A; (+) strand; PAM type: YTN; PAM sequence: TTA
gagctttatagtaaatctcg

SEQ ID NO: 73681 - DNA, 20 bp, Artificial Sequence
  Description of Artificial Sequence: Synthetic oligonucleotide
  Target: SCN10A; (+) strand; PAM type: YTN; PAM sequence: CTT
tatagtaaatctcgacatcc

SEQ ID NO: 73682 - DNA, 20 bp, Artificial Sequence
  Description of Artificial Sequence: Synthetic oligonucleotide
  Target: SCN10A; (+) strand; PAM type: YTN; PAM sequence: TTT
atagtaaatctcgacatcca

SEQ ID NO: 73683 - DNA, 20 bp, Artificial Sequence
  Description of Artificial Sequence: Synthetic oligonucleotide
  Target: SCN10A; (+) strand; PAM type: YTN; PAM sequence: TTA
tagtaaatctcgacatccag

SEQ ID NO: 73684 - DNA, 20 bp, Artificial Sequence
  Description of Artificial Sequence: Synthetic oligonucleotide
  Target: SCN10A; (+) strand; PAM type: YTN; PAM sequence: CTC
gacatccagtagaatgagtt

SEQ ID NO: 73685 - DNA, 20 bp, Artificial Sequence
  Description of Artificial Sequence: Synthetic oligonucleotide
  Target: SCN10A; (+) strand; PAM type: YTN; PAM sequence: TTC
tcccactttgtatttcttcc

SEQ ID NO: 73686 - DNA, 20 bp, Artificial Sequence
  Description of Artificial Sequence: Synthetic oligonucleotide
  Target: SCN10A; (+) strand; PAM type: YTN; PAM sequence: CTC
ccactttgtatttcttcctc

SEQ ID NO: 73687 - DNA, 20 bp, Artificial Sequence
  Description of Artificial Sequence: Synthetic oligonucleotide
  Target: SCN10A; (+) strand; PAM type: YTN; PAM sequence: CTT
tgtatttcttcctcaaaagt

SEQ ID NO: 73688 - DNA, 20 bp, Artificial Sequence
  Description of Artificial Sequence: Synthetic oligonucleotide
  Target: SCN10A; (+) strand; PAM type: YTN; PAM sequence: TTT
gtatttcttcctcaaaagtt

SEQ ID NO: 73689 - DNA, 20 bp, Artificial Sequence
  Description of Artificial Sequence: Synthetic oligonucleotide
  Target: SCN10A; (+) strand; PAM type: YTN; PAM sequence: TTG
tatttcttcctcaaaagttt

SEQ ID NO: 73690 - DNA, 20 bp, Artificial Sequence
  Description of Artificial Sequence: Synthetic oligonucleotide
  Target: SCN10A; (+) strand; PAM type: YTN; PAM sequence: TTT
cttcctcaaaagtttcttgg

SEQ ID NO: 73691 - DNA, 20 bp, Artificial Sequence
  Description of Artificial Sequence: Synthetic oligonucleotide
  Target: SCN10A; (+) strand; PAM type: YTN; PAM sequence: TTC
ttcctcaaaagtttcttggc

SEQ ID NO: 73692 - DNA, 20 bp, Artificial Sequence
  Description of Artificial Sequence: Synthetic oligonucleotide
  Target: SCN10A; (+) strand; PAM type: YTN; PAM sequence: CTT
cctcaaaagtttcttggcta

SEQ ID NO: 73693 - DNA, 20 bp, Artificial Sequence
  Description of Artificial Sequence: Synthetic oligonucleotide
  Target: SCN10A; (+) strand; PAM type: YTN; PAM sequence: TTC
ctcaaaagtttcttggctat

SEQ ID NO: 73694 - DNA, 20 bp, Artificial Sequence
  Description of Artificial Sequence: Synthetic oligonucleotide
  Target: SCN10A; (+) strand; PAM type: YTN; PAM sequence: CTC
aaaagtttcttggctataat

SEQ ID NO: 73695 - DNA, 20 bp, Artificial Sequence
  Description of Artificial Sequence: Synthetic oligonucleotide
  Target: SCN10A; (+) strand; PAM type: YTN; PAM sequence: TTT
cttggctataatttgctctt

SEQ ID NO: 73696 - DNA, 20 bp, Artificial Sequence
  Description of Artificial Sequence: Synthetic oligonucleotide
  Target: SCN10A; (+) strand; PAM type: YTN; PAM sequence: TTC
ttggctataatttgctcttt

SEQ ID NO: 73697 - DNA, 20 bp, Artificial Sequence
  Description of Artificial Sequence: Synthetic oligonucleotide
  Target: SCN10A; (+) strand; PAM type: YTN; PAM sequence: CTT
ggctataatttgctctttaa

SEQ ID NO: 73698 - DNA, 20 bp, Artificial Sequence
  Description of Artificial Sequence: Synthetic oligonucleotide
  Target: SCN10A; (+) strand; PAM type: YTN; PAM sequence: TTG
gctataatttgctctttaaa

SEQ ID NO: 73699 - DNA, 20 bp, Artificial Sequence
  Description of Artificial Sequence: Synthetic oligonucleotide
  Target: SCN10A; (+) strand; PAM type: YTN; PAM sequence: CTA
taatttgctctttaaaattt

SEQ ID NO: 73700 - DNA, 20 bp, Artificial Sequence
  Description of Artificial Sequence: Synthetic oligonucleotide
  Target: SCN10A; (+) strand; PAM type: YTN; PAM sequence: TTT
gctctttaaaatttcatgta

SEQ ID NO: 73701 - DNA, 20 bp, Artificial Sequence
  Description of Artificial Sequence: Synthetic oligonucleotide
  Target: SCN10A; (+) strand; PAM type: YTN; PAM sequence: TTG
ctctttaaaatttcatgtaa

SEQ ID NO: 73702 - DNA, 20 bp, Artificial Sequence
  Description of Artificial Sequence: Synthetic oligonucleotide
  Target: SCN10A; (+) strand; PAM type: YTN; PAM sequence: CTC
tttaaaatttcatgtaaact

SEQ ID NO: 73703 - DNA, 20 bp, Artificial Sequence
  Description of Artificial Sequence: Synthetic oligonucleotide
  Target: SCN10A; (+) strand; PAM type: YTN; PAM sequence: CTT
taaaatttcatgtaaacttt

SEQ ID NO: 73704 - DNA, 20 bp, Artificial Sequence
  Description of Artificial Sequence: Synthetic oligonucleotide
  Target: SCN10A; (+) strand; PAM type: YTN; PAM sequence: TTT
aaaatttcatgtaaactttt

SEQ ID NO: 73705 - DNA, 20 bp, Artificial Sequence
  Description of Artificial Sequence: Synthetic oligonucleotide
  Target: SCN10A; (+) strand; PAM type: YTN; PAM sequence: TTA
aaatttcatgtaaacttttg

SEQ ID NO: 73706 - DNA, 20 bp, Artificial Sequence
  Description of Artificial Sequence: Synthetic oligonucleotide
  Target: SCN10A; (+) strand; PAM type: YTN; PAM sequence: TTT
catgtaaacttttgaggaag

SEQ ID NO: 73707 - DNA, 20 bp, Artificial Sequence
  Description of Artificial Sequence: Synthetic oligonucleotide
  Target: SCN10A; (+) strand; PAM type: YTN; PAM sequence: TTC
atgtaaacttttgaggaaga

SEQ ID NO: 73708 - DNA, 20 bp, Artificial Sequence
  Description of Artificial Sequence: Synthetic oligonucleotide
  Target: SCN10A; (+) strand; PAM type: YTN; PAM sequence: CTT
ttgaggaagaaaatttaaag

SEQ ID NO: 73709 - DNA, 20 bp, Artificial Sequence
  Description of Artificial Sequence: Synthetic oligonucleotide
  Target: SCN10A; (+) strand; PAM type: YTN; PAM sequence: TTT
tgaggaagaaaatttaaagt

SEQ ID NO: 73710 - DNA, 20 bp, Artificial Sequence
  Description of Artificial Sequence: Synthetic oligonucleotide
  Target: SCN10A; (+) strand; PAM type: YTN; PAM sequence: TTT
gaggaagaaaatttaaagtt

SEQ ID NO: 73711 - DNA, 20 bp, Artificial Sequence
  Description of Artificial Sequence: Synthetic oligonucleotide
  Target: SCN10A; (+) strand; PAM type: YTN; PAM sequence: TTG
aggaagaaaatttaaagttt

SEQ ID NO: 73712 - DNA, 20 bp, Artificial Sequence
  Description of Artificial Sequence: Synthetic oligonucleotide
  Target: SCN10A; (+) strand; PAM type: YTN; PAM sequence: TTT
aaagtttaaagtttgtcaag

SEQ ID NO: 73713 - DNA, 20 bp, Artificial Sequence
  Description of Artificial Sequence: Synthetic oligonucleotide
  Target: SCN10A; (+) strand; PAM type: YTN; PAM sequence: TTA
aagtttaaagtttgtcaagt

SEQ ID NO: 73714 - DNA, 20 bp, Artificial Sequence
  Description of Artificial Sequence: Synthetic oligonucleotide
  Target: SCN10A; (+) strand; PAM type: YTN; PAM sequence: TTT
aaagtttgtcaagtaatacc

SEQ ID NO: 73715 - DNA, 20 bp, Artificial Sequence
  Description of Artificial Sequence: Synthetic oligonucleotide
  Target: SCN10A; (+) strand; PAM type: YTN; PAM sequence: TTA
aagtttgtcaagtaatacca

SEQ ID NO: 73716 - DNA, 20 bp, Artificial Sequence
  Description of Artificial Sequence: Synthetic oligonucleotide
  Target: SCN10A; (+) strand; PAM type: YTN; PAM sequence: TTT
gtcaagtaataccaaaagaa

SEQ ID NO: 73717 - DNA, 20 bp, Artificial Sequence
  Description of Artificial Sequence: Synthetic oligonucleotide
  Target: SCN10A; (+) strand; PAM type: YTN; PAM sequence: TTG
tcaagtaataccaaaagaag

SEQ ID NO: 73718 - DNA, 20 bp, Artificial Sequence
  Description of Artificial Sequence: Synthetic oligonucleotide
  Target: SCN10A; (+) strand; PAM type: YTN; PAM sequence: CTG
ttgaaatattgatttgagga

SEQ ID NO: 73719 - DNA, 20 bp, Artificial Sequence
  Description of Artificial Sequence: Synthetic oligonucleotide
  Target: SCN10A; (+) strand; PAM type: YTN; PAM sequence: TTG
aaatattgatttgaggatca

SEQ ID NO: 73720 - DNA, 20 bp, Artificial Sequence
  Description of Artificial Sequence: Synthetic oligonucleotide
  Target: SCN10A; (+) strand; PAM type: YTN; PAM sequence: TTG
atttgaggatcatattaaat

SEQ ID NO: 73721 - DNA, 20 bp, Artificial Sequence
  Description of Artificial Sequence: Synthetic oligonucleotide
  Target: SCN10A; (+) strand; PAM type: YTN; PAM sequence: TTT
gaggatcatattaaatttat

SEQ ID NO: 73722 - DNA, 20 bp, Artificial Sequence
  Description of Artificial Sequence: Synthetic oligonucleotide
  Target: SCN10A; (+) strand; PAM type: YTN; PAM sequence: TTG
aggatcatattaaatttatt

SEQ ID NO: 73723 - DNA, 20 bp, Artificial Sequence
  Description of Artificial Sequence: Synthetic oligonucleotide
  Target: SCN10A; (+) strand; PAM type: YTN; PAM sequence: TTA
aatttattaatcatttttgg

SEQ ID NO: 73724 - DNA, 20 bp, Artificial Sequence
  Description of Artificial Sequence: Synthetic oligonucleotide
  Target: SCN10A; (+) strand; PAM type: YTN; PAM sequence: TTT
attaatcatttttgggagtc

SEQ ID NO: 73725 - DNA, 20 bp, Artificial Sequence
  Description of Artificial Sequence: Synthetic oligonucleotide
  Target: SCN10A; (+) strand; PAM type: YTN; PAM sequence: TTA
ttaatcatttttgggagtct

SEQ ID NO: 73726 - DNA, 20 bp, Artificial Sequence
  Description of Artificial Sequence: Synthetic oligonucleotide
  Target: SCN10A; (+) strand; PAM type: YTN; PAM sequence: TTA
atcatttttgggagtcttta

SEQ ID NO: 73727 - DNA, 20 bp, Artificial Sequence
  Description of Artificial Sequence: Synthetic oligonucleotide
  Target: SCN10A; (+) strand; PAM type: YTN; PAM sequence: TTT
ttgggagtctttacaatatt

SEQ ID NO: 73728 - DNA, 20 bp, Artificial Sequence
  Description of Artificial Sequence: Synthetic oligonucleotide
  Target: SCN10A; (+) strand; PAM type: YTN; PAM sequence: TTT
tgggagtctttacaatattg

SEQ ID NO: 73729 - DNA, 20 bp, Artificial Sequence
  Description of Artificial Sequence: Synthetic oligonucleotide
  Target: SCN10A; (+) strand; PAM type: YTN; PAM sequence: TTT
gggagtctttacaatattga

SEQ ID NO: 73730 - DNA, 20 bp, Artificial Sequence
  Description of Artificial Sequence: Synthetic oligonucleotide
  Target: SCN10A; (+) strand; PAM type: YTN; PAM sequence: TTG
ggagtctttacaatattgag

SEQ ID NO: 73731 - DNA, 20 bp, Artificial Sequence
  Description of Artificial Sequence: Synthetic oligonucleotide
  Target: SCN10A; (+) strand; PAM type: YTN; PAM sequence: CTT
tacaatattgagactttgaa

SEQ ID NO: 73732 - DNA, 20 bp, Artificial Sequence
  Description of Artificial Sequence: Synthetic oligonucleotide
  Target: SCN10A; (+) strand; PAM type: YTN; PAM sequence: TTT
acaatattgagactttgaat

SEQ ID NO: 73733 - DNA, 20 bp, Artificial Sequence
  Description of Artificial Sequence: Synthetic oligonucleotide
  Target: SCN10A; (+) strand; PAM type: YTN; PAM sequence: TTA
caatattgagactttgaatc

SEQ ID NO: 73734 - DNA, 20 bp, Artificial Sequence
  Description of Artificial Sequence: Synthetic oligonucleotide
  Target: SCN10A; (+) strand; PAM type: YTN; PAM sequence: TTG
agactttgaatctgagaaca

SEQ ID NO: 73735 - DNA, 20 bp, Artificial Sequence
  Description of Artificial Sequence: Synthetic oligonucleotide
  Target: SCN10A; (+) strand; PAM type: YTN; PAM sequence: CTT
tgaatctgagaacatgtctc

SEQ ID NO: 73736 - DNA, 20 bp, Artificial Sequence
  Description of Artificial Sequence: Synthetic oligonucleotide
  Target: SCN10A; (+) strand; PAM type: YTN; PAM sequence: TTT
gaatctgagaacatgtctcc

SEQ ID NO: 73737 - DNA, 20 bp, Artificial Sequence
  Description of Artificial Sequence: Synthetic oligonucleotide
  Target: SCN10A; (+) strand; PAM type: YTN; PAM sequence: TTG
aatctgagaacatgtctccc

SEQ ID NO: 73738 - DNA, 20 bp, Artificial Sequence
  Description of Artificial Sequence: Synthetic oligonucleotide
  Target: SCN10A; (+) strand; PAM type: YTN; PAM sequence: CTG
agaacatgtctccccactga

SEQ ID NO: 73739 - DNA, 20 bp, Artificial Sequence
  Description of Artificial Sequence: Synthetic oligonucleotide
  Target: SCN10A; (+) strand; PAM type: YTN; PAM sequence: CTC
cccactgatttggttttctt

SEQ ID NO: 73740 - DNA, 20 bp, Artificial Sequence
  Description of Artificial Sequence: Synthetic oligonucleotide
  Target: SCN10A; (+) strand; PAM type: YTN; PAM sequence: CTG
atttggttttctttaaaaac

SEQ ID NO: 73741 - DNA, 20 bp, Artificial Sequence
  Description of Artificial Sequence: Synthetic oligonucleotide
  Target: SCN10A; (+) strand; PAM type: YTN; PAM sequence: TTT
ggttttctttaaaaacttta

SEQ ID NO: 73742 - DNA, 20 bp, Artificial Sequence
  Description of Artificial Sequence: Synthetic oligonucleotide
  Target: SCN10A; (+) strand; PAM type: YTN; PAM sequence: TTG
gttttctttaaaaactttac

SEQ ID NO: 73743 - DNA, 20 bp, Artificial Sequence
  Description of Artificial Sequence: Synthetic oligonucleotide
  Target: SCN10A; (+) strand; PAM type: YTN; PAM sequence: TTT
tctttaaaaactttacacaa

SEQ ID NO: 73744 - DNA, 20 bp, Artificial Sequence
  Description of Artificial Sequence: Synthetic oligonucleotide
  Target: SCN10A; (+) strand; PAM type: YTN; PAM sequence: TTT
ctttaaaaactttacacaat

SEQ ID NO: 73745 - DNA, 20 bp, Artificial Sequence
  Description of Artificial Sequence: Synthetic oligonucleotide
  Target: SCN10A; (+) strand; PAM type: YTN; PAM sequence: TTC
tttaaaaactttacacaata

SEQ ID NO: 73746 - DNA, 20 bp, Artificial Sequence
  Description of Artificial Sequence: Synthetic oligonucleotide
  Target: SCN10A; (+) strand; PAM type: YTN; PAM sequence: CTT
taaaaactttacacaatact

SEQ ID NO: 73747 - DNA, 20 bp, Artificial Sequence
  Description of Artificial Sequence: Synthetic oligonucleotide
  Target: SCN10A; (+) strand; PAM type: YTN; PAM sequence: TTT
aaaaactttacacaatactt

SEQ ID NO: 73748 - DNA, 20 bp, Artificial Sequence
  Description of Artificial Sequence: Synthetic oligonucleotide
  Target: SCN10A; (+) strand; PAM type: YTN; PAM sequence: TTA
aaaactttacacaatactta

SEQ ID NO: 73749 - DNA, 20 bp, Artificial Sequence
  Description of Artificial Sequence: Synthetic oligonucleotide
  Target: SCN10A; (+) strand; PAM type: YTN; PAM sequence: CTT
tacacaatacttattataat

SEQ ID NO: 73750 - DNA, 20 bp, Artificial Sequence
  Description of Artificial Sequence: Synthetic oligonucleotide
  Target: SCN10A; (+) strand; PAM type: YTN; PAM sequence: TTT
acacaatacttattataatt

SEQ ID NO: 73751 - DNA, 20 bp, Artificial Sequence
  Description of Artificial Sequence: Synthetic oligonucleotide
  Target: SCN10A; (+) strand; PAM type: YTN; PAM sequence: TTA
cacaatacttattataattt

SEQ ID NO: 73752 - DNA, 20 bp, Artificial Sequence
  Description of Artificial Sequence: Synthetic oligonucleotide
  Target: SCN10A; (+) strand; PAM type: YTN; PAM sequence: CTT
attataattttccttataga

SEQ ID NO: 73753 - DNA, 20 bp, Artificial Sequence
  Description of Artificial Sequence: Synthetic oligonucleotide
  Target: SCN10A; (+) strand; PAM type: YTN; PAM sequence: TTA
ttataattttccttatagag

SEQ ID NO: 73754 - DNA, 20 bp, Artificial Sequence
  Description of Artificial Sequence: Synthetic oligonucleotide
  Target: SCN10A; (+) strand; PAM type: YTN; PAM sequence: TTA
taattttccttatagagatc

SEQ ID NO: 73755 - DNA, 20 bp, Artificial Sequence
  Description of Artificial Sequence: Synthetic oligonucleotide
  Target: SCN10A; (+) strand; PAM type: YTN; PAM sequence: TTT
tccttatagagatctcactt

SEQ ID NO: 73756 - DNA, 20 bp, Artificial Sequence
  Description of Artificial Sequence: Synthetic oligonucleotide
  Target: SCN10A; (+) strand; PAM type: YTN; PAM sequence: TTT
ccttatagagatctcactta

SEQ ID NO: 73757 - DNA, 20 bp, Artificial Sequence
  Description of Artificial Sequence: Synthetic oligonucleotide
  Target: SCN10A; (+) strand; PAM type: YTN; PAM sequence: TTC
cttatagagatctcacttat

SEQ ID NO: 73758 - DNA, 20 bp, Artificial Sequence
  Description of Artificial Sequence: Synthetic oligonucleotide
  Target: SCN10A; (+) strand; PAM type: YTN; PAM sequence: CTT
atagagatctcacttatact

SEQ ID NO: 73759 - DNA, 20 bp, Artificial Sequence
  Description of Artificial Sequence: Synthetic oligonucleotide
  Target: SCN10A; (+) strand; PAM type: YTN; PAM sequence: TTA
tagagatctcacttatactt

SEQ ID NO: 73760 - DNA, 20 bp, Artificial Sequence
  Description of Artificial Sequence: Synthetic oligonucleotide
  Target: SCN10A; (+) strand; PAM type: YTN; PAM sequence: CTC
acttatactttgataatctt

SEQ ID NO: 73761 - DNA, 20 bp, Artificial Sequence
  Description of Artificial Sequence: Synthetic oligonucleotide
  Target: SCN10A; (+) strand; PAM type: YTN; PAM sequence: CTT
atactttgataatcttattc

SEQ ID NO: 73762 - DNA, 20 bp, Artificial Sequence
  Description of Artificial Sequence: Synthetic oligonucleotide
  Target: SCN10A; (+) strand; PAM type: YTN; PAM sequence: TTA
tactttgataatcttattcc

SEQ ID NO: 73763 - DNA, 20 bp, Artificial Sequence
  Description of Artificial Sequence: Synthetic oligonucleotide
  Target: SCN10A; (+) strand; PAM type: YTN; PAM sequence: CTT
tgataatcttattcctagat

SEQ ID NO: 73764 - DNA, 20 bp, Artificial Sequence
  Description of Artificial Sequence: Synthetic oligonucleotide
  Target: SCN10A; (+) strand; PAM type: YTN; PAM sequence: TTT
gataatcttattcctagata

SEQ ID NO: 73765 - DNA, 20 bp, Artificial Sequence
  Description of Artificial Sequence: Synthetic oligonucleotide
  Target: SCN10A; (+) strand; PAM type: YTN; PAM sequence: TTG
ataatcttattcctagatac

SEQ ID NO: 73766 - DNA, 20 bp, Artificial Sequence
  Description of Artificial Sequence: Synthetic oligonucleotide
  Target: SCN10A; (+) strand; PAM type: YTN; PAM sequence: CTT
attcctagatacttgacatt

SEQ ID NO: 73767 - DNA, 20 bp, Artificial Sequence
  Description of Artificial Sequence: Synthetic oligonucleotide
  Target: SCN10A; (+) strand; PAM type: YTN; PAM sequence: TTA
ttcctagatacttgacattt

SEQ ID NO: 73768 - DNA, 20 bp, Artificial Sequence
  Description of Artificial Sequence: Synthetic oligonucleotide
  Target: SCN10A; (+) strand; PAM type: YTN; PAM sequence: TTC
ctagatacttgacattttaa

SEQ ID NO: 73769 - DNA, 20 bp, Artificial Sequence
  Description of Artificial Sequence: Synthetic oligonucleotide
  Target: SCN10A; (+) strand; PAM type: YTN; PAM sequence: CTA
gatacttgacattttaaaat

SEQ ID NO: 73770 - DNA, 20 bp, Artificial Sequence
  Description of Artificial Sequence: Synthetic oligonucleotide
  Target: SCN10A; (+) strand; PAM type: YTN; PAM sequence: CTT
gacattttaaaatgccagtg

SEQ ID NO: 73771 - DNA, 20 bp, Artificial Sequence
  Description of Artificial Sequence: Synthetic oligonucleotide
  Target: SCN10A; (+) strand; PAM type: YTN; PAM sequence: TTG
acattttaaaatgccagtgt

SEQ ID NO: 73772 - DNA, 20 bp, Artificial Sequence
  Description of Artificial Sequence: Synthetic oligonucleotide
  Target: SCN10A; (+) strand; PAM type: YTN; PAM sequence: TTT
taaaatgccagtgtaaatgg

SEQ ID NO: 73773 - DNA, 20 bp, Artificial Sequence
  Description of Artificial Sequence: Synthetic oligonucleotide
  Target: SCN10A; (+) strand; PAM type: YTN; PAM sequence: TTT
aaaatgccagtgtaaatggt

SEQ ID NO: 73774 - DNA, 20 bp, Artificial Sequence
  Description of Artificial Sequence: Synthetic oligonucleotide
  Target: SCN10A; (+) strand; PAM type: YTN; PAM sequence: TTA
aaatgccagtgtaaatggta

SEQ ID NO: 73775 - DNA, 20 bp, Artificial Sequence
  Description of Artificial Sequence: Synthetic oligonucleotide
  Target: SCN10A; (+) strand; PAM type: YTN; PAM sequence: TTT
ttaaaaactattttctgttt

SEQ ID NO: 73776 - DNA, 20 bp, Artificial Sequence
  Description of Artificial Sequence: Synthetic oligonucleotide
  Target: SCN10A; (+) strand; PAM type: YTN; PAM sequence: TTT
taaaaactattttctgtttg

SEQ ID NO: 73777 - DNA, 20 bp, Artificial Sequence
  Description of Artificial Sequence: Synthetic oligonucleotide
  Target: SCN10A; (+) strand; PAM type: YTN; PAM sequence: TTT
aaaaactattttctgtttgt

SEQ ID NO: 73778 - DNA, 20 bp, Artificial Sequence
  Description of Artificial Sequence: Synthetic oligonucleotide
  Target: SCN10A; (+) strand; PAM type: YTN; PAM sequence: TTA
aaaactattttctgtttgtt

SEQ ID NO: 73779 - DNA, 20 bp, Artificial Sequence
  Description of Artificial Sequence: Synthetic oligonucleotide
  Target: SCN10A; (+) strand; PAM type: YTN; PAM sequence: CTA
ttttctgtttgttgctagtg

SEQ ID NO: 73780 - DNA, 20 bp, Artificial Sequence
  Description of Artificial Sequence: Synthetic oligonucleotide
  Target: SCN10A; (+) strand; PAM type: YTN; PAM sequence: TTT
tctgtttgttgctagtgtct

SEQ ID NO: 73781 - DNA, 20 bp, Artificial Sequence
  Description of Artificial Sequence: Synthetic oligonucleotide
  Target: SCN10A; (+) strand; PAM type: YTN; PAM sequence: TTT
ctgtttgttgctagtgtcta

SEQ ID NO: 73782 - DNA, 20 bp, Artificial Sequence
  Description of Artificial Sequence: Synthetic oligonucleotide
  Target: SCN10A; (+) strand; PAM type: YTN; PAM sequence: TTC
tgtttgttgctagtgtctat

SEQ ID NO: 73783 - DNA, 20 bp, Artificial Sequence
  Description of Artificial Sequence: Synthetic oligonucleotide
  Target: SCN10A; (+) strand; PAM type: YTN; PAM sequence: CTG
tttgttgctagtgtctatac

SEQ ID NO: 73784 - DNA, 20 bp, Artificial Sequence
  Description of Artificial Sequence: Synthetic oligonucleotide
  Target: SCN10A; (+) strand; PAM type: YTN; PAM sequence: TTT
gttgctagtgtctatacaca

SEQ ID NO: 73785 - DNA, 20 bp, Artificial Sequence
  Description of Artificial Sequence: Synthetic oligonucleotide
  Target: SCN10A; (+) strand; PAM type: YTN; PAM sequence: TTG
ttgctagtgtctatacacaa

SEQ ID NO: 73786 - DNA, 20 bp, Artificial Sequence
  Description of Artificial Sequence: Synthetic oligonucleotide
  Target: SCN10A; (+) strand; PAM type: YTN; PAM sequence: TTG
ctagtgtctatacacaattg

SEQ ID NO: 73787 - DNA, 20 bp, Artificial Sequence
  Description of Artificial Sequence: Synthetic oligonucleotide
  Target: SCN10A; (+) strand; PAM type: YTN; PAM sequence: CTA
gtgtctatacacaattgatt

SEQ ID NO: 73788 - DNA, 20 bp, Artificial Sequence
  Description of Artificial Sequence: Synthetic oligonucleotide
  Target: SCN10A; (+) strand; PAM type: YTN; PAM sequence: CTA
tacacaattgatttatgtat

SEQ ID NO: 73789 - DNA, 20 bp, Artificial Sequence
  Description of Artificial Sequence: Synthetic oligonucleotide
  Target: SCN10A; (+) strand; PAM type: YTN; PAM sequence: TTG
atttatgtatgttaatttgt

SEQ ID NO: 73790 - DNA, 20 bp, Artificial Sequence
  Description of Artificial Sequence: Synthetic oligonucleotide
  Target: SCN10A; (+) strand; PAM type: YTN; PAM sequence: TTT
atgtatgttaatttgtaccc

SEQ ID NO: 73791 - DNA, 20 bp, Artificial Sequence
  Description of Artificial Sequence: Synthetic oligonucleotide
  Target: SCN10A; (+) strand; PAM type: YTN; PAM sequence: TTA
tgtatgttaatttgtaccca

SEQ ID NO: 73792 - DNA, 20 bp, Artificial Sequence
  Description of Artificial Sequence: Synthetic oligonucleotide
  Target: SCN10A; (+) strand; PAM type: YTN; PAM sequence: TTA
atttgtacccagctacctta

SEQ ID NO: 73793 - DNA, 20 bp, Artificial Sequence
  Description of Artificial Sequence: Synthetic oligonucleotide
  Target: SCN10A; (+) strand; PAM type: YTN; PAM sequence: TTT
gtacccagctaccttactat

SEQ ID NO: 73794 - DNA, 20 bp, Artificial Sequence
  Description of Artificial Sequence: Synthetic oligonucleotide
  Target: SCN10A; (+) strand; PAM type: YTN; PAM sequence: TTG
tacccagctaccttactata

SEQ ID NO: 73795 - DNA, 20 bp, Artificial Sequence
  Description of Artificial Sequence: Synthetic oligonucleotide
  Target: SCN10A; (+) strand; PAM type: YTN; PAM sequence: CTA
ccttactatactcttttatt

SEQ ID NO: 73796 - DNA, 20 bp, Artificial Sequence
  Description of Artificial Sequence: Synthetic oligonucleotide
  Target: SCN10A; (+) strand; PAM type: YTN; PAM sequence: CTT
actatactcttttattaatt

SEQ ID NO: 73797 - DNA, 20 bp, Artificial Sequence
  Description of Artificial Sequence: Synthetic oligonucleotide
  Target: SCN10A; (+) strand; PAM type: YTN; PAM sequence: TTA
ctatactcttttattaattc

SEQ ID NO: 73798 - DNA, 20 bp, Artificial Sequence
  Description of Artificial Sequence: Synthetic oligonucleotide
  Target: SCN10A; (+) strand; PAM type: YTN; PAM sequence: CTA
tactcttttattaattctta

SEQ ID NO: 73799 - DNA, 20 bp, Artificial Sequence
  Description of Artificial Sequence: Synthetic oligonucleotide
  Target: SCN10A; (+) strand; PAM type: YTN; PAM sequence: CTC
ttttattaattcttactgtt

SEQ ID NO: 73800 - DNA, 20 bp, Artificial Sequence
  Description of Artificial Sequence: Synthetic oligonucleotide
  Target: SCN10A; (+) strand; PAM type: YTN; PAM sequence: CTT
ttattaattcttactgttta

SEQ ID NO: 73801 - DNA, 20 bp, Artificial Sequence
  Description of Artificial Sequence: Synthetic oligonucleotide
  Target: SCN10A; (+) strand; PAM type: YTN; PAM sequence: TTT
tattaattcttactgtttat

SEQ ID NO: 73802 - DNA, 20 bp, Artificial Sequence
  Description of Artificial Sequence: Synthetic oligonucleotide
  Target: SCN10A; (+) strand; PAM type: YTN; PAM sequence: TTT
attaattcttactgtttatc

SEQ ID NO: 73803 - DNA, 20 bp, Artificial Sequence
  Description of Artificial Sequence: Synthetic oligonucleotide
  Target: SCN10A; (+) strand; PAM type: YTN; PAM sequence: TTA
ttaattcttactgtttatct

SEQ ID NO: 73804 - DNA, 20 bp, Artificial Sequence
  Description of Artificial Sequence: Synthetic oligonucleotide
  Target: SCN10A; (+) strand; PAM type: YTN; PAM sequence: TTA
attcttactgtttatctcta

SEQ ID NO: 73805 - DNA, 20 bp, Artificial Sequence
  Description of Artificial Sequence: Synthetic oligonucleotide
  Target: SCN10A; (+) strand; PAM type: YTN; PAM sequence: TTC
ttactgtttatctctaggtt

SEQ ID NO: 73806 - DNA, 20 bp, Artificial Sequence
  Description of Artificial Sequence: Synthetic oligonucleotide
  Target: SCN10A; (+) strand; PAM type: YTN; PAM sequence: CTT
actgtttatctctaggttat

SEQ ID NO: 73807 - DNA, 20 bp, Artificial Sequence
  Description of Artificial Sequence: Synthetic oligonucleotide
  Target: SCN10A; (+) strand; PAM type: YTN; PAM sequence: TTA
ctgtttatctctaggttatg

SEQ ID NO: 73808 - DNA, 20 bp, Artificial Sequence
  Description of Artificial Sequence: Synthetic oligonucleotide
  Target: SCN10A; (+) strand; PAM type: YTN; PAM sequence: CTG
tttatctctaggttatgttg

SEQ ID NO: 73809 - DNA, 20 bp, Artificial Sequence
  Description of Artificial Sequence: Synthetic oligonucleotide
  Target: SCN10A; (+) strand; PAM type: YTN; PAM sequence: TTT
atctctaggttatgttggat

SEQ ID NO: 73810 - DNA, 20 bp, Artificial Sequence
  Description of Artificial Sequence: Synthetic oligonucleotide
  Target: SCN10A; (+) strand; PAM type: YTN; PAM sequence: TTA
tctctaggttatgttggata

SEQ ID NO: 73811 - DNA, 20 bp, Artificial Sequence
  Description of Artificial Sequence: Synthetic oligonucleotide
  Target: SCN10A; (+) strand; PAM type: YTN; PAM sequence: CTC
taggttatgttggatatttt

SEQ ID NO: 73812 - DNA, 20 bp, Artificial Sequence
  Description of Artificial Sequence: Synthetic oligonucleotide
  Target: SCN10A; (+) strand; PAM type: YTN; PAM sequence: CTA
ggttatgttggatattttat

SEQ ID NO: 73813 - DNA, 20 bp, Artificial Sequence
  Description of Artificial Sequence: Synthetic oligonucleotide
  Target: SCN10A; (+) strand; PAM type: YTN; PAM sequence: TTA
tgttggatattttatgtata

SEQ ID NO: 73814 - DNA, 20 bp, Artificial Sequence
  Description of Artificial Sequence: Synthetic oligonucleotide
  Target: SCN10A; (+) strand; PAM type: YTN; PAM sequence: TTG
gatattttatgtatacaatc

SEQ ID NO: 73815 - DNA, 20 bp, Artificial Sequence
  Description of Artificial Sequence: Synthetic oligonucleotide
  Target: SCN10A; (+) strand; PAM type: YTN; PAM sequence: TTT
tatgtatacaatcttattat

SEQ ID NO: 73816 - DNA, 20 bp, Artificial Sequence
  Description of Artificial Sequence: Synthetic oligonucleotide
  Target: SCN10A; (+) strand; PAM type: YTN; PAM sequence: TTT
atgtatacaatcttattatc

SEQ ID NO: 73817 - DNA, 20 bp, Artificial Sequence
  Description of Artificial Sequence: Synthetic oligonucleotide
  Target: SCN10A; (+) strand; PAM type: YTN; PAM sequence: TTA
tgtatacaatcttattatct

SEQ ID NO: 73818 - DNA, 20 bp, Artificial Sequence
  Description of Artificial Sequence: Synthetic oligonucleotide
  Target: SCN10A; (+) strand; PAM type: YTN; PAM sequence: CTT
attatctgtaaattacatct

SEQ ID NO: 73819 - DNA, 20 bp, Artificial Sequence
  Description of Artificial Sequence: Synthetic oligonucleotide
  Target: SCN10A; (+) strand; PAM type: YTN; PAM sequence: TTA
ttatctgtaaattacatctt

SEQ ID NO: 73820 - DNA, 20 bp, Artificial Sequence
  Description of Artificial Sequence: Synthetic oligonucleotide
  Target: SCN10A; (+) strand; PAM type: YTN; PAM sequence: TTA
tctgtaaattacatcttcgg

SEQ ID NO: 73821 - DNA, 20 bp, Artificial Sequence
  Description of Artificial Sequence: Synthetic oligonucleotide
  Target: SCN10A; (+) strand; PAM type: YTN; PAM sequence: CTG
taaattacatcttcggtact

SEQ ID NO: 73822 - DNA, 20 bp, Artificial Sequence
  Description of Artificial Sequence: Synthetic oligonucleotide
  Target: SCN10A; (+) strand; PAM type: YTN; PAM sequence: TTA
catcttcggtacttttttct

SEQ ID NO: 73823 - DNA, 20 bp, Artificial Sequence
  Description of Artificial Sequence: Synthetic oligonucleotide
  Target: SCN10A; (+) strand; PAM type: YTN; PAM sequence: CTT
cggtacttttttcttcttgc

SEQ ID NO: 73824 - DNA, 20 bp, Artificial Sequence
  Description of Artificial Sequence: Synthetic oligonucleotide
  Target: SCN10A; (+) strand; PAM type: YTN; PAM sequence: TTC
ggtacttttttcttcttgca

SEQ ID NO: 73825 - DNA, 20 bp, Artificial Sequence
  Description of Artificial Sequence: Synthetic oligonucleotide
  Target: SCN10A; (+) strand; PAM type: YTN; PAM sequence: CTT
ttttcttcttgcactttttt

SEQ ID NO: 73826 - DNA, 20 bp, Artificial Sequence
  Description of Artificial Sequence: Synthetic oligonucleotide
  Target: SCN10A; (+) strand; PAM type: YTN; PAM sequence: TTT
tttcttcttgcacttttttt

SEQ ID NO: 73827 - DNA, 20 bp, Artificial Sequence
  Description of Artificial Sequence: Synthetic oligonucleotide
  Target: SCN10A; (+) strand; PAM type: YTN; PAM sequence: TTT
ttcttcttgcactttttttt

SEQ ID NO: 73828 - DNA, 20 bp, Artificial Sequence
  Description of Artificial Sequence: Synthetic oligonucleotide
  Target: SCN10A; (+) strand; PAM type: YTN; PAM sequence: TTT
tcttcttgcacttttttttt

SEQ ID NO: 73829 - DNA, 20 bp, Artificial Sequence
  Description of Artificial Sequence: Synthetic oligonucleotide
  Target: SCN10A; (+) strand; PAM type: YTN; PAM sequence: TTT
cttcttgcactttttttttc

SEQ ID NO: 73830 - DNA, 20 bp, Artificial Sequence
  Description of Artificial Sequence: Synthetic oligonucleotide
  Target: SCN10A; (+) strand; PAM type: YTN; PAM sequence: TTC
ttcttgcactttttttttct

SEQ ID NO: 73831 - DNA, 20 bp, Artificial Sequence
  Description of Artificial Sequence: Synthetic oligonucleotide
  Target: SCN10A; (+) strand; PAM type: YTN; PAM sequence: CTT
cttgcactttttttttcttt

SEQ ID NO: 73832 - DNA, 20 bp, Artificial Sequence
  Description of Artificial Sequence: Synthetic oligonucleotide
  Target: SCN10A; (+) strand; PAM type: YTN; PAM sequence: TTC
ttgcactttttttttctttg

SEQ ID NO: 73833 - DNA, 20 bp, Artificial Sequence
  Description of Artificial Sequence: Synthetic oligonucleotide
  Target: SCN10A; (+) strand; PAM type: YTN; PAM sequence: CTT
gcactttttttttctttgct

SEQ ID NO: 73834 - DNA, 20 bp, Artificial Sequence
  Description of Artificial Sequence: Synthetic oligonucleotide
  Target: SCN10A; (+) strand; PAM type: YTN; PAM sequence: TTG
cactttttttttctttgctt

SEQ ID NO: 73835 - DNA, 20 bp, Artificial Sequence
  Description of Artificial Sequence: Synthetic oligonucleotide
  Target: SCN10A; (+) strand; PAM type: YTN; PAM sequence: CTT
tttttttctttgctttacta

SEQ ID NO: 73836 - DNA, 20 bp, Artificial Sequence
  Description of Artificial Sequence: Synthetic oligonucleotide
  Target: SCN10A; (+) strand; PAM type: YTN; PAM sequence: TTT
ttttttctttgctttactat

SEQ ID NO: 73837 - DNA, 20 bp, Artificial Sequence
  Description of Artificial Sequence: Synthetic oligonucleotide
  Target: SCN10A; (+) strand; PAM type: YTN; PAM sequence: TTT
tttttctttgctttactatg

SEQ ID NO: 73838 - DNA, 20 bp, Artificial Sequence
  Description of Artificial Sequence: Synthetic oligonucleotide
  Target: SCN10A; (+) strand; PAM type: YTN; PAM sequence: TTT
ttttctttgctttactatgc

SEQ ID NO: 73839 - DNA, 20 bp, Artificial Sequence
  Description of Artificial Sequence: Synthetic oligonucleotide
  Target: SCN10A; (+) strand; PAM type: YTN; PAM sequence: TTT
tttctttgctttactatgct

SEQ ID NO: 73840 - DNA, 20 bp, Artificial Sequence
  Description of Artificial Sequence: Synthetic oligonucleotide
  Target: SCN10A; (+) strand; PAM type: YTN; PAM sequence: TTT
ttctttgctttactatgctg

SEQ ID NO: 73841 - DNA, 20 bp, Artificial Sequence
  Description of Artificial Sequence: Synthetic oligonucleotide
  Target: SCN10A; (+) strand; PAM type: YTN; PAM sequence: TTT
tctttgctttactatgctgg

SEQ ID NO: 73842 - DNA, 20 bp, Artificial Sequence
  Description of Artificial Sequence: Synthetic oligonucleotide
  Target: SCN10A; (+) strand; PAM type: YTN; PAM sequence: TTT
ctttgctttactatgctggc

SEQ ID NO: 73843 - DNA, 20 bp, Artificial Sequence
  Description of Artificial Sequence: Synthetic oligonucleotide
  Target: SCN10A; (+) strand; PAM type: YTN; PAM sequence: TTC
tttgctttactatgctggct

SEQ ID NO: 73844 - DNA, 20 bp, Artificial Sequence
  Description of Artificial Sequence: Synthetic oligonucleotide
  Target: SCN10A; (+) strand; PAM type: YTN; PAM sequence: CTT
tgctttactatgctggctga

SEQ ID NO: 73845 - DNA, 20 bp, Artificial Sequence
  Description of Artificial Sequence: Synthetic oligonucleotide
  Target: SCN10A; (+) strand; PAM type: YTN; PAM sequence: TTT
gctttactatgctggctgag

SEQ ID NO: 73846 - DNA, 20 bp, Artificial Sequence
  Description of Artificial Sequence: Synthetic oligonucleotide
  Target: SCN10A; (+) strand; PAM type: YTN; PAM sequence: TTG
ctttactatgctggctgaga

SEQ ID NO: 73847 - DNA, 20 bp, Artificial Sequence
  Description of Artificial Sequence: Synthetic oligonucleotide
  Target: SCN10A; (+) strand; PAM type: YTN; PAM sequence: CTT
tactatgctggctgagacct

SEQ ID NO: 73848 - DNA, 20 bp, Artificial Sequence
  Description of Artificial Sequence: Synthetic oligonucleotide
  Target: SCN10A; (+) strand; PAM type: YTN; PAM sequence: TTT
actatgctggctgagacctc

SEQ ID NO: 73849 - DNA, 20 bp, Artificial Sequence
  Description of Artificial Sequence: Synthetic oligonucleotide
  Target: SCN10A; (+) strand; PAM type: YTN; PAM sequence: TTA
ctatgctggctgagacctcc

SEQ ID NO: 73850 - DNA, 20 bp, Artificial Sequence
  Description of Artificial Sequence: Synthetic oligonucleotide
  Target: SCN10A; (+) strand; PAM type: YTN; PAM sequence: CTA
tgctggctgagacctccttt

SEQ ID NO: 73851 - DNA, 20 bp, Artificial Sequence
  Description of Artificial Sequence: Synthetic oligonucleotide
  Target: SCN10A; (+) strand; PAM type: YTN; PAM sequence: CTG
gctgagacctcctttacaaa

SEQ ID NO: 73852 - DNA, 20 bp, Artificial Sequence
  Description of Artificial Sequence: Synthetic oligonucleotide
  Target: SCN10A; (+) strand; PAM type: YTN; PAM sequence: CTG
agacctcctttacaaagtgg

SEQ ID NO: 73853 - DNA, 20 bp, Artificial Sequence
  Description of Artificial Sequence: Synthetic oligonucleotide
  Target: SCN10A; (+) strand; PAM type: YTN; PAM sequence: CTC
ctttacaaagtggaactgag

SEQ ID NO: 73854 - DNA, 20 bp, Artificial Sequence
  Description of Artificial Sequence: Synthetic oligonucleotide
  Target: SCN10A; (+) strand; PAM type: YTN; PAM sequence: CTT
tacaaagtggaactgagaag

SEQ ID NO: 73855 - DNA, 20 bp, Artificial Sequence
  Description of Artificial Sequence: Synthetic oligonucleotide
  Target: SCN10A; (+) strand; PAM type: YTN; PAM sequence: TTT
acaaagtggaactgagaaga

SEQ ID NO: 73856 - DNA, 20 bp, Artificial Sequence
  Description of Artificial Sequence: Synthetic oligonucleotide
  Target: SCN10A; (+) strand; PAM type: YTN; PAM sequence: TTA
caaagtggaactgagaagaa

SEQ ID NO: 73857 - DNA, 20 bp, Artificial Sequence
  Description of Artificial Sequence: Synthetic oligonucleotide
  Target: SCN10A; (+) strand; PAM type: YTN; PAM sequence: CTG
agaagaacagacatctttgg

SEQ ID NO: 73858 - DNA, 20 bp, Artificial Sequence
  Description of Artificial Sequence: Synthetic oligonucleotide
  Target: SCN10A; (+) strand; PAM type: YTN; PAM sequence: CTT
tggtttttttttcttttgat

SEQ ID NO: 73859 - DNA, 20 bp, Artificial Sequence
  Description of Artificial Sequence: Synthetic oligonucleotide
  Target: SCN10A; (+) strand; PAM type: YTN; PAM sequence: TTT
ggtttttttttcttttgatc

SEQ ID NO: 73860 - DNA, 20 bp, Artificial Sequence
  Description of Artificial Sequence: Synthetic oligonucleotide
  Target: SCN10A; (+) strand; PAM type: YTN; PAM sequence: TTG
gtttttttttcttttgatct

SEQ ID NO: 73861 - DNA, 20 bp, Artificial Sequence
  Description of Artificial Sequence: Synthetic oligonucleotide
  Target: SCN10A; (+) strand; PAM type: YTN; PAM sequence: TTT
ttttttcttttgatctcaaa

SEQ ID NO: 73862 - DNA, 20 bp, Artificial Sequence
  Description of Artificial Sequence: Synthetic oligonucleotide
  Target: SCN10A; (+) strand; PAM type: YTN; PAM sequence: TTT
tttttcttttgatctcaaag

SEQ ID NO: 73863 - DNA, 20 bp, Artificial Sequence
  Description of Artificial Sequence: Synthetic oligonucleotide
  Target: SCN10A; (+) strand; PAM type: YTN; PAM sequence: TTT
ttttcttttgatctcaaagg

SEQ ID NO: 73864 - DNA, 20 bp, Artificial Sequence
  Description of Artificial Sequence: Synthetic oligonucleotide
  Target: SCN10A; (+) strand; PAM type: YTN; PAM sequence: TTT
tttcttttgatctcaaaggg

SEQ ID NO: 73865 - DNA, 20 bp, Artificial Sequence
  Description of Artificial Sequence: Synthetic oligonucleotide
  Target: SCN10A; (+) strand; PAM type: YTN; PAM sequence: TTT
ttcttttgatctcaaaggga

SEQ ID NO: 73866 - DNA, 20 bp, Artificial Sequence
  Description of Artificial Sequence: Synthetic oligonucleotide
  Target: SCN10A; (+) strand; PAM type: YTN; PAM sequence: TTT
tcttttgatctcaaagggaa

SEQ ID NO: 73867 - DNA, 20 bp, Artificial Sequence
  Description of Artificial Sequence: Synthetic oligonucleotide
  Target: SCN10A; (+) strand; PAM type: YTN; PAM sequence: TTT
cttttgatctcaaagggaaa

SEQ ID NO: 73868 - DNA, 20 bp, Artificial Sequence
  Description of Artificial Sequence: Synthetic oligonucleotide
  Target: SCN10A; (+) strand; PAM type: YTN; PAM sequence: TTC
ttttgatctcaaagggaaag

SEQ ID NO: 73869 - DNA, 20 bp, Artificial Sequence
  Description of Artificial Sequence: Synthetic oligonucleotide
  Target: SCN10A; (+) strand; PAM type: YTN; PAM sequence: CTT
ttgatctcaaagggaaagct

SEQ ID NO: 73870 - DNA, 20 bp, Artificial Sequence
  Description of Artificial Sequence: Synthetic oligonucleotide
  Target: SCN10A; (+) strand; PAM type: YTN; PAM sequence: TTT
tgatctcaaagggaaagctt

SEQ ID NO: 73871 - DNA, 20 bp, Artificial Sequence
  Description of Artificial Sequence: Synthetic oligonucleotide
  Target: SCN10A; (+) strand; PAM type: YTN; PAM sequence: TTT
gatctcaaagggaaagcttt

SEQ ID NO: 73872 - DNA, 20 bp, Artificial Sequence
  Description of Artificial Sequence: Synthetic oligonucleotide
  Target: SCN10A; (+) strand; PAM type: YTN; PAM sequence: TTG
atctcaaagggaaagctttc

SEQ ID NO: 73873 - DNA, 20 bp, Artificial Sequence
  Description of Artificial Sequence: Synthetic oligonucleotide
  Target: SCN10A; (+) strand; PAM type: YTN; PAM sequence: CTC
aaagggaaagctttccatgt

SEQ ID NO: 73874 - DNA, 20 bp, Artificial Sequence
  Description of Artificial Sequence: Synthetic oligonucleotide
  Target: SCN10A; (+) strand; PAM type: YTN; PAM sequence: CTT
tccatgttcacaattaagta

SEQ ID NO: 73875 - DNA, 20 bp, Artificial Sequence
  Description of Artificial Sequence: Synthetic oligonucleotide
  Target: SCN10A; (+) strand; PAM type: YTN; PAM sequence: TTT
ccatgttcacaattaagtat

SEQ ID NO: 73876 - DNA, 20 bp, Artificial Sequence
  Description of Artificial Sequence: Synthetic oligonucleotide
  Target: SCN10A; (+) strand; PAM type: YTN; PAM sequence: TTC
catgttcacaattaagtatg

SEQ ID NO: 73877 - DNA, 20 bp, Artificial Sequence
  Description of Artificial Sequence: Synthetic oligonucleotide
  Target: SCN10A; (+) strand; PAM type: YTN; PAM sequence: TTC
acaattaagtatgacgcttg

SEQ ID NO: 73878 - DNA, 20 bp, Artificial Sequence
  Description of Artificial Sequence: Synthetic oligonucleotide
  Target: SCN10A; (+) strand; PAM type: YTN; PAM sequence: TTA
agtatgacgcttgatacttt

SEQ ID NO: 73879 - DNA, 20 bp, Artificial Sequence
  Description of Artificial Sequence: Synthetic oligonucleotide
  Target: SCN10A; (+) strand; PAM type: YTN; PAM sequence: CTT
gatactttaaaacaatgaat

SEQ ID NO: 73880 - DNA, 20 bp, Artificial Sequence
  Description of Artificial Sequence: Synthetic oligonucleotide
  Target: SCN10A; (+) strand; PAM type: YTN; PAM sequence: TTG
atactttaaaacaatgaata

SEQ ID NO: 73881 - DNA, 20 bp, Artificial Sequence
  Description of Artificial Sequence: Synthetic oligonucleotide
  Target: SCN10A; (+) strand; PAM type: YTN; PAM sequence: CTT
taaaacaatgaatacccttt

SEQ ID NO: 73882 - DNA, 20 bp, Artificial Sequence
  Description of Artificial Sequence: Synthetic oligonucleotide
  Target: SCN10A; (+) strand; PAM type: YTN; PAM sequence: TTT
aaaacaatgaatacccttta

SEQ ID NO: 73883 - DNA, 20 bp, Artificial Sequence
  Description of Artificial Sequence: Synthetic oligonucleotide
  Target: SCN10A; (+) strand; PAM type: YTN; PAM sequence: TTA
aaacaatgaataccctttat

SEQ ID NO: 73884 - DNA, 20 bp, Artificial Sequence
  Description of Artificial Sequence: Synthetic oligonucleotide
  Target: SCN10A; (+) strand; PAM type: YTN; PAM sequence: CTT
tatcagagtgatgcaatccc

SEQ ID NO: 73885 - DNA, 20 bp, Artificial Sequence
  Description of Artificial Sequence: Synthetic oligonucleotide
  Target: SCN10A; (+) strand; PAM type: YTN; PAM sequence: TTT
atcagagtgatgcaatcccc

SEQ ID NO: 73886 - DNA, 20 bp, Artificial Sequence
  Description of Artificial Sequence: Synthetic oligonucleotide
  Target: SCN10A; (+) strand; PAM type: YTN; PAM sequence: TTA
tcagagtgatgcaatcccct

SEQ ID NO: 73887 - DNA, 20 bp, Artificial Sequence
  Description of Artificial Sequence: Synthetic oligonucleotide
  Target: SCN10A; (+) strand; PAM type: YTN; PAM sequence: CTT
tttaaaattattatacttta

SEQ ID NO: 73888 - DNA, 20 bp, Artificial Sequence
  Description of Artificial Sequence: Synthetic oligonucleotide
  Target: SCN10A; (+) strand; PAM type: YTN; PAM sequence: TTT
ttaaaattattatactttaa

SEQ ID NO: 73889 - DNA, 20 bp, Artificial Sequence
  Description of Artificial Sequence: Synthetic oligonucleotide
  Target: SCN10A; (+) strand; PAM type: YTN; PAM sequence: TTT
taaaattattatactttaag

SEQ ID NO: 73890 - DNA, 20 bp, Artificial Sequence
  Description of Artificial Sequence: Synthetic oligonucleotide
  Target: SCN10A; (+) strand; PAM type: YTN; PAM sequence: TTT
aaaattattatactttaagt

SEQ ID NO: 73891 - DNA, 20 bp, Artificial Sequence
  Description of Artificial Sequence: Synthetic oligonucleotide
  Target: SCN10A; (+) strand; PAM type: YTN; PAM sequence: TTA
aaattattatactttaagtt

SEQ ID NO: 73892 - DNA, 20 bp, Artificial Sequence
  Description of Artificial Sequence: Synthetic oligonucleotide
  Target: SCN10A; (+) strand; PAM type: YTN; PAM sequence: TTA
ttatactttaagttctgggg

SEQ ID NO: 73893 - DNA, 20 bp, Artificial Sequence
  Description of Artificial Sequence: Synthetic oligonucleotide
  Target: SCN10A; (+) strand; PAM type: YTN; PAM sequence: TTA
tactttaagttctggggtac

SEQ ID NO: 73894 - DNA, 20 bp, Artificial Sequence
  Description of Artificial Sequence: Synthetic oligonucleotide
  Target: SCN10A; (+) strand; PAM type: YTN; PAM sequence: CTT
taagttctggggtacatgtg

SEQ ID NO: 73895 - DNA, 20 bp, Artificial Sequence
  Description of Artificial Sequence: Synthetic oligonucleotide
  Target: SCN10A; (+) strand; PAM type: YTN; PAM sequence: TTT
aagttctggggtacatgtgc

SEQ ID NO: 73896 - DNA, 20 bp, Artificial Sequence
  Description of Artificial Sequence: Synthetic oligonucleotide
  Target: SCN10A; (+) strand; PAM type: YTN; PAM sequence: TTA
agttctggggtacatgtgca

SEQ ID NO: 73897 - DNA, 20 bp, Artificial Sequence
  Description of Artificial Sequence: Synthetic oligonucleotide
  Target: SCN10A; (+) strand; PAM type: YTN; PAM sequence: TTC
tggggtacatgtgcagaacg

SEQ ID NO: 73898 - DNA, 20 bp, Artificial Sequence
  Description of Artificial Sequence: Synthetic oligonucleotide
  Target: SCN10A; (+) strand; PAM type: YTN; PAM sequence: CTG
gggtacatgtgcagaacgtg

SEQ ID NO: 73899 - DNA, 20 bp, Artificial Sequence
  Description of Artificial Sequence: Synthetic oligonucleotide
  Target: SCN10A; (+) strand; PAM type: YTN; PAM sequence: TTT
gttacataggtgtacccgtg

SEQ ID NO: 73900 - DNA, 20 bp, Artificial Sequence
  Description of Artificial Sequence: Synthetic oligonucleotide
  Target: SCN10A; (+) strand; PAM type: YTN; PAM sequence: TTG
ttacataggtgtacccgtgc

SEQ ID NO: 73901 - DNA, 20 bp, Artificial Sequence
  Description of Artificial Sequence: Synthetic oligonucleotide
  Target: SCN10A; (+) strand; PAM type: YTN; PAM sequence: TTA
cataggtgtacccgtgccat

SEQ ID NO: 73902 - DNA, 20 bp, Artificial Sequence
  Description of Artificial Sequence: Synthetic oligonucleotide
  Target: SCN10A; (+) strand; PAM type: YTN; PAM sequence: TTT
gctgcacccttcaacccgtc

SEQ ID NO: 73903 - DNA, 20 bp, Artificial Sequence
  Description of Artificial Sequence: Synthetic oligonucleotide
  Target: SCN10A; (+) strand; PAM type: YTN; PAM sequence: TTG
ctgcacccttcaacccgtca

SEQ ID NO: 73904 - DNA, 20 bp, Artificial Sequence
  Description of Artificial Sequence: Synthetic oligonucleotide
  Target: SCN10A; (+) strand; PAM type: YTN; PAM sequence: CTG
cacccttcaacccgtcattt

SEQ ID NO: 73905 - DNA, 20 bp, Artificial Sequence
  Description of Artificial Sequence: Synthetic oligonucleotide
  Target: SCN10A; (+) strand; PAM type: YTN; PAM sequence: CTT
caacccgtcatttacattag

SEQ ID NO: 73906 - DNA, 20 bp, Artificial Sequence
  Description of Artificial Sequence: Synthetic oligonucleotide
  Target: SCN10A; (+) strand; PAM type: YTN; PAM sequence: TTC
aacccgtcatttacattagg

SEQ ID NO: 73907 - DNA, 20 bp, Artificial Sequence
  Description of Artificial Sequence: Synthetic oligonucleotide
  Target: SCN10A; (+) strand; PAM type: YTN; PAM sequence: TTT
acattaggtatttctcctaa

SEQ ID NO: 73908 - DNA, 20 bp, Artificial Sequence
  Description of Artificial Sequence: Synthetic oligonucleotide
  Target: SCN10A; (+) strand; PAM type: YTN; PAM sequence: TTA
cattaggtatttctcctaat

SEQ ID NO: 73909 - DNA, 20 bp, Artificial Sequence
  Description of Artificial Sequence: Synthetic oligonucleotide
  Target: SCN10A; (+) strand; PAM type: YTN; PAM sequence: TTA
ggtatttctcctaatgctat

SEQ ID NO: 73910 - DNA, 20 bp, Artificial Sequence
  Description of Artificial Sequence: Synthetic oligonucleotide
  Target: SCN10A; (+) strand; PAM type: YTN; PAM sequence: TTT
ctcctaatgctatccctccc

SEQ ID NO: 73911 - DNA, 20 bp, Artificial Sequence
  Description of Artificial Sequence: Synthetic oligonucleotide
  Target: SCN10A; (+) strand; PAM type: YTN; PAM sequence: TTC
tcctaatgctatccctcccc

SEQ ID NO: 73912 - DNA, 20 bp, Artificial Sequence
  Description of Artificial Sequence: Synthetic oligonucleotide
  Target: SCN10A; (+) strand; PAM type: YTN; PAM sequence: CTC
ctaatgctatccctccccta

SEQ ID NO: 73913 - DNA, 20 bp, Artificial Sequence
  Description of Artificial Sequence: Synthetic oligonucleotide
  Target: SCN10A; (+) strand; PAM type: YTN; PAM sequence: CTA
atgctatccctcccctagcc

SEQ ID NO: 73914 - DNA, 20 bp, Artificial Sequence
  Description of Artificial Sequence: Synthetic oligonucleotide
  Target: SCN10A; (+) strand; PAM type: YTN; PAM sequence: CTA
tccctcccctagccccccac

SEQ ID NO: 73915 - DNA, 20 bp, Artificial Sequence
  Description of Artificial Sequence: Synthetic oligonucleotide
  Target: SCN10A; (+) strand; PAM type: YTN; PAM sequence: CTC
ccctagccccccacccctca

SEQ ID NO: 73916 - DNA, 20 bp, Artificial Sequence
  Description of Artificial Sequence: Synthetic oligonucleotide
  Target: SCN10A; (+) strand; PAM type: YTN; PAM sequence: CTA
gccccccacccctcaacagg

SEQ ID NO: 73917 - DNA, 20 bp, Artificial Sequence
  Description of Artificial Sequence: Synthetic oligonucleotide
  Target: SCN10A; (+) strand; PAM type: YTN; PAM sequence: CTC
aacaggccccagtgtgttcc

SEQ ID NO: 73918 - DNA, 20 bp, Artificial Sequence
  Description of Artificial Sequence: Synthetic oligonucleotide
  Target: SCN10A; (+) strand; PAM type: YTN; PAM sequence: TTC
ccctccctgtgtccatgtgt

SEQ ID NO: 73919 - DNA, 20 bp, Artificial Sequence
  Description of Artificial Sequence: Synthetic oligonucleotide
  Target: SCN10A; (+) strand; PAM type: YTN; PAM sequence: CTC
cctgtgtccatgtgttctca

SEQ ID NO: 73920 - DNA, 20 bp, Artificial Sequence
  Description of Artificial Sequence: Synthetic oligonucleotide
  Target: SCN10A; (+) strand; PAM type: YTN; PAM sequence: CTG
tgtccatgtgttctcattgt

SEQ ID NO: 73921 - DNA, 20 bp, Artificial Sequence
  Description of Artificial Sequence: Synthetic oligonucleotide
  Target: SCN10A; (+) strand; PAM type: YTN; PAM sequence: TTC
tcattgttcaactcccactt

SEQ ID NO: 73922 - DNA, 20 bp, Artificial Sequence
  Description of Artificial Sequence: Synthetic oligonucleotide
  Target: SCN10A; (+) strand; PAM type: YTN; PAM sequence: CTC
attgttcaactcccacttat

SEQ ID NO: 73923 - DNA, 20 bp, Artificial Sequence
  Description of Artificial Sequence: Synthetic oligonucleotide
  Target: SCN10A; (+) strand; PAM type: YTN; PAM sequence: TTG
ttcaactcccacttatgagt

SEQ ID NO: 73924 - DNA, 20 bp, Artificial Sequence
  Description of Artificial Sequence: Synthetic oligonucleotide
  Target: SCN10A; (+) strand; PAM type: YTN; PAM sequence: TTC
aactcccacttatgagtgag

SEQ ID NO: 73925 - DNA, 20 bp, Artificial Sequence
  Description of Artificial Sequence: Synthetic oligonucleotide
  Target: SCN10A; (+) strand; PAM type: YTN; PAM sequence: CTC
ccacttatgagtgagaacat

SEQ ID NO: 73926 - DNA, 20 bp, Artificial Sequence
  Description of Artificial Sequence: Synthetic oligonucleotide
  Target: SCN10A; (+) strand; PAM type: YTN; PAM sequence: CTT
atgagtgagaacatacggtg

SEQ ID NO: 73927 - DNA, 20 bp, Artificial Sequence
  Description of Artificial Sequence: Synthetic oligonucleotide
  Target: SCN10A; (+) strand; PAM type: YTN; PAM sequence: TTA
tgagtgagaacatacggtgt

SEQ ID NO: 73928 - DNA, 20 bp, Artificial Sequence
  Description of Artificial Sequence: Synthetic oligonucleotide
  Target: SCN10A; (+) strand; PAM type: YTN; PAM sequence: TTT
ggttttctgttcttgtgtta

SEQ ID NO: 73929 - DNA, 20 bp, Artificial Sequence
  Description of Artificial Sequence: Synthetic oligonucleotide
  Target: SCN10A; (+) strand; PAM type: YTN; PAM sequence: TTG
gttttctgttcttgtgttag

SEQ ID NO: 73930 - DNA, 20 bp, Artificial Sequence
  Description of Artificial Sequence: Synthetic oligonucleotide
  Target: SCN10A; (+) strand; PAM type: YTN; PAM sequence: TTT
tctgttcttgtgttagtttg

SEQ ID NO: 73931 - DNA, 20 bp, Artificial Sequence
  Description of Artificial Sequence: Synthetic oligonucleotide
  Target: SCN10A; (+) strand; PAM type: YTN; PAM sequence: TTT
ctgttcttgtgttagtttgc

SEQ ID NO: 73932 - DNA, 20 bp, Artificial Sequence
  Description of Artificial Sequence: Synthetic oligonucleotide
  Target: SCN10A; (+) strand; PAM type: YTN; PAM sequence: TTC
tgttcttgtgttagtttgct

SEQ ID NO: 73933 - DNA, 20 bp, Artificial Sequence
  Description of Artificial Sequence: Synthetic oligonucleotide
  Target: SCN10A; (+) strand; PAM type: YTN; PAM sequence: CTG
ttcttgtgttagtttgctga

SEQ ID NO: 73934 - DNA, 20 bp, Artificial Sequence
  Description of Artificial Sequence: Synthetic oligonucleotide
  Target: SCN10A; (+) strand; PAM type: YTN; PAM sequence: TTC
ttgtgttagtttgctgagaa

SEQ ID NO: 73935 - DNA, 20 bp, Artificial Sequence
  Description of Artificial Sequence: Synthetic oligonucleotide
  Target: SCN10A; (+) strand; PAM type: YTN; PAM sequence: CTT
gtgttagtttgctgagaatg

SEQ ID NO: 73936 - DNA, 20 bp, Artificial Sequence
  Description of Artificial Sequence: Synthetic oligonucleotide
  Target: SCN10A; (+) strand; PAM type: YTN; PAM sequence: TTG
tgttagtttgctgagaatga

SEQ ID NO: 73937 - DNA, 20 bp, Artificial Sequence
  Description of Artificial Sequence: Synthetic oligonucleotide
  Target: SCN10A; (+) strand; PAM type: YTN; PAM sequence: TTA
gtttgctgagaatgatggtt

SEQ ID NO: 73938 - DNA, 20 bp, Artificial Sequence
  Description of Artificial Sequence: Synthetic oligonucleotide
  Target: SCN10A; (+) strand; PAM type: YTN; PAM sequence: TTT
gctgagaatgatggtttcca

SEQ ID NO: 73939 - DNA, 20 bp, Artificial Sequence
  Description of Artificial Sequence: Synthetic oligonucleotide
  Target: SCN10A; (+) strand; PAM type: YTN; PAM sequence: TTG
ctgagaatgatggtttccag

SEQ ID NO: 73940 - DNA, 20 bp, Artificial Sequence
  Description of Artificial Sequence: Synthetic oligonucleotide
  Target: SCN10A; (+) strand; PAM type: YTN; PAM sequence: CTG
agaatgatggtttccagctt

SEQ ID NO: 73941 - DNA, 20 bp, Artificial Sequence
  Description of Artificial Sequence: Synthetic oligonucleotide
  Target: SCN10A; (+) strand; PAM type: YTN; PAM sequence: TTT
ccagcttcatccatgtccct

SEQ ID NO: 73942 - DNA, 20 bp, Artificial Sequence
  Description of Artificial Sequence: Synthetic oligonucleotide
  Target: SCN10A; (+) strand; PAM type: YTN; PAM sequence: TTC
cagcttcatccatgtccctg

SEQ ID NO: 73943 - DNA, 20 bp, Artificial Sequence
  Description of Artificial Sequence: Synthetic oligonucleotide
  Target: SCN10A; (+) strand; PAM type: YTN; PAM sequence: CTT
catccatgtccctgcaaagg

SEQ ID NO: 73944 - DNA, 20 bp, Artificial Sequence
  Description of Artificial Sequence: Synthetic oligonucleotide
  Target: SCN10A; (+) strand; PAM type: YTN; PAM sequence: TTC
atccatgtccctgcaaagga

SEQ ID NO: 73945 - DNA, 20 bp, Artificial Sequence
  Description of Artificial Sequence: Synthetic oligonucleotide
  Target: SCN10A; (+) strand; PAM type: YTN; PAM sequence: CTG
caaaggacatgaactcatcc

SEQ ID NO: 73946 - DNA, 20 bp, Artificial Sequence
  Description of Artificial Sequence: Synthetic oligonucleotide
  Target: SCN10A; (+) strand; PAM type: YTN; PAM sequence: CTC
atccttttttatgactgcat

SEQ ID NO: 73947 - DNA, 20 bp, Artificial Sequence
  Description of Artificial Sequence: Synthetic oligonucleotide
  Target: SCN10A; (+) strand; PAM type: YTN; PAM sequence: CTT
ttttatgactgcatagcatt

SEQ ID NO: 73948 - DNA, 20 bp, Artificial Sequence
  Description of Artificial Sequence: Synthetic oligonucleotide
  Target: SCN10A; (+) strand; PAM type: YTN; PAM sequence: TTT
tttatgactgcatagcattc

SEQ ID NO: 73949 - DNA, 20 bp, Artificial Sequence
  Description of Artificial Sequence: Synthetic oligonucleotide
  Target: SCN10A; (+) strand; PAM type: YTN; PAM sequence: TTT
ttatgactgcatagcattcc

SEQ ID NO: 73950 - DNA, 20 bp, Artificial Sequence
  Description of Artificial Sequence: Synthetic oligonucleotide
  Target: SCN10A; (+) strand; PAM type: YTN; PAM sequence: TTT
tatgactgcatagcattcca

SEQ ID NO: 73951 - DNA, 20 bp, Artificial Sequence
  Description of Artificial Sequence: Synthetic oligonucleotide
  Target: SCN10A; (+) strand; PAM type: YTN; PAM sequence: TTT
atgactgcatagcattccat

SEQ ID NO: 73952 - DNA, 20 bp, Artificial Sequence
  Description of Artificial Sequence: Synthetic oligonucleotide
  Target: SCN10A; (+) strand; PAM type: YTN; PAM sequence: TTA
tgactgcatagcattccatg

SEQ ID NO: 73953 - DNA, 20 bp, Artificial Sequence
  Description of Artificial Sequence: Synthetic oligonucleotide
  Target: SCN10A; (+) strand; PAM type: YTN; PAM sequence: CTG
catagcattccatggtgtat

SEQ ID NO: 73954 - DNA, 20 bp, Artificial Sequence
  Description of Artificial Sequence: Synthetic oligonucleotide
  Target: SCN10A; (+) strand; PAM type: YTN; PAM sequence: TTC
catggtgtatatgtgccaca

SEQ ID NO: 73955 - DNA, 20 bp, Artificial Sequence
  Description of Artificial Sequence: Synthetic oligonucleotide
  Target: SCN10A; (+) strand; PAM type: YTN; PAM sequence: TTT
attcccttctatttcaactt

SEQ ID NO: 73956 - DNA, 20 bp, Artificial Sequence
  Description of Artificial Sequence: Synthetic oligonucleotide
  Target: SCN10A; (+) strand; PAM type: YTN; PAM sequence: TTA
ttcccttctatttcaacttt

SEQ ID NO: 73957 - DNA, 20 bp, Artificial Sequence
  Description of Artificial Sequence: Synthetic oligonucleotide
  Target: SCN10A; (+) strand; PAM type: YTN; PAM sequence: TTC
ccttctatttcaacttttct

SEQ ID NO: 73958 - DNA, 20 bp, Artificial Sequence
  Description of Artificial Sequence: Synthetic oligonucleotide
  Target: SCN10A; (+) strand; PAM type: YTN; PAM sequence: CTT
ctatttcaacttttctaaga

SEQ ID NO: 73959 - DNA, 20 bp, Artificial Sequence
  Description of Artificial Sequence: Synthetic oligonucleotide
  Target: SCN10A; (+) strand; PAM type: YTN; PAM sequence: TTC
tatttcaacttttctaagaa

SEQ ID NO: 73960 - DNA, 20 bp, Artificial Sequence
  Description of Artificial Sequence: Synthetic oligonucleotide
  Target: SCN10A; (+) strand; PAM type: YTN; PAM sequence: CTA
tttcaacttttctaagaatt

SEQ ID NO: 73961 - DNA, 20 bp, Artificial Sequence
  Description of Artificial Sequence: Synthetic oligonucleotide
  Target: SCN10A; (+) strand; PAM type: YTN; PAM sequence: TTT
caacttttctaagaatttaa

SEQ ID NO: 73962 - DNA, 20 bp, Artificial Sequence
  Description of Artificial Sequence: Synthetic oligonucleotide
  Target: SCN10A; (+) strand; PAM type: YTN; PAM sequence: TTC
aacttttctaagaatttaaa

SEQ ID NO: 73963 - DNA, 20 bp, Artificial Sequence
  Description of Artificial Sequence: Synthetic oligonucleotide
  Target: SCN10A; (+) strand; PAM type: YTN; PAM sequence: CTT
ttctaagaatttaaaattat

SEQ ID NO: 73964 - DNA, 20 bp, Artificial Sequence
  Description of Artificial Sequence: Synthetic oligonucleotide
  Target: SCN10A; (+) strand; PAM type: YTN; PAM sequence: TTT
tctaagaatttaaaattata

SEQ ID NO: 73965 - DNA, 20 bp, Artificial Sequence
  Description of Artificial Sequence: Synthetic oligonucleotide
  Target: SCN10A; (+) strand; PAM type: YTN; PAM sequence: TTT
ctaagaatttaaaattataa

SEQ ID NO: 73966 - DNA, 20 bp, Artificial Sequence
  Description of Artificial Sequence: Synthetic oligonucleotide
  Target: SCN10A; (+) strand; PAM type: YTN; PAM sequence: TTC
taagaatttaaaattataaa

SEQ ID NO: 73967 - DNA, 20 bp, Artificial Sequence
  Description of Artificial Sequence: Synthetic oligonucleotide
  Target: SCN10A; (+) strand; PAM type: YTN; PAM sequence: CTA
agaatttaaaattataaatg

SEQ ID NO: 73968 - DNA, 20 bp, Artificial Sequence
  Description of Artificial Sequence: Synthetic oligonucleotide
  Target: SCN10A; (+) strand; PAM type: YTN; PAM sequence: TTT
aaaattataaatggaaatta

SEQ ID NO: 73969 - DNA, 20 bp, Artificial Sequence
  Description of Artificial Sequence: Synthetic oligonucleotide
  Target: SCN10A; (+) strand; PAM type: YTN; PAM sequence: TTA
aaattataaatggaaattaa

SEQ ID NO: 73970 - DNA, 20 bp, Artificial Sequence
  Description of Artificial Sequence: Synthetic oligonucleotide
  Target: SCN10A; (+) strand; PAM type: YTN; PAM sequence: TTA
taaatggaaattaaacttta

SEQ ID NO: 73971 - DNA, 20 bp, Artificial Sequence
  Description of Artificial Sequence: Synthetic oligonucleotide
  Target: SCN10A; (+) strand; PAM type: YTN; PAM sequence: TTA
aactttatcaaatgatttta

SEQ ID NO: 73972 - DNA, 20 bp, Artificial Sequence
  Description of Artificial Sequence: Synthetic oligonucleotide
  Target: SCN10A; (+) strand; PAM type: YTN; PAM sequence: CTT
tatcaaatgattttagcatc

SEQ ID NO: 73973 - DNA, 20 bp, Artificial Sequence
  Description of Artificial Sequence: Synthetic oligonucleotide
  Target: SCN10A; (+) strand; PAM type: YTN; PAM sequence: TTT
atcaaatgattttagcatca

SEQ ID NO: 73974 - DNA, 20 bp, Artificial Sequence
  Description of Artificial Sequence: Synthetic oligonucleotide
  Target: SCN10A; (+) strand; PAM type: YTN; PAM sequence: TTA
tcaaatgattttagcatcaa

SEQ ID NO: 73975 - DNA, 20 bp, Artificial Sequence
  Description of Artificial Sequence: Synthetic oligonucleotide
  Target: SCN10A; (+) strand; PAM type: YTN; PAM sequence: TTT
tagcatcaattaagaagact

SEQ ID NO: 73976 - DNA, 20 bp, Artificial Sequence
  Description of Artificial Sequence: Synthetic oligonucleotide
  Target: SCN10A; (+) strand; PAM type: YTN; PAM sequence: TTT
agcatcaattaagaagacta

SEQ ID NO: 73977 - DNA, 20 bp, Artificial Sequence
  Description of Artificial Sequence: Synthetic oligonucleotide
  Target: SCN10A; (+) strand; PAM type: YTN; PAM sequence: TTA
gcatcaattaagaagactat

SEQ ID NO: 73978 - DNA, 20 bp, Artificial Sequence
  Description of Artificial Sequence: Synthetic oligonucleotide
  Target: SCN10A; (+) strand; PAM type: YTN; PAM sequence: TTA
agaagactatgtgatccttt

SEQ ID NO: 73979 - DNA, 20 bp, Artificial Sequence
  Description of Artificial Sequence: Synthetic oligonucleotide
  Target: SCN10A; (+) strand; PAM type: YTN; PAM sequence: CTA
tgtgatccttttcctttaat

SEQ ID NO: 73980 - DNA, 20 bp, Artificial Sequence
  Description of Artificial Sequence: Synthetic oligonucleotide
  Target: SCN10A; (+) strand; PAM type: YTN; PAM sequence: CTT
ttcctttaatctattaataa

SEQ ID NO: 73981 - DNA, 20 bp, Artificial Sequence
  Description of Artificial Sequence: Synthetic oligonucleotide
  Target: SCN10A; (+) strand; PAM type: YTN; PAM sequence: TTT
tcctttaatctattaataaa

SEQ ID NO: 73982 - DNA, 20 bp, Artificial Sequence
  Description of Artificial Sequence: Synthetic oligonucleotide
  Target: SCN10A; (+) strand; PAM type: YTN; PAM sequence: TTT
cctttaatctattaataaaa

SEQ ID NO: 73983 - DNA, 20 bp, Artificial Sequence
  Description of Artificial Sequence: Synthetic oligonucleotide
  Target: SCN10A; (+) strand; PAM type: YTN; PAM sequence: TTC
ctttaatctattaataaaaa

SEQ ID NO: 73984 - DNA, 20 bp, Artificial Sequence
  Description of Artificial Sequence: Synthetic oligonucleotide
  Target: SCN10A; (+) strand; PAM type: YTN; PAM sequence: CTT
taatctattaataaaaatat

SEQ ID NO: 73985 - DNA, 20 bp, Artificial Sequence
  Description of Artificial Sequence: Synthetic oligonucleotide
  Target: SCN10A; (+) strand; PAM type: YTN; PAM sequence: TTT
aatctattaataaaaatata

SEQ ID NO: 73986 - DNA, 20 bp, Artificial Sequence
  Description of Artificial Sequence: Synthetic oligonucleotide
  Target: SCN10A; (+) strand; PAM type: YTN; PAM sequence: TTA
atctattaataaaaatataa

SEQ ID NO: 73987 - DNA, 20 bp, Artificial Sequence
  Description of Artificial Sequence: Synthetic oligonucleotide
  Target: SCN10A; (+) strand; PAM type: YTN; PAM sequence: CTA
ttaataaaaatataacgtat

SEQ ID NO: 73988 - DNA, 20 bp, Artificial Sequence
  Description of Artificial Sequence: Synthetic oligonucleotide
  Target: SCN10A; (+) strand; PAM type: YTN; PAM sequence: TTA
ataaaaatataacgtatttt

SEQ ID NO: 73989 - DNA, 20 bp, Artificial Sequence
  Description of Artificial Sequence: Synthetic oligonucleotide
  Target: SCN10A; (+) strand; PAM type: YTN; PAM sequence: TTT
tctgttgtggcatgcattac

SEQ ID NO: 73990 - DNA, 20 bp, Artificial Sequence
  Description of Artificial Sequence: Synthetic oligonucleotide
  Target: SCN10A; (+) strand; PAM type: YTN; PAM sequence: TTT
ctgttgtggcatgcattact

SEQ ID NO: 73991 - DNA, 20 bp, Artificial Sequence
  Description of Artificial Sequence: Synthetic oligonucleotide
  Target: SCN10A; (+) strand; PAM type: YTN; PAM sequence: TTC
tgttgtggcatgcattactg

SEQ ID NO: 73992 - DNA, 20 bp, Artificial Sequence
  Description of Artificial Sequence: Synthetic oligonucleotide
  Target: SCN10A; (+) strand; PAM type: YTN; PAM sequence: CTG
ttgtggcatgcattactgtt

SEQ ID NO: 73993 - DNA, 20 bp, Artificial Sequence
  Description of Artificial Sequence: Synthetic oligonucleotide
  Target: SCN10A; (+) strand; PAM type: YTN; PAM sequence: TTG
tggcatgcattactgttatg

SEQ ID NO: 73994 - DNA, 20 bp, Artificial Sequence
  Description of Artificial Sequence: Synthetic oligonucleotide
  Target: SCN10A; (+) strand; PAM type: YTN; PAM sequence: TTA
ctgttatgattagcaaaaaa

SEQ ID NO: 73995 - DNA, 20 bp, Artificial Sequence
  Description of Artificial Sequence: Synthetic oligonucleotide
  Target: SCN10A; (+) strand; PAM type: YTN; PAM sequence: CTG
ttatgattagcaaaaaaaaa

SEQ ID NO: 73996 - DNA, 20 bp, Artificial Sequence
  Description of Artificial Sequence: Synthetic oligonucleotide
  Target: SCN10A; (+) strand; PAM type: YTN; PAM sequence: TTA
tgattagcaaaaaaaaaaaa

SEQ ID NO: 73997 - DNA, 20 bp, Artificial Sequence
  Description of Artificial Sequence: Synthetic oligonucleotide
  Target: SCN10A; (+) strand; PAM type: YTN; PAM sequence: TTA
gcaaaaaaaaaaaaaaaaaa

SEQ ID NO: 73998 - DNA, 20 bp, Artificial Sequence
  Description of Artificial Sequence: Synthetic oligonucleotide
  Target: SCN10A; (+) strand; PAM type: YTN; PAM sequence: CTC
tgcaaagcacctgttattat

SEQ ID NO: 73999 - DNA, 20 bp, Artificial Sequence
  Description of Artificial Sequence: Synthetic oligonucleotide
  Target: SCN10A; (+) strand; PAM type: YTN; PAM sequence: CTG
caaagcacctgttattataa

SEQ ID NO: 74000 - DNA, 20 bp, Artificial Sequence
  Description of Artificial Sequence: Synthetic oligonucleotide
  Target: SCN10A; (+) strand; PAM type: YTN; PAM sequence: CTG
ttattataaccaaaggtatg

SEQ ID NO: 74001 - DNA, 20 bp, Artificial Sequence
  Description of Artificial Sequence: Synthetic oligonucleotide
  Target: SCN10A; (+) strand; PAM type: YTN; PAM sequence: TTA
ttataaccaaaggtatgtta

SEQ ID NO: 74002 - DNA, 20 bp, Artificial Sequence
  Description of Artificial Sequence: Synthetic oligonucleotide
  Target: SCN10A; (+) strand; PAM type: YTN; PAM sequence: TTA
taaccaaaggtatgttaggt

SEQ ID NO: 74003 - DNA, 20 bp, Artificial Sequence
  Description of Artificial Sequence: Synthetic oligonucleotide
  Target: SCN10A; (+) strand; PAM type: YTN; PAM sequence: TTA
ggttcaagctggagtggaag

SEQ ID NO: 74004 - DNA, 20 bp, Artificial Sequence
  Description of Artificial Sequence: Synthetic oligonucleotide
  Target: SCN10A; (+) strand; PAM type: YTN; PAM sequence: TTC
aagctggagtggaagcatcc

SEQ ID NO: 74005 - DNA, 20 bp, Artificial Sequence
  Description of Artificial Sequence: Synthetic oligonucleotide
  Target: SCN10A; (+) strand; PAM type: YTN; PAM sequence: CTG
gagtggaagcatccctccca

SEQ ID NO: 74006 - DNA, 20 bp, Artificial Sequence
  Description of Artificial Sequence: Synthetic oligonucleotide
  Target: SCN10A; (+) strand; PAM type: YTN; PAM sequence: CTC
ccagatgtgtggatatggaa

SEQ ID NO: 74007 - DNA, 20 bp, Artificial Sequence
  Description of Artificial Sequence: Synthetic oligonucleotide
  Target: SCN10A; (+) strand; PAM type: YTN; PAM sequence: TTT
ttggaaaactcccagattct

SEQ ID NO: 74008 - DNA, 20 bp, Artificial Sequence
  Description of Artificial Sequence: Synthetic oligonucleotide
  Target: SCN10A; (+) strand; PAM type: YTN; PAM sequence: TTT
tggaaaactcccagattctg

SEQ ID NO: 74009 - DNA, 20 bp, Artificial Sequence
  Description of Artificial Sequence: Synthetic oligonucleotide
  Target: SCN10A; (+) strand; PAM type: YTN; PAM sequence: TTT
ggaaaactcccagattctga

SEQ ID NO: 74010 - DNA, 20 bp, Artificial Sequence
  Description of Artificial Sequence: Synthetic oligonucleotide
  Target: SCN10A; (+) strand; PAM type: YTN; PAM sequence: TTG
gaaaactcccagattctgaa

SEQ ID NO: 74011 - DNA, 20 bp, Artificial Sequence
  Description of Artificial Sequence: Synthetic oligonucleotide
  Target: SCN10A; (+) strand; PAM type: YTN; PAM sequence: CTC
ccagattctgaaactatagg

SEQ ID NO: 74012 - DNA, 20 bp, Artificial Sequence
  Description of Artificial Sequence: Synthetic oligonucleotide
  Target: SCN10A; (+) strand; PAM type: YTN; PAM sequence: TTC
tgaaactataggggtttcac

SEQ ID NO: 74013 - DNA, 20 bp, Artificial Sequence
  Description of Artificial Sequence: Synthetic oligonucleotide
  Target: SCN10A; (+) strand; PAM type: YTN; PAM sequence: CTG
aaactataggggtttcaccc

SEQ ID NO: 74014 - DNA, 20 bp, Artificial Sequence
  Description of Artificial Sequence: Synthetic oligonucleotide
  Target: SCN10A; (+) strand; PAM type: YTN; PAM sequence: CTA
taggggtttcacccactaac

SEQ ID NO: 74015 - DNA, 20 bp, Artificial Sequence
  Description of Artificial Sequence: Synthetic oligonucleotide
  Target: SCN10A; (+) strand; PAM type: YTN; PAM sequence: TTT
cacccactaacctagggaaa

SEQ ID NO: 74016 - DNA, 20 bp, Artificial Sequence
  Description of Artificial Sequence: Synthetic oligonucleotide
  Target: SCN10A; (+) strand; PAM type: YTN; PAM sequence: TTC
acccactaacctagggaaat

SEQ ID NO: 74017 - DNA, 20 bp, Artificial Sequence
  Description of Artificial Sequence: Synthetic oligonucleotide
  Target: SCN10A; (+) strand; PAM type: YTN; PAM sequence: CTA
acctagggaaatagaataac

SEQ ID NO: 74018 - DNA, 20 bp, Artificial Sequence
  Description of Artificial Sequence: Synthetic oligonucleotide
  Target: SCN10A; (+) strand; PAM type: YTN; PAM sequence: CTA
gggaaatagaataacttcag

SEQ ID NO: 74019 - DNA, 20 bp, Artificial Sequence
  Description of Artificial Sequence: Synthetic oligonucleotide
  Target: SCN10A; (+) strand; PAM type: YTN; PAM sequence: CTT
caggaatactaaggttactt

SEQ ID NO: 74020 - DNA, 20 bp, Artificial Sequence
  Description of Artificial Sequence: Synthetic oligonucleotide
  Target: SCN10A; (+) strand; PAM type: YTN; PAM sequence: TTC
aggaatactaaggttacttt

SEQ ID NO: 74021 - DNA, 20 bp, Artificial Sequence
  Description of Artificial Sequence: Synthetic oligonucleotide
  Target: SCN10A; (+) strand; PAM type: YTN; PAM sequence: CTA
aggttactttgaggcatatg

SEQ ID NO: 74022 - DNA, 20 bp, Artificial Sequence
  Description of Artificial Sequence: Synthetic oligonucleotide
  Target: SCN10A; (+) strand; PAM type: YTN; PAM sequence: TTA
ctttgaggcatatgaagcat

SEQ ID NO: 74023 - DNA, 20 bp, Artificial Sequence
  Description of Artificial Sequence: Synthetic oligonucleotide
  Target: SCN10A; (+) strand; PAM type: YTN; PAM sequence: CTT
tgaggcatatgaagcatgat

SEQ ID NO: 74024 - DNA, 20 bp, Artificial Sequence
  Description of Artificial Sequence: Synthetic oligonucleotide
  Target: SCN10A; (+) strand; PAM type: YTN; PAM sequence: TTT
gaggcatatgaagcatgata

SEQ ID NO: 74025 - DNA, 20 bp, Artificial Sequence
  Description of Artificial Sequence: Synthetic oligonucleotide
  Target: SCN10A; (+) strand; PAM type: YTN; PAM sequence: TTG
aggcatatgaagcatgataa

SEQ ID NO: 74026 - DNA, 20 bp, Artificial Sequence
  Description of Artificial Sequence: Synthetic oligonucleotide
  Target: SCN10A; (+) strand; PAM type: YTN; PAM sequence: CTT
aaacagcttcatttatgagt

SEQ ID NO: 74027 - DNA, 20 bp, Artificial Sequence
  Description of Artificial Sequence: Synthetic oligonucleotide
  Target: SCN10A; (+) strand; PAM type: YTN; PAM sequence: TTA
aacagcttcatttatgagtt

SEQ ID NO: 74028 - DNA, 20 bp, Artificial Sequence
  Description of Artificial Sequence: Synthetic oligonucleotide
  Target: SCN10A; (+) strand; PAM type: YTN; PAM sequence: CTT
catttatgagttattttcta

SEQ ID NO: 74029 - DNA, 20 bp, Artificial Sequence
  Description of Artificial Sequence: Synthetic oligonucleotide
  Target: SCN10A; (+) strand; PAM type: YTN; PAM sequence: TTC
atttatgagttattttctaa

SEQ ID NO: 74030 - DNA, 20 bp, Artificial Sequence
  Description of Artificial Sequence: Synthetic oligonucleotide
  Target: SCN10A; (+) strand; PAM type: YTN; PAM sequence: TTT
atgagttattttctaaatat

SEQ ID NO: 74031 - DNA, 20 bp, Artificial Sequence
  Description of Artificial Sequence: Synthetic oligonucleotide
  Target: SCN10A; (+) strand; PAM type: YTN; PAM sequence: TTA
tgagttattttctaaatata

SEQ ID NO: 74032 - DNA, 20 bp, Artificial Sequence
  Description of Artificial Sequence: Synthetic oligonucleotide
  Target: SCN10A; (+) strand; PAM type: YTN; PAM sequence: TTA
ttttctaaatatactccaga

SEQ ID NO: 74033 - DNA, 20 bp, Artificial Sequence
  Description of Artificial Sequence: Synthetic oligonucleotide
  Target: SCN10A; (+) strand; PAM type: YTN; PAM sequence: TTT
tctaaatatactccagagcc

SEQ ID NO: 74034 - DNA, 20 bp, Artificial Sequence
  Description of Artificial Sequence: Synthetic oligonucleotide
  Target: SCN10A; (+) strand; PAM type: YTN; PAM sequence: TTT
ctaaatatactccagagcca

SEQ ID NO: 74035 - DNA, 20 bp, Artificial Sequence
  Description of Artificial Sequence: Synthetic oligonucleotide
  Target: SCN10A; (+) strand; PAM type: YTN; PAM sequence: TTC
taaatatactccagagccat

SEQ ID NO: 74036 - DNA, 20 bp, Artificial Sequence
  Description of Artificial Sequence: Synthetic oligonucleotide
  Target: SCN10A; (+) strand; PAM type: YTN; PAM sequence: CTA
aatatactccagagccattt

SEQ ID NO: 74037 - DNA, 20 bp, Artificial Sequence
  Description of Artificial Sequence: Synthetic oligonucleotide
  Target: SCN10A; (+) strand; PAM type: YTN; PAM sequence: CTC
cagagccatttgttcttagt

SEQ ID NO: 74038 - DNA, 20 bp, Artificial Sequence
  Description of Artificial Sequence: Synthetic oligonucleotide
  Target: SCN10A; (+) strand; PAM type: YTN; PAM sequence: TTT
gttcttagttctgtctcagt

SEQ ID NO: 74039 - DNA, 20 bp, Artificial Sequence
  Description of Artificial Sequence: Synthetic oligonucleotide
  Target: SCN10A; (+) strand; PAM type: YTN; PAM sequence: TTG
ttcttagttctgtctcagtt

SEQ ID NO: 74040 - DNA, 20 bp, Artificial Sequence
  Description of Artificial Sequence: Synthetic oligonucleotide
  Target: SCN10A; (+) strand; PAM type: YTN; PAM sequence: TTC
ttagttctgtctcagttttg

SEQ ID NO: 74041 - DNA, 20 bp, Artificial Sequence
  Description of Artificial Sequence: Synthetic oligonucleotide
  Target: SCN10A; (+) strand; PAM type: YTN; PAM sequence: CTT
agttctgtctcagttttgct

SEQ ID NO: 74042 - DNA, 20 bp, Artificial Sequence
  Description of Artificial Sequence: Synthetic oligonucleotide
  Target: SCN10A; (+) strand; PAM type: YTN; PAM sequence: TTA
gttctgtctcagttttgctc

SEQ ID NO: 74043 - DNA, 20 bp, Artificial Sequence
  Description of Artificial Sequence: Synthetic oligonucleotide
  Target: SCN10A; (+) strand; PAM type: YTN; PAM sequence: TTC
tgtctcagttttgctcctgt

SEQ ID NO: 74044 - DNA, 20 bp, Artificial Sequence
  Description of Artificial Sequence: Synthetic oligonucleotide
  Target: SCN10A; (+) strand; PAM type: YTN; PAM sequence: CTG
tctcagttttgctcctgtct

SEQ ID NO: 74045 - DNA, 20 bp, Artificial Sequence
  Description of Artificial Sequence: Synthetic oligonucleotide
  Target: SCN10A; (+) strand; PAM type: YTN; PAM sequence: CTC
agttttgctcctgtctctct

SEQ ID NO: 74046 - DNA, 20 bp, Artificial Sequence
  Description of Artificial Sequence: Synthetic oligonucleotide
  Target: SCN10A; (+) strand; PAM type: YTN; PAM sequence: TTT
tgctcctgtctctctttcat

SEQ ID NO: 74047 - DNA, 20 bp, Artificial Sequence
  Description of Artificial Sequence: Synthetic oligonucleotide
  Target: SCN10A; (+) strand; PAM type: YTN; PAM sequence: TTT
gctcctgtctctctttcata

SEQ ID NO: 74048 - DNA, 20 bp, Artificial Sequence
  Description of Artificial Sequence: Synthetic oligonucleotide
  Target: SCN10A; (+) strand; PAM type: YTN; PAM sequence: TTG
ctcctgtctctctttcatag

SEQ ID NO: 74049 - DNA, 20 bp, Artificial Sequence
  Description of Artificial Sequence: Synthetic oligonucleotide
  Target: SCN10A; (+) strand; PAM type: YTN; PAM sequence: CTC
ctgtctctctttcatagcag

SEQ ID NO: 74050 - DNA, 20 bp, Artificial Sequence
  Description of Artificial Sequence: Synthetic oligonucleotide
  Target: SCN10A; (+) strand; PAM type: YTN; PAM sequence: CTG
tctctctttcatagcaggcc

SEQ ID NO: 74051 - DNA, 20 bp, Artificial Sequence
  Description of Artificial Sequence: Synthetic oligonucleotide
  Target: SCN10A; (+) strand; PAM type: YTN; PAM sequence: CTC
tctttcatagcaggccttct

SEQ ID NO: 74052 - DNA, 20 bp, Artificial Sequence
  Description of Artificial Sequence: Synthetic oligonucleotide
  Target: SCN10A; (+) strand; PAM type: YTN; PAM sequence: CTC
tttcatagcaggccttctca

SEQ ID NO: 74053 - DNA, 20 bp, Artificial Sequence
  Description of Artificial Sequence: Synthetic oligonucleotide
  Target: SCN10A; (+) strand; PAM type: YTN; PAM sequence: CTT
tcatagcaggccttctcaaa

SEQ ID NO: 74054 - DNA, 20 bp, Artificial Sequence
  Description of Artificial Sequence: Synthetic oligonucleotide
  Target: SCN10A; (+) strand; PAM type: YTN; PAM sequence: TTT
catagcaggccttctcaaaa

SEQ ID NO: 74055 - DNA, 20 bp, Artificial Sequence
  Description of Artificial Sequence: Synthetic oligonucleotide
  Target: SCN10A; (+) strand; PAM type: YTN; PAM sequence: TTC
atagcaggccttctcaaaag

SEQ ID NO: 74056 - DNA, 20 bp, Artificial Sequence
  Description of Artificial Sequence: Synthetic oligonucleotide
  Target: SCN10A; (+) strand; PAM type: YTN; PAM sequence: CTT
ctcaaaagcataccttctct

SEQ ID NO: 74057 - DNA, 20 bp, Artificial Sequence
  Description of Artificial Sequence: Synthetic oligonucleotide
  Target: SCN10A; (+) strand; PAM type: YTN; PAM sequence: TTC
tcaaaagcataccttctcta

SEQ ID NO: 74058 - DNA, 20 bp, Artificial Sequence
  Description of Artificial Sequence: Synthetic oligonucleotide
  Target: SCN10A; (+) strand; PAM type: YTN; PAM sequence: CTC
aaaagcataccttctctaag

SEQ ID NO: 74059 - DNA, 20 bp, Artificial Sequence
  Description of Artificial Sequence: Synthetic oligonucleotide
  Target: SCN10A; (+) strand; PAM type: YTN; PAM sequence: CTT
ctctaaggcatacatttgtg

SEQ ID NO: 74060 - DNA, 20 bp, Artificial Sequence
  Description of Artificial Sequence: Synthetic oligonucleotide
  Target: SCN10A; (+) strand; PAM type: YTN; PAM sequence: TTC
tctaaggcatacatttgtgt

SEQ ID NO: 74061 - DNA, 20 bp, Artificial Sequence
  Description of Artificial Sequence: Synthetic oligonucleotide
  Target: SCN10A; (+) strand; PAM type: YTN; PAM sequence: CTC
taaggcatacatttgtgtgt

SEQ ID NO: 74062 - DNA, 20 bp, Artificial Sequence
  Description of Artificial Sequence: Synthetic oligonucleotide
  Target: SCN10A; (+) strand; PAM type: YTN; PAM sequence: CTA
aggcatacatttgtgtgtgc

SEQ ID NO: 74063 - DNA, 20 bp, Artificial Sequence
  Description of Artificial Sequence: Synthetic oligonucleotide
  Target: SCN10A; (+) strand; PAM type: YTN; PAM sequence: TTT
gtgtgtgcatctagcaggtg

SEQ ID NO: 74064 - DNA, 20 bp, Artificial Sequence
  Description of Artificial Sequence: Synthetic oligonucleotide
  Target: SCN10A; (+) strand; PAM type: YTN; PAM sequence: TTG
tgtgtgcatctagcaggtga

SEQ ID NO: 74065 - DNA, 20 bp, Artificial Sequence
  Description of Artificial Sequence: Synthetic oligonucleotide
  Target: SCN10A; (+) strand; PAM type: YTN; PAM sequence: CTA
gcaggtgagtgagtgtgtgt

SEQ ID NO: 74066 - DNA, 20 bp, Artificial Sequence
  Description of Artificial Sequence: Synthetic oligonucleotide
  Target: SCN10A; (+) strand; PAM type: YTN; PAM sequence: TTG
ggggggggtgggggcgagga

SEQ ID NO: 74067 - DNA, 20 bp, Artificial Sequence
  Description of Artificial Sequence: Synthetic oligonucleotide
  Target: SCN10A; (+) strand; PAM type: YTN; PAM sequence: CTC
atcttcccaggccaccttag

SEQ ID NO: 74068 - DNA, 20 bp, Artificial Sequence
  Description of Artificial Sequence: Synthetic oligonucleotide
  Target: SCN10A; (+) strand; PAM type: YTN; PAM sequence: CTT
cccaggccaccttagacttt

SEQ ID NO: 74069 - DNA, 20 bp, Artificial Sequence
  Description of Artificial Sequence: Synthetic oligonucleotide
  Target: SCN10A; (+) strand; PAM type: YTN; PAM sequence: TTC
ccaggccaccttagactttc

SEQ ID NO: 74070 - DNA, 20 bp, Artificial Sequence
  Description of Artificial Sequence: Synthetic oligonucleotide
  Target: SCN10A; (+) strand; PAM type: YTN; PAM sequence: CTT
agactttctggggctgggac

SEQ ID NO: 74071 - DNA, 20 bp, Artificial Sequence
  Description of Artificial Sequence: Synthetic oligonucleotide
  Target: SCN10A; (+) strand; PAM type: YTN; PAM sequence: TTA
gactttctggggctgggact

SEQ ID NO: 74072 - DNA, 20 bp, Artificial Sequence
  Description of Artificial Sequence: Synthetic oligonucleotide
  Target: SCN10A; (+) strand; PAM type: YTN; PAM sequence: CTT
tctggggctgggactcaggc

SEQ ID NO: 74073 - DNA, 20 bp, Artificial Sequence
  Description of Artificial Sequence: Synthetic oligonucleotide
  Target: SCN10A; (+) strand; PAM type: YTN; PAM sequence: TTT
ctggggctgggactcaggca

SEQ ID NO: 74074 - DNA, 20 bp, Artificial Sequence
  Description of Artificial Sequence: Synthetic oligonucleotide
  Target: SCN10A; (+) strand; PAM type: YTN; PAM sequence: TTC
tggggctgggactcaggcat

SEQ ID NO: 74075 - DNA, 20 bp, Artificial Sequence
  Description of Artificial Sequence: Synthetic oligonucleotide
  Target: SCN10A; (+) strand; PAM type: YTN; PAM sequence: CTG
gggctgggactcaggcattt

SEQ ID NO: 74076 - DNA, 20 bp, Artificial Sequence
  Description of Artificial Sequence: Synthetic oligonucleotide
  Target: SCN10A; (+) strand; PAM type: YTN; PAM sequence: CTG
ggactcaggcatttaaaaaa

SEQ ID NO: 74077 - DNA, 20 bp, Artificial Sequence
  Description of Artificial Sequence: Synthetic oligonucleotide
  Target: SCN10A; (+) strand; PAM type: YTN; PAM sequence: CTC
aggcatttaaaaaatctccc

SEQ ID NO: 74078 - DNA, 20 bp, Artificial Sequence
  Description of Artificial Sequence: Synthetic oligonucleotide
  Target: SCN10A; (+) strand; PAM type: YTN; PAM sequence: TTT
aaaaaatctccccaaaaatt

SEQ ID NO: 74079 - DNA, 20 bp, Artificial Sequence
  Description of Artificial Sequence: Synthetic oligonucleotide
  Target: SCN10A; (+) strand; PAM type: YTN; PAM sequence: TTA
aaaaatctccccaaaaattg

SEQ ID NO: 74080 - DNA, 20 bp, Artificial Sequence
  Description of Artificial Sequence: Synthetic oligonucleotide
  Target: SCN10A; (+) strand; PAM type: YTN; PAM sequence: CTC
cccaaaaattgcaatatgca

SEQ ID NO: 74081 - DNA, 20 bp, Artificial Sequence
  Description of Artificial Sequence: Synthetic oligonucleotide
  Target: SCN10A; (+) strand; PAM type: YTN; PAM sequence: TTG
caatatgcagccaaagttga

SEQ ID NO: 74082 - DNA, 20 bp, Artificial Sequence
  Description of Artificial Sequence: Synthetic oligonucleotide
  Target: SCN10A; (+) strand; PAM type: YTN; PAM sequence: TTG
agaaccactaatctgtatct

SEQ ID NO: 74083 - DNA, 20 bp, Artificial Sequence
  Description of Artificial Sequence: Synthetic oligonucleotide
  Target: SCN10A; (+) strand; PAM type: YTN; PAM sequence: CTA
atctgtatctctttgaaact

SEQ ID NO: 74084 - DNA, 20 bp, Artificial Sequence
  Description of Artificial Sequence: Synthetic oligonucleotide
  Target: SCN10A; (+) strand; PAM type: YTN; PAM sequence: CTG
tatctctttgaaactgaaaa

SEQ ID NO: 74085 - DNA, 20 bp, Artificial Sequence
  Description of Artificial Sequence: Synthetic oligonucleotide
  Target: SCN10A; (+) strand; PAM type: YTN; PAM sequence: CTC
tttgaaactgaaaatcatgt

SEQ ID NO: 74086 - DNA, 20 bp, Artificial Sequence
  Description of Artificial Sequence: Synthetic oligonucleotide
  Target: SCN10A; (+) strand; PAM type: YTN; PAM sequence: CTT
tgaaactgaaaatcatgtat

SEQ ID NO: 74087 - DNA, 20 bp, Artificial Sequence
  Description of Artificial Sequence: Synthetic oligonucleotide
  Target: SCN10A; (+) strand; PAM type: YTN; PAM sequence: TTT
gaaactgaaaatcatgtatg

SEQ ID NO: 74088 - DNA, 20 bp, Artificial Sequence
  Description of Artificial Sequence: Synthetic oligonucleotide
  Target: SCN10A; (+) strand; PAM type: YTN; PAM sequence: TTG
aaactgaaaatcatgtatgt

SEQ ID NO: 74089 - DNA, 20 bp, Artificial Sequence
  Description of Artificial Sequence: Synthetic oligonucleotide
  Target: SCN10A; (+) strand; PAM type: YTN; PAM sequence: CTG
aaaatcatgtatgtttatga

SEQ ID NO: 74090 - DNA, 20 bp, Artificial Sequence
  Description of Artificial Sequence: Synthetic oligonucleotide
  Target: SCN10A; (+) strand; PAM type: YTN; PAM sequence: TTT
atgaaacaaatctcacagaa

SEQ ID NO: 74091 - DNA, 20 bp, Artificial Sequence
  Description of Artificial Sequence: Synthetic oligonucleotide
  Target: SCN10A; (+) strand; PAM type: YTN; PAM sequence: TTA
tgaaacaaatctcacagaag

SEQ ID NO: 74092 - DNA, 20 bp, Artificial Sequence
  Description of Artificial Sequence: Synthetic oligonucleotide
  Target: SCN10A; (+) strand; PAM type: YTN; PAM sequence: CTC
acagaaggagagacctggtt

SEQ ID NO: 74093 - DNA, 20 bp, Artificial Sequence
  Description of Artificial Sequence: Synthetic oligonucleotide
  Target: SCN10A; (+) strand; PAM type: YTN; PAM sequence: CTG
gttattacaaagacatatag

SEQ ID NO: 74094 - DNA, 20 bp, Artificial Sequence
  Description of Artificial Sequence: Synthetic oligonucleotide
  Target: SCN10A; (+) strand; PAM type: YTN; PAM sequence: TTA
ttacaaagacatatagacaa

SEQ ID NO: 74095 - DNA, 20 bp, Artificial Sequence
  Description of Artificial Sequence: Synthetic oligonucleotide
  Target: SCN10A; (+) strand; PAM type: YTN; PAM sequence: TTA
caaagacatatagacaatga

SEQ ID NO: 74096 - DNA, 20 bp, Artificial Sequence
  Description of Artificial Sequence: Synthetic oligonucleotide
  Target: SCN10A; (+) strand; PAM type: YTN; PAM sequence: TTC
agcattacccacatgaggca

SEQ ID NO: 74097 - DNA, 20 bp, Artificial Sequence
  Description of Artificial Sequence: Synthetic oligonucleotide
  Target: SCN10A; (+) strand; PAM type: YTN; PAM sequence: TTA
cccacatgaggcatggcagg

SEQ ID NO: 74098 - DNA, 20 bp, Artificial Sequence
  Description of Artificial Sequence: Synthetic oligonucleotide
  Target: SCN10A; (+) strand; PAM type: YTN; PAM sequence: CTG
ccaagtgaaggaagaaaaga

SEQ ID NO: 74099 - DNA, 20 bp, Artificial Sequence
  Description of Artificial Sequence: Synthetic oligonucleotide
  Target: SCN10A; (+) strand; PAM type: YTN; PAM sequence: CTA
ctcactcaattttctctgga

SEQ ID NO: 74100 - DNA, 20 bp, Artificial Sequence
  Description of Artificial Sequence: Synthetic oligonucleotide
  Target: SCN10A; (+) strand; PAM type: YTN; PAM sequence: CTC
actcaattttctctggaagg

SEQ ID NO: 74101 - DNA, 20 bp, Artificial Sequence
  Description of Artificial Sequence: Synthetic oligonucleotide
  Target: SCN10A; (+) strand; PAM type: YTN; PAM sequence: CTC
aattttctctggaaggtcag

SEQ ID NO: 74102 - DNA, 20 bp, Artificial Sequence
  Description of Artificial Sequence: Synthetic oligonucleotide
  Target: SCN10A; (+) strand; PAM type: YTN; PAM sequence: TTT
tctctggaaggtcagttcgg

SEQ ID NO: 74103 - DNA, 20 bp, Artificial Sequence
  Description of Artificial Sequence: Synthetic oligonucleotide
  Target: SCN10A; (+) strand; PAM type: YTN; PAM sequence: TTT
ctctggaaggtcagttcggg

SEQ ID NO: 74104 - DNA, 20 bp, Artificial Sequence
  Description of Artificial Sequence: Synthetic oligonucleotide
  Target: SCN10A; (+) strand; PAM type: YTN; PAM sequence: TTC
tctggaaggtcagttcgggt

SEQ ID NO: 74105 - DNA, 20 bp, Artificial Sequence
  Description of Artificial Sequence: Synthetic oligonucleotide
  Target: SCN10A; (+) strand; PAM type: YTN; PAM sequence: CTC
tggaaggtcagttcgggtca

SEQ ID NO: 74106 - DNA, 20 bp, Artificial Sequence
  Description of Artificial Sequence: Synthetic oligonucleotide
  Target: SCN10A; (+) strand; PAM type: YTN; PAM sequence: CTG
gaaggtcagttcgggtcatg

SEQ ID NO: 74107 - DNA, 20 bp, Artificial Sequence
  Description of Artificial Sequence: Synthetic oligonucleotide
  Target: SCN10A; (+) strand; PAM type: YTN; PAM sequence: TTC
gggtcatgcacacacaatta

SEQ ID NO: 74108 - DNA, 20 bp, Artificial Sequence
  Description of Artificial Sequence: Synthetic oligonucleotide
  Target: SCN10A; (+) strand; PAM type: YTN; PAM sequence: TTA
accaaaatagtgaccgtaat

SEQ ID NO: 74109 - DNA, 20 bp, Artificial Sequence
  Description of Artificial Sequence: Synthetic oligonucleotide
  Target: SCN10A; (+) strand; PAM type: YTN; PAM sequence: CTG
aaccacctgaaaggcctgtg

SEQ ID NO: 74110 - DNA, 20 bp, Artificial Sequence
  Description of Artificial Sequence: Synthetic oligonucleotide
  Target: SCN10A; (+) strand; PAM type: YTN; PAM sequence: CTG
aaaggcctgtgttaaggaaa

SEQ ID NO: 74111 - DNA, 20 bp, Artificial Sequence
  Description of Artificial Sequence: Synthetic oligonucleotide
  Target: SCN10A; (+) strand; PAM type: YTN; PAM sequence: CTG
tgttaaggaaaagctgagat

SEQ ID NO: 74112 - DNA, 20 bp, Artificial Sequence
  Description of Artificial Sequence: Synthetic oligonucleotide
  Target: SCN10A; (+) strand; PAM type: YTN; PAM sequence: TTA
aggaaaagctgagatcacca

SEQ ID NO: 74113 - DNA, 20 bp, Artificial Sequence
  Description of Artificial Sequence: Synthetic oligonucleotide
  Target: SCN10A; (+) strand; PAM type: YTN; PAM sequence: CTG
agatcaccaagtctctgtga

SEQ ID NO: 74114 - DNA, 20 bp, Artificial Sequence
  Description of Artificial Sequence: Synthetic oligonucleotide
  Target: SCN10A; (+) strand; PAM type: YTN; PAM sequence: CTC
tgtgatgtcatctaggatca

SEQ ID NO: 74115 - DNA, 20 bp, Artificial Sequence
  Description of Artificial Sequence: Synthetic oligonucleotide
  Target: SCN10A; (+) strand; PAM type: YTN; PAM sequence: CTG
tgatgtcatctaggatcacc

SEQ ID NO: 74116 - DNA, 20 bp, Artificial Sequence
  Description of Artificial Sequence: Synthetic oligonucleotide
  Target: SCN10A; (+) strand; PAM type: YTN; PAM sequence: CTA
ggatcaccttgatgctgaat

SEQ ID NO: 74117 - DNA, 20 bp, Artificial Sequence
  Description of Artificial Sequence: Synthetic oligonucleotide
  Target: SCN10A; (+) strand; PAM type: YTN; PAM sequence: CTT
gatgctgaatgattacattc

SEQ ID NO: 74118 - DNA, 20 bp, Artificial Sequence
  Description of Artificial Sequence: Synthetic oligonucleotide
  Target: SCN10A; (+) strand; PAM type: YTN; PAM sequence: TTG
atgctgaatgattacattca

SEQ ID NO: 74119 - DNA, 20 bp, Artificial Sequence
  Description of Artificial Sequence: Synthetic oligonucleotide
  Target: SCN10A; (+) strand; PAM type: YTN; PAM sequence: CTG
aatgattacattcataaatc

SEQ ID NO: 74120 - DNA, 20 bp, Artificial Sequence
  Description of Artificial Sequence: Synthetic oligonucleotide
  Target: SCN10A; (+) strand; PAM type: YTN; PAM sequence: TTA
cattcataaatcttagccaa

SEQ ID NO: 74121 - DNA, 20 bp, Artificial Sequence
  Description of Artificial Sequence: Synthetic oligonucleotide
  Target: SCN10A; (+) strand; PAM type: YTN; PAM sequence: TTC
ataaatcttagccaatatta

SEQ ID NO: 74122 - DNA, 20 bp, Artificial Sequence
  Description of Artificial Sequence: Synthetic oligonucleotide
  Target: SCN10A; (+) strand; PAM type: YTN; PAM sequence: CTT
agccaatattagctttatga

SEQ ID NO: 74123 - DNA, 20 bp, Artificial Sequence
  Description of Artificial Sequence: Synthetic oligonucleotide
  Target: SCN10A; (+) strand; PAM type: YTN; PAM sequence: TTA
gccaatattagctttatgat

SEQ ID NO: 74124 - DNA, 20 bp, Artificial Sequence
  Description of Artificial Sequence: Synthetic oligonucleotide
  Target: SCN10A; (+) strand; PAM type: YTN; PAM sequence: TTA
gctttatgatcttgtcacat

SEQ ID NO: 74125 - DNA, 20 bp, Artificial Sequence
  Description of Artificial Sequence: Synthetic oligonucleotide
  Target: SCN10A; (+) strand; PAM type: YTN; PAM sequence: CTT
tatgatcttgtcacataata

SEQ ID NO: 74126 - DNA, 20 bp, Artificial Sequence
  Description of Artificial Sequence: Synthetic oligonucleotide
  Target: SCN10A; (+) strand; PAM type: YTN; PAM sequence: TTT
atgatcttgtcacataataa

SEQ ID NO: 74127 - DNA, 20 bp, Artificial Sequence
  Description of Artificial Sequence: Synthetic oligonucleotide
  Target: SCN10A; (+) strand; PAM type: YTN; PAM sequence: TTA
tgatcttgtcacataataac

SEQ ID NO: 74128 - DNA, 20 bp, Artificial Sequence
  Description of Artificial Sequence: Synthetic oligonucleotide
  Target: SCN10A; (+) strand; PAM type: YTN; PAM sequence: CTT
gtcacataataaccactaac

SEQ ID NO: 74129 - DNA, 20 bp, Artificial Sequence
  Description of Artificial Sequence: Synthetic oligonucleotide
  Target: SCN10A; (+) strand; PAM type: YTN; PAM sequence: TTG
tcacataataaccactaaca

SEQ ID NO: 74130 - DNA, 20 bp, Artificial Sequence
  Description of Artificial Sequence: Synthetic oligonucleotide
  Target: SCN10A; (+) strand; PAM type: YTN; PAM sequence: CTA
acatttactgagtgcctaag

SEQ ID NO: 74131 - DNA, 20 bp, Artificial Sequence
  Description of Artificial Sequence: Synthetic oligonucleotide
  Target: SCN10A; (+) strand; PAM type: YTN; PAM sequence: TTT
actgagtgcctaagctaggc

SEQ ID NO: 74132 - DNA, 20 bp, Artificial Sequence
  Description of Artificial Sequence: Synthetic oligonucleotide
  Target: SCN10A; (+) strand; PAM type: YTN; PAM sequence: TTA
ctgagtgcctaagctaggct

SEQ ID NO: 74133 - DNA, 20 bp, Artificial Sequence
  Description of Artificial Sequence: Synthetic oligonucleotide
  Target: SCN10A; (+) strand; PAM type: YTN; PAM sequence: CTG
agtgcctaagctaggctgag

SEQ ID NO: 74134 - DNA, 20 bp, Artificial Sequence
  Description of Artificial Sequence: Synthetic oligonucleotide
  Target: SCN10A; (+) strand; PAM type: YTN; PAM sequence: CTA
agctaggctgagtactttgt

SEQ ID NO: 74135 - DNA, 20 bp, Artificial Sequence
  Description of Artificial Sequence: Synthetic oligonucleotide
  Target: SCN10A; (+) strand; PAM type: YTN; PAM sequence: CTA
ggctgagtactttgtccatg

SEQ ID NO: 74136 - DNA, 20 bp, Artificial Sequence
  Description of Artificial Sequence: Synthetic oligonucleotide
  Target: SCN10A; (+) strand; PAM type: YTN; PAM sequence: CTG
agtactttgtccatgttact

SEQ ID NO: 74137 - DNA, 20 bp, Artificial Sequence
  Description of Artificial Sequence: Synthetic oligonucleotide
  Target: SCN10A; (+) strand; PAM type: YTN; PAM sequence: CTT
tgtccatgttacttctaata

SEQ ID NO: 74138 - DNA, 20 bp, Artificial Sequence
  Description of Artificial Sequence: Synthetic oligonucleotide
  Target: SCN10A; (+) strand; PAM type: YTN; PAM sequence: TTT
gtccatgttacttctaatac

SEQ ID NO: 74139 - DNA, 20 bp, Artificial Sequence
  Description of Artificial Sequence: Synthetic oligonucleotide
  Target: SCN10A; (+) strand; PAM type: YTN; PAM sequence: TTG
tccatgttacttctaataca

SEQ ID NO: 74140 - DNA, 20 bp, Artificial Sequence
  Description of Artificial Sequence: Synthetic oligonucleotide
  Target: SCN10A; (+) strand; PAM type: YTN; PAM sequence: TTA
cttctaatacaactgatcta

SEQ ID NO: 74141 - DNA, 20 bp, Artificial Sequence
  Description of Artificial Sequence: Synthetic oligonucleotide
  Target: SCN10A; (+) strand; PAM type: YTN; PAM sequence: CTT
ctaatacaactgatctacag

SEQ ID NO: 74142 - DNA, 20 bp, Artificial Sequence
  Description of Artificial Sequence: Synthetic oligonucleotide
  Target: SCN10A; (+) strand; PAM type: YTN; PAM sequence: TTC
taatacaactgatctacagg

SEQ ID NO: 74143 - DNA, 20 bp, Artificial Sequence
  Description of Artificial Sequence: Synthetic oligonucleotide
  Target: SCN10A; (+) strand; PAM type: YTN; PAM sequence: CTA
atacaactgatctacaggtg

SEQ ID NO: 74144 - DNA, 20 bp, Artificial Sequence
  Description of Artificial Sequence: Synthetic oligonucleotide
  Target: SCN10A; (+) strand; PAM type: YTN; PAM sequence: CTG
atctacaggtgggtataaat

SEQ ID NO: 74145 - DNA, 20 bp, Artificial Sequence
  Description of Artificial Sequence: Synthetic oligonucleotide
  Target: SCN10A; (+) strand; PAM type: YTN; PAM sequence: CTA
caggtgggtataaatatcta

SEQ ID NO: 74146 - DNA, 20 bp, Artificial Sequence
  Description of Artificial Sequence: Synthetic oligonucleotide
  Target: SCN10A; (+) strand; PAM type: YTN; PAM sequence: CTA
cattttgaagctgagaaaca

SEQ ID NO: 74147 - DNA, 20 bp, Artificial Sequence
  Description of Artificial Sequence: Synthetic oligonucleotide
  Target: SCN10A; (+) strand; PAM type: YTN; PAM sequence: TTT
tgaagctgagaaacaggctg

SEQ ID NO: 74148 - DNA, 20 bp, Artificial Sequence
  Description of Artificial Sequence: Synthetic oligonucleotide
  Target: SCN10A; (+) strand; PAM type: YTN; PAM sequence: TTT
gaagctgagaaacaggctga

SEQ ID NO: 74149 - DNA, 20 bp, Artificial Sequence
  Description of Artificial Sequence: Synthetic oligonucleotide
  Target: SCN10A; (+) strand; PAM type: YTN; PAM sequence: TTG
aagctgagaaacaggctgac

SEQ ID NO: 74150 - DNA, 20 bp, Artificial Sequence
  Description of Artificial Sequence: Synthetic oligonucleotide
  Target: SCN10A; (+) strand; PAM type: YTN; PAM sequence: CTG
agaaacaggctgacaaaaaa

SEQ ID NO: 74151 - DNA, 20 bp, Artificial Sequence
  Description of Artificial Sequence: Synthetic oligonucleotide
  Target: SCN10A; (+) strand; PAM type: YTN; PAM sequence: CTG
acaaaaaataaaagttaaat

SEQ ID NO: 74152 - DNA, 20 bp, Artificial Sequence
  Description of Artificial Sequence: Synthetic oligonucleotide
  Target: SCN10A; (+) strand; PAM type: YTN; PAM sequence: TTA
aataacttttctcaggtcat

SEQ ID NO: 74153 - DNA, 20 bp, Artificial Sequence
  Description of Artificial Sequence: Synthetic oligonucleotide
  Target: SCN10A; (+) strand; PAM type: YTN; PAM sequence: CTT
ttctcaggtcatgcagctag

SEQ ID NO: 74154 - DNA, 20 bp, Artificial Sequence
  Description of Artificial Sequence: Synthetic oligonucleotide
  Target: SCN10A; (+) strand; PAM type: YTN; PAM sequence: TTT
tctcaggtcatgcagctagt

SEQ ID NO: 74155 - DNA, 20 bp, Artificial Sequence
  Description of Artificial Sequence: Synthetic oligonucleotide
  Target: SCN10A; (+) strand; PAM type: YTN; PAM sequence: TTT
ctcaggtcatgcagctagtc

SEQ ID NO: 74156 - DNA, 20 bp, Artificial Sequence
  Description of Artificial Sequence: Synthetic oligonucleotide
  Target: SCN10A; (+) strand; PAM type: YTN; PAM sequence: TTC
tcaggtcatgcagctagtca

SEQ ID NO: 74157 - DNA, 20 bp, Artificial Sequence
  Description of Artificial Sequence: Synthetic oligonucleotide
  Target: SCN10A; (+) strand; PAM type: YTN; PAM sequence: CTC
aggtcatgcagctagtcaac

SEQ ID NO: 74158 - DNA, 20 bp, Artificial Sequence
  Description of Artificial Sequence: Synthetic oligonucleotide
  Target: SCN10A; (+) strand; PAM type: YTN; PAM sequence: CTA
gtcaaccatgctgcagagat

SEQ ID NO: 74159 - DNA, 20 bp, Artificial Sequence
  Description of Artificial Sequence: Synthetic oligonucleotide
  Target: SCN10A; (+) strand; PAM type: YTN; PAM sequence: CTG
cagagatgtgaactcttatc

SEQ ID NO: 74160 - DNA, 20 bp, Artificial Sequence
  Description of Artificial Sequence: Synthetic oligonucleotide
  Target: SCN10A; (+) strand; PAM type: YTN; PAM sequence: CTC
ttatctgtttgataacaaac

SEQ ID NO: 74161 - DNA, 20 bp, Artificial Sequence
  Description of Artificial Sequence: Synthetic oligonucleotide
  Target: SCN10A; (+) strand; PAM type: YTN; PAM sequence: CTT
atctgtttgataacaaactc

SEQ ID NO: 74162 - DNA, 20 bp, Artificial Sequence
  Description of Artificial Sequence: Synthetic oligonucleotide
  Target: SCN10A; (+) strand; PAM type: YTN; PAM sequence: TTA
tctgtttgataacaaactct

SEQ ID NO: 74163 - DNA, 20 bp, Artificial Sequence
  Description of Artificial Sequence: Synthetic oligonucleotide
  Target: SCN10A; (+) strand; PAM type: YTN; PAM sequence: CTG
tttgataacaaactctgagc

SEQ ID NO: 74164 - DNA, 20 bp, Artificial Sequence
  Description of Artificial Sequence: Synthetic oligonucleotide
  Target: SCN10A; (+) strand; PAM type: YTN; PAM sequence: TTT
gataacaaactctgagcaag

SEQ ID NO: 74165 - DNA, 20 bp, Artificial Sequence
  Description of Artificial Sequence: Synthetic oligonucleotide
  Target: SCN10A; (+) strand; PAM type: YTN; PAM sequence: TTG
ataacaaactctgagcaaga

SEQ ID NO: 74166 - DNA, 20 bp, Artificial Sequence
  Description of Artificial Sequence: Synthetic oligonucleotide
  Target: SCN10A; (+) strand; PAM type: YTN; PAM sequence: CTC
tgagcaagatagaaggaaac

SEQ ID NO: 74167 - DNA, 20 bp, Artificial Sequence
  Description of Artificial Sequence: Synthetic oligonucleotide
  Target: SCN10A; (+) strand; PAM type: YTN; PAM sequence: CTG
agcaagatagaaggaaacag

SEQ ID NO: 74168 - DNA, 20 bp, Artificial Sequence
  Description of Artificial Sequence: Synthetic oligonucleotide
  Target: SCN10A; (+) strand; PAM type: YTN; PAM sequence: CTC
ccttttccaaaatgtccttc

SEQ ID NO: 74169 - DNA, 20 bp, Artificial Sequence
  Description of Artificial Sequence: Synthetic oligonucleotide
  Target: SCN10A; (+) strand; PAM type: YTN; PAM sequence: CTT
ttccaaaatgtccttctgcc

SEQ ID NO: 74170 - DNA, 20 bp, Artificial Sequence
  Description of Artificial Sequence: Synthetic oligonucleotide
  Target: SCN10A; (+) strand; PAM type: YTN; PAM sequence: TTT
tccaaaatgtccttctgccc

SEQ ID NO: 74171 - DNA, 20 bp, Artificial Sequence
  Description of Artificial Sequence: Synthetic oligonucleotide
  Target: SCN10A; (+) strand; PAM type: YTN; PAM sequence: TTT
ccaaaatgtccttctgcccc

SEQ ID NO: 74172 - DNA, 20 bp, Artificial Sequence
  Description of Artificial Sequence: Synthetic oligonucleotide
  Target: SCN10A; (+) strand; PAM type: YTN; PAM sequence: TTC
caaaatgtccttctgccccg

SEQ ID NO: 74173 - DNA, 20 bp, Artificial Sequence
  Description of Artificial Sequence: Synthetic oligonucleotide
  Target: SCN10A; (+) strand; PAM type: YTN; PAM sequence: CTT
ctgccccgaagccttcattt

SEQ ID NO: 74174 - DNA, 20 bp, Artificial Sequence
  Description of Artificial Sequence: Synthetic oligonucleotide
  Target: SCN10A; (+) strand; PAM type: YTN; PAM sequence: TTC
tgccccgaagccttcatttc

SEQ ID NO: 74175 - DNA, 20 bp, Artificial Sequence
  Description of Artificial Sequence: Synthetic oligonucleotide
  Target: SCN10A; (+) strand; PAM type: YTN; PAM sequence: CTG
ccccgaagccttcatttcag

SEQ ID NO: 74176 - DNA, 20 bp, Artificial Sequence
  Description of Artificial Sequence: Synthetic oligonucleotide
  Target: SCN10A; (+) strand; PAM type: YTN; PAM sequence: CTT
catttcagtatacaaaatgg

SEQ ID NO: 74177 - DNA, 20 bp, Artificial Sequence
  Description of Artificial Sequence: Synthetic oligonucleotide
  Target: SCN10A; (+) strand; PAM type: YTN; PAM sequence: TTC
atttcagtatacaaaatggc

SEQ ID NO: 74178 - DNA, 20 bp, Artificial Sequence
  Description of Artificial Sequence: Synthetic oligonucleotide
  Target: SCN10A; (+) strand; PAM type: YTN; PAM sequence: TTT
cagtatacaaaatggcctga

SEQ ID NO: 74179 - DNA, 20 bp, Artificial Sequence
  Description of Artificial Sequence: Synthetic oligonucleotide
  Target: SCN10A; (+) strand; PAM type: YTN; PAM sequence: TTC
agtatacaaaatggcctgaa

SEQ ID NO: 74180 - DNA, 20 bp, Artificial Sequence
  Description of Artificial Sequence: Synthetic oligonucleotide
  Target: SCN10A; (+) strand; PAM type: YTN; PAM sequence: CTG
aaatttcatctggcaaatgt

SEQ ID NO: 74181 - DNA, 20 bp, Artificial Sequence
  Description of Artificial Sequence: Synthetic oligonucleotide
  Target: SCN10A; (+) strand; PAM type: YTN; PAM sequence: TTT
catctggcaaatgtcttttt

SEQ ID NO: 74182 - DNA, 20 bp, Artificial Sequence
  Description of Artificial Sequence: Synthetic oligonucleotide
  Target: SCN10A; (+) strand; PAM type: YTN; PAM sequence: TTC
atctggcaaatgtctttttt

SEQ ID NO: 74183 - DNA, 20 bp, Artificial Sequence
  Description of Artificial Sequence: Synthetic oligonucleotide
  Target: SCN10A; (+) strand; PAM type: YTN; PAM sequence: CTG
gcaaatgtcttttttattct

SEQ ID NO: 74184 - DNA, 20 bp, Artificial Sequence
  Description of Artificial Sequence: Synthetic oligonucleotide
  Target: SCN10A; (+) strand; PAM type: YTN; PAM sequence: CTT
ttttattctaaaagacaaag

SEQ ID NO: 74185 - DNA, 20 bp, Artificial Sequence
  Description of Artificial Sequence: Synthetic oligonucleotide
  Target: SCN10A; (+) strand; PAM type: YTN; PAM sequence: TTT
tttattctaaaagacaaaga

SEQ ID NO: 74186 - DNA, 20 bp, Artificial Sequence
  Description of Artificial Sequence: Synthetic oligonucleotide
  Target: SCN10A; (+) strand; PAM type: YTN; PAM sequence: TTT
ttattctaaaagacaaagaa

SEQ ID NO: 74187 - DNA, 20 bp, Artificial Sequence
  Description of Artificial Sequence: Synthetic oligonucleotide
  Target: SCN10A; (+) strand; PAM type: YTN; PAM sequence: TTT
tattctaaaagacaaagaaa

SEQ ID NO: 74188 - DNA, 20 bp, Artificial Sequence
  Description of Artificial Sequence: Synthetic oligonucleotide
  Target: SCN10A; (+) strand; PAM type: YTN; PAM sequence: TTT
attctaaaagacaaagaaaa

SEQ ID NO: 74189 - DNA, 20 bp, Artificial Sequence
  Description of Artificial Sequence: Synthetic oligonucleotide
  Target: SCN10A; (+) strand; PAM type: YTN; PAM sequence: TTA
ttctaaaagacaaagaaaag

SEQ ID NO: 74190 - DNA, 20 bp, Artificial Sequence
  Description of Artificial Sequence: Synthetic oligonucleotide
  Target: SCN10A; (+) strand; PAM type: YTN; PAM sequence: TTC
taaaagacaaagaaaagtta

SEQ ID NO: 74191 - DNA, 20 bp, Artificial Sequence
  Description of Artificial Sequence: Synthetic oligonucleotide
  Target: SCN10A; (+) strand; PAM type: YTN; PAM sequence: CTA
aaagacaaagaaaagttaga

SEQ ID NO: 74192 - DNA, 20 bp, Artificial Sequence
  Description of Artificial Sequence: Synthetic oligonucleotide
  Target: SCN10A; (+) strand; PAM type: YTN; PAM sequence: TTA
gaaacttggagataagtgaa

SEQ ID NO: 74193 - DNA, 20 bp, Artificial Sequence
  Description of Artificial Sequence: Synthetic oligonucleotide
  Target: SCN10A; (+) strand; PAM type: YTN; PAM sequence: CTT
ggagataagtgaagaggtac

SEQ ID NO: 74194 - DNA, 20 bp, Artificial Sequence
  Description of Artificial Sequence: Synthetic oligonucleotide
  Target: SCN10A; (+) strand; PAM type: YTN; PAM sequence: TTG
gagataagtgaagaggtaca

SEQ ID NO: 74195 - DNA, 20 bp, Artificial Sequence
  Description of Artificial Sequence: Synthetic oligonucleotide
  Target: SCN10A; (+) strand; PAM type: YTN; PAM sequence: CTT
tcatgggaattagtttcatc

SEQ ID NO: 74196 - DNA, 20 bp, Artificial Sequence
  Description of Artificial Sequence: Synthetic oligonucleotide
  Target: SCN10A; (+) strand; PAM type: YTN; PAM sequence: TTT
catgggaattagtttcatca

SEQ ID NO: 74197 - DNA, 20 bp, Artificial Sequence
  Description of Artificial Sequence: Synthetic oligonucleotide
  Target: SCN10A; (+) strand; PAM type: YTN; PAM sequence: TTC
atgggaattagtttcatcag

SEQ ID NO: 74198 - DNA, 20 bp, Artificial Sequence
  Description of Artificial Sequence: Synthetic oligonucleotide
  Target: SCN10A; (+) strand; PAM type: YTN; PAM sequence: TTA
gtttcatcagattgtttggg

SEQ ID NO: 74199 - DNA, 20 bp, Artificial Sequence
  Description of Artificial Sequence: Synthetic oligonucleotide
  Target: SCN10A; (+) strand; PAM type: YTN; PAM sequence: TTT
catcagattgtttgggtaac

SEQ ID NO: 74200 - DNA, 20 bp, Artificial Sequence
  Description of Artificial Sequence: Synthetic oligonucleotide
  Target: SCN10A; (+) strand; PAM type: YTN; PAM sequence: TTC
atcagattgtttgggtaact

SEQ ID NO: 74201 - DNA, 20 bp, Artificial Sequence
  Description of Artificial Sequence: Synthetic oligonucleotide
  Target: SCN10A; (+) strand; PAM type: YTN; PAM sequence: TTG
tttgggtaacttagttgaga

SEQ ID NO: 74202 - DNA, 20 bp, Artificial Sequence
  Description of Artificial Sequence: Synthetic oligonucleotide
  Target: SCN10A; (+) strand; PAM type: YTN; PAM sequence: TTT
gggtaacttagttgagatca

SEQ ID NO: 74203 - DNA, 20 bp, Artificial Sequence
  Description of Artificial Sequence: Synthetic oligonucleotide
  Target: SCN10A; (+) strand; PAM type: YTN; PAM sequence: TTG
ggtaacttagttgagatcag

SEQ ID NO: 74204 - DNA, 20 bp, Artificial Sequence
  Description of Artificial Sequence: Synthetic oligonucleotide
  Target: SCN10A; (+) strand; PAM type: YTN; PAM sequence: CTT
agttgagatcagttccaccg

SEQ ID NO: 74205 - DNA, 20 bp, Artificial Sequence
  Description of Artificial Sequence: Synthetic oligonucleotide
  Target: SCN10A; (+) strand; PAM type: YTN; PAM sequence: TTA
gttgagatcagttccaccga

SEQ ID NO: 74206 - DNA, 20 bp, Artificial Sequence
  Description of Artificial Sequence: Synthetic oligonucleotide
  Target: SCN10A; (+) strand; PAM type: YTN; PAM sequence: TTG
agatcagttccaccgaggaa

SEQ ID NO: 74207 - DNA, 20 bp, Artificial Sequence
  Description of Artificial Sequence: Synthetic oligonucleotide
  Target: SCN10A; (+) strand; PAM type: YTN; PAM sequence: TTC
caccgaggaaatggtcttct

SEQ ID NO: 74208 - DNA, 20 bp, Artificial Sequence
  Description of Artificial Sequence: Synthetic oligonucleotide
  Target: SCN10A; (+) strand; PAM type: YTN; PAM sequence: CTT
ctgggtaggaacggtggagg

SEQ ID NO: 74209 - DNA, 20 bp, Artificial Sequence
  Description of Artificial Sequence: Synthetic oligonucleotide
  Target: SCN10A; (+) strand; PAM type: YTN; PAM sequence: TTC
tgggtaggaacggtggaggc

SEQ ID NO: 74210 - DNA, 20 bp, Artificial Sequence
  Description of Artificial Sequence: Synthetic oligonucleotide
  Target: SCN10A; (+) strand; PAM type: YTN; PAM sequence: CTG
ggtaggaacggtggaggcag

SEQ ID NO: 74211 - DNA, 20 bp, Artificial Sequence
  Description of Artificial Sequence: Synthetic oligonucleotide
  Target: SCN10A; (+) strand; PAM type: YTN; PAM sequence: CTG
gctcaggaagaaaaccccaa

SEQ ID NO: 74212 - DNA, 20 bp, Artificial Sequence
  Description of Artificial Sequence: Synthetic oligonucleotide
  Target: SCN10A; (+) strand; PAM type: YTN; PAM sequence: CTC
aggaagaaaaccccaagtag

SEQ ID NO: 74213 - DNA, 20 bp, Artificial Sequence
  Description of Artificial Sequence: Synthetic oligonucleotide
  Target: SCN10A; (+) strand; PAM type: YTN; PAM sequence: TTA
ggctggagtggagaactctg

SEQ ID NO: 74214 - DNA, 20 bp, Artificial Sequence
  Description of Artificial Sequence: Synthetic oligonucleotide
  Target: SCN10A; (+) strand; PAM type: YTN; PAM sequence: CTG
gagtggagaactctgaatag

SEQ ID NO: 74215 - DNA, 20 bp, Artificial Sequence
  Description of Artificial Sequence: Synthetic oligonucleotide
  Target: SCN10A; (+) strand; PAM type: YTN; PAM sequence: CTC
tgaatagctagagtggagaa

SEQ ID NO: 74216 - DNA, 20 bp, Artificial Sequence
  Description of Artificial Sequence: Synthetic oligonucleotide
  Target: SCN10A; (+) strand; PAM type: YTN; PAM sequence: CTG
aatagctagagtggagaata

SEQ ID NO: 74217 - DNA, 20 bp, Artificial Sequence
  Description of Artificial Sequence: Synthetic oligonucleotide
  Target: SCN10A; (+) strand; PAM type: YTN; PAM sequence: CTA
gagtggagaatattgacagc

SEQ ID NO: 74218 - DNA, 20 bp, Artificial Sequence
  Description of Artificial Sequence: Synthetic oligonucleotide
  Target: SCN10A; (+) strand; PAM type: YTN; PAM sequence: TTG
acagcagactatgggcaaag

SEQ ID NO: 74219 - DNA, 20 bp, Artificial Sequence
  Description of Artificial Sequence: Synthetic oligonucleotide
  Target: SCN10A; (+) strand; PAM type: YTN; PAM sequence: CTA
tgggcaaagggattatcaaa

SEQ ID NO: 74220 - DNA, 20 bp, Artificial Sequence
  Description of Artificial Sequence: Synthetic oligonucleotide
  Target: SCN10A; (+) strand; PAM type: YTN; PAM sequence: TTA
tcaaaaggggagggagacat

SEQ ID NO: 74221 - DNA, 20 bp, Artificial Sequence
  Description of Artificial Sequence: Synthetic oligonucleotide
  Target: SCN10A; (+) strand; PAM type: YTN; PAM sequence: TTG
aaaggaaggtgggtggaagg

SEQ ID NO: 74222 - DNA, 20 bp, Artificial Sequence
  Description of Artificial Sequence: Synthetic oligonucleotide
  Target: SCN10A; (+) strand; PAM type: YTN; PAM sequence: TTG
gtggggagaatctaaaggta

SEQ ID NO: 74223 - DNA, 20 bp, Artificial Sequence
  Description of Artificial Sequence: Synthetic oligonucleotide
  Target: SCN10A; (+) strand; PAM type: YTN; PAM sequence: CTA
aaggtaaattgttcccactt

SEQ ID NO: 74224 - DNA, 20 bp, Artificial Sequence
  Description of Artificial Sequence: Synthetic oligonucleotide
  Target: SCN10A; (+) strand; PAM type: YTN; PAM sequence: TTG
ttcccacttggacatttttc

SEQ ID NO: 74225 - DNA, 20 bp, Artificial Sequence
  Description of Artificial Sequence: Synthetic oligonucleotide
  Target: SCN10A; (+) strand; PAM type: YTN; PAM sequence: TTC
ccacttggacatttttctta

SEQ ID NO: 74226 - DNA, 20 bp, Artificial Sequence
  Description of Artificial Sequence: Synthetic oligonucleotide
  Target: SCN10A; (+) strand; PAM type: YTN; PAM sequence: CTT
ggacatttttcttaggaata

SEQ ID NO: 74227 - DNA, 20 bp, Artificial Sequence
  Description of Artificial Sequence: Synthetic oligonucleotide
  Target: SCN10A; (+) strand; PAM type: YTN; PAM sequence: TTG
gacatttttcttaggaatag

SEQ ID NO: 74228 - DNA, 20 bp, Artificial Sequence
  Description of Artificial Sequence: Synthetic oligonucleotide
  Target: SCN10A; (+) strand; PAM type: YTN; PAM sequence: TTT
ttcttaggaatagctgggct

SEQ ID NO: 74229 - DNA, 20 bp, Artificial Sequence
  Description of Artificial Sequence: Synthetic oligonucleotide
  Target: SCN10A; (+) strand; PAM type: YTN; PAM sequence: TTT
tcttaggaatagctgggctc

SEQ ID NO: 74230 - DNA, 20 bp, Artificial Sequence
  Description of Artificial Sequence: Synthetic oligonucleotide
  Target: SCN10A; (+) strand; PAM type: YTN; PAM sequence: TTT
cttaggaatagctgggctcc

SEQ ID NO: 74231 - DNA, 20 bp, Artificial Sequence
  Description of Artificial Sequence: Synthetic oligonucleotide
  Target: SCN10A; (+) strand; PAM type: YTN; PAM sequence: TTC
ttaggaatagctgggctccc

SEQ ID NO: 74232 - DNA, 20 bp, Artificial Sequence
  Description of Artificial Sequence: Synthetic oligonucleotide
  Target: SCN10A; (+) strand; PAM type: YTN; PAM sequence: CTT
aggaatagctgggctcccaa

SEQ ID NO: 74233 - DNA, 20 bp, Artificial Sequence
  Description of Artificial Sequence: Synthetic oligonucleotide
  Target: SCN10A; (+) strand; PAM type: YTN; PAM sequence: TTA
ggaatagctgggctcccaac

SEQ ID NO: 74234 - DNA, 20 bp, Artificial Sequence
  Description of Artificial Sequence: Synthetic oligonucleotide
  Target: SCN10A; (+) strand; PAM type: YTN; PAM sequence: CTG
ggctcccaacagtgcttcct

SEQ ID NO: 74235 - DNA, 20 bp, Artificial Sequence
  Description of Artificial Sequence: Synthetic oligonucleotide
  Target: SCN10A; (+) strand; PAM type: YTN; PAM sequence: CTC
ccaacagtgcttcctaagga

SEQ ID NO: 74236 - DNA, 20 bp, Artificial Sequence
  Description of Artificial Sequence: Synthetic oligonucleotide
  Target: SCN10A; (+) strand; PAM type: YTN; PAM sequence: CTT
cctaaggaaaaataaaactt

SEQ ID NO: 74237 - DNA, 20 bp, Artificial Sequence
  Description of Artificial Sequence: Synthetic oligonucleotide
  Target: SCN10A; (+) strand; PAM type: YTN; PAM sequence: TTC
ctaaggaaaaataaaacttg

SEQ ID NO: 74238 - DNA, 20 bp, Artificial Sequence
  Description of Artificial Sequence: Synthetic oligonucleotide
  Target: SCN10A; (+) strand; PAM type: YTN; PAM sequence: CTA
aggaaaaataaaacttgaag

SEQ ID NO: 74239 - DNA, 20 bp, Artificial Sequence
  Description of Artificial Sequence: Synthetic oligonucleotide
  Target: SCN10A; (+) strand; PAM type: YTN; PAM sequence: CTT
gaagataaacttgacctaca

SEQ ID NO: 74240 - DNA, 20 bp, Artificial Sequence
  Description of Artificial Sequence: Synthetic oligonucleotide
  Target: SCN10A; (+) strand; PAM type: YTN; PAM sequence: TTG
aagataaacttgacctacag

SEQ ID NO: 74241 - DNA, 20 bp, Artificial Sequence
  Description of Artificial Sequence: Synthetic oligonucleotide
  Target: SCN10A; (+) strand; PAM type: YTN; PAM sequence: CTT
gacctacagagagagtacaa

SEQ ID NO: 74242 - DNA, 20 bp, Artificial Sequence
  Description of Artificial Sequence: Synthetic oligonucleotide
  Target: SCN10A; (+) strand; PAM type: YTN; PAM sequence: TTG
acctacagagagagtacaac

SEQ ID NO: 74243 - DNA, 20 bp, Artificial Sequence
  Description of Artificial Sequence: Synthetic oligonucleotide
  Target: SCN10A; (+) strand; PAM type: YTN; PAM sequence: CTA
cagagagagtacaacactca

SEQ ID NO: 74244 - DNA, 20 bp, Artificial Sequence
  Description of Artificial Sequence: Synthetic oligonucleotide
  Target: SCN10A; (+) strand; PAM type: YTN; PAM sequence: CTC
atttttcaatttgagcagaa

SEQ ID NO: 74245 - DNA, 20 bp, Artificial Sequence
  Description of Artificial Sequence: Synthetic oligonucleotide
  Target: SCN10A; (+) strand; PAM type: YTN; PAM sequence: TTT
ttcaatttgagcagaagtat

SEQ ID NO: 74246 - DNA, 20 bp, Artificial Sequence
  Description of Artificial Sequence: Synthetic oligonucleotide
  Target: SCN10A; (+) strand; PAM type: YTN; PAM sequence: TTT
tcaatttgagcagaagtatt

SEQ ID NO: 74247 - DNA, 20 bp, Artificial Sequence
  Description of Artificial Sequence: Synthetic oligonucleotide
  Target: SCN10A; (+) strand; PAM type: YTN; PAM sequence: TTT
caatttgagcagaagtattt

SEQ ID NO: 74248 - DNA, 20 bp, Artificial Sequence
  Description of Artificial Sequence: Synthetic oligonucleotide
  Target: SCN10A; (+) strand; PAM type: YTN; PAM sequence: TTC
aatttgagcagaagtattta

SEQ ID NO: 74249 - DNA, 20 bp, Artificial Sequence
  Description of Artificial Sequence: Synthetic oligonucleotide
  Target: SCN10A; (+) strand; PAM type: YTN; PAM sequence: TTT
gagcagaagtatttaaatgt

SEQ ID NO: 74250 - DNA, 20 bp, Artificial Sequence
  Description of Artificial Sequence: Synthetic oligonucleotide
  Target: SCN10A; (+) strand; PAM type: YTN; PAM sequence: TTG
agcagaagtatttaaatgta

SEQ ID NO: 74251 - DNA, 20 bp, Artificial Sequence
  Description of Artificial Sequence: Synthetic oligonucleotide
  Target: SCN10A; (+) strand; PAM type: YTN; PAM sequence: TTT
aaatgtattttagttttctg

SEQ ID NO: 74252 - DNA, 20 bp, Artificial Sequence
  Description of Artificial Sequence: Synthetic oligonucleotide
  Target: SCN10A; (+) strand; PAM type: YTN; PAM sequence: TTA
aatgtattttagttttctgt

SEQ ID NO: 74253 - DNA, 20 bp, Artificial Sequence
  Description of Artificial Sequence: Synthetic oligonucleotide
  Target: SCN10A; (+) strand; PAM type: YTN; PAM sequence: TTT
tagttttctgtaaatgcctt

SEQ ID NO: 74254 - DNA, 20 bp, Artificial Sequence
  Description of Artificial Sequence: Synthetic oligonucleotide
  Target: SCN10A; (+) strand; PAM type: YTN; PAM sequence: TTT
agttttctgtaaatgccttg

SEQ ID NO: 74255 - DNA, 20 bp, Artificial Sequence
  Description of Artificial Sequence: Synthetic oligonucleotide
  Target: SCN10A; (+) strand; PAM type: YTN; PAM sequence: TTA
gttttctgtaaatgccttga

SEQ ID NO: 74256 - DNA, 20 bp, Artificial Sequence
  Description of Artificial Sequence: Synthetic oligonucleotide
  Target: SCN10A; (+) strand; PAM type: YTN; PAM sequence: TTT
tctgtaaatgccttgatgtg

SEQ ID NO: 74257 - DNA, 20 bp, Artificial Sequence
  Description of Artificial Sequence: Synthetic oligonucleotide
  Target: SCN10A; (+) strand; PAM type: YTN; PAM sequence: TTT
ctgtaaatgccttgatgtgt

SEQ ID NO: 74258 - DNA, 20 bp, Artificial Sequence
  Description of Artificial Sequence: Synthetic oligonucleotide
  Target: SCN10A; (+) strand; PAM type: YTN; PAM sequence: TTC
tgtaaatgccttgatgtgtc

SEQ ID NO: 74259 - DNA, 20 bp, Artificial Sequence
  Description of Artificial Sequence: Synthetic oligonucleotide
  Target: SCN10A; (+) strand; PAM type: YTN; PAM sequence: CTG
taaatgccttgatgtgtcta

SEQ ID NO: 74260 - DNA, 20 bp, Artificial Sequence
  Description of Artificial Sequence: Synthetic oligonucleotide
  Target: SCN10A; (+) strand; PAM type: YTN; PAM sequence: CTT
gatgtgtctagttttacagt

SEQ ID NO: 74261 - DNA, 20 bp, Artificial Sequence
  Description of Artificial Sequence: Synthetic oligonucleotide
  Target: SCN10A; (+) strand; PAM type: YTN; PAM sequence: TTG
atgtgtctagttttacagtt

SEQ ID NO: 74262 - DNA, 20 bp, Artificial Sequence
  Description of Artificial Sequence: Synthetic oligonucleotide
  Target: SCN10A; (+) strand; PAM type: YTN; PAM sequence: CTA
gttttacagttacttaggaa

SEQ ID NO: 74263 - DNA, 20 bp, Artificial Sequence
  Description of Artificial Sequence: Synthetic oligonucleotide
  Target: SCN10A; (+) strand; PAM type: YTN; PAM sequence: TTT
tacagttacttaggaacaca

SEQ ID NO: 74264 - DNA, 20 bp, Artificial Sequence
  Description of Artificial Sequence: Synthetic oligonucleotide
  Target: SCN10A; (+) strand; PAM type: YTN; PAM sequence: TTT
acagttacttaggaacacat

SEQ ID NO: 74265 - DNA, 20 bp, Artificial Sequence
  Description of Artificial Sequence: Synthetic oligonucleotide
  Target: SCN10A; (+) strand; PAM type: YTN; PAM sequence: TTA
cagttacttaggaacacatc

SEQ ID NO: 74266 - DNA, 20 bp, Artificial Sequence
  Description of Artificial Sequence: Synthetic oligonucleotide
  Target: SCN10A; (+) strand; PAM type: YTN; PAM sequence: TTA
cttaggaacacatctattat

SEQ ID NO: 74267 - DNA, 20 bp, Artificial Sequence
  Description of Artificial Sequence: Synthetic oligonucleotide
  Target: SCN10A; (+) strand; PAM type: YTN; PAM sequence: CTT
aggaacacatctattatgaa

SEQ ID NO: 74268 - DNA, 20 bp, Artificial Sequence
  Description of Artificial Sequence: Synthetic oligonucleotide
  Target: SCN10A; (+) strand; PAM type: YTN; PAM sequence: TTA
ggaacacatctattatgaaa

SEQ ID NO: 74269 - DNA, 20 bp, Artificial Sequence
  Description of Artificial Sequence: Synthetic oligonucleotide
  Target: SCN10A; (+) strand; PAM type: YTN; PAM sequence: CTA
ttatgaaaaggaaaattcta

SEQ ID NO: 74270 - DNA, 20 bp, Artificial Sequence
  Description of Artificial Sequence: Synthetic oligonucleotide
  Target: SCN10A; (+) strand; PAM type: YTN; PAM sequence: TTA
tgaaaaggaaaattctatta

SEQ ID NO: 74271 - DNA, 20 bp, Artificial Sequence
  Description of Artificial Sequence: Synthetic oligonucleotide
  Target: SCN10A; (+) strand; PAM type: YTN; PAM sequence: TTC
tattaattaaaccacatttt

SEQ ID NO: 74272 - DNA, 20 bp, Artificial Sequence
  Description of Artificial Sequence: Synthetic oligonucleotide
  Target: SCN10A; (+) strand; PAM type: YTN; PAM sequence: CTA
ttaattaaaccacattttcc

SEQ ID NO: 74273 - DNA, 20 bp, Artificial Sequence
  Description of Artificial Sequence: Synthetic oligonucleotide
  Target: SCN10A; (+) strand; PAM type: YTN; PAM sequence: TTA
attaaaccacattttcctgc

SEQ ID NO: 74274 - DNA, 20 bp, Artificial Sequence
  Description of Artificial Sequence: Synthetic oligonucleotide
  Target: SCN10A; (+) strand; PAM type: YTN; PAM sequence: TTA
aaccacattttcctgctgac

SEQ ID NO: 74275 - DNA, 20 bp, Artificial Sequence
  Description of Artificial Sequence: Synthetic oligonucleotide
  Target: SCN10A; (+) strand; PAM type: YTN; PAM sequence: TTT
tcctgctgacttacaattaa

SEQ ID NO: 74276 - DNA, 20 bp, Artificial Sequence
  Description of Artificial Sequence: Synthetic oligonucleotide
  Target: SCN10A; (+) strand; PAM type: YTN; PAM sequence: TTT
cctgctgacttacaattaaa

SEQ ID NO: 74277 - DNA, 20 bp, Artificial Sequence
  Description of Artificial Sequence: Synthetic oligonucleotide
  Target: SCN10A; (+) strand; PAM type: YTN; PAM sequence: TTC
ctgctgacttacaattaaat

SEQ ID NO: 74278 - DNA, 20 bp, Artificial Sequence
  Description of Artificial Sequence: Synthetic oligonucleotide
  Target: SCN10A; (+) strand; PAM type: YTN; PAM sequence: CTG
ctgacttacaattaaattaa

SEQ ID NO: 74279 - DNA, 20 bp, Artificial Sequence
  Description of Artificial Sequence: Synthetic oligonucleotide
  Target: SCN10A; (+) strand; PAM type: YTN; PAM sequence: CTG
acttacaattaaattaagaa

SEQ ID NO: 74280 - DNA, 20 bp, Artificial Sequence
  Description of Artificial Sequence: Synthetic oligonucleotide
  Target: SCN10A; (+) strand; PAM type: YTN; PAM sequence: CTT
acaattaaattaagaaatat

SEQ ID NO: 74281 - DNA, 20 bp, Artificial Sequence
  Description of Artificial Sequence: Synthetic oligonucleotide
  Target: SCN10A; (+) strand; PAM type: YTN; PAM sequence: TTA
caattaaattaagaaatatg

SEQ ID NO: 74282 - DNA, 20 bp, Artificial Sequence
  Description of Artificial Sequence: Synthetic oligonucleotide
  Target: SCN10A; (+) strand; PAM type: YTN; PAM sequence: TTA
aattaagaaatatgctcaca

SEQ ID NO: 74283 - DNA, 20 bp, Artificial Sequence
  Description of Artificial Sequence: Synthetic oligonucleotide
  Target: SCN10A; (+) strand; PAM type: YTN; PAM sequence: TTA
agaaatatgctcacatgggg

SEQ ID NO: 74284 - DNA, 20 bp, Artificial Sequence
  Description of Artificial Sequence: Synthetic oligonucleotide
  Target: SCN10A; (+) strand; PAM type: YTN; PAM sequence: CTC
acatggggggaaatgttaat

SEQ ID NO: 74285 - DNA, 20 bp, Artificial Sequence
  Description of Artificial Sequence: Synthetic oligonucleotide
  Target: SCN10A; (+) strand; PAM type: YTN; PAM sequence: TTA
atccaaggattaaactaaaa

SEQ ID NO: 74286 - DNA, 20 bp, Artificial Sequence
  Description of Artificial Sequence: Synthetic oligonucleotide
  Target: SCN10A; (+) strand; PAM type: YTN; PAM sequence: TTA
aactaaaatcgtgtctccaa

SEQ ID NO: 74287 - DNA, 20 bp, Artificial Sequence
  Description of Artificial Sequence: Synthetic oligonucleotide
  Target: SCN10A; (+) strand; PAM type: YTN; PAM sequence: CTA
aaatcgtgtctccaattcta

SEQ ID NO: 74288 - DNA, 20 bp, Artificial Sequence
  Description of Artificial Sequence: Synthetic oligonucleotide
  Target: SCN10A; (+) strand; PAM type: YTN; PAM sequence: CTC
caattctacaaatatttaaa

SEQ ID NO: 74289 - DNA, 20 bp, Artificial Sequence
  Description of Artificial Sequence: Synthetic oligonucleotide
  Target: SCN10A; (+) strand; PAM type: YTN; PAM sequence: TTC
tacaaatatttaaaagtaat

SEQ ID NO: 74290 - DNA, 20 bp, Artificial Sequence
  Description of Artificial Sequence: Synthetic oligonucleotide
  Target: SCN10A; (+) strand; PAM type: YTN; PAM sequence: CTA
caaatatttaaaagtaatat

SEQ ID NO: 74291 - DNA, 20 bp, Artificial Sequence
  Description of Artificial Sequence: Synthetic oligonucleotide
  Target: SCN10A; (+) strand; PAM type: YTN; PAM sequence: TTT
aaaagtaatatatcttatgt

SEQ ID NO: 74292 - DNA, 20 bp, Artificial Sequence
  Description of Artificial Sequence: Synthetic oligonucleotide
  Target: SCN10A; (+) strand; PAM type: YTN; PAM sequence: TTA
aaagtaatatatcttatgta

SEQ ID NO: 74293 - DNA, 20 bp, Artificial Sequence
  Description of Artificial Sequence: Synthetic oligonucleotide
  Target: SCN10A; (+) strand; PAM type: YTN; PAM sequence: CTT
atgtataatattagttatga

SEQ ID NO: 74294 - DNA, 20 bp, Artificial Sequence
  Description of Artificial Sequence: Synthetic oligonucleotide
  Target: SCN10A; (+) strand; PAM type: YTN; PAM sequence: TTA
tgtataatattagttatgaa

SEQ ID NO: 74295 - DNA, 20 bp, Artificial Sequence
  Description of Artificial Sequence: Synthetic oligonucleotide
  Target: SCN10A; (+) strand; PAM type: YTN; PAM sequence: TTA
gttatgaaaacattcatagc

SEQ ID NO: 74296 - DNA, 20 bp, Artificial Sequence
  Description of Artificial Sequence: Synthetic oligonucleotide
  Target: SCN10A; (+) strand; PAM type: YTN; PAM sequence: TTA
tgaaaacattcatagcaaat

SEQ ID NO: 74297 - DNA, 20 bp, Artificial Sequence
  Description of Artificial Sequence: Synthetic oligonucleotide
  Target: SCN10A; (+) strand; PAM type: YTN; PAM sequence: TTC
atagcaaatgtgattagaat

SEQ ID NO: 74298 - DNA, 20 bp, Artificial Sequence
  Description of Artificial Sequence: Synthetic oligonucleotide
  Target: SCN10A; (+) strand; PAM type: YTN; PAM sequence: TTA
gaattatatttttggtgaaa

SEQ ID NO: 74299 - DNA, 20 bp, Artificial Sequence
  Description of Artificial Sequence: Synthetic oligonucleotide
  Target: SCN10A; (+) strand; PAM type: YTN; PAM sequence: TTA
tatttttggtgaaatattaa

SEQ ID NO: 74300 - DNA, 20 bp, Artificial Sequence
  Description of Artificial Sequence: Synthetic oligonucleotide
  Target: SCN10A; (+) strand; PAM type: YTN; PAM sequence: TTT
ttggtgaaatattaataata

SEQ ID NO: 74301 - DNA, 20 bp, Artificial Sequence
  Description of Artificial Sequence: Synthetic oligonucleotide
  Target: SCN10A; (+) strand; PAM type: YTN; PAM sequence: TTT
tggtgaaatattaataatag

SEQ ID NO: 74302 - DNA, 20 bp, Artificial Sequence
  Description of Artificial Sequence: Synthetic oligonucleotide
  Target: SCN10A; (+) strand; PAM type: YTN; PAM sequence: TTT
ggtgaaatattaataatagg

SEQ ID NO: 74303 - DNA, 20 bp, Artificial Sequence
  Description of Artificial Sequence: Synthetic oligonucleotide
  Target: SCN10A; (+) strand; PAM type: YTN; PAM sequence: TTG
gtgaaatattaataataggg

SEQ ID NO: 74304 - DNA, 20 bp, Artificial Sequence
  Description of Artificial Sequence: Synthetic oligonucleotide
  Target: SCN10A; (+) strand; PAM type: YTN; PAM sequence: TTA
ataatagggccctgagaatt

SEQ ID NO: 74305 - DNA, 20 bp, Artificial Sequence
  Description of Artificial Sequence: Synthetic oligonucleotide
  Target: SCN10A; (+) strand; PAM type: YTN; PAM sequence: CTG
agaattctagtatcttttgg

SEQ ID NO: 74306 - DNA, 20 bp, Artificial Sequence
  Description of Artificial Sequence: Synthetic oligonucleotide
  Target: SCN10A; (+) strand; PAM type: YTN; PAM sequence: TTC
tagtatcttttggggctgga

SEQ ID NO: 74307 - DNA, 20 bp, Artificial Sequence
  Description of Artificial Sequence: Synthetic oligonucleotide
  Target: SCN10A; (+) strand; PAM type: YTN; PAM sequence: CTA
gtatcttttggggctggagt

SEQ ID NO: 74308 - DNA, 20 bp, Artificial Sequence
  Description of Artificial Sequence: Synthetic oligonucleotide
  Target: SCN10A; (+) strand; PAM type: YTN; PAM sequence: CTT
ttggggctggagttaccaaa

SEQ ID NO: 74309 - DNA, 20 bp, Artificial Sequence
  Description of Artificial Sequence: Synthetic oligonucleotide
  Target: SCN10A; (+) strand; PAM type: YTN; PAM sequence: TTT
tggggctggagttaccaaat

SEQ ID NO: 74310 - DNA, 20 bp, Artificial Sequence
  Description of Artificial Sequence: Synthetic oligonucleotide
  Target: SCN10A; (+) strand; PAM type: YTN; PAM sequence: TTT
ggggctggagttaccaaatt

SEQ ID NO: 74311 - DNA, 20 bp, Artificial Sequence
  Description of Artificial Sequence: Synthetic oligonucleotide
  Target: SCN10A; (+) strand; PAM type: YTN; PAM sequence: TTG
gggctggagttaccaaattt

SEQ ID NO: 74312 - DNA, 20 bp, Artificial Sequence
  Description of Artificial Sequence: Synthetic oligonucleotide
  Target: SCN10A; (+) strand; PAM type: YTN; PAM sequence: CTG
gagttaccaaatttatgaga

SEQ ID NO: 74313 - DNA, 20 bp, Artificial Sequence
  Description of Artificial Sequence: Synthetic oligonucleotide
  Target: SCN10A; (+) strand; PAM type: YTN; PAM sequence: TTA
ccaaatttatgagatttaaa

SEQ ID NO: 74314 - DNA, 20 bp, Artificial Sequence
  Description of Artificial Sequence: Synthetic oligonucleotide
  Target: SCN10A; (+) strand; PAM type: YTN; PAM sequence: TTT
atgagatttaaatgcagact

SEQ ID NO: 74315 - DNA, 20 bp, Artificial Sequence
  Description of Artificial Sequence: Synthetic oligonucleotide
  Target: SCN10A; (+) strand; PAM type: YTN; PAM sequence: TTA
tgagatttaaatgcagactt

SEQ ID NO: 74316 - DNA, 20 bp, Artificial Sequence
  Description of Artificial Sequence: Synthetic oligonucleotide
  Target: SCN10A; (+) strand; PAM type: YTN; PAM sequence: TTT
aaatgcagacttttgtgagg

SEQ ID NO: 74317 - DNA, 20 bp, Artificial Sequence
  Description of Artificial Sequence: Synthetic oligonucleotide
  Target: SCN10A; (+) strand; PAM type: YTN; PAM sequence: TTA
aatgcagacttttgtgagga

SEQ ID NO: 74318 - DNA, 20 bp, Artificial Sequence
  Description of Artificial Sequence: Synthetic oligonucleotide
  Target: SCN10A; (+) strand; PAM type: YTN; PAM sequence: CTT
ttgtgaggaagagaccccct

SEQ ID NO: 74319 - DNA, 20 bp, Artificial Sequence
  Description of Artificial Sequence: Synthetic oligonucleotide
  Target: SCN10A; (+) strand; PAM type: YTN; PAM sequence: TTT
tgtgaggaagagaccccctc

SEQ ID NO: 74320 - DNA, 20 bp, Artificial Sequence
  Description of Artificial Sequence: Synthetic oligonucleotide
  Target: SCN10A; (+) strand; PAM type: YTN; PAM sequence: TTT
gtgaggaagagaccccctca

SEQ ID NO: 74321 - DNA, 20 bp, Artificial Sequence
  Description of Artificial Sequence: Synthetic oligonucleotide
  Target: SCN10A; (+) strand; PAM type: YTN; PAM sequence: TTG
tgaggaagagaccccctcaa

SEQ ID NO: 74322 - DNA, 20 bp, Artificial Sequence
  Description of Artificial Sequence: Synthetic oligonucleotide
  Target: SCN10A; (+) strand; PAM type: YTN; PAM sequence: CTC
aacagcttttctgtccagct

SEQ ID NO: 74323 - DNA, 20 bp, Artificial Sequence
  Description of Artificial Sequence: Synthetic oligonucleotide
  Target: SCN10A; (+) strand; PAM type: YTN; PAM sequence: CTT
ttctgtccagctgtgactct

SEQ ID NO: 74324 - DNA, 20 bp, Artificial Sequence
  Description of Artificial Sequence: Synthetic oligonucleotide
  Target: SCN10A; (+) strand; PAM type: YTN; PAM sequence: TTT
tctgtccagctgtgactcta

SEQ ID NO: 74325 - DNA, 20 bp, Artificial Sequence
  Description of Artificial Sequence: Synthetic oligonucleotide
  Target: SCN10A; (+) strand; PAM type: YTN; PAM sequence: TTT
ctgtccagctgtgactctac

SEQ ID NO: 74326 - DNA, 20 bp, Artificial Sequence
  Description of Artificial Sequence: Synthetic oligonucleotide
  Target: SCN10A; (+) strand; PAM type: YTN; PAM sequence: TTC
tgtccagctgtgactctacc

SEQ ID NO: 74327 - DNA, 20 bp, Artificial Sequence
  Description of Artificial Sequence: Synthetic oligonucleotide
  Target: SCN10A; (+) strand; PAM type: YTN; PAM sequence: CTG
tccagctgtgactctaccaa

SEQ ID NO: 74328 - DNA, 20 bp, Artificial Sequence
  Description of Artificial Sequence: Synthetic oligonucleotide
  Target: SCN10A; (+) strand; PAM type: YTN; PAM sequence: CTG
tgactctaccaagcaattat

SEQ ID NO: 74329 - DNA, 20 bp, Artificial Sequence
  Description of Artificial Sequence: Synthetic oligonucleotide
  Target: SCN10A; (+) strand; PAM type: YTN; PAM sequence: CTC
taccaagcaattatttactc

SEQ ID NO: 74330 - DNA, 20 bp, Artificial Sequence
  Description of Artificial Sequence: Synthetic oligonucleotide
  Target: SCN10A; (+) strand; PAM type: YTN; PAM sequence: CTA
ccaagcaattatttactcat

SEQ ID NO: 74331 - DNA, 20 bp, Artificial Sequence
  Description of Artificial Sequence: Synthetic oligonucleotide
  Target: SCN10A; (+) strand; PAM type: YTN; PAM sequence: TTA
tttactcatcaaatctcaag

SEQ ID NO: 74332 - DNA, 20 bp, Artificial Sequence
  Description of Artificial Sequence: Synthetic oligonucleotide
  Target: SCN10A; (+) strand; PAM type: YTN; PAM sequence: TTT
actcatcaaatctcaagatg

SEQ ID NO: 74333 - DNA, 20 bp, Artificial Sequence
  Description of Artificial Sequence: Synthetic oligonucleotide
  Target: SCN10A; (+) strand; PAM type: YTN; PAM sequence: TTA
ctcatcaaatctcaagatga

SEQ ID NO: 74334 - DNA, 20 bp, Artificial Sequence
  Description of Artificial Sequence: Synthetic oligonucleotide
  Target: SCN10A; (+) strand; PAM type: YTN; PAM sequence: CTC
atcaaatctcaagatgaaga

SEQ ID NO: 74335 - DNA, 20 bp, Artificial Sequence
  Description of Artificial Sequence: Synthetic oligonucleotide
  Target: SCN10A; (+) strand; PAM type: YTN; PAM sequence: CTC
aagatgaagagaatattcac

SEQ ID NO: 74336 - DNA, 20 bp, Artificial Sequence
  Description of Artificial Sequence: Synthetic oligonucleotide
  Target: SCN10A; (+) strand; PAM type: YTN; PAM sequence: TTC
actggtcacttggttctttt

SEQ ID NO: 74337 - DNA, 20 bp, Artificial Sequence
  Description of Artificial Sequence: Synthetic oligonucleotide
  Target: SCN10A; (+) strand; PAM type: YTN; PAM sequence: CTG
gtcacttggttctttttagg

SEQ ID NO: 74338 - DNA, 20 bp, Artificial Sequence
  Description of Artificial Sequence: Synthetic oligonucleotide
  Target: SCN10A; (+) strand; PAM type: YTN; PAM sequence: CTT
ggttctttttaggggatttt

SEQ ID NO: 74339 - DNA, 20 bp, Artificial Sequence
  Description of Artificial Sequence: Synthetic oligonucleotide
  Target: SCN10A; (+) strand; PAM type: YTN; PAM sequence: TTG
gttctttttaggggatttta

SEQ ID NO: 74340 - DNA, 20 bp, Artificial Sequence
  Description of Artificial Sequence: Synthetic oligonucleotide
  Target: SCN10A; (+) strand; PAM type: YTN; PAM sequence: TTC
tttttaggggattttatttc

SEQ ID NO: 74341 - DNA, 20 bp, Artificial Sequence
  Description of Artificial Sequence: Synthetic oligonucleotide
  Target: SCN10A; (+) strand; PAM type: YTN; PAM sequence: CTT
tttaggggattttatttcta

SEQ ID NO: 74342 - DNA, 20 bp, Artificial Sequence
  Description of Artificial Sequence: Synthetic oligonucleotide
  Target: SCN10A; (+) strand; PAM type: YTN; PAM sequence: TTT
ttaggggattttatttctaa

SEQ ID NO: 74343 - DNA, 20 bp, Artificial Sequence
  Description of Artificial Sequence: Synthetic oligonucleotide
  Target: SCN10A; (+) strand; PAM type: YTN; PAM sequence: TTT
taggggattttatttctaat

SEQ ID NO: 74344 - DNA, 20 bp, Artificial Sequence
  Description of Artificial Sequence: Synthetic oligonucleotide
  Target: SCN10A; (+) strand; PAM type: YTN; PAM sequence: TTT
aggggattttatttctaatt

SEQ ID NO: 74345 - DNA, 20 bp, Artificial Sequence
  Description of Artificial Sequence: Synthetic oligonucleotide
  Target: SCN10A; (+) strand; PAM type: YTN; PAM sequence: TTA
ggggattttatttctaatta

SEQ ID NO: 74346 - DNA, 20 bp, Artificial Sequence
  Description of Artificial Sequence: Synthetic oligonucleotide
  Target: SCN10A; (+) strand; PAM type: YTN; PAM sequence: TTT
tatttctaattagctgtttc

SEQ ID NO: 74347 - DNA, 20 bp, Artificial Sequence
  Description of Artificial Sequence: Synthetic oligonucleotide
  Target: SCN10A; (+) strand; PAM type: YTN; PAM sequence: TTT
atttctaattagctgtttct

SEQ ID NO: 74348 - DNA, 20 bp, Artificial Sequence
  Description of Artificial Sequence: Synthetic oligonucleotide
  Target: SCN10A; (+) strand; PAM type: YTN; PAM sequence: TTA
tttctaattagctgtttctt

SEQ ID NO: 74349 - DNA, 20 bp, Artificial Sequence
  Description of Artificial Sequence: Synthetic oligonucleotide
  Target: SCN10A; (+) strand; PAM type: YTN; PAM sequence: TTT
ctaattagctgtttcttact

SEQ ID NO: 74350 - DNA, 20 bp, Artificial Sequence
  Description of Artificial Sequence: Synthetic oligonucleotide
  Target: SCN10A; (+) strand; PAM type: YTN; PAM sequence: TTC
taattagctgtttcttactt

SEQ ID NO: 74351 - DNA, 20 bp, Artificial Sequence
  Description of Artificial Sequence: Synthetic oligonucleotide
  Target: SCN10A; (+) strand; PAM type: YTN; PAM sequence: CTA
attagctgtttcttacttat

SEQ ID NO: 74352 - DNA, 20 bp, Artificial Sequence
  Description of Artificial Sequence: Synthetic oligonucleotide
  Target: SCN10A; (+) strand; PAM type: YTN; PAM sequence: TTA
gctgtttcttacttatccag

SEQ ID NO: 74353 - DNA, 20 bp, Artificial Sequence
  Description of Artificial Sequence: Synthetic oligonucleotide
  Target: SCN10A; (+) strand; PAM type: YTN; PAM sequence: CTG
tttcttacttatccagatgt

SEQ ID NO: 74354 - DNA, 20 bp, Artificial Sequence
  Description of Artificial Sequence: Synthetic oligonucleotide
  Target: SCN10A; (+) strand; PAM type: YTN; PAM sequence: TTT
cttacttatccagatgtaat

SEQ ID NO: 74355 - DNA, 20 bp, Artificial Sequence
  Description of Artificial Sequence: Synthetic oligonucleotide
  Target: SCN10A; (+) strand; PAM type: YTN; PAM sequence: TTC
ttacttatccagatgtaatt

SEQ ID NO: 74356 - DNA, 20 bp, Artificial Sequence
  Description of Artificial Sequence: Synthetic oligonucleotide
  Target: SCN10A; (+) strand; PAM type: YTN; PAM sequence: CTT
acttatccagatgtaattca

SEQ ID NO: 74357 - DNA, 20 bp, Artificial Sequence
  Description of Artificial Sequence: Synthetic oligonucleotide
  Target: SCN10A; (+) strand; PAM type: YTN; PAM sequence: TTA
cttatccagatgtaattcaa

SEQ ID NO: 74358 - DNA, 20 bp, Artificial Sequence
  Description of Artificial Sequence: Synthetic oligonucleotide
  Target: SCN10A; (+) strand; PAM type: YTN; PAM sequence: CTT
atccagatgtaattcaacca

SEQ ID NO: 74359 - DNA, 20 bp, Artificial Sequence
  Description of Artificial Sequence: Synthetic oligonucleotide
  Target: SCN10A; (+) strand; PAM type: YTN; PAM sequence: TTA
tccagatgtaattcaaccag

SEQ ID NO: 74360 - DNA, 20 bp, Artificial Sequence
  Description of Artificial Sequence: Synthetic oligonucleotide
  Target: SCN10A; (+) strand; PAM type: YTN; PAM sequence: TTC
aaccagaatccataaagagg

SEQ ID NO: 74361 - DNA, 20 bp, Artificial Sequence
  Description of Artificial Sequence: Synthetic oligonucleotide
  Target: SCN10A; (+) strand; PAM type: YTN; PAM sequence: TTT
gtatgtttgtgatttctctt

SEQ ID NO: 74362 - DNA, 20 bp, Artificial Sequence
  Description of Artificial Sequence: Synthetic oligonucleotide
  Target: SCN10A; (+) strand; PAM type: YTN; PAM sequence: TTG
tatgtttgtgatttctcttt

SEQ ID NO: 74363 - DNA, 20 bp, Artificial Sequence
  Description of Artificial Sequence: Synthetic oligonucleotide
  Target: SCN10A; (+) strand; PAM type: YTN; PAM sequence: TTT
gtgatttctctttatttgta

SEQ ID NO: 74364 - DNA, 20 bp, Artificial Sequence
  Description of Artificial Sequence: Synthetic oligonucleotide
  Target: SCN10A; (+) strand; PAM type: YTN; PAM sequence: TTG
tgatttctctttatttgtaa

SEQ ID NO: 74365 - DNA, 20 bp, Artificial Sequence
  Description of Artificial Sequence: Synthetic oligonucleotide
  Target: SCN10A; (+) strand; PAM type: YTN; PAM sequence: TTT
ctctttatttgtaatttcca

SEQ ID NO: 74366 - DNA, 20 bp, Artificial Sequence
  Description of Artificial Sequence: Synthetic oligonucleotide
  Target: SCN10A; (+) strand; PAM type: YTN; PAM sequence: TTC
tctttatttgtaatttccat

SEQ ID NO: 74367 - DNA, 20 bp, Artificial Sequence
  Description of Artificial Sequence: Synthetic oligonucleotide
  Target: SCN10A; (+) strand; PAM type: YTN; PAM sequence: CTC
tttatttgtaatttccatgt

SEQ ID NO: 74368 - DNA, 20 bp, Artificial Sequence
  Description of Artificial Sequence: Synthetic oligonucleotide
  Target: SCN10A; (+) strand; PAM type: YTN; PAM sequence: CTT
tatttgtaatttccatgtaa

SEQ ID NO: 74369 - DNA, 20 bp, Artificial Sequence
  Description of Artificial Sequence: Synthetic oligonucleotide
  Target: SCN10A; (+) strand; PAM type: YTN; PAM sequence: TTT
atttgtaatttccatgtaat

SEQ ID NO: 74370 - DNA, 20 bp, Artificial Sequence
  Description of Artificial Sequence: Synthetic oligonucleotide
  Target: SCN10A; (+) strand; PAM type: YTN; PAM sequence: TTA
tttgtaatttccatgtaatt

SEQ ID NO: 74371 - DNA, 20 bp, Artificial Sequence
  Description of Artificial Sequence: Synthetic oligonucleotide
  Target: SCN10A; (+) strand; PAM type: YTN; PAM sequence: TTT
gtaatttccatgtaattgta

SEQ ID NO: 74372 - DNA, 20 bp, Artificial Sequence
  Description of Artificial Sequence: Synthetic oligonucleotide
  Target: SCN10A; (+) strand; PAM type: YTN; PAM sequence: TTG
taatttccatgtaattgtat

SEQ ID NO: 74373 - DNA, 20 bp, Artificial Sequence
  Description of Artificial Sequence: Synthetic oligonucleotide
  Target: SCN10A; (+) strand; PAM type: YTN; PAM sequence: TTT
ccatgtaattgtatatattt

SEQ ID NO: 74374 - DNA, 20 bp, Artificial Sequence
  Description of Artificial Sequence: Synthetic oligonucleotide
  Target: SCN10A; (+) strand; PAM type: YTN; PAM sequence: TTC
catgtaattgtatatatttt

SEQ ID NO: 74375 - DNA, 20 bp, Artificial Sequence
  Description of Artificial Sequence: Synthetic oligonucleotide
  Target: SCN10A; (+) strand; PAM type: YTN; PAM sequence: TTG
tatatattttgaaaaagcaa

SEQ ID NO: 74376 - DNA, 20 bp, Artificial Sequence
  Description of Artificial Sequence: Synthetic oligonucleotide
  Target: SCN10A; (+) strand; PAM type: YTN; PAM sequence: TTT
tgaaaaagcaacaactaccc

SEQ ID NO: 74377 - DNA, 20 bp, Artificial Sequence
  Description of Artificial Sequence: Synthetic oligonucleotide
  Target: SCN10A; (+) strand; PAM type: YTN; PAM sequence: TTT
gaaaaagcaacaactaccca

SEQ ID NO: 74378 - DNA, 20 bp, Artificial Sequence
  Description of Artificial Sequence: Synthetic oligonucleotide
  Target: SCN10A; (+) strand; PAM type: YTN; PAM sequence: TTG
aaaaagcaacaactacccaa

SEQ ID NO: 74379 - DNA, 20 bp, Artificial Sequence
  Description of Artificial Sequence: Synthetic oligonucleotide
  Target: SCN10A; (+) strand; PAM type: YTN; PAM sequence: CTA
cccaagcagagacgacacat

SEQ ID NO: 74380 - DNA, 20 bp, Artificial Sequence
  Description of Artificial Sequence: Synthetic oligonucleotide
  Target: SCN10A; (+) strand; PAM type: YTN; PAM sequence: TTG
agagaataattaccctgatt

SEQ ID NO: 74381 - DNA, 20 bp, Artificial Sequence
  Description of Artificial Sequence: Synthetic oligonucleotide
  Target: SCN10A; (+) strand; PAM type: YTN; PAM sequence: TTA
ccctgattactttccaccct

SEQ ID NO: 74382 - DNA, 20 bp, Artificial Sequence
  Description of Artificial Sequence: Synthetic oligonucleotide
  Target: SCN10A; (+) strand; PAM type: YTN; PAM sequence: CTG
attactttccaccctacttc

SEQ ID NO: 74383 - DNA, 20 bp, Artificial Sequence
  Description of Artificial Sequence: Synthetic oligonucleotide
  Target: SCN10A; (+) strand; PAM type: YTN; PAM sequence: TTA
ctttccaccctacttcctca

SEQ ID NO: 74384 - DNA, 20 bp, Artificial Sequence
  Description of Artificial Sequence: Synthetic oligonucleotide
  Target: SCN10A; (+) strand; PAM type: YTN; PAM sequence: CTT
tccaccctacttcctcactg

SEQ ID NO: 74385 - DNA, 20 bp, Artificial Sequence
  Description of Artificial Sequence: Synthetic oligonucleotide
  Target: SCN10A; (+) strand; PAM type: YTN; PAM sequence: TTT
ccaccctacttcctcactgt

SEQ ID NO: 74386 - DNA, 20 bp, Artificial Sequence
  Description of Artificial Sequence: Synthetic oligonucleotide
  Target: SCN10A; (+) strand; PAM type: YTN; PAM sequence: TTC
caccctacttcctcactgta

SEQ ID NO: 74387 - DNA, 20 bp, Artificial Sequence
  Description of Artificial Sequence: Synthetic oligonucleotide
  Target: SCN10A; (+) strand; PAM type: YTN; PAM sequence: CTA
cttcctcactgtagatactg

SEQ ID NO: 74388 - DNA, 20 bp, Artificial Sequence
  Description of Artificial Sequence: Synthetic oligonucleotide
  Target: SCN10A; (+) strand; PAM type: YTN; PAM sequence: CTT
cctcactgtagatactgctc

SEQ ID NO: 74389 - DNA, 20 bp, Artificial Sequence
  Description of Artificial Sequence: Synthetic oligonucleotide
  Target: SCN10A; (+) strand; PAM type: YTN; PAM sequence: TTC
ctcactgtagatactgctct

SEQ ID NO: 74390 - DNA, 20 bp, Artificial Sequence
  Description of Artificial Sequence: Synthetic oligonucleotide
  Target: SCN10A; (+) strand; PAM type: YTN; PAM sequence: CTC
actgtagatactgctctacg

SEQ ID NO: 74391 - DNA, 20 bp, Artificial Sequence
  Description of Artificial Sequence: Synthetic oligonucleotide
  Target: SCN10A; (+) strand; PAM type: YTN; PAM sequence: CTG
tagatactgctctacgcagg

SEQ ID NO: 74392 - DNA, 20 bp, Artificial Sequence
  Description of Artificial Sequence: Synthetic oligonucleotide
  Target: SCN10A; (+) strand; PAM type: YTN; PAM sequence: CTG
ctctacgcaggatgcaggct

SEQ ID NO: 74393 - DNA, 20 bp, Artificial Sequence
  Description of Artificial Sequence: Synthetic oligonucleotide
  Target: SCN10A; (+) strand; PAM type: YTN; PAM sequence: CTC
tacgcaggatgcaggctgga

SEQ ID NO: 74394 - DNA, 20 bp, Artificial Sequence
  Description of Artificial Sequence: Synthetic oligonucleotide
  Target: SCN10A; (+) strand; PAM type: YTN; PAM sequence: CTA
cgcaggatgcaggctggact

SEQ ID NO: 74395 - DNA, 20 bp, Artificial Sequence
  Description of Artificial Sequence: Synthetic oligonucleotide
  Target: SCN10A; (+) strand; PAM type: YTN; PAM sequence: CTG
gacttcttaactagctacat

SEQ ID NO: 74396 - DNA, 20 bp, Artificial Sequence
  Description of Artificial Sequence: Synthetic oligonucleotide
  Target: SCN10A; (+) strand; PAM type: YTN; PAM sequence: CTT
cttaactagctacatggtct

SEQ ID NO: 74397 - DNA, 20 bp, Artificial Sequence
  Description of Artificial Sequence: Synthetic oligonucleotide
  Target: SCN10A; (+) strand; PAM type: YTN; PAM sequence: TTC
ttaactagctacatggtctt

SEQ ID NO: 74398 - DNA, 20 bp, Artificial Sequence
  Description of Artificial Sequence: Synthetic oligonucleotide
  Target: SCN10A; (+) strand; PAM type: YTN; PAM sequence: CTT
aactagctacatggtcttgg

SEQ ID NO: 74399 - DNA, 20 bp, Artificial Sequence
  Description of Artificial Sequence: Synthetic oligonucleotide
  Target: SCN10A; (+) strand; PAM type: YTN; PAM sequence: TTA
actagctacatggtcttgga

SEQ ID NO: 74400 - DNA, 20 bp, Artificial Sequence
  Description of Artificial Sequence: Synthetic oligonucleotide
  Target: SCN10A; (+) strand; PAM type: YTN; PAM sequence: CTA
gctacatggtcttggataat

SEQ ID NO: 74401 - DNA, 20 bp, Artificial Sequence
  Description of Artificial Sequence: Synthetic oligonucleotide
  Target: SCN10A; (+) strand; PAM type: YTN; PAM sequence: CTA
catggtcttggataatttac

SEQ ID NO: 74402 - DNA, 20 bp, Artificial Sequence
  Description of Artificial Sequence: Synthetic oligonucleotide
  Target: SCN10A; (+) strand; PAM type: YTN; PAM sequence: CTT
ggataatttacttaatgcct

SEQ ID NO: 74403 - DNA, 20 bp, Artificial Sequence
  Description of Artificial Sequence: Synthetic oligonucleotide
  Target: SCN10A; (+) strand; PAM type: YTN; PAM sequence: TTG
gataatttacttaatgcctc

SEQ ID NO: 74404 - DNA, 20 bp, Artificial Sequence
  Description of Artificial Sequence: Synthetic oligonucleotide
  Target: SCN10A; (+) strand; PAM type: YTN; PAM sequence: TTT
acttaatgcctctgtgtgtc

SEQ ID NO: 74405 - DNA, 20 bp, Artificial Sequence
  Description of Artificial Sequence: Synthetic oligonucleotide
  Target: SCN10A; (+) strand; PAM type: YTN; PAM sequence: TTA
cttaatgcctctgtgtgtca

SEQ ID NO: 74406 - DNA, 20 bp, Artificial Sequence
  Description of Artificial Sequence: Synthetic oligonucleotide
  Target: SCN10A; (+) strand; PAM type: YTN; PAM sequence: CTT
aatgcctctgtgtgtcagtt

SEQ ID NO: 74407 - DNA, 20 bp, Artificial Sequence
  Description of Artificial Sequence: Synthetic oligonucleotide
  Target: SCN10A; (+) strand; PAM type: YTN; PAM sequence: TTA
atgcctctgtgtgtcagttt

SEQ ID NO: 74408 - DNA, 20 bp, Artificial Sequence
  Description of Artificial Sequence: Synthetic oligonucleotide
  Target: SCN10A; (+) strand; PAM type: YTN; PAM sequence: CTC
tgtgtgtcagtttcattatc

SEQ ID NO: 74409 - DNA, 20 bp, Artificial Sequence
  Description of Artificial Sequence: Synthetic oligonucleotide
  Target: SCN10A; (+) strand; PAM type: YTN; PAM sequence: CTG
tgtgtcagtttcattatctg

SEQ ID NO: 74410 - DNA, 20 bp, Artificial Sequence
  Description of Artificial Sequence: Synthetic oligonucleotide
  Target: SCN10A; (+) strand; PAM type: YTN; PAM sequence: TTT
cattatctgtaaaatgggga

SEQ ID NO: 74411 - DNA, 20 bp, Artificial Sequence
  Description of Artificial Sequence: Synthetic oligonucleotide
  Target: SCN10A; (+) strand; PAM type: YTN; PAM sequence: TTC
attatctgtaaaatggggat

SEQ ID NO: 74412 - DNA, 20 bp, Artificial Sequence
  Description of Artificial Sequence: Synthetic oligonucleotide
  Target: SCN10A; (+) strand; PAM type: YTN; PAM sequence: TTA
tctgtaaaatggggatggta

SEQ ID NO: 74413 - DNA, 20 bp, Artificial Sequence
  Description of Artificial Sequence: Synthetic oligonucleotide
  Target: SCN10A; (+) strand; PAM type: YTN; PAM sequence: CTG
taaaatggggatggtaatct

SEQ ID NO: 74414 - DNA, 20 bp, Artificial Sequence
  Description of Artificial Sequence: Synthetic oligonucleotide
  Target: SCN10A; (+) strand; PAM type: YTN; PAM sequence: CTC
tacttcagaggcttttgaac

SEQ ID NO: 74415 - DNA, 20 bp, Artificial Sequence
  Description of Artificial Sequence: Synthetic oligonucleotide
  Target: SCN10A; (+) strand; PAM type: YTN; PAM sequence: CTA
cttcagaggcttttgaactg

SEQ ID NO: 74416 - DNA, 20 bp, Artificial Sequence
  Description of Artificial Sequence: Synthetic oligonucleotide
  Target: SCN10A; (+) strand; PAM type: YTN; PAM sequence: CTT
cagaggcttttgaactgatg

SEQ ID NO: 74417 - DNA, 20 bp, Artificial Sequence
  Description of Artificial Sequence: Synthetic oligonucleotide
  Target: SCN10A; (+) strand; PAM type: YTN; PAM sequence: TTC
agaggcttttgaactgatga

SEQ ID NO: 74418 - DNA, 20 bp, Artificial Sequence
  Description of Artificial Sequence: Synthetic oligonucleotide
  Target: SCN10A; (+) strand; PAM type: YTN; PAM sequence: CTT
ttgaactgatgatggtattg

SEQ ID NO: 74419 - DNA, 20 bp, Artificial Sequence
  Description of Artificial Sequence: Synthetic oligonucleotide
  Target: SCN10A; (+) strand; PAM type: YTN; PAM sequence: TTT
tgaactgatgatggtattga

SEQ ID NO: 74420 - DNA, 20 bp, Artificial Sequence
  Description of Artificial Sequence: Synthetic oligonucleotide
  Target: SCN10A; (+) strand; PAM type: YTN; PAM sequence: TTT
gaactgatgatggtattgac

SEQ ID NO: 74421 - DNA, 20 bp, Artificial Sequence
  Description of Artificial Sequence: Synthetic oligonucleotide
  Target: SCN10A; (+) strand; PAM type: YTN; PAM sequence: TTG
aactgatgatggtattgaca

SEQ ID NO: 74422 - DNA, 20 bp, Artificial Sequence
  Description of Artificial Sequence: Synthetic oligonucleotide
  Target: SCN10A; (+) strand; PAM type: YTN; PAM sequence: CTG
atgatggtattgacacttag

SEQ ID NO: 74423 - DNA, 20 bp, Artificial Sequence
  Description of Artificial Sequence: Synthetic oligonucleotide
  Target: SCN10A; (+) strand; PAM type: YTN; PAM sequence: TTG
acacttaggaagtatttagc

SEQ ID NO: 74424 - DNA, 20 bp, Artificial Sequence
  Description of Artificial Sequence: Synthetic oligonucleotide
  Target: SCN10A; (+) strand; PAM type: YTN; PAM sequence: CTT
aggaagtatttagcaagtga

SEQ ID NO: 74425 - DNA, 20 bp, Artificial Sequence
  Description of Artificial Sequence: Synthetic oligonucleotide
  Target: SCN10A; (+) strand; PAM type: YTN; PAM sequence: TTA
ggaagtatttagcaagtgag

SEQ ID NO: 74426 - DNA, 20 bp, Artificial Sequence
  Description of Artificial Sequence: Synthetic oligonucleotide
  Target: SCN10A; (+) strand; PAM type: YTN; PAM sequence: TTT
agcaagtgagagactgtatt

SEQ ID NO: 74427 - DNA, 20 bp, Artificial Sequence
  Description of Artificial Sequence: Synthetic oligonucleotide
  Target: SCN10A; (+) strand; PAM type: YTN; PAM sequence: TTA
gcaagtgagagactgtattg

SEQ ID NO: 74428 - DNA, 20 bp, Artificial Sequence
  Description of Artificial Sequence: Synthetic oligonucleotide
  Target: SCN10A; (+) strand; PAM type: YTN; PAM sequence: CTG
tattgtcattaaatatcctt

SEQ ID NO: 74429 - DNA, 20 bp, Artificial Sequence
  Description of Artificial Sequence: Synthetic oligonucleotide
  Target: SCN10A; (+) strand; PAM type: YTN; PAM sequence: TTG
tcattaaatatccttctgta

SEQ ID NO: 74430 - DNA, 20 bp, Artificial Sequence
  Description of Artificial Sequence: Synthetic oligonucleotide
  Target: SCN10A; (+) strand; PAM type: YTN; PAM sequence: TTA
aatatccttctgtagaatct

SEQ ID NO: 74431 - DNA, 20 bp, Artificial Sequence
  Description of Artificial Sequence: Synthetic oligonucleotide
  Target: SCN10A; (+) strand; PAM type: YTN; PAM sequence: CTT
ctgtagaatctgaaaattca

SEQ ID NO: 74432 - DNA, 20 bp, Artificial Sequence
  Description of Artificial Sequence: Synthetic oligonucleotide
  Target: SCN10A; (+) strand; PAM type: YTN; PAM sequence: TTC
tgtagaatctgaaaattcaa

SEQ ID NO: 74433 - DNA, 20 bp, Artificial Sequence
  Description of Artificial Sequence: Synthetic oligonucleotide
  Target: SCN10A; (+) strand; PAM type: YTN; PAM sequence: CTG
tagaatctgaaaattcaaga

SEQ ID NO: 74434 - DNA, 20 bp, Artificial Sequence
  Description of Artificial Sequence: Synthetic oligonucleotide
  Target: SCN10A; (+) strand; PAM type: YTN; PAM sequence: CTG
aaaattcaagattcagctca

SEQ ID NO: 74435 - DNA, 20 bp, Artificial Sequence
  Description of Artificial Sequence: Synthetic oligonucleotide
  Target: SCN10A; (+) strand; PAM type: YTN; PAM sequence: TTC
aagattcagctcagaaaacg

SEQ ID NO: 74436 - DNA, 20 bp, Artificial Sequence
  Description of Artificial Sequence: Synthetic oligonucleotide
  Target: SCN10A; (+) strand; PAM type: YTN; PAM sequence: TTC
agctcagaaaacgtaattct

SEQ ID NO: 74437 - DNA, 20 bp, Artificial Sequence
  Description of Artificial Sequence: Synthetic oligonucleotide
  Target: SCN10A; (+) strand; PAM type: YTN; PAM sequence: CTC
agaaaacgtaattcttgctg

SEQ ID NO: 74438 - DNA, 20 bp, Artificial Sequence
  Description of Artificial Sequence: Synthetic oligonucleotide
  Target: SCN10A; (+) strand; PAM type: YTN; PAM sequence: TTC
ttgctggccagccagaaaga

SEQ ID NO: 74439 - DNA, 20 bp, Artificial Sequence
  Description of Artificial Sequence: Synthetic oligonucleotide
  Target: SCN10A; (+) strand; PAM type: YTN; PAM sequence: CTT
gctggccagccagaaagaaa

SEQ ID NO: 74440 - DNA, 20 bp, Artificial Sequence
  Description of Artificial Sequence: Synthetic oligonucleotide
  Target: SCN10A; (+) strand; PAM type: YTN; PAM sequence: TTG
ctggccagccagaaagaaaa

SEQ ID NO: 74441 - DNA, 20 bp, Artificial Sequence
  Description of Artificial Sequence: Synthetic oligonucleotide
  Target: SCN10A; (+) strand; PAM type: YTN; PAM sequence: CTG
gccagccagaaagaaaaaaa

SEQ ID NO: 74442 - DNA, 20 bp, Artificial Sequence
  Description of Artificial Sequence: Synthetic oligonucleotide
  Target: SCN10A; (+) strand; PAM type: YTN; PAM sequence: CTT
catcaagctgtgcagcttca

SEQ ID NO: 74443 - DNA, 20 bp, Artificial Sequence
  Description of Artificial Sequence: Synthetic oligonucleotide
  Target: SCN10A; (+) strand; PAM type: YTN; PAM sequence: TTC
atcaagctgtgcagcttcat

SEQ ID NO: 74444 - DNA, 20 bp, Artificial Sequence
  Description of Artificial Sequence: Synthetic oligonucleotide
  Target: SCN10A; (+) strand; PAM type: YTN; PAM sequence: CTG
tgcagcttcatgttgagtgt

SEQ ID NO: 74445 - DNA, 20 bp, Artificial Sequence
  Description of Artificial Sequence: Synthetic oligonucleotide
  Target: SCN10A; (+) strand; PAM type: YTN; PAM sequence: CTT
catgttgagtgtgcagatag

SEQ ID NO: 74446 - DNA, 20 bp, Artificial Sequence
  Description of Artificial Sequence: Synthetic oligonucleotide
  Target: SCN10A; (+) strand; PAM type: YTN; PAM sequence: TTC
atgttgagtgtgcagataga

SEQ ID NO: 74447 - DNA, 20 bp, Artificial Sequence
  Description of Artificial Sequence: Synthetic oligonucleotide
  Target: SCN10A; (+) strand; PAM type: YTN; PAM sequence: TTG
agtgtgcagatagatgactg

SEQ ID NO: 74448 - DNA, 20 bp, Artificial Sequence
  Description of Artificial Sequence: Synthetic oligonucleotide
  Target: SCN10A; (+) strand; PAM type: YTN; PAM sequence: CTG
tgccaaggttaccagctcaa

SEQ ID NO: 74449 - DNA, 20 bp, Artificial Sequence
  Description of Artificial Sequence: Synthetic oligonucleotide
  Target: SCN10A; (+) strand; PAM type: YTN; PAM sequence: TTA
ccagctcaatgacaactgtc

SEQ ID NO: 74450 - DNA, 20 bp, Artificial Sequence
  Description of Artificial Sequence: Synthetic oligonucleotide
  Target: SCN10A; (+) strand; PAM type: YTN; PAM sequence: CTC
aatgacaactgtccagaaat

SEQ ID NO: 74451 - DNA, 20 bp, Artificial Sequence
  Description of Artificial Sequence: Synthetic oligonucleotide
  Target: SCN10A; (+) strand; PAM type: YTN; PAM sequence: CTG
tccagaaatccaacaatctg

SEQ ID NO: 74452 - DNA, 20 bp, Artificial Sequence
  Description of Artificial Sequence: Synthetic oligonucleotide
  Target: SCN10A; (+) strand; PAM type: YTN; PAM sequence: CTG
cctcagagttagggagcagg

SEQ ID NO: 74453 - DNA, 20 bp, Artificial Sequence
  Description of Artificial Sequence: Synthetic oligonucleotide
  Target: SCN10A; (+) strand; PAM type: YTN; PAM sequence: CTC
agagttagggagcagggtag

SEQ ID NO: 74454 - DNA, 20 bp, Artificial Sequence
  Description of Artificial Sequence: Synthetic oligonucleotide
  Target: SCN10A; (+) strand; PAM type: YTN; PAM sequence: TTA
gggagcagggtagaactctt

SEQ ID NO: 74455 - DNA, 20 bp, Artificial Sequence
  Description of Artificial Sequence: Synthetic oligonucleotide
  Target: SCN10A; (+) strand; PAM type: YTN; PAM sequence: CTC
ttttttactgaagccttcta

SEQ ID NO: 74456 - DNA, 20 bp, Artificial Sequence
  Description of Artificial Sequence: Synthetic oligonucleotide
  Target: SCN10A; (+) strand; PAM type: YTN; PAM sequence: CTT
ttttactgaagccttctaag

SEQ ID NO: 74457 - DNA, 20 bp, Artificial Sequence
  Description of Artificial Sequence: Synthetic oligonucleotide
  Target: SCN10A; (+) strand; PAM type: YTN; PAM sequence: TTT
tttactgaagccttctaaga

SEQ ID NO: 74458 - DNA, 20 bp, Artificial Sequence
  Description of Artificial Sequence: Synthetic oligonucleotide
  Target: SCN10A; (+) strand; PAM type: YTN; PAM sequence: TTT
ttactgaagccttctaagaa

SEQ ID NO: 74459 - DNA, 20 bp, Artificial Sequence
  Description of Artificial Sequence: Synthetic oligonucleotide
  Target: SCN10A; (+) strand; PAM type: YTN; PAM sequence: TTT
tactgaagccttctaagaaa

SEQ ID NO: 74460 - DNA, 20 bp, Artificial Sequence
  Description of Artificial Sequence: Synthetic oligonucleotide
  Target: SCN10A; (+) strand; PAM type: YTN; PAM sequence: TTT
actgaagccttctaagaaaa

SEQ ID NO: 74461 - DNA, 20 bp, Artificial Sequence
  Description of Artificial Sequence: Synthetic oligonucleotide
  Target: SCN10A; (+) strand; PAM type: YTN; PAM sequence: TTA
ctgaagccttctaagaaaag

SEQ ID NO: 74462 - DNA, 20 bp, Artificial Sequence
  Description of Artificial Sequence: Synthetic oligonucleotide
  Target: SCN10A; (+) strand; PAM type: YTN; PAM sequence: CTG
aagccttctaagaaaaggct

SEQ ID NO: 74463 - DNA, 20 bp, Artificial Sequence
  Description of Artificial Sequence: Synthetic oligonucleotide
  Target: SCN10A; (+) strand; PAM type: YTN; PAM sequence: CTT
ctaagaaaaggctggttacc

SEQ ID NO: 74464 - DNA, 20 bp, Artificial Sequence
  Description of Artificial Sequence: Synthetic oligonucleotide
  Target: SCN10A; (+) strand; PAM type: YTN; PAM sequence: TTC
taagaaaaggctggttacca

SEQ ID NO: 74465 - DNA, 20 bp, Artificial Sequence
  Description of Artificial Sequence: Synthetic oligonucleotide
  Target: SCN10A; (+) strand; PAM type: YTN; PAM sequence: CTA
agaaaaggctggttaccatt

SEQ ID NO: 74466 - DNA, 20 bp, Artificial Sequence
  Description of Artificial Sequence: Synthetic oligonucleotide
  Target: SCN10A; (+) strand; PAM type: YTN; PAM sequence: CTG
gttaccatttgtcaggcaac

SEQ ID NO: 74467 - DNA, 20 bp, Artificial Sequence
  Description of Artificial Sequence: Synthetic oligonucleotide
  Target: SCN10A; (+) strand; PAM type: YTN; PAM sequence: TTA
ccatttgtcaggcaactgag

SEQ ID NO: 74468 - DNA, 20 bp, Artificial Sequence
  Description of Artificial Sequence: Synthetic oligonucleotide
  Target: SCN10A; (+) strand; PAM type: YTN; PAM sequence: TTT
gtcaggcaactgaggcaggt

SEQ ID NO: 74469 - DNA, 20 bp, Artificial Sequence
  Description of Artificial Sequence: Synthetic oligonucleotide
  Target: SCN10A; (+) strand; PAM type: YTN; PAM sequence: TTG
tcaggcaactgaggcaggtg

SEQ ID NO: 74470 - DNA, 20 bp, Artificial Sequence
  Description of Artificial Sequence: Synthetic oligonucleotide
  Target: SCN10A; (+) strand; PAM type: YTN; PAM sequence: CTG
aggcaggtgtattcttgtac

SEQ ID NO: 74471 - DNA, 20 bp, Artificial Sequence
  Description of Artificial Sequence: Synthetic oligonucleotide
  Target: SCN10A; (+) strand; PAM type: YTN; PAM sequence: TTC
ttgtacatcaacctcctgca

SEQ ID NO: 74472 - DNA, 20 bp, Artificial Sequence
  Description of Artificial Sequence: Synthetic oligonucleotide
  Target: SCN10A; (+) strand; PAM type: YTN; PAM sequence: CTT
gtacatcaacctcctgcaag

SEQ ID NO: 74473 - DNA, 20 bp, Artificial Sequence
  Description of Artificial Sequence: Synthetic oligonucleotide
  Target: SCN10A; (+) strand; PAM type: YTN; PAM sequence: TTG
tacatcaacctcctgcaagc

SEQ ID NO: 74474 - DNA, 20 bp, Artificial Sequence
  Description of Artificial Sequence: Synthetic oligonucleotide
  Target: SCN10A; (+) strand; PAM type: YTN; PAM sequence: CTC
ctgcaagccagggctaaatt

SEQ ID NO: 74475 - DNA, 20 bp, Artificial Sequence
  Description of Artificial Sequence: Synthetic oligonucleotide
  Target: SCN10A; (+) strand; PAM type: YTN; PAM sequence: CTG
caagccagggctaaatttgt

SEQ ID NO: 74476 - DNA, 20 bp, Artificial Sequence
  Description of Artificial Sequence: Synthetic oligonucleotide
  Target: SCN10A; (+) strand; PAM type: YTN; PAM sequence: CTA
aatttgtcataaagaacttc

SEQ ID NO: 74477 - DNA, 20 bp, Artificial Sequence
  Description of Artificial Sequence: Synthetic oligonucleotide
  Target: SCN10A; (+) strand; PAM type: YTN; PAM sequence: TTT
gtcataaagaacttccaatc

SEQ ID NO: 74478 - DNA, 20 bp, Artificial Sequence
  Description of Artificial Sequence: Synthetic oligonucleotide
  Target: SCN10A; (+) strand; PAM type: YTN; PAM sequence: TTG
tcataaagaacttccaatcc

SEQ ID NO: 74479 - DNA, 20 bp, Artificial Sequence
  Description of Artificial Sequence: Synthetic oligonucleotide
  Target: SCN10A; (+) strand; PAM type: YTN; PAM sequence: CTT
ccaatccttccgatgaccaa

SEQ ID NO: 74480 - DNA, 20 bp, Artificial Sequence
  Description of Artificial Sequence: Synthetic oligonucleotide
  Target: SCN10A; (+) strand; PAM type: YTN; PAM sequence: TTC
caatccttccgatgaccaag

SEQ ID NO: 74481 - DNA, 20 bp, Artificial Sequence
  Description of Artificial Sequence: Synthetic oligonucleotide
  Target: SCN10A; (+) strand; PAM type: YTN; PAM sequence: CTT
ccgatgaccaaggatcttag

SEQ ID NO: 74482 - DNA, 20 bp, Artificial Sequence
  Description of Artificial Sequence: Synthetic oligonucleotide
  Target: SCN10A; (+) strand; PAM type: YTN; PAM sequence: TTC
cgatgaccaaggatcttagg

SEQ ID NO: 74483 - DNA, 20 bp, Artificial Sequence
  Description of Artificial Sequence: Synthetic oligonucleotide
  Target: SCN10A; (+) strand; PAM type: YTN; PAM sequence: CTT
aggtcattaggatctttcca

SEQ ID NO: 74484 - DNA, 20 bp, Artificial Sequence
  Description of Artificial Sequence: Synthetic oligonucleotide
  Target: SCN10A; (+) strand; PAM type: YTN; PAM sequence: TTA
ggtcattaggatctttccat

SEQ ID NO: 74485 - DNA, 20 bp, Artificial Sequence
  Description of Artificial Sequence: Synthetic oligonucleotide
  Target: SCN10A; (+) strand; PAM type: YTN; PAM sequence: TTA
ggatctttccattaggatca

SEQ ID NO: 74486 - DNA, 20 bp, Artificial Sequence
  Description of Artificial Sequence: Synthetic oligonucleotide
  Target: SCN10A; (+) strand; PAM type: YTN; PAM sequence: CTT
tccattaggatcacccagga

SEQ ID NO: 74487 - DNA, 20 bp, Artificial Sequence
  Description of Artificial Sequence: Synthetic oligonucleotide
  Target: SCN10A; (+) strand; PAM type: YTN; PAM sequence: TTT
ccattaggatcacccaggaa

SEQ ID NO: 74488 - DNA, 20 bp, Artificial Sequence
  Description of Artificial Sequence: Synthetic oligonucleotide
  Target: SCN10A; (+) strand; PAM type: YTN; PAM sequence: TTC
cattaggatcacccaggaag

SEQ ID NO: 74489 - DNA, 20 bp, Artificial Sequence
  Description of Artificial Sequence: Synthetic oligonucleotide
  Target: SCN10A; (+) strand; PAM type: YTN; PAM sequence: TTA
ggatcacccaggaagatctt

SEQ ID NO: 74490 - DNA, 20 bp, Artificial Sequence
  Description of Artificial Sequence: Synthetic oligonucleotide
  Target: SCN10A; (+) strand; PAM type: YTN; PAM sequence: CTT
aggaaaccaaaccaaagtat

SEQ ID NO: 74491 - DNA, 20 bp, Artificial Sequence
  Description of Artificial Sequence: Synthetic oligonucleotide
  Target: SCN10A; (+) strand; PAM type: YTN; PAM sequence: TTA
ggaaaccaaaccaaagtatc

SEQ ID NO: 74492 - DNA, 20 bp, Artificial Sequence
  Description of Artificial Sequence: Synthetic oligonucleotide
  Target: SCN10A; (+) strand; PAM type: YTN; PAM sequence: CTT
ttttctactagtttggcttg

SEQ ID NO: 74493 - DNA, 20 bp, Artificial Sequence
  Description of Artificial Sequence: Synthetic oligonucleotide
  Target: SCN10A; (+) strand; PAM type: YTN; PAM sequence: TTT
tttctactagtttggcttgc

SEQ ID NO: 74494 - DNA, 20 bp, Artificial Sequence
  Description of Artificial Sequence: Synthetic oligonucleotide
  Target: SCN10A; (+) strand; PAM type: YTN; PAM sequence: TTT
ttctactagtttggcttgcc

SEQ ID NO: 74495 - DNA, 20 bp, Artificial Sequence
  Description of Artificial Sequence: Synthetic oligonucleotide
  Target: SCN10A; (+) strand; PAM type: YTN; PAM sequence: TTT
tctactagtttggcttgcct

SEQ ID NO: 74496 - DNA, 20 bp, Artificial Sequence
  Description of Artificial Sequence: Synthetic oligonucleotide
  Target: SCN10A; (+) strand; PAM type: YTN; PAM sequence: TTT
ctactagtttggcttgcctt

SEQ ID NO: 74497 - DNA, 20 bp, Artificial Sequence
  Description of Artificial Sequence: Synthetic oligonucleotide
  Target: SCN10A; (+) strand; PAM type: YTN; PAM sequence: TTC
tactagtttggcttgccttg

SEQ ID NO: 74498 - DNA, 20 bp, Artificial Sequence
  Description of Artificial Sequence: Synthetic oligonucleotide
  Target: SCN10A; (+) strand; PAM type: YTN; PAM sequence: CTA
ctagtttggcttgccttgca

SEQ ID NO: 74499 - DNA, 20 bp, Artificial Sequence
  Description of Artificial Sequence: Synthetic oligonucleotide
  Target: SCN10A; (+) strand; PAM type: YTN; PAM sequence: CTA
gtttggcttgccttgcaaaa

SEQ ID NO: 74500 - DNA, 20 bp, Artificial Sequence
  Description of Artificial Sequence: Synthetic oligonucleotide
  Target: SCN10A; (+) strand; PAM type: YTN; PAM sequence: TTT
ggcttgccttgcaaaatccc

SEQ ID NO: 74501 - DNA, 20 bp, Artificial Sequence
  Description of Artificial Sequence: Synthetic oligonucleotide
  Target: SCN10A; (+) strand; PAM type: YTN; PAM sequence: TTG
gcttgccttgcaaaatcccc

SEQ ID NO: 74502 - DNA, 20 bp, Artificial Sequence
  Description of Artificial Sequence: Synthetic oligonucleotide
  Target: SCN10A; (+) strand; PAM type: YTN; PAM sequence: CTT
gccttgcaaaatcccctgaa

SEQ ID NO: 74503 - DNA, 20 bp, Artificial Sequence
  Description of Artificial Sequence: Synthetic oligonucleotide
  Target: SCN10A; (+) strand; PAM type: YTN; PAM sequence: TTG
ccttgcaaaatcccctgaaa

SEQ ID NO: 74504 - DNA, 20 bp, Artificial Sequence
  Description of Artificial Sequence: Synthetic oligonucleotide
  Target: SCN10A; (+) strand; PAM type: YTN; PAM sequence: CTT
gcaaaatcccctgaaagcag

SEQ ID NO: 74505 - DNA, 20 bp, Artificial Sequence
  Description of Artificial Sequence: Synthetic oligonucleotide
  Target: SCN10A; (+) strand; PAM type: YTN; PAM sequence: TTG
caaaatcccctgaaagcagc

SEQ ID NO: 74506 - DNA, 20 bp, Artificial Sequence
  Description of Artificial Sequence: Synthetic oligonucleotide
  Target: SCN10A; (+) strand; PAM type: YTN; PAM sequence: CTG
aaagcagcttctgacattac

SEQ ID NO: 74507 - DNA, 20 bp, Artificial Sequence
  Description of Artificial Sequence: Synthetic oligonucleotide
  Target: SCN10A; (+) strand; PAM type: YTN; PAM sequence: CTT
ctgacattacctaaaacaat

SEQ ID NO: 74508 - DNA, 20 bp, Artificial Sequence
  Description of Artificial Sequence: Synthetic oligonucleotide
  Target: SCN10A; (+) strand; PAM type: YTN; PAM sequence: TTC
tgacattacctaaaacaatt

SEQ ID NO: 74509 - DNA, 20 bp, Artificial Sequence
  Description of Artificial Sequence: Synthetic oligonucleotide
  Target: SCN10A; (+) strand; PAM type: YTN; PAM sequence: CTG
acattacctaaaacaattca

SEQ ID NO: 74510 - DNA, 20 bp, Artificial Sequence
  Description of Artificial Sequence: Synthetic oligonucleotide
  Target: SCN10A; (+) strand; PAM type: YTN; PAM sequence: TTA
cctaaaacaattcatatagt

SEQ ID NO: 74511 - DNA, 20 bp, Artificial Sequence
  Description of Artificial Sequence: Synthetic oligonucleotide
  Target: SCN10A; (+) strand; PAM type: YTN; PAM sequence: CTA
aaacaattcatatagtagac

SEQ ID NO: 74512 - DNA, 20 bp, Artificial Sequence
  Description of Artificial Sequence: Synthetic oligonucleotide
  Target: SCN10A; (+) strand; PAM type: YTN; PAM sequence: TTC
atatagtagacatttgacca

SEQ ID NO: 74513 - DNA, 20 bp, Artificial Sequence
  Description of Artificial Sequence: Synthetic oligonucleotide
  Target: SCN10A; (+) strand; PAM type: YTN; PAM sequence: TTT
gaccaatgtgtctctaatca

SEQ ID NO: 74514 - DNA, 20 bp, Artificial Sequence
  Description of Artificial Sequence: Synthetic oligonucleotide
  Target: SCN10A; (+) strand; PAM type: YTN; PAM sequence: TTG
accaatgtgtctctaatcat

SEQ ID NO: 74515 - DNA, 20 bp, Artificial Sequence
  Description of Artificial Sequence: Synthetic oligonucleotide
  Target: SCN10A; (+) strand; PAM type: YTN; PAM sequence: CTC
taatcattacagtcttgtat

SEQ ID NO: 74516 - DNA, 20 bp, Artificial Sequence
  Description of Artificial Sequence: Synthetic oligonucleotide
  Target: SCN10A; (+) strand; PAM type: YTN; PAM sequence: CTA
atcattacagtcttgtatgg

SEQ ID NO: 74517 - DNA, 20 bp, Artificial Sequence
  Description of Artificial Sequence: Synthetic oligonucleotide
  Target: SCN10A; (+) strand; PAM type: YTN; PAM sequence: TTA
cagtcttgtatggcatgaac

SEQ ID NO: 74518 - DNA, 20 bp, Artificial Sequence
  Description of Artificial Sequence: Synthetic oligonucleotide
  Target: SCN10A; (+) strand; PAM type: YTN; PAM sequence: CTT
gtatggcatgaacatcagat

SEQ ID NO: 74519 - DNA, 20 bp, Artificial Sequence
  Description of Artificial Sequence: Synthetic oligonucleotide
  Target: SCN10A; (+) strand; PAM type: YTN; PAM sequence: TTG
tatggcatgaacatcagatt

SEQ ID NO: 74520 - DNA, 20 bp, Artificial Sequence
  Description of Artificial Sequence: Synthetic oligonucleotide
  Target: SCN10A; (+) strand; PAM type: YTN; PAM sequence: TTA
ttgacattttaaacctgcta

SEQ ID NO: 74521 - DNA, 20 bp, Artificial Sequence
  Description of Artificial Sequence: Synthetic oligonucleotide
  Target: SCN10A; (+) strand; PAM type: YTN; PAM sequence: TTG
acattttaaacctgctagta

SEQ ID NO: 74522 - DNA, 20 bp, Artificial Sequence
  Description of Artificial Sequence: Synthetic oligonucleotide
  Target: SCN10A; (+) strand; PAM type: YTN; PAM sequence: TTT
taaacctgctagtagttttt

SEQ ID NO: 74523 - DNA, 20 bp, Artificial Sequence
  Description of Artificial Sequence: Synthetic oligonucleotide
  Target: SCN10A; (+) strand; PAM type: YTN; PAM sequence: TTT
aaacctgctagtagtttttg

SEQ ID NO: 74524 - DNA, 20 bp, Artificial Sequence
  Description of Artificial Sequence: Synthetic oligonucleotide
  Target: SCN10A; (+) strand; PAM type: YTN; PAM sequence: TTA
aacctgctagtagtttttga

SEQ ID NO: 74525 - DNA, 20 bp, Artificial Sequence
  Description of Artificial Sequence: Synthetic oligonucleotide
  Target: SCN10A; (+) strand; PAM type: YTN; PAM sequence: CTG
ctagtagtttttgagtaatt

SEQ ID NO: 74526 - DNA, 20 bp, Artificial Sequence
  Description of Artificial Sequence: Synthetic oligonucleotide
  Target: SCN10A; (+) strand; PAM type: YTN; PAM sequence: CTA
gtagtttttgagtaatttgt

SEQ ID NO: 74527 - DNA, 20 bp, Artificial Sequence
  Description of Artificial Sequence: Synthetic oligonucleotide
  Target: SCN10A; (+) strand; PAM type: YTN; PAM sequence: TTT
ttgagtaatttgtgatgtta

SEQ ID NO: 74528 - DNA, 20 bp, Artificial Sequence
  Description of Artificial Sequence: Synthetic oligonucleotide
  Target: SCN10A; (+) strand; PAM type: YTN; PAM sequence: TTT
tgagtaatttgtgatgttaa

SEQ ID NO: 74529 - DNA, 20 bp, Artificial Sequence
  Description of Artificial Sequence: Synthetic oligonucleotide
  Target: SCN10A; (+) strand; PAM type: YTN; PAM sequence: TTT
gagtaatttgtgatgttaac

SEQ ID NO: 74530 - DNA, 20 bp, Artificial Sequence
  Description of Artificial Sequence: Synthetic oligonucleotide
  Target: SCN10A; (+) strand; PAM type: YTN; PAM sequence: TTG
agtaatttgtgatgttaaca

SEQ ID NO: 74531 - DNA, 20 bp, Artificial Sequence
  Description of Artificial Sequence: Synthetic oligonucleotide
  Target: SCN10A; (+) strand; PAM type: YTN; PAM sequence: TTT
gtgatgttaacagtgcccca

SEQ ID NO: 74532 - DNA, 20 bp, Artificial Sequence
  Description of Artificial Sequence: Synthetic oligonucleotide
  Target: SCN10A; (+) strand; PAM type: YTN; PAM sequence: TTG
tgatgttaacagtgccccat

SEQ ID NO: 74533 - DNA, 20 bp, Artificial Sequence
  Description of Artificial Sequence: Synthetic oligonucleotide
  Target: SCN10A; (+) strand; PAM type: YTN; PAM sequence: TTA
acagtgccccatgaccaatg

SEQ ID NO: 74534 - DNA, 20 bp, Artificial Sequence
  Description of Artificial Sequence: Synthetic oligonucleotide
  Target: SCN10A; (+) strand; PAM type: YTN; PAM sequence: TTG
agactatgtgtgctcttccc

SEQ ID NO: 74535 - DNA, 20 bp, Artificial Sequence
  Description of Artificial Sequence: Synthetic oligonucleotide
  Target: SCN10A; (+) strand; PAM type: YTN; PAM sequence: CTA
tgtgtgctcttcccatcatg

SEQ ID NO: 74536 - DNA, 20 bp, Artificial Sequence
  Description of Artificial Sequence: Synthetic oligonucleotide
  Target: SCN10A; (+) strand; PAM type: YTN; PAM sequence: CTC
ttcccatcatggtctgtttt

SEQ ID NO: 74537 - DNA, 20 bp, Artificial Sequence
  Description of Artificial Sequence: Synthetic oligonucleotide
  Target: SCN10A; (+) strand; PAM type: YTN; PAM sequence: CTT
cccatcatggtctgttttcc

SEQ ID NO: 74538 - DNA, 20 bp, Artificial Sequence
  Description of Artificial Sequence: Synthetic oligonucleotide
  Target: SCN10A; (+) strand; PAM type: YTN; PAM sequence: TTC
ccatcatggtctgttttcct

SEQ ID NO: 74539 - DNA, 20 bp, Artificial Sequence
  Description of Artificial Sequence: Synthetic oligonucleotide
  Target: SCN10A; (+) strand; PAM type: YTN; PAM sequence: CTG
ttttccttgccctctgggag

SEQ ID NO: 74540 - DNA, 20 bp, Artificial Sequence
  Description of Artificial Sequence: Synthetic oligonucleotide
  Target: SCN10A; (+) strand; PAM type: YTN; PAM sequence: TTT
tccttgccctctgggaggtg

SEQ ID NO: 74541 - DNA, 20 bp, Artificial Sequence
  Description of Artificial Sequence: Synthetic oligonucleotide
  Target: SCN10A; (+) strand; PAM type: YTN; PAM sequence: TTT
ccttgccctctgggaggtgc

SEQ ID NO: 74542 - DNA, 20 bp, Artificial Sequence
  Description of Artificial Sequence: Synthetic oligonucleotide
  Target: SCN10A; (+) strand; PAM type: YTN; PAM sequence: TTC
cttgccctctgggaggtgct

SEQ ID NO: 74543 - DNA, 20 bp, Artificial Sequence
  Description of Artificial Sequence: Synthetic oligonucleotide
  Target: SCN10A; (+) strand; PAM type: YTN; PAM sequence: CTT
gccctctgggaggtgctgct

SEQ ID NO: 74544 - DNA, 20 bp, Artificial Sequence
  Description of Artificial Sequence: Synthetic oligonucleotide
  Target: SCN10A; (+) strand; PAM type: YTN; PAM sequence: TTG
ccctctgggaggtgctgctc

SEQ ID NO: 74545 - DNA, 20 bp, Artificial Sequence
  Description of Artificial Sequence: Synthetic oligonucleotide
  Target: SCN10A; (+) strand; PAM type: YTN; PAM sequence: CTC
tgggaggtgctgctcttttg

SEQ ID NO: 74546 - DNA, 20 bp, Artificial Sequence
  Description of Artificial Sequence: Synthetic oligonucleotide
  Target: SCN10A; (+) strand; PAM type: YTN; PAM sequence: CTG
ggaggtgctgctcttttgcc

SEQ ID NO: 74547 - DNA, 20 bp, Artificial Sequence
  Description of Artificial Sequence: Synthetic oligonucleotide
  Target: SCN10A; (+) strand; PAM type: YTN; PAM sequence: CTG
ctcttttgcccagtaagcag

SEQ ID NO: 74548 - DNA, 20 bp, Artificial Sequence
  Description of Artificial Sequence: Synthetic oligonucleotide
  Target: SCN10A; (+) strand; PAM type: YTN; PAM sequence: CTC
ttttgcccagtaagcagcca

SEQ ID NO: 74549 - DNA, 20 bp, Artificial Sequence
  Description of Artificial Sequence: Synthetic oligonucleotide
  Target: SCN10A; (+) strand; PAM type: YTN; PAM sequence: CTT
ttgcccagtaagcagccact

SEQ ID NO: 74550 - DNA, 20 bp, Artificial Sequence
  Description of Artificial Sequence: Synthetic oligonucleotide
  Target: SCN10A; (+) strand; PAM type: YTN; PAM sequence: TTT
tgcccagtaagcagccactt

SEQ ID NO: 74551 - DNA, 20 bp, Artificial Sequence
  Description of Artificial Sequence: Synthetic oligonucleotide
  Target: SCN10A; (+) strand; PAM type: YTN; PAM sequence: TTT
gcccagtaagcagccacttc

SEQ ID NO: 74552 - DNA, 20 bp, Artificial Sequence
  Description of Artificial Sequence: Synthetic oligonucleotide
  Target: SCN10A; (+) strand; PAM type: YTN; PAM sequence: TTG
cccagtaagcagccacttct

SEQ ID NO: 74553 - DNA, 20 bp, Artificial Sequence
  Description of Artificial Sequence: Synthetic oligonucleotide
  Target: SCN10A; (+) strand; PAM type: YTN; PAM sequence: CTT
ctcagcatggctatggcaca

SEQ ID NO: 74554 - DNA, 20 bp, Artificial Sequence
  Description of Artificial Sequence: Synthetic oligonucleotide
  Target: SCN10A; (+) strand; PAM type: YTN; PAM sequence: TTC
tcagcatggctatggcacag

SEQ ID NO: 74555 - DNA, 20 bp, Artificial Sequence
  Description of Artificial Sequence: Synthetic oligonucleotide
  Target: SCN10A; (+) strand; PAM type: YTN; PAM sequence: CTC
agcatggctatggcacagag

SEQ ID NO: 74556 - DNA, 20 bp, Artificial Sequence
  Description of Artificial Sequence: Synthetic oligonucleotide
  Target: SCN10A; (+) strand; PAM type: YTN; PAM sequence: CTA
tggcacagagcaacaactca

SEQ ID NO: 74557 - DNA, 20 bp, Artificial Sequence
  Description of Artificial Sequence: Synthetic oligonucleotide
  Target: SCN10A; (+) strand; PAM type: YTN; PAM sequence: CTC
atgcctatctcatctgccca

SEQ ID NO: 74558 - DNA, 20 bp, Artificial Sequence
  Description of Artificial Sequence: Synthetic oligonucleotide
  Target: SCN10A; (+) strand; PAM type: YTN; PAM sequence: CTA
tctcatctgcccaaagaagg

SEQ ID NO: 74559 - DNA, 20 bp, Artificial Sequence
  Description of Artificial Sequence: Synthetic oligonucleotide
  Target: SCN10A; (+) strand; PAM type: YTN; PAM sequence: CTC
atctgcccaaagaaggcttg

SEQ ID NO: 74560 - DNA, 20 bp, Artificial Sequence
  Description of Artificial Sequence: Synthetic oligonucleotide
  Target: SCN10A; (+) strand; PAM type: YTN; PAM sequence: CTG
cccaaagaaggcttgggccc

SEQ ID NO: 74561 - DNA, 20 bp, Artificial Sequence
  Description of Artificial Sequence: Synthetic oligonucleotide
  Target: SCN10A; (+) strand; PAM type: YTN; PAM sequence: CTT
gggccctcttactgcctgtt

SEQ ID NO: 74562 - DNA, 20 bp, Artificial Sequence
  Description of Artificial Sequence: Synthetic oligonucleotide
  Target: SCN10A; (+) strand; PAM type: YTN; PAM sequence: TTG
ggccctcttactgcctgttg

SEQ ID NO: 74563 - DNA, 20 bp, Artificial Sequence
  Description of Artificial Sequence: Synthetic oligonucleotide
  Target: SCN10A; (+) strand; PAM type: YTN; PAM sequence: CTC
ttactgcctgttgtgttgtg

SEQ ID NO: 74564 - DNA, 20 bp, Artificial Sequence
  Description of Artificial Sequence: Synthetic oligonucleotide
  Target: SCN10A; (+) strand; PAM type: YTN; PAM sequence: CTT
actgcctgttgtgttgtggg

SEQ ID NO: 74565 - DNA, 20 bp, Artificial Sequence
  Description of Artificial Sequence: Synthetic oligonucleotide
  Target: SCN10A; (+) strand; PAM type: YTN; PAM sequence: TTA
ctgcctgttgtgttgtgggg

SEQ ID NO: 74566 - DNA, 20 bp, Artificial Sequence
  Description of Artificial Sequence: Synthetic oligonucleotide
  Target: SCN10A; (+) strand; PAM type: YTN; PAM sequence: CTG
cctgttgtgttgtggggaaa

SEQ ID NO: 74567 - DNA, 20 bp, Artificial Sequence
  Description of Artificial Sequence: Synthetic oligonucleotide
  Target: SCN10A; (+) strand; PAM type: YTN; PAM sequence: CTG
ttgtgttgtggggaaagcgg

SEQ ID NO: 74568 - DNA, 20 bp, Artificial Sequence
  Description of Artificial Sequence: Synthetic oligonucleotide
  Target: SCN10A; (+) strand; PAM type: YTN; PAM sequence: TTG
tgttgtggggaaagcggacc

SEQ ID NO: 74569 - DNA, 20 bp, Artificial Sequence
  Description of Artificial Sequence: Synthetic oligonucleotide
  Target: SCN10A; (+) strand; PAM type: YTN; PAM sequence: TTG
tggggaaagcggaccacaca

SEQ ID NO: 74570 - DNA, 20 bp, Artificial Sequence
  Description of Artificial Sequence: Synthetic oligonucleotide
  Target: SCN10A; (+) strand; PAM type: YTN; PAM sequence: CTG
ggggcatcagcaaacctccc

SEQ ID NO: 74571 - DNA, 20 bp, Artificial Sequence
  Description of Artificial Sequence: Synthetic oligonucleotide
  Target: SCN10A; (+) strand; PAM type: YTN; PAM sequence: CTC
ccctcataaagaggatgttt

SEQ ID NO: 74572 - DNA, 20 bp, Artificial Sequence
  Description of Artificial Sequence: Synthetic oligonucleotide
  Target: SCN10A; (+) strand; PAM type: YTN; PAM sequence: CTC
ataaagaggatgtttttcaa

SEQ ID NO: 74573 - DNA, 20 bp, Artificial Sequence
  Description of Artificial Sequence: Synthetic oligonucleotide
  Target: SCN10A; (+) strand; PAM type: YTN; PAM sequence: TTT
ttcaagttgtgcatccacag

SEQ ID NO: 74574 - DNA, 20 bp, Artificial Sequence
  Description of Artificial Sequence: Synthetic oligonucleotide
  Target: SCN10A; (+) strand; PAM type: YTN; PAM sequence: TTT
tcaagttgtgcatccacagg

SEQ ID NO: 74575 - DNA, 20 bp, Artificial Sequence
  Description of Artificial Sequence: Synthetic oligonucleotide
  Target: SCN10A; (+) strand; PAM type: YTN; PAM sequence: TTT
caagttgtgcatccacaggt

SEQ ID NO: 74576 - DNA, 20 bp, Artificial Sequence
  Description of Artificial Sequence: Synthetic oligonucleotide
  Target: SCN10A; (+) strand; PAM type: YTN; PAM sequence: TTC
aagttgtgcatccacaggtg

SEQ ID NO: 74577 - DNA, 20 bp, Artificial Sequence
  Description of Artificial Sequence: Synthetic oligonucleotide
  Target: SCN10A; (+) strand; PAM type: YTN; PAM sequence: TTG
tgcatccacaggtgtgtcta

SEQ ID NO: 74578 - DNA, 20 bp, Artificial Sequence
  Description of Artificial Sequence: Synthetic oligonucleotide
  Target: SCN10A; (+) strand; PAM type: YTN; PAM sequence: CTA
gattagtctgaggtgaatcc

SEQ ID NO: 74579 - DNA, 20 bp, Artificial Sequence
  Description of Artificial Sequence: Synthetic oligonucleotide
  Target: SCN10A; (+) strand; PAM type: YTN; PAM sequence: TTA
gtctgaggtgaatccaaacc

SEQ ID NO: 74580 - DNA, 20 bp, Artificial Sequence
  Description of Artificial Sequence: Synthetic oligonucleotide
  Target: SCN10A; (+) strand; PAM type: YTN; PAM sequence: CTG
aggtgaatccaaaccacctg

SEQ ID NO: 74581 - DNA, 20 bp, Artificial Sequence
  Description of Artificial Sequence: Synthetic oligonucleotide
  Target: SCN10A; (+) strand; PAM type: YTN; PAM sequence: CTG
tgtgttgcataaacacttct

SEQ ID NO: 74582 - DNA, 20 bp, Artificial Sequence
  Description of Artificial Sequence: Synthetic oligonucleotide
  Target: SCN10A; (+) strand; PAM type: YTN; PAM sequence: TTG
cataaacacttcttctgtgt

SEQ ID NO: 74583 - DNA, 20 bp, Artificial Sequence
  Description of Artificial Sequence: Synthetic oligonucleotide
  Target: SCN10A; (+) strand; PAM type: YTN; PAM sequence: CTT
cttctgtgtcttgggactgc

SEQ ID NO: 74584 - DNA, 20 bp, Artificial Sequence
  Description of Artificial Sequence: Synthetic oligonucleotide
  Target: SCN10A; (+) strand; PAM type: YTN; PAM sequence: TTC
ttctgtgtcttgggactgct

SEQ ID NO: 74585 - DNA, 20 bp, Artificial Sequence
  Description of Artificial Sequence: Synthetic oligonucleotide
  Target: SCN10A; (+) strand; PAM type: YTN; PAM sequence: CTT
ctgtgtcttgggactgcttt

SEQ ID NO: 74586 - DNA, 20 bp, Artificial Sequence
  Description of Artificial Sequence: Synthetic oligonucleotide
  Target: SCN10A; (+) strand; PAM type: YTN; PAM sequence: TTC
tgtgtcttgggactgctttg

SEQ ID NO: 74587 - DNA, 20 bp, Artificial Sequence
  Description of Artificial Sequence: Synthetic oligonucleotide
  Target: SCN10A; (+) strand; PAM type: YTN; PAM sequence: CTG
tgtcttgggactgctttggg

SEQ ID NO: 74588 - DNA, 20 bp, Artificial Sequence
  Description of Artificial Sequence: Synthetic oligonucleotide
  Target: SCN10A; (+) strand; PAM type: YTN; PAM sequence: CTT
gggactgctttggggtgtgg

SEQ ID NO: 74589 - DNA, 20 bp, Artificial Sequence
  Description of Artificial Sequence: Synthetic oligonucleotide
  Target: SCN10A; (+) strand; PAM type: YTN; PAM sequence: TTG
ggactgctttggggtgtggg

SEQ ID NO: 74590 - DNA, 20 bp, Artificial Sequence
  Description of Artificial Sequence: Synthetic oligonucleotide
  Target: SCN10A; (+) strand; PAM type: YTN; PAM sequence: CTG
ctttggggtgtgggacacat

SEQ ID NO: 74591 - DNA, 20 bp, Artificial Sequence
  Description of Artificial Sequence: Synthetic oligonucleotide
  Target: SCN10A; (+) strand; PAM type: YTN; PAM sequence: CTT
tggggtgtgggacacattaa

SEQ ID NO: 74592 - DNA, 20 bp, Artificial Sequence
  Description of Artificial Sequence: Synthetic oligonucleotide
  Target: SCN10A; (+) strand; PAM type: YTN; PAM sequence: TTT
ggggtgtgggacacattaaa

SEQ ID NO: 74593 - DNA, 20 bp, Artificial Sequence
  Description of Artificial Sequence: Synthetic oligonucleotide
  Target: SCN10A; (+) strand; PAM type: YTN; PAM sequence: TTG
gggtgtgggacacattaaag

SEQ ID NO: 74594 - DNA, 20 bp, Artificial Sequence
  Description of Artificial Sequence: Synthetic oligonucleotide
  Target: SCN10A; (+) strand; PAM type: YTN; PAM sequence: TTA
aaggcccaagccattttttc

SEQ ID NO: 74595 - DNA, 20 bp, Artificial Sequence
  Description of Artificial Sequence: Synthetic oligonucleotide
  Target: SCN10A; (+) strand; PAM type: YTN; PAM sequence: TTT
tttcaatctaatgacctcat

SEQ ID NO: 74596 - DNA, 20 bp, Artificial Sequence
  Description of Artificial Sequence: Synthetic oligonucleotide
  Target: SCN10A; (+) strand; PAM type: YTN; PAM sequence: TTT
ttcaatctaatgacctcatt

SEQ ID NO: 74597 - DNA, 20 bp, Artificial Sequence
  Description of Artificial Sequence: Synthetic oligonucleotide
  Target: SCN10A; (+) strand; PAM type: YTN; PAM sequence: TTT
tcaatctaatgacctcattg

SEQ ID NO: 74598 - DNA, 20 bp, Artificial Sequence
  Description of Artificial Sequence: Synthetic oligonucleotide
  Target: SCN10A; (+) strand; PAM type: YTN; PAM sequence: TTT
caatctaatgacctcattgt

SEQ ID NO: 74599 - DNA, 20 bp, Artificial Sequence
  Description of Artificial Sequence: Synthetic oligonucleotide
  Target: SCN10A; (+) strand; PAM type: YTN; PAM sequence: TTC
aatctaatgacctcattgta

SEQ ID NO: 74600 - DNA, 20 bp, Artificial Sequence
  Description of Artificial Sequence: Synthetic oligonucleotide
  Target: SCN10A; (+) strand; PAM type: YTN; PAM sequence: CTA
atgacctcattgtacttttg

SEQ ID NO: 74601 - DNA, 20 bp, Artificial Sequence
  Description of Artificial Sequence: Synthetic oligonucleotide
  Target: SCN10A; (+) strand; PAM type: YTN; PAM sequence: CTC
attgtacttttgggattcaa

SEQ ID NO: 74602 - DNA, 20 bp, Artificial Sequence
  Description of Artificial Sequence: Synthetic oligonucleotide
  Target: SCN10A; (+) strand; PAM type: YTN; PAM sequence: TTG
tacttttgggattcaattgg

SEQ ID NO: 74603 - DNA, 20 bp, Artificial Sequence
  Description of Artificial Sequence: Synthetic oligonucleotide
  Target: SCN10A; (+) strand; PAM type: YTN; PAM sequence: CTT
ttgggattcaattggataag

SEQ ID NO: 74604 - DNA, 20 bp, Artificial Sequence
  Description of Artificial Sequence: Synthetic oligonucleotide
  Target: SCN10A; (+) strand; PAM type: YTN; PAM sequence: TTT
tgggattcaattggataagg

SEQ ID NO: 74605 - DNA, 20 bp, Artificial Sequence
  Description of Artificial Sequence: Synthetic oligonucleotide
  Target: SCN10A; (+) strand; PAM type: YTN; PAM sequence: TTT
gggattcaattggataaggg

SEQ ID NO: 74606 - DNA, 20 bp, Artificial Sequence
  Description of Artificial Sequence: Synthetic oligonucleotide
  Target: SCN10A; (+) strand; PAM type: YTN; PAM sequence: TTG
ggattcaattggataagggc

SEQ ID NO: 74607 - DNA, 20 bp, Artificial Sequence
  Description of Artificial Sequence: Synthetic oligonucleotide
  Target: SCN10A; (+) strand; PAM type: YTN; PAM sequence: TTC
aattggataagggctctgtt

SEQ ID NO: 74608 - DNA, 20 bp, Artificial Sequence
  Description of Artificial Sequence: Synthetic oligonucleotide
  Target: SCN10A; (+) strand; PAM type: YTN; PAM sequence: TTG
gataagggctctgttgctaa

SEQ ID NO: 74609 - DNA, 20 bp, Artificial Sequence
  Description of Artificial Sequence: Synthetic oligonucleotide
  Target: SCN10A; (+) strand; PAM type: YTN; PAM sequence: CTC
tgttgctaacctctaaagaa

SEQ ID NO: 74610 - DNA, 20 bp, Artificial Sequence
  Description of Artificial Sequence: Synthetic oligonucleotide
  Target: SCN10A; (+) strand; PAM type: YTN; PAM sequence: CTG
ttgctaacctctaaagaagg

SEQ ID NO: 74611 - DNA, 20 bp, Artificial Sequence
  Description of Artificial Sequence: Synthetic oligonucleotide
  Target: SCN10A; (+) strand; PAM type: YTN; PAM sequence: TTG
ctaacctctaaagaaggtac

SEQ ID NO: 74612 - DNA, 20 bp, Artificial Sequence
  Description of Artificial Sequence: Synthetic oligonucleotide
  Target: SCN10A; (+) strand; PAM type: YTN; PAM sequence: CTA
acctctaaagaaggtactgg

SEQ ID NO: 74613 - DNA, 20 bp, Artificial Sequence
  Description of Artificial Sequence: Synthetic oligonucleotide
  Target: SCN10A; (+) strand; PAM type: YTN; PAM sequence: CTC
taaagaaggtactggacaca

SEQ ID NO: 74614 - DNA, 20 bp, Artificial Sequence
  Description of Artificial Sequence: Synthetic oligonucleotide
  Target: SCN10A; (+) strand; PAM type: YTN; PAM sequence: CTA
aagaaggtactggacacagt

SEQ ID NO: 74615 - DNA, 20 bp, Artificial Sequence
  Description of Artificial Sequence: Synthetic oligonucleotide
  Target: SCN10A; (+) strand; PAM type: YTN; PAM sequence: CTG
gacacagtaggcaaggtcta

SEQ ID NO: 74616 - DNA, 20 bp, Artificial Sequence
  Description of Artificial Sequence: Synthetic oligonucleotide
  Target: SCN10A; (+) strand; PAM type: YTN; PAM sequence: CTA
attgtaacacgtggaagagg

SEQ ID NO: 74617 - DNA, 20 bp, Artificial Sequence
  Description of Artificial Sequence: Synthetic oligonucleotide
  Target: SCN10A; (+) strand; PAM type: YTN; PAM sequence: TTG
taacacgtggaagaggcaat

SEQ ID NO: 74618 - DNA, 20 bp, Artificial Sequence
  Description of Artificial Sequence: Synthetic oligonucleotide
  Target: SCN10A; (+) strand; PAM type: YTN; PAM sequence: CTT
tgatggccgttcttctgatc

SEQ ID NO: 74619 - DNA, 20 bp, Artificial Sequence
  Description of Artificial Sequence: Synthetic oligonucleotide
  Target: SCN10A; (+) strand; PAM type: YTN; PAM sequence: TTT
gatggccgttcttctgatca

SEQ ID NO: 74620 - DNA, 20 bp, Artificial Sequence
  Description of Artificial Sequence: Synthetic oligonucleotide
  Target: SCN10A; (+) strand; PAM type: YTN; PAM sequence: TTG
atggccgttcttctgatcag

SEQ ID NO: 74621 - DNA, 20 bp, Artificial Sequence
  Description of Artificial Sequence: Synthetic oligonucleotide
  Target: SCN10A; (+) strand; PAM type: YTN; PAM sequence: TTC
ttctgatcaggttgaaagga

SEQ ID NO: 74622 - DNA, 20 bp, Artificial Sequence
  Description of Artificial Sequence: Synthetic oligonucleotide
  Target: SCN10A; (+) strand; PAM type: YTN; PAM sequence: CTT
ctgatcaggttgaaaggact

SEQ ID NO: 74623 - DNA, 20 bp, Artificial Sequence
  Description of Artificial Sequence: Synthetic oligonucleotide
  Target: SCN10A; (+) strand; PAM type: YTN; PAM sequence: TTC
tgatcaggttgaaaggactg

SEQ ID NO: 74624 - DNA, 20 bp, Artificial Sequence
  Description of Artificial Sequence: Synthetic oligonucleotide
  Target: SCN10A; (+) strand; PAM type: YTN; PAM sequence: CTG
atcaggttgaaaggactgaa

SEQ ID NO: 74625 - DNA, 20 bp, Artificial Sequence
  Description of Artificial Sequence: Synthetic oligonucleotide
  Target: SCN10A; (+) strand; PAM type: YTN; PAM sequence: TTG
aaaggactgaatagccacag

SEQ ID NO: 74626 - DNA, 20 bp, Artificial Sequence
  Description of Artificial Sequence: Synthetic oligonucleotide
  Target: SCN10A; (+) strand; PAM type: YTN; PAM sequence: CTG
aatagccacagggcccgagt

SEQ ID NO: 74627 - DNA, 20 bp, Artificial Sequence
  Description of Artificial Sequence: Synthetic oligonucleotide
  Target: SCN10A; (+) strand; PAM type: YTN; PAM sequence: CTA
aaccgggaaatggtcctccc

SEQ ID NO: 74628 - DNA, 20 bp, Artificial Sequence
  Description of Artificial Sequence: Synthetic oligonucleotide
  Target: SCN10A; (+) strand; PAM type: YTN; PAM sequence: CTC
cctttgttcagcaccataaa

SEQ ID NO: 74629 - DNA, 20 bp, Artificial Sequence
  Description of Artificial Sequence: Synthetic oligonucleotide
  Target: SCN10A; (+) strand; PAM type: YTN; PAM sequence: CTT
tgttcagcaccataaatgtc

SEQ ID NO: 74630 - DNA, 20 bp, Artificial Sequence
  Description of Artificial Sequence: Synthetic oligonucleotide
  Target: SCN10A; (+) strand; PAM type: YTN; PAM sequence: TTT
gttcagcaccataaatgtct

SEQ ID NO: 74631 - DNA, 20 bp, Artificial Sequence
  Description of Artificial Sequence: Synthetic oligonucleotide
  Target: SCN10A; (+) strand; PAM type: YTN; PAM sequence: TTG
ttcagcaccataaatgtctg

SEQ ID NO: 74632 - DNA, 20 bp, Artificial Sequence
  Description of Artificial Sequence: Synthetic oligonucleotide
  Target: SCN10A; (+) strand; PAM type: YTN; PAM sequence: TTC
agcaccataaatgtctgaaa

SEQ ID NO: 74633 - DNA, 20 bp, Artificial Sequence
  Description of Artificial Sequence: Synthetic oligonucleotide
  Target: SCN10A; (+) strand; PAM type: YTN; PAM sequence: CTG
aaacaaaacaaaacagaaag

SEQ ID NO: 74634 - DNA, 20 bp, Artificial Sequence
  Description of Artificial Sequence: Synthetic oligonucleotide
  Target: SCN10A; (+) strand; PAM type: YTN; PAM sequence: CTC
caatgagaaacaagattcct

SEQ ID NO: 74635 - DNA, 20 bp, Artificial Sequence
  Description of Artificial Sequence: Synthetic oligonucleotide
  Target: SCN10A; (+) strand; PAM type: YTN; PAM sequence: TTC
cttatacaaccatgttttta

SEQ ID NO: 74636 - DNA, 20 bp, Artificial Sequence
  Description of Artificial Sequence: Synthetic oligonucleotide
  Target: SCN10A; (+) strand; PAM type: YTN; PAM sequence: CTT
atacaaccatgtttttaaac

SEQ ID NO: 74637 - DNA, 20 bp, Artificial Sequence
  Description of Artificial Sequence: Synthetic oligonucleotide
  Target: SCN10A; (+) strand; PAM type: YTN; PAM sequence: TTA
tacaaccatgtttttaaaca

SEQ ID NO: 74638 - DNA, 20 bp, Artificial Sequence
  Description of Artificial Sequence: Synthetic oligonucleotide
  Target: SCN10A; (+) strand; PAM type: YTN; PAM sequence: TTT
ttaaacatgagaggcattat

SEQ ID NO: 74639 - DNA, 20 bp, Artificial Sequence
  Description of Artificial Sequence: Synthetic oligonucleotide
  Target: SCN10A; (+) strand; PAM type: YTN; PAM sequence: TTT
taaacatgagaggcattatc

SEQ ID NO: 74640 - DNA, 20 bp, Artificial Sequence
  Description of Artificial Sequence: Synthetic oligonucleotide
  Target: SCN10A; (+) strand; PAM type: YTN; PAM sequence: TTT
aaacatgagaggcattatct

SEQ ID NO: 74641 - DNA, 20 bp, Artificial Sequence
  Description of Artificial Sequence: Synthetic oligonucleotide
  Target: SCN10A; (+) strand; PAM type: YTN; PAM sequence: TTA
aacatgagaggcattatctc

SEQ ID NO: 74642 - DNA, 20 bp, Artificial Sequence
  Description of Artificial Sequence: Synthetic oligonucleotide
  Target: SCN10A; (+) strand; PAM type: YTN; PAM sequence: TTA
tctcaggcttatgagcaaga

SEQ ID NO: 74643 - DNA, 20 bp, Artificial Sequence
  Description of Artificial Sequence: Synthetic oligonucleotide
  Target: SCN10A; (+) strand; PAM type: YTN; PAM sequence: CTC
aggcttatgagcaagaaggg

SEQ ID NO: 74644 - DNA, 20 bp, Artificial Sequence
  Description of Artificial Sequence: Synthetic oligonucleotide
  Target: SCN10A; (+) strand; PAM type: YTN; PAM sequence: CTT
atgagcaagaagggctctgg

SEQ ID NO: 74645 - DNA, 20 bp, Artificial Sequence
  Description of Artificial Sequence: Synthetic oligonucleotide
  Target: SCN10A; (+) strand; PAM type: YTN; PAM sequence: TTA
tgagcaagaagggctctggg

SEQ ID NO: 74646 - DNA, 20 bp, Artificial Sequence
  Description of Artificial Sequence: Synthetic oligonucleotide
  Target: SCN10A; (+) strand; PAM type: YTN; PAM sequence: CTC
tgggaactacaggtcaatga

SEQ ID NO: 74647 - DNA, 20 bp, Artificial Sequence
  Description of Artificial Sequence: Synthetic oligonucleotide
  Target: SCN10A; (+) strand; PAM type: YTN; PAM sequence: CTG
ggaactacaggtcaatgaga

SEQ ID NO: 74648 - DNA, 20 bp, Artificial Sequence
  Description of Artificial Sequence: Synthetic oligonucleotide
  Target: SCN10A; (+) strand; PAM type: YTN; PAM sequence: CTA
caggtcaatgagagtcaaat

SEQ ID NO: 74649 - DNA, 20 bp, Artificial Sequence
  Description of Artificial Sequence: Synthetic oligonucleotide
  Target: SCN10A; (+) strand; PAM type: YTN; PAM sequence: CTA
aaagccatatcctcaccctc

SEQ ID NO: 74650 - DNA, 20 bp, Artificial Sequence
  Description of Artificial Sequence: Synthetic oligonucleotide
  Target: SCN10A; (+) strand; PAM type: YTN; PAM sequence: CTC
accctctcagcaagatcctc

SEQ ID NO: 74651 - DNA, 20 bp, Artificial Sequence
  Description of Artificial Sequence: Synthetic oligonucleotide
  Target: SCN10A; (+) strand; PAM type: YTN; PAM sequence: CTC
tcagcaagatcctcatctct

SEQ ID NO: 74652 - DNA, 20 bp, Artificial Sequence
  Description of Artificial Sequence: Synthetic oligonucleotide
  Target: SCN10A; (+) strand; PAM type: YTN; PAM sequence: CTC
agcaagatcctcatctctgg

SEQ ID NO: 74653 - DNA, 20 bp, Artificial Sequence
  Description of Artificial Sequence: Synthetic oligonucleotide
  Target: SCN10A; (+) strand; PAM type: YTN; PAM sequence: CTC
atctctgggactgacagtgc

SEQ ID NO: 74654 - DNA, 20 bp, Artificial Sequence
  Description of Artificial Sequence: Synthetic oligonucleotide
  Target: SCN10A; (+) strand; PAM type: YTN; PAM sequence: CTC
tgggactgacagtgcaccaa

SEQ ID NO: 74655 - DNA, 20 bp, Artificial Sequence
  Description of Artificial Sequence: Synthetic oligonucleotide
  Target: SCN10A; (+) strand; PAM type: YTN; PAM sequence: CTG
ggactgacagtgcaccaaga

SEQ ID NO: 74656 - DNA, 20 bp, Artificial Sequence
  Description of Artificial Sequence: Synthetic oligonucleotide
  Target: SCN10A; (+) strand; PAM type: YTN; PAM sequence: CTG
acagtgcaccaagatgagcc

SEQ ID NO: 74657 - DNA, 20 bp, Artificial Sequence
  Description of Artificial Sequence: Synthetic oligonucleotide
  Target: SCN10A; (+) strand; PAM type: YTN; PAM sequence: CTG
agggtactttaatggacaga

SEQ ID NO: 74658 - DNA, 20 bp, Artificial Sequence
  Description of Artificial Sequence: Synthetic oligonucleotide
  Target: SCN10A; (+) strand; PAM type: YTN; PAM sequence: CTT
taatggacagacagccaatc

SEQ ID NO: 74659 - DNA, 20 bp, Artificial Sequence
  Description of Artificial Sequence: Synthetic oligonucleotide
  Target: SCN10A; (+) strand; PAM type: YTN; PAM sequence: TTT
aatggacagacagccaatcc

SEQ ID NO: 74660 - DNA, 20 bp, Artificial Sequence
  Description of Artificial Sequence: Synthetic oligonucleotide
  Target: SCN10A; (+) strand; PAM type: YTN; PAM sequence: TTA
atggacagacagccaatcct

SEQ ID NO: 74661 - DNA, 20 bp, Artificial Sequence
  Description of Artificial Sequence: Synthetic oligonucleotide
  Target: SCN10A; (+) strand; PAM type: YTN; PAM sequence: CTC
aggctggtaagaggtgttat

SEQ ID NO: 74662 - DNA, 20 bp, Artificial Sequence
  Description of Artificial Sequence: Synthetic oligonucleotide
  Target: SCN10A; (+) strand; PAM type: YTN; PAM sequence: CTG
gtaagaggtgttatgcccag

SEQ ID NO: 74663 - DNA, 20 bp, Artificial Sequence
  Description of Artificial Sequence: Synthetic oligonucleotide
  Target: SCN10A; (+) strand; PAM type: YTN; PAM sequence: TTA
tgcccaggggaggactctgg

SEQ ID NO: 74664 - DNA, 20 bp, Artificial Sequence
  Description of Artificial Sequence: Synthetic oligonucleotide
  Target: SCN10A; (+) strand; PAM type: YTN; PAM sequence: CTC
tggcaacaggatggtgaagt

SEQ ID NO: 74665 - DNA, 20 bp, Artificial Sequence
  Description of Artificial Sequence: Synthetic oligonucleotide
  Target: SCN10A; (+) strand; PAM type: YTN; PAM sequence: CTG
gcaacaggatggtgaagtta

SEQ ID NO: 74666 - DNA, 20 bp, Artificial Sequence
  Description of Artificial Sequence: Synthetic oligonucleotide
  Target: SCN10A; (+) strand; PAM type: YTN; PAM sequence: TTA
tggttgcatttaatttctct

SEQ ID NO: 74667 - DNA, 20 bp, Artificial Sequence
  Description of Artificial Sequence: Synthetic oligonucleotide
  Target: SCN10A; (+) strand; PAM type: YTN; PAM sequence: TTG
catttaatttctcttctgac

SEQ ID NO: 74668 - DNA, 20 bp, Artificial Sequence
  Description of Artificial Sequence: Synthetic oligonucleotide
  Target: SCN10A; (+) strand; PAM type: YTN; PAM sequence: TTT
aatttctcttctgacaagag

SEQ ID NO: 74669 - DNA, 20 bp, Artificial Sequence
  Description of Artificial Sequence: Synthetic oligonucleotide
  Target: SCN10A; (+) strand; PAM type: YTN; PAM sequence: TTA
atttctcttctgacaagaga

SEQ ID NO: 74670 - DNA, 20 bp, Artificial Sequence
  Description of Artificial Sequence: Synthetic oligonucleotide
  Target: SCN10A; (+) strand; PAM type: YTN; PAM sequence: TTT
ctcttctgacaagagaacca

SEQ ID NO: 74671 - DNA, 20 bp, Artificial Sequence
  Description of Artificial Sequence: Synthetic oligonucleotide
  Target: SCN10A; (+) strand; PAM type: YTN; PAM sequence: TTC
tcttctgacaagagaaccat

SEQ ID NO: 74672 - DNA, 20 bp, Artificial Sequence
  Description of Artificial Sequence: Synthetic oligonucleotide
  Target: SCN10A; (+) strand; PAM type: YTN; PAM sequence: CTC
ttctgacaagagaaccatcc

SEQ ID NO: 74673 - DNA, 20 bp, Artificial Sequence
  Description of Artificial Sequence: Synthetic oligonucleotide
  Target: SCN10A; (+) strand; PAM type: YTN; PAM sequence: CTT
ctgacaagagaaccatcctt

SEQ ID NO: 74674 - DNA, 20 bp, Artificial Sequence
  Description of Artificial Sequence: Synthetic oligonucleotide
  Target: SCN10A; (+) strand; PAM type: YTN; PAM sequence: TTC
tgacaagagaaccatccttg

SEQ ID NO: 74675 - DNA, 20 bp, Artificial Sequence
  Description of Artificial Sequence: Synthetic oligonucleotide
  Target: SCN10A; (+) strand; PAM type: YTN; PAM sequence: CTG
acaagagaaccatccttgtt

SEQ ID NO: 74676 - DNA, 20 bp, Artificial Sequence
  Description of Artificial Sequence: Synthetic oligonucleotide
  Target: SCN10A; (+) strand; PAM type: YTN; PAM sequence: CTT
gttttgtaatgtttcttctg

SEQ ID NO: 74677 - DNA, 20 bp, Artificial Sequence
  Description of Artificial Sequence: Synthetic oligonucleotide
  Target: SCN10A; (+) strand; PAM type: YTN; PAM sequence: TTG
ttttgtaatgtttcttctgt

SEQ ID NO: 74678 - DNA, 20 bp, Artificial Sequence
  Description of Artificial Sequence: Synthetic oligonucleotide
  Target: SCN10A; (+) strand; PAM type: YTN; PAM sequence: TTT
tgtaatgtttcttctgtctc

SEQ ID NO: 74679 - DNA, 20 bp, Artificial Sequence
  Description of Artificial Sequence: Synthetic oligonucleotide
  Target: SCN10A; (+) strand; PAM type: YTN; PAM sequence: TTT
gtaatgtttcttctgtctcc

SEQ ID NO: 74680 - DNA, 20 bp, Artificial Sequence
  Description of Artificial Sequence: Synthetic oligonucleotide
  Target: SCN10A; (+) strand; PAM type: YTN; PAM sequence: TTG
taatgtttcttctgtctcca

SEQ ID NO: 74681 - DNA, 20 bp, Artificial Sequence
  Description of Artificial Sequence: Synthetic oligonucleotide
  Target: SCN10A; (+) strand; PAM type: YTN; PAM sequence: TTT
cttctgtctccaccttctac

SEQ ID NO: 74682 - DNA, 20 bp, Artificial Sequence
  Description of Artificial Sequence: Synthetic oligonucleotide
  Target: SCN10A; (+) strand; PAM type: YTN; PAM sequence: TTC
ttctgtctccaccttctaca

SEQ ID NO: 74683 - DNA, 20 bp, Artificial Sequence
  Description of Artificial Sequence: Synthetic oligonucleotide
  Target: SCN10A; (+) strand; PAM type: YTN; PAM sequence: CTT
ctgtctccaccttctacatc

SEQ ID NO: 74684 - DNA, 20 bp, Artificial Sequence
  Description of Artificial Sequence: Synthetic oligonucleotide
  Target: SCN10A; (+) strand; PAM type: YTN; PAM sequence: TTC
tgtctccaccttctacatct

SEQ ID NO: 74685 - DNA, 20 bp, Artificial Sequence
  Description of Artificial Sequence: Synthetic oligonucleotide
  Target: SCN10A; (+) strand; PAM type: YTN; PAM sequence: CTG
tctccaccttctacatctct

SEQ ID NO: 74686 - DNA, 20 bp, Artificial Sequence
  Description of Artificial Sequence: Synthetic oligonucleotide
  Target: SCN10A; (+) strand; PAM type: YTN; PAM sequence: CTC
caccttctacatctctgtct

SEQ ID NO: 74687 - DNA, 20 bp, Artificial Sequence
  Description of Artificial Sequence: Synthetic oligonucleotide
  Target: SCN10A; (+) strand; PAM type: YTN; PAM sequence: CTT
ctacatctctgtctcttaaa

SEQ ID NO: 74688 - DNA, 20 bp, Artificial Sequence
  Description of Artificial Sequence: Synthetic oligonucleotide
  Target: SCN10A; (+) strand; PAM type: YTN; PAM sequence: TTC
tacatctctgtctcttaaat

SEQ ID NO: 74689 - DNA, 20 bp, Artificial Sequence
  Description of Artificial Sequence: Synthetic oligonucleotide
  Target: SCN10A; (+) strand; PAM type: YTN; PAM sequence: CTA
catctctgtctcttaaatcc

SEQ ID NO: 74690 - DNA, 20 bp, Artificial Sequence
  Description of Artificial Sequence: Synthetic oligonucleotide
  Target: SCN10A; (+) strand; PAM type: YTN; PAM sequence: CTC
tgtctcttaaatcctctcct

SEQ ID NO: 74691 - DNA, 20 bp, Artificial Sequence
  Description of Artificial Sequence: Synthetic oligonucleotide
  Target: SCN10A; (+) strand; PAM type: YTN; PAM sequence: CTG
tctcttaaatcctctcctgg

SEQ ID NO: 74692 - DNA, 20 bp, Artificial Sequence
  Description of Artificial Sequence: Synthetic oligonucleotide
  Target: SCN10A; (+) strand; PAM type: YTN; PAM sequence: CTC
ttaaatcctctcctggtttc

SEQ ID NO: 74693 - DNA, 20 bp, Artificial Sequence
  Description of Artificial Sequence: Synthetic oligonucleotide
  Target: SCN10A; (+) strand; PAM type: YTN; PAM sequence: CTT
aaatcctctcctggtttctc

SEQ ID NO: 74694 - DNA, 20 bp, Artificial Sequence
  Description of Artificial Sequence: Synthetic oligonucleotide
  Target: SCN10A; (+) strand; PAM type: YTN; PAM sequence: TTA
aatcctctcctggtttctcc

SEQ ID NO: 74695 - DNA, 20 bp, Artificial Sequence
  Description of Artificial Sequence: Synthetic oligonucleotide
  Target: SCN10A; (+) strand; PAM type: YTN; PAM sequence: CTC
tcctggtttctccctctgag

SEQ ID NO: 74696 - DNA, 20 bp, Artificial Sequence
  Description of Artificial Sequence: Synthetic oligonucleotide
  Target: SCN10A; (+) strand; PAM type: YTN; PAM sequence: CTC
ctggtttctccctctgagga

SEQ ID NO: 74697 - DNA, 20 bp, Artificial Sequence
  Description of Artificial Sequence: Synthetic oligonucleotide
  Target: SCN10A; (+) strand; PAM type: YTN; PAM sequence: CTG
gtttctccctctgaggattt

SEQ ID NO: 74698 - DNA, 20 bp, Artificial Sequence
  Description of Artificial Sequence: Synthetic oligonucleotide
  Target: SCN10A; (+) strand; PAM type: YTN; PAM sequence: TTT
ctccctctgaggatttagga

SEQ ID NO: 74699 - DNA, 20 bp, Artificial Sequence
  Description of Artificial Sequence: Synthetic oligonucleotide
  Target: SCN10A; (+) strand; PAM type: YTN; PAM sequence: TTC
tccctctgaggatttaggag

SEQ ID NO: 74700 - DNA, 20 bp, Artificial Sequence
  Description of Artificial Sequence: Synthetic oligonucleotide
  Target: SCN10A; (+) strand; PAM type: YTN; PAM sequence: CTC
cctctgaggatttaggagga

SEQ ID NO: 74701 - DNA, 20 bp, Artificial Sequence
  Description of Artificial Sequence: Synthetic oligonucleotide
  Target: SCN10A; (+) strand; PAM type: YTN; PAM sequence: CTC
tgaggatttaggaggatatg

SEQ ID NO: 74702 - DNA, 20 bp, Artificial Sequence
  Description of Artificial Sequence: Synthetic oligonucleotide
  Target: SCN10A; (+) strand; PAM type: YTN; PAM sequence: CTG
aggatttaggaggatatgaa

SEQ ID NO: 74703 - DNA, 20 bp, Artificial Sequence
  Description of Artificial Sequence: Synthetic oligonucleotide
  Target: SCN10A; (+) strand; PAM type: YTN; PAM sequence: TTT
aggaggatatgaactcttgg

SEQ ID NO: 74704 - DNA, 20 bp, Artificial Sequence
  Description of Artificial Sequence: Synthetic oligonucleotide
  Target: SCN10A; (+) strand; PAM type: YTN; PAM sequence: TTA
ggaggatatgaactcttggc

SEQ ID NO: 74705 - DNA, 20 bp, Artificial Sequence
  Description of Artificial Sequence: Synthetic oligonucleotide
  Target: SCN10A; (+) strand; PAM type: YTN; PAM sequence: CTC
ttggcatgggagaggaggaa

SEQ ID NO: 74706 - DNA, 20 bp, Artificial Sequence
  Description of Artificial Sequence: Synthetic oligonucleotide
  Target: SCN10A; (+) strand; PAM type: YTN; PAM sequence: CTT
ggcatgggagaggaggaaga

SEQ ID NO: 74707 - DNA, 20 bp, Artificial Sequence
  Description of Artificial Sequence: Synthetic oligonucleotide
  Target: SCN10A; (+) strand; PAM type: YTN; PAM sequence: TTG
gcatgggagaggaggaagaa

SEQ ID NO: 74708 - DNA, 20 bp, Artificial Sequence
  Description of Artificial Sequence: Synthetic oligonucleotide
  Target: SCN10A; (+) strand; PAM type: YTN; PAM sequence: TTC
agtgcctttttatttactct

SEQ ID NO: 74709 - DNA, 20 bp, Artificial Sequence
  Description of Artificial Sequence: Synthetic oligonucleotide
  Target: SCN10A; (+) strand; PAM type: YTN; PAM sequence: CTT
tttatttactctgctagcca

SEQ ID NO: 74710 - DNA, 20 bp, Artificial Sequence
  Description of Artificial Sequence: Synthetic oligonucleotide
  Target: SCN10A; (+) strand; PAM type: YTN; PAM sequence: TTT
ttatttactctgctagccat

SEQ ID NO: 74711 - DNA, 20 bp, Artificial Sequence
  Description of Artificial Sequence: Synthetic oligonucleotide
  Target: SCN10A; (+) strand; PAM type: YTN; PAM sequence: TTT
tatttactctgctagccata

SEQ ID NO: 74712 - DNA, 20 bp, Artificial Sequence
  Description of Artificial Sequence: Synthetic oligonucleotide
  Target: SCN10A; (+) strand; PAM type: YTN; PAM sequence: TTT
atttactctgctagccatat

SEQ ID NO: 74713 - DNA, 20 bp, Artificial Sequence
  Description of Artificial Sequence: Synthetic oligonucleotide
  Target: SCN10A; (+) strand; PAM type: YTN; PAM sequence: TTA
tttactctgctagccatatt

SEQ ID NO: 74714 - DNA, 20 bp, Artificial Sequence
  Description of Artificial Sequence: Synthetic oligonucleotide
  Target: SCN10A; (+) strand; PAM type: YTN; PAM sequence: TTT
actctgctagccatatttga

SEQ ID NO: 74715 - DNA, 20 bp, Artificial Sequence
  Description of Artificial Sequence: Synthetic oligonucleotide
  Target: SCN10A; (+) strand; PAM type: YTN; PAM sequence: TTA
ctctgctagccatatttgag

SEQ ID NO: 74716 - DNA, 20 bp, Artificial Sequence
  Description of Artificial Sequence: Synthetic oligonucleotide
  Target: SCN10A; (+) strand; PAM type: YTN; PAM sequence: CTC
tgctagccatatttgagatg

SEQ ID NO: 74717 - DNA, 20 bp, Artificial Sequence
  Description of Artificial Sequence: Synthetic oligonucleotide
  Target: SCN10A; (+) strand; PAM type: YTN; PAM sequence: CTG
ctagccatatttgagatggc

SEQ ID NO: 74718 - DNA, 20 bp, Artificial Sequence
  Description of Artificial Sequence: Synthetic oligonucleotide
  Target: SCN10A; (+) strand; PAM type: YTN; PAM sequence: CTA
gccatatttgagatggctga

SEQ ID NO: 74719 - DNA, 20 bp, Artificial Sequence
  Description of Artificial Sequence: Synthetic oligonucleotide
  Target: SCN10A; (+) strand; PAM type: YTN; PAM sequence: TTT
gagatggctgattcctgtcc

SEQ ID NO: 74720 - DNA, 20 bp, Artificial Sequence
  Description of Artificial Sequence: Synthetic oligonucleotide
  Target: SCN10A; (+) strand; PAM type: YTN; PAM sequence: TTG
agatggctgattcctgtcct

SEQ ID NO: 74721 - DNA, 20 bp, Artificial Sequence
  Description of Artificial Sequence: Synthetic oligonucleotide
  Target: SCN10A; (+) strand; PAM type: YTN; PAM sequence: CTG
attcctgtcctcctaactcc

SEQ ID NO: 74722 - DNA, 20 bp, Artificial Sequence
  Description of Artificial Sequence: Synthetic oligonucleotide
  Target: SCN10A; (+) strand; PAM type: YTN; PAM sequence: TTC
ctgtcctcctaactcccaaa

SEQ ID NO: 74723 - DNA, 20 bp, Artificial Sequence
  Description of Artificial Sequence: Synthetic oligonucleotide
  Target: SCN10A; (+) strand; PAM type: YTN; PAM sequence: CTG
tcctcctaactcccaaacat

SEQ ID NO: 74724 - DNA, 20 bp, Artificial Sequence
  Description of Artificial Sequence: Synthetic oligonucleotide
  Target: SCN10A; (+) strand; PAM type: YTN; PAM sequence: CTC
ctaactcccaaacatgcatt

SEQ ID NO: 74725 - DNA, 20 bp, Artificial Sequence
  Description of Artificial Sequence: Synthetic oligonucleotide
  Target: SCN10A; (+) strand; PAM type: YTN; PAM sequence: CTA
actcccaaacatgcattcac

SEQ ID NO: 74726 - DNA, 20 bp, Artificial Sequence
  Description of Artificial Sequence: Synthetic oligonucleotide
  Target: SCN10A; (+) strand; PAM type: YTN; PAM sequence: CTC
ccaaacatgcattcaccatt

SEQ ID NO: 74727 - DNA, 20 bp, Artificial Sequence
  Description of Artificial Sequence: Synthetic oligonucleotide
  Target: SCN10A; (+) strand; PAM type: YTN; PAM sequence: TTC
accattttttggctcgtaga

SEQ ID NO: 74728 - DNA, 20 bp, Artificial Sequence
  Description of Artificial Sequence: Synthetic oligonucleotide
  Target: SCN10A; (+) strand; PAM type: YTN; PAM sequence: TTT
tttggctcgtagaacatcaa

SEQ ID NO: 74729 - DNA, 20 bp, Artificial Sequence
  Description of Artificial Sequence: Synthetic oligonucleotide
  Target: SCN10A; (+) strand; PAM type: YTN; PAM sequence: TTT
ttggctcgtagaacatcaaa

SEQ ID NO: 74730 - DNA, 20 bp, Artificial Sequence
  Description of Artificial Sequence: Synthetic oligonucleotide
  Target: SCN10A; (+) strand; PAM type: YTN; PAM sequence: TTT
tggctcgtagaacatcaaaa

SEQ ID NO: 74731 - DNA, 20 bp, Artificial Sequence
  Description of Artificial Sequence: Synthetic oligonucleotide
  Target: SCN10A; (+) strand; PAM type: YTN; PAM sequence: TTT
ggctcgtagaacatcaaaaa

SEQ ID NO: 74732 - DNA, 20 bp, Artificial Sequence
  Description of Artificial Sequence: Synthetic oligonucleotide
  Target: SCN10A; (+) strand; PAM type: YTN; PAM sequence: TTG
gctcgtagaacatcaaaaat

SEQ ID NO: 74733 - DNA, 20 bp, Artificial Sequence
  Description of Artificial Sequence: Synthetic oligonucleotide
  Target: SCN10A; (+) strand; PAM type: YTN; PAM sequence: CTC
gtagaacatcaaaaatacaa

SEQ ID NO: 74734 - DNA, 20 bp, Artificial Sequence
  Description of Artificial Sequence: Synthetic oligonucleotide
  Target: SCN10A; (+) strand; PAM type: YTN; PAM sequence: TTG
tcatgaagaagctcttgttt

SEQ ID NO: 74735 - DNA, 20 bp, Artificial Sequence
  Description of Artificial Sequence: Synthetic oligonucleotide
  Target: SCN10A; (+) strand; PAM type: YTN; PAM sequence: CTC
ttgtttaaactactgattct

SEQ ID NO: 74736 - DNA, 20 bp, Artificial Sequence
  Description of Artificial Sequence: Synthetic oligonucleotide
  Target: SCN10A; (+) strand; PAM type: YTN; PAM sequence: CTT
gtttaaactactgattctca

SEQ ID NO: 74737 - DNA, 20 bp, Artificial Sequence
  Description of Artificial Sequence: Synthetic oligonucleotide
  Target: SCN10A; (+) strand; PAM type: YTN; PAM sequence: TTG
tttaaactactgattctcaa

SEQ ID NO: 74738 - DNA, 20 bp, Artificial Sequence
  Description of Artificial Sequence: Synthetic oligonucleotide
  Target: SCN10A; (+) strand; PAM type: YTN; PAM sequence: TTT
aaactactgattctcaaact

SEQ ID NO: 74739 - DNA, 20 bp, Artificial Sequence
  Description of Artificial Sequence: Synthetic oligonucleotide
  Target: SCN10A; (+) strand; PAM type: YTN; PAM sequence: TTA
aactactgattctcaaactt

SEQ ID NO: 74740 - DNA, 20 bp, Artificial Sequence
  Description of Artificial Sequence: Synthetic oligonucleotide
  Target: SCN10A; (+) strand; PAM type: YTN; PAM sequence: CTA
ctgattctcaaactttttga

SEQ ID NO: 74741 - DNA, 20 bp, Artificial Sequence
  Description of Artificial Sequence: Synthetic oligonucleotide
  Target: SCN10A; (+) strand; PAM type: YTN; PAM sequence: CTG
attctcaaactttttgattt

SEQ ID NO: 74742 - DNA, 20 bp, Artificial Sequence
  Description of Artificial Sequence: Synthetic oligonucleotide
  Target: SCN10A; (+) strand; PAM type: YTN; PAM sequence: TTC
tcaaactttttgatttcagg

SEQ ID NO: 74743 - DNA, 20 bp, Artificial Sequence
  Description of Artificial Sequence: Synthetic oligonucleotide
  Target: SCN10A; (+) strand; PAM type: YTN; PAM sequence: CTC
aaactttttgatttcaggga

SEQ ID NO: 74744 - DNA, 20 bp, Artificial Sequence
  Description of Artificial Sequence: Synthetic oligonucleotide
  Target: SCN10A; (+) strand; PAM type: YTN; PAM sequence: CTT
tttgatttcagggattatta

SEQ ID NO: 74745 - DNA, 20 bp, Artificial Sequence
  Description of Artificial Sequence: Synthetic oligonucleotide
  Target: SCN10A; (+) strand; PAM type: YTN; PAM sequence: TTT
ttgatttcagggattattac

SEQ ID NO: 74746 - DNA, 20 bp, Artificial Sequence
  Description of Artificial Sequence: Synthetic oligonucleotide
  Target: SCN10A; (+) strand; PAM type: YTN; PAM sequence: TTT
tgatttcagggattattact

SEQ ID NO: 74747 - DNA, 20 bp, Artificial Sequence
  Description of Artificial Sequence: Synthetic oligonucleotide
  Target: SCN10A; (+) strand; PAM type: YTN; PAM sequence: TTT
gatttcagggattattactc

SEQ ID NO: 74748 - DNA, 20 bp, Artificial Sequence
  Description of Artificial Sequence: Synthetic oligonucleotide
  Target: SCN10A; (+) strand; PAM type: YTN; PAM sequence: TTG
atttcagggattattactct

SEQ ID NO: 74749 - DNA, 20 bp, Artificial Sequence
  Description of Artificial Sequence: Synthetic oligonucleotide
  Target: SCN10A; (+) strand; PAM type: YTN; PAM sequence: TTT
cagggattattactctcaaa

SEQ ID NO: 74750 - DNA, 20 bp, Artificial Sequence
  Description of Artificial Sequence: Synthetic oligonucleotide
  Target: SCN10A; (+) strand; PAM type: YTN; PAM sequence: TTC
agggattattactctcaaac

SEQ ID NO: 74751 - DNA, 20 bp, Artificial Sequence
  Description of Artificial Sequence: Synthetic oligonucleotide
  Target: SCN10A; (+) strand; PAM type: YTN; PAM sequence: TTA
ttactctcaaaccttattga

SEQ ID NO: 74752 - DNA, 20 bp, Artificial Sequence
  Description of Artificial Sequence: Synthetic oligonucleotide
  Target: SCN10A; (+) strand; PAM type: YTN; PAM sequence: TTA
ctctcaaaccttattgagga

SEQ ID NO: 74753 - DNA, 20 bp, Artificial Sequence
  Description of Artificial Sequence: Synthetic oligonucleotide
  Target: SCN10A; (+) strand; PAM type: YTN; PAM sequence: CTC
tcaaaccttattgaggaccc

SEQ ID NO: 74754 - DNA, 20 bp, Artificial Sequence
  Description of Artificial Sequence: Synthetic oligonucleotide
  Target: SCN10A; (+) strand; PAM type: YTN; PAM sequence: CTC
aaaccttattgaggacccca

SEQ ID NO: 74755 - DNA, 20 bp, Artificial Sequence
  Description of Artificial Sequence: Synthetic oligonucleotide
  Target: SCN10A; (+) strand; PAM type: YTN; PAM sequence: CTT
attgaggaccccaaataact

SEQ ID NO: 74756 - DNA, 20 bp, Artificial Sequence
  Description of Artificial Sequence: Synthetic oligonucleotide
  Target: SCN10A; (+) strand; PAM type: YTN; PAM sequence: TTA
ttgaggaccccaaataactt

SEQ ID NO: 74757 - DNA, 20 bp, Artificial Sequence
  Description of Artificial Sequence: Synthetic oligonucleotide
  Target: SCN10A; (+) strand; PAM type: YTN; PAM sequence: TTG
aggaccccaaataacttttg

SEQ ID NO: 74758 - DNA, 20 bp, Artificial Sequence
  Description of Artificial Sequence: Synthetic oligonucleotide
  Target: SCN10A; (+) strand; PAM type: YTN; PAM sequence: CTT
ttgtttatgttgataccttt

SEQ ID NO: 74759 - DNA, 20 bp, Artificial Sequence
  Description of Artificial Sequence: Synthetic oligonucleotide
  Target: SCN10A; (+) strand; PAM type: YTN; PAM sequence: TTT
tgtttatgttgatacctttt

SEQ ID NO: 74760 - DNA, 20 bp, Artificial Sequence
  Description of Artificial Sequence: Synthetic oligonucleotide
  Target: SCN10A; (+) strand; PAM type: YTN; PAM sequence: TTT
gtttatgttgataccttttt

SEQ ID NO: 74761 - DNA, 20 bp, Artificial Sequence
  Description of Artificial Sequence: Synthetic oligonucleotide
  Target: SCN10A; (+) strand; PAM type: YTN; PAM sequence: TTG
tttatgttgatacctttttg

SEQ ID NO: 74762 - DNA, 20 bp, Artificial Sequence
  Description of Artificial Sequence: Synthetic oligonucleotide
  Target: SCN10A; (+) strand; PAM type: YTN; PAM sequence: TTT
atgttgatacctttttgttt

SEQ ID NO: 74763 - DNA, 20 bp, Artificial Sequence
  Description of Artificial Sequence: Synthetic oligonucleotide
  Target: SCN10A; (+) strand; PAM type: YTN; PAM sequence: TTA
tgttgatacctttttgttta

SEQ ID NO: 74764 - DNA, 20 bp, Artificial Sequence
  Description of Artificial Sequence: Synthetic oligonucleotide
  Target: SCN10A; (+) strand; PAM type: YTN; PAM sequence: TTG
atacctttttgtttatgcca

SEQ ID NO: 74765 - DNA, 20 bp, Artificial Sequence
  Description of Artificial Sequence: Synthetic oligonucleotide
  Target: SCN10A; (+) strand; PAM type: YTN; PAM sequence: CTT
tttgtttatgccagatatat

SEQ ID NO: 74766 - DNA, 20 bp, Artificial Sequence
  Description of Artificial Sequence: Synthetic oligonucleotide
  Target: SCN10A; (+) strand; PAM type: YTN; PAM sequence: TTT
ttgtttatgccagatatatg

SEQ ID NO: 74767 - DNA, 20 bp, Artificial Sequence
  Description of Artificial Sequence: Synthetic oligonucleotide
  Target: SCN10A; (+) strand; PAM type: YTN; PAM sequence: TTT
tgtttatgccagatatatgt

SEQ ID NO: 74768 - DNA, 20 bp, Artificial Sequence
  Description of Artificial Sequence: Synthetic oligonucleotide
  Target: SCN10A; (+) strand; PAM type: YTN; PAM sequence: TTT
gtttatgccagatatatgta

SEQ ID NO: 74769 - DNA, 20 bp, Artificial Sequence
  Description of Artificial Sequence: Synthetic oligonucleotide
  Target: SCN10A; (+) strand; PAM type: YTN; PAM sequence: TTG
tttatgccagatatatgtat

SEQ ID NO: 74770 - DNA, 20 bp, Artificial Sequence
  Description of Artificial Sequence: Synthetic oligonucleotide
  Target: SCN10A; (+) strand; PAM type: YTN; PAM sequence: TTT
atgccagatatatgtatatc

SEQ ID NO: 74771 - DNA, 20 bp, Artificial Sequence
  Description of Artificial Sequence: Synthetic oligonucleotide
  Target: SCN10A; (+) strand; PAM type: YTN; PAM sequence: TTA
tgccagatatatgtatatca

SEQ ID NO: 74772 - DNA, 20 bp, Artificial Sequence
  Description of Artificial Sequence: Synthetic oligonucleotide
  Target: SCN10A; (+) strand; PAM type: YTN; PAM sequence: TTA
gaaattaatatatatgtata

SEQ ID NO: 74773 - DNA, 20 bp, Artificial Sequence
  Description of Artificial Sequence: Synthetic oligonucleotide
  Target: SCN10A; (+) strand; PAM type: YTN; PAM sequence: TTA
atatatatgtatatatgctt

SEQ ID NO: 74774 - DNA, 20 bp, Artificial Sequence
  Description of Artificial Sequence: Synthetic oligonucleotide
  Target: SCN10A; (+) strand; PAM type: YTN; PAM sequence: CTT
atatacctatatatacataa

SEQ ID NO: 74775 - DNA, 20 bp, Artificial Sequence
  Description of Artificial Sequence: Synthetic oligonucleotide
  Target: SCN10A; (+) strand; PAM type: YTN; PAM sequence: TTA
tatacctatatatacataac

SEQ ID NO: 74776 - DNA, 20 bp, Artificial Sequence
  Description of Artificial Sequence: Synthetic oligonucleotide
  Target: SCN10A; (+) strand; PAM type: YTN; PAM sequence: CTA
tatatacataactagctaca

SEQ ID NO: 74777 - DNA, 20 bp, Artificial Sequence
  Description of Artificial Sequence: Synthetic oligonucleotide
  Target: SCN10A; (+) strand; PAM type: YTN; PAM sequence: CTA
gctacatggtctagttgtat

SEQ ID NO: 74778 - DNA, 20 bp, Artificial Sequence
  Description of Artificial Sequence: Synthetic oligonucleotide
  Target: SCN10A; (+) strand; PAM type: YTN; PAM sequence: CTA
catggtctagttgtatgtat

SEQ ID NO: 74779 - DNA, 20 bp, Artificial Sequence
  Description of Artificial Sequence: Synthetic oligonucleotide
  Target: SCN10A; (+) strand; PAM type: YTN; PAM sequence: CTA
gttgtatgtatatacatagt

SEQ ID NO: 74780 - DNA, 20 bp, Artificial Sequence
  Description of Artificial Sequence: Synthetic oligonucleotide
  Target: SCN10A; (+) strand; PAM type: YTN; PAM sequence: TTG
tatgtatatacatagttgta

SEQ ID NO: 74781 - DNA, 20 bp, Artificial Sequence
  Description of Artificial Sequence: Synthetic oligonucleotide
  Target: SCN10A; (+) strand; PAM type: YTN; PAM sequence: TTG
tatgtatatatatagtgtat

SEQ ID NO: 74782 - DNA, 20 bp, Artificial Sequence
  Description of Artificial Sequence: Synthetic oligonucleotide
  Target: SCN10A; (+) strand; PAM type: YTN; PAM sequence: CTC
atattagaaattcaaaactc

SEQ ID NO: 74783 - DNA, 20 bp, Artificial Sequence
  Description of Artificial Sequence: Synthetic oligonucleotide
  Target: SCN10A; (+) strand; PAM type: YTN; PAM sequence: TTA
gaaattcaaaactcaggaaa

SEQ ID NO: 74784 - DNA, 20 bp, Artificial Sequence
  Description of Artificial Sequence: Synthetic oligonucleotide
  Target: SCN10A; (+) strand; PAM type: YTN; PAM sequence: TTC
aaaactcaggaaattttaaa

SEQ ID NO: 74785 - DNA, 20 bp, Artificial Sequence
  Description of Artificial Sequence: Synthetic oligonucleotide
  Target: SCN10A; (+) strand; PAM type: YTN; PAM sequence: CTC
aggaaattttaaaacacggg

SEQ ID NO: 74786 - DNA, 20 bp, Artificial Sequence
  Description of Artificial Sequence: Synthetic oligonucleotide
  Target: SCN10A; (+) strand; PAM type: YTN; PAM sequence: TTT
taaaacacgggaatatacag

SEQ ID NO: 74787 - DNA, 20 bp, Artificial Sequence
  Description of Artificial Sequence: Synthetic oligonucleotide
  Target: SCN10A; (+) strand; PAM type: YTN; PAM sequence: TTT
aaaacacgggaatatacagg

SEQ ID NO: 74788 - DNA, 20 bp, Artificial Sequence
  Description of Artificial Sequence: Synthetic oligonucleotide
  Target: SCN10A; (+) strand; PAM type: YTN; PAM sequence: TTA
aaacacgggaatatacaggc

SEQ ID NO: 74789 - DNA, 20 bp, Artificial Sequence
  Description of Artificial Sequence: Synthetic oligonucleotide
  Target: SCN10A; (+) strand; PAM type: YTN; PAM sequence: TTC
cagtagcttttagagtgatg

SEQ ID NO: 74790 - DNA, 20 bp, Artificial Sequence
  Description of Artificial Sequence: Synthetic oligonucleotide
  Target: SCN10A; (+) strand; PAM type: YTN; PAM sequence: CTT
ttagagtgatgacatcatcc

SEQ ID NO: 74791 - DNA, 20 bp, Artificial Sequence
  Description of Artificial Sequence: Synthetic oligonucleotide
  Target: SCN10A; (+) strand; PAM type: YTN; PAM sequence: TTT
tagagtgatgacatcatccc

SEQ ID NO: 74792 - DNA, 20 bp, Artificial Sequence
  Description of Artificial Sequence: Synthetic oligonucleotide
  Target: SCN10A; (+) strand; PAM type: YTN; PAM sequence: TTT
agagtgatgacatcatcccc

SEQ ID NO: 74793 - DNA, 20 bp, Artificial Sequence
  Description of Artificial Sequence: Synthetic oligonucleotide
  Target: SCN10A; (+) strand; PAM type: YTN; PAM sequence: TTA
gagtgatgacatcatccccc

SEQ ID NO: 74794 - DNA, 20 bp, Artificial Sequence
  Description of Artificial Sequence: Synthetic oligonucleotide
  Target: SCN10A; (+) strand; PAM type: YTN; PAM sequence: CTC
tatattcaccaatgtatgat

SEQ ID NO: 74795 - DNA, 20 bp, Artificial Sequence
  Description of Artificial Sequence: Synthetic oligonucleotide
  Target: SCN10A; (+) strand; PAM type: YTN; PAM sequence: CTA
tattcaccaatgtatgatca

SEQ ID NO: 74796 - DNA, 20 bp, Artificial Sequence
  Description of Artificial Sequence: Synthetic oligonucleotide
  Target: SCN10A; (+) strand; PAM type: YTN; PAM sequence: TTC
accaatgtatgatcataaga

SEQ ID NO: 74797 - DNA, 20 bp, Artificial Sequence
  Description of Artificial Sequence: Synthetic oligonucleotide
  Target: SCN10A; (+) strand; PAM type: YTN; PAM sequence: TTA
catccaagtattgttataca

SEQ ID NO: 74798 - DNA, 20 bp, Artificial Sequence
  Description of Artificial Sequence: Synthetic oligonucleotide
  Target: SCN10A; (+) strand; PAM type: YTN; PAM sequence: TTG
ttatacaatagttttcattt

SEQ ID NO: 74799 - DNA, 20 bp, Artificial Sequence
  Description of Artificial Sequence: Synthetic oligonucleotide
  Target: SCN10A; (+) strand; PAM type: YTN; PAM sequence: TTA
tacaatagttttcattttat

SEQ ID NO: 74800 - DNA, 20 bp, Artificial Sequence
  Description of Artificial Sequence: Synthetic oligonucleotide
  Target: SCN10A; (+) strand; PAM type: YTN; PAM sequence: TTT
tcattttataaacccactaa

SEQ ID NO: 74801 - DNA, 20 bp, Artificial Sequence
  Description of Artificial Sequence: Synthetic oligonucleotide
  Target: SCN10A; (+) strand; PAM type: YTN; PAM sequence: TTT
cattttataaacccactaaa

SEQ ID NO: 74802 - DNA, 20 bp, Artificial Sequence
  Description of Artificial Sequence: Synthetic oligonucleotide
  Target: SCN10A; (+) strand; PAM type: YTN; PAM sequence: TTC
attttataaacccactaaaa

SEQ ID NO: 74803 - DNA, 20 bp, Artificial Sequence
  Description of Artificial Sequence: Synthetic oligonucleotide
  Target: SCN10A; (+) strand; PAM type: YTN; PAM sequence: TTT
tataaacccactaaaacagt

SEQ ID NO: 74804 - DNA, 20 bp, Artificial Sequence
  Description of Artificial Sequence: Synthetic oligonucleotide
  Target: SCN10A; (+) strand; PAM type: YTN; PAM sequence: TTT
ataaacccactaaaacagtt

SEQ ID NO: 74805 - DNA, 20 bp, Artificial Sequence
  Description of Artificial Sequence: Synthetic oligonucleotide
  Target: SCN10A; (+) strand; PAM type: YTN; PAM sequence: TTA
taaacccactaaaacagttt

SEQ ID NO: 74806 - DNA, 20 bp, Artificial Sequence
  Description of Artificial Sequence: Synthetic oligonucleotide
  Target: SCN10A; (+) strand; PAM type: YTN; PAM sequence: CTA
aaacagttttggggacacca

SEQ ID NO: 74807 - DNA, 20 bp, Artificial Sequence
  Description of Artificial Sequence: Synthetic oligonucleotide
  Target: SCN10A; (+) strand; PAM type: YTN; PAM sequence: TTT
tggggacaccaggggttcca

SEQ ID NO: 74808 - DNA, 20 bp, Artificial Sequence
  Description of Artificial Sequence: Synthetic oligonucleotide
  Target: SCN10A; (+) strand; PAM type: YTN; PAM sequence: TTT
ggggacaccaggggttccaa

SEQ ID NO: 74809 - DNA, 20 bp, Artificial Sequence
  Description of Artificial Sequence: Synthetic oligonucleotide
  Target: SCN10A; (+) strand; PAM type: YTN; PAM sequence: TTG
gggacaccaggggttccaag

SEQ ID NO: 74810 - DNA, 20 bp, Artificial Sequence
  Description of Artificial Sequence: Synthetic oligonucleotide
  Target: SCN10A; (+) strand; PAM type: YTN; PAM sequence: TTC
caagatcatagttgaggacc

SEQ ID NO: 74811 - DNA, 20 bp, Artificial Sequence
  Description of Artificial Sequence: Synthetic oligonucleotide
  Target: SCN10A; (+) strand; PAM type: YTN; PAM sequence: TTG
aggaccactggcttaaattc

SEQ ID NO: 74812 - DNA, 20 bp, Artificial Sequence
  Description of Artificial Sequence: Synthetic oligonucleotide
  Target: SCN10A; (+) strand; PAM type: YTN; PAM sequence: CTG
gcttaaattcatcctgcttt

SEQ ID NO: 74813 - DNA, 20 bp, Artificial Sequence
  Description of Artificial Sequence: Synthetic oligonucleotide
  Target: SCN10A; (+) strand; PAM type: YTN; PAM sequence: CTT
aaattcatcctgctttctgt

SEQ ID NO: 74814 - DNA, 20 bp, Artificial Sequence
  Description of Artificial Sequence: Synthetic oligonucleotide
  Target: SCN10A; (+) strand; PAM type: YTN; PAM sequence: TTA
aattcatcctgctttctgtc

SEQ ID NO: 74815 - DNA, 20 bp, Artificial Sequence
  Description of Artificial Sequence: Synthetic oligonucleotide
  Target: SCN10A; (+) strand; PAM type: YTN; PAM sequence: TTC
atcctgctttctgtcctcac

SEQ ID NO: 74816 - DNA, 20 bp, Artificial Sequence
  Description of Artificial Sequence: Synthetic oligonucleotide
  Target: SCN10A; (+) strand; PAM type: YTN; PAM sequence: CTG
ctttctgtcctcaccgccat

SEQ ID NO: 74817 - DNA, 20 bp, Artificial Sequence
  Description of Artificial Sequence: Synthetic oligonucleotide
  Target: SCN10A; (+) strand; PAM type: YTN; PAM sequence: CTT
tctgtcctcaccgccatgct

SEQ ID NO: 74818 - DNA, 20 bp, Artificial Sequence
  Description of Artificial Sequence: Synthetic oligonucleotide
  Target: SCN10A; (+) strand; PAM type: YTN; PAM sequence: TTT
ctgtcctcaccgccatgctc

SEQ ID NO: 74819 - DNA, 20 bp, Artificial Sequence
  Description of Artificial Sequence: Synthetic oligonucleotide
  Target: SCN10A; (+) strand; PAM type: YTN; PAM sequence: TTC
tgtcctcaccgccatgctcc

SEQ ID NO: 74820 - DNA, 20 bp, Artificial Sequence
  Description of Artificial Sequence: Synthetic oligonucleotide
  Target: SCN10A; (+) strand; PAM type: YTN; PAM sequence: CTG
tcctcaccgccatgctcctc

SEQ ID NO: 74821 - DNA, 20 bp, Artificial Sequence
  Description of Artificial Sequence: Synthetic oligonucleotide
  Target: SCN10A; (+) strand; PAM type: YTN; PAM sequence: CTC
accgccatgctcctccccca

SEQ ID NO: 74822 - DNA, 20 bp, Artificial Sequence
  Description of Artificial Sequence: Synthetic oligonucleotide
  Target: SCN10A; (+) strand; PAM type: YTN; PAM sequence: CTC
ctcccccaacctcaagatgt

SEQ ID NO: 74823 - DNA, 20 bp, Artificial Sequence
  Description of Artificial Sequence: Synthetic oligonucleotide
  Target: SCN10A; (+) strand; PAM type: YTN; PAM sequence: CTC
ccccaacctcaagatgtctg

SEQ ID NO: 74824 - DNA, 20 bp, Artificial Sequence
  Description of Artificial Sequence: Synthetic oligonucleotide
  Target: SCN10A; (+) strand; PAM type: YTN; PAM sequence: CTC
aagatgtctgctctccacct

SEQ ID NO: 74825 - DNA, 20 bp, Artificial Sequence
  Description of Artificial Sequence: Synthetic oligonucleotide
  Target: SCN10A; (+) strand; PAM type: YTN; PAM sequence: CTG
ctctccacctgcaaagagac

SEQ ID NO: 74826 - DNA, 20 bp, Artificial Sequence
  Description of Artificial Sequence: Synthetic oligonucleotide
  Target: SCN10A; (+) strand; PAM type: YTN; PAM sequence: CTC
tccacctgcaaagagaccca

SEQ ID NO: 74827 - DNA, 20 bp, Artificial Sequence
  Description of Artificial Sequence: Synthetic oligonucleotide
  Target: SCN10A; (+) strand; PAM type: YTN; PAM sequence: CTC
cacctgcaaagagacccaac

SEQ ID NO: 74828 - DNA, 20 bp, Artificial Sequence
  Description of Artificial Sequence: Synthetic oligonucleotide
  Target: SCN10A; (+) strand; PAM type: YTN; PAM sequence: CTG
caaagagacccaactcctct

SEQ ID NO: 74829 - DNA, 20 bp, Artificial Sequence
  Description of Artificial Sequence: Synthetic oligonucleotide
  Target: SCN10A; (+) strand; PAM type: YTN; PAM sequence: CTC
ctctggaggccccaggccag

SEQ ID NO: 74830 - DNA, 20 bp, Artificial Sequence
  Description of Artificial Sequence: Synthetic oligonucleotide
  Target: SCN10A; (+) strand; PAM type: YTN; PAM sequence: CTC
tggaggccccaggccagagg

SEQ ID NO: 74831 - DNA, 20 bp, Artificial Sequence
  Description of Artificial Sequence: Synthetic oligonucleotide
  Target: SCN10A; (+) strand; PAM type: YTN; PAM sequence: CTG
gaggccccaggccagaggtc

SEQ ID NO: 74832 - DNA, 20 bp, Artificial Sequence
  Description of Artificial Sequence: Synthetic oligonucleotide
  Target: SCN10A; (+) strand; PAM type: YTN; PAM sequence: CTT
tccctgaaagctctgcagca

SEQ ID NO: 74833 - DNA, 20 bp, Artificial Sequence
  Description of Artificial Sequence: Synthetic oligonucleotide
  Target: SCN10A; (+) strand; PAM type: YTN; PAM sequence: TTT
ccctgaaagctctgcagcag

SEQ ID NO: 74834 - DNA, 20 bp, Artificial Sequence
  Description of Artificial Sequence: Synthetic oligonucleotide
  Target: SCN10A; (+) strand; PAM type: YTN; PAM sequence: TTC
cctgaaagctctgcagcagt

SEQ ID NO: 74835 - DNA, 20 bp, Artificial Sequence
  Description of Artificial Sequence: Synthetic oligonucleotide
  Target: SCN10A; (+) strand; PAM type: YTN; PAM sequence: CTG
aaagctctgcagcagttatc

SEQ ID NO: 74836 - DNA, 20 bp, Artificial Sequence
  Description of Artificial Sequence: Synthetic oligonucleotide
  Target: SCN10A; (+) strand; PAM type: YTN; PAM sequence: CTC
tgcagcagttatctgctttt

SEQ ID NO: 74837 - DNA, 20 bp, Artificial Sequence
  Description of Artificial Sequence: Synthetic oligonucleotide
  Target: SCN10A; (+) strand; PAM type: YTN; PAM sequence: CTG
cagcagttatctgcttttga

SEQ ID NO: 74838 - DNA, 20 bp, Artificial Sequence
  Description of Artificial Sequence: Synthetic oligonucleotide
  Target: SCN10A; (+) strand; PAM type: YTN; PAM sequence: TTA
tctgcttttgaagatgtggg

SEQ ID NO: 74839 - DNA, 20 bp, Artificial Sequence
  Description of Artificial Sequence: Synthetic oligonucleotide
  Target: SCN10A; (+) strand; PAM type: YTN; PAM sequence: CTG
cttttgaagatgtgggttta

SEQ ID NO: 74840 - DNA, 20 bp, Artificial Sequence
  Description of Artificial Sequence: Synthetic oligonucleotide
  Target: SCN10A; (+) strand; PAM type: YTN; PAM sequence: CTT
ttgaagatgtgggtttagtt

SEQ ID NO: 74841 - DNA, 20 bp, Artificial Sequence
  Description of Artificial Sequence: Synthetic oligonucleotide
  Target: SCN10A; (+) strand; PAM type: YTN; PAM sequence: TTT
tgaagatgtgggtttagtta

SEQ ID NO: 74842 - DNA, 20 bp, Artificial Sequence
  Description of Artificial Sequence: Synthetic oligonucleotide
  Target: SCN10A; (+) strand; PAM type: YTN; PAM sequence: TTT
gaagatgtgggtttagttag

SEQ ID NO: 74843 - DNA, 20 bp, Artificial Sequence
  Description of Artificial Sequence: Synthetic oligonucleotide
  Target: SCN10A; (+) strand; PAM type: YTN; PAM sequence: TTG
aagatgtgggtttagttagt

SEQ ID NO: 74844 - DNA, 20 bp, Artificial Sequence
  Description of Artificial Sequence: Synthetic oligonucleotide
  Target: SCN10A; (+) strand; PAM type: YTN; PAM sequence: TTT
agttagtttctatcataaat

SEQ ID NO: 74845 - DNA, 20 bp, Artificial Sequence
  Description of Artificial Sequence: Synthetic oligonucleotide
  Target: SCN10A; (+) strand; PAM type: YTN; PAM sequence: TTA
gttagtttctatcataaatg

SEQ ID NO: 74846 - DNA, 20 bp, Artificial Sequence
  Description of Artificial Sequence: Synthetic oligonucleotide
  Target: SCN10A; (+) strand; PAM type: YTN; PAM sequence: TTA
gtttctatcataaatgtcat

SEQ ID NO: 74847 - DNA, 20 bp, Artificial Sequence
  Description of Artificial Sequence: Synthetic oligonucleotide
  Target: SCN10A; (+) strand; PAM type: YTN; PAM sequence: TTT
ctatcataaatgtcataaaa

SEQ ID NO: 74848 - DNA, 20 bp, Artificial Sequence
  Description of Artificial Sequence: Synthetic oligonucleotide
  Target: SCN10A; (+) strand; PAM type: YTN; PAM sequence: TTC
tatcataaatgtcataaaaa

SEQ ID NO: 74849 - DNA, 20 bp, Artificial Sequence
  Description of Artificial Sequence: Synthetic oligonucleotide
  Target: SCN10A; (+) strand; PAM type: YTN; PAM sequence: CTA
tcataaatgtcataaaaatt

SEQ ID NO: 74850 - DNA, 20 bp, Artificial Sequence
  Description of Artificial Sequence: Synthetic oligonucleotide
  Target: SCN10A; (+) strand; PAM type: YTN; PAM sequence: TTC
aaagagatcatcaaataagt

SEQ ID NO: 74851 - DNA, 20 bp, Artificial Sequence
  Description of Artificial Sequence: Synthetic oligonucleotide
  Target: SCN10A; (+) strand; PAM type: YTN; PAM sequence: TTA
gagatatatatatatatttt

SEQ ID NO: 74852 - DNA, 20 bp, Artificial Sequence
  Description of Artificial Sequence: Synthetic oligonucleotide
  Target: SCN10A; (+) strand; PAM type: YTN; PAM sequence: TTT
tttttggttgttaacggaat

SEQ ID NO: 74853 - DNA, 20 bp, Artificial Sequence
  Description of Artificial Sequence: Synthetic oligonucleotide
  Target: SCN10A; (+) strand; PAM type: YTN; PAM sequence: TTT
ttttggttgttaacggaatc

SEQ ID NO: 74854 - DNA, 20 bp, Artificial Sequence
  Description of Artificial Sequence: Synthetic oligonucleotide
  Target: SCN10A; (+) strand; PAM type: YTN; PAM sequence: TTT
tttggttgttaacggaatct

SEQ ID NO: 74855 - DNA, 20 bp, Artificial Sequence
  Description of Artificial Sequence: Synthetic oligonucleotide
  Target: SCN10A; (+) strand; PAM type: YTN; PAM sequence: TTT
ttggttgttaacggaatctt

SEQ ID NO: 74856 - DNA, 20 bp, Artificial Sequence
  Description of Artificial Sequence: Synthetic oligonucleotide
  Target: SCN10A; (+) strand; PAM type: YTN; PAM sequence: TTT
tggttgttaacggaatcttt

SEQ ID NO: 74857 - DNA, 20 bp, Artificial Sequence
  Description of Artificial Sequence: Synthetic oligonucleotide
  Target: SCN10A; (+) strand; PAM type: YTN; PAM sequence: TTT
ggttgttaacggaatcttta

SEQ ID NO: 74858 - DNA, 20 bp, Artificial Sequence
  Description of Artificial Sequence: Synthetic oligonucleotide
  Target: SCN10A; (+) strand; PAM type: YTN; PAM sequence: TTG
gttgttaacggaatctttag

SEQ ID NO: 74859 - DNA, 20 bp, Artificial Sequence
  Description of Artificial Sequence: Synthetic oligonucleotide
  Target: SCN10A; (+) strand; PAM type: YTN; PAM sequence: TTG
ttaacggaatctttagcaga

SEQ ID NO: 74860 - DNA, 20 bp, Artificial Sequence
  Description of Artificial Sequence: Synthetic oligonucleotide
  Target: SCN10A; (+) strand; PAM type: YTN; PAM sequence: TTA
acggaatctttagcagactg

SEQ ID NO: 74861 - DNA, 20 bp, Artificial Sequence
  Description of Artificial Sequence: Synthetic oligonucleotide
  Target: SCN10A; (+) strand; PAM type: YTN; PAM sequence: CTT
tagcagactgccacatcacc

SEQ ID NO: 74862 - DNA, 20 bp, Artificial Sequence
  Description of Artificial Sequence: Synthetic oligonucleotide
  Target: SCN10A; (+) strand; PAM type: YTN; PAM sequence: TTT
agcagactgccacatcaccc

SEQ ID NO: 74863 - DNA, 20 bp, Artificial Sequence
  Description of Artificial Sequence: Synthetic oligonucleotide
  Target: SCN10A; (+) strand; PAM type: YTN; PAM sequence: TTA
gcagactgccacatcaccca

SEQ ID NO: 74864 - DNA, 20 bp, Artificial Sequence
  Description of Artificial Sequence: Synthetic oligonucleotide
  Target: SCN10A; (+) strand; PAM type: YTN; PAM sequence: CTG
ccacatcacccagggccaag

SEQ ID NO: 74865 - DNA, 20 bp, Artificial Sequence
  Description of Artificial Sequence: Synthetic oligonucleotide
  Target: SCN10A; (+) strand; PAM type: YTN; PAM sequence: CTT
tctgggctgggtgggaccga

SEQ ID NO: 74866 - DNA, 20 bp, Artificial Sequence
  Description of Artificial Sequence: Synthetic oligonucleotide
  Target: SCN10A; (+) strand; PAM type: YTN; PAM sequence: TTT
ctgggctgggtgggaccgag

SEQ ID NO: 74867 - DNA, 20 bp, Artificial Sequence
  Description of Artificial Sequence: Synthetic oligonucleotide
  Target: SCN10A; (+) strand; PAM type: YTN; PAM sequence: TTC
tgggctgggtgggaccgaga

SEQ ID NO: 74868 - DNA, 20 bp, Artificial Sequence
  Description of Artificial Sequence: Synthetic oligonucleotide
  Target: SCN10A; (+) strand; PAM type: YTN; PAM sequence: CTG
ggctgggtgggaccgagact

SEQ ID NO: 74869 - DNA, 20 bp, Artificial Sequence
  Description of Artificial Sequence: Synthetic oligonucleotide
  Target: SCN10A; (+) strand; PAM type: YTN; PAM sequence: CTG
ggtgggaccgagacttcctc

SEQ ID NO: 74870 - DNA, 20 bp, Artificial Sequence
  Description of Artificial Sequence: Synthetic oligonucleotide
  Target: SCN10A; (+) strand; PAM type: YTN; PAM sequence: CTT
cctctccaagagctgagagc

SEQ ID NO: 74871 - DNA, 20 bp, Artificial Sequence
  Description of Artificial Sequence: Synthetic oligonucleotide
  Target: SCN10A; (+) strand; PAM type: YTN; PAM sequence: TTC
ctctccaagagctgagagca

SEQ ID NO: 74872 - DNA, 20 bp, Artificial Sequence
  Description of Artificial Sequence: Synthetic oligonucleotide
  Target: SCN10A; (+) strand; PAM type: YTN; PAM sequence: CTC
tccaagagctgagagcagac

SEQ ID NO: 74873 - DNA, 20 bp, Artificial Sequence
  Description of Artificial Sequence: Synthetic oligonucleotide
  Target: SCN10A; (+) strand; PAM type: YTN; PAM sequence: CTC
caagagctgagagcagacat

SEQ ID NO: 74874 - DNA, 20 bp, Artificial Sequence
  Description of Artificial Sequence: Synthetic oligonucleotide
  Target: SCN10A; (+) strand; PAM type: YTN; PAM sequence: CTG
agagcagacattcctactag

SEQ ID NO: 74875 - DNA, 20 bp, Artificial Sequence
  Description of Artificial Sequence: Synthetic oligonucleotide
  Target: SCN10A; (+) strand; PAM type: YTN; PAM sequence: TTC
ctactagtagctcttacccg

SEQ ID NO: 74876 - DNA, 20 bp, Artificial Sequence
  Description of Artificial Sequence: Synthetic oligonucleotide
  Target: SCN10A; (+) strand; PAM type: YTN; PAM sequence: CTA
ctagtagctcttacccggtg

SEQ ID NO: 74877 - DNA, 20 bp, Artificial Sequence
  Description of Artificial Sequence: Synthetic oligonucleotide
  Target: SCN10A; (+) strand; PAM type: YTN; PAM sequence: CTA
gtagctcttacccggtgtgt

SEQ ID NO: 74878 - DNA, 20 bp, Artificial Sequence
  Description of Artificial Sequence: Synthetic oligonucleotide
  Target: SCN10A; (+) strand; PAM type: YTN; PAM sequence: CTC
ttacccggtgtgtgctgtag

SEQ ID NO: 74879 - DNA, 20 bp, Artificial Sequence
  Description of Artificial Sequence: Synthetic oligonucleotide
  Target: SCN10A; (+) strand; PAM type: YTN; PAM sequence: CTT
acccggtgtgtgctgtagaa

SEQ ID NO: 74880 - DNA, 20 bp, Artificial Sequence
  Description of Artificial Sequence: Synthetic oligonucleotide
  Target: SCN10A; (+) strand; PAM type: YTN; PAM sequence: TTA
cccggtgtgtgctgtagaac

SEQ ID NO: 74881 - DNA, 20 bp, Artificial Sequence
  Description of Artificial Sequence: Synthetic oligonucleotide
  Target: SCN10A; (+) strand; PAM type: YTN; PAM sequence: CTG
tagaacggatctagatcctc

SEQ ID NO: 74882 - DNA, 20 bp, Artificial Sequence
  Description of Artificial Sequence: Synthetic oligonucleotide
  Target: SCN10A; (+) strand; PAM type: YTN; PAM sequence: CTA
gatcctccaggggctccccg

SEQ ID NO: 74883 - DNA, 20 bp, Artificial Sequence
  Description of Artificial Sequence: Synthetic oligonucleotide
  Target: SCN10A; (+) strand; PAM type: YTN; PAM sequence: CTC
caggggctccccgatcagtt

SEQ ID NO: 74884 - DNA, 20 bp, Artificial Sequence
  Description of Artificial Sequence: Synthetic oligonucleotide
  Target: SCN10A; (+) strand; PAM type: YTN; PAM sequence: CTC
cccgatcagttctgctggga

SEQ ID NO: 74885 - DNA, 20 bp, Artificial Sequence
  Description of Artificial Sequence: Synthetic oligonucleotide
  Target: SCN10A; (+) strand; PAM type: YTN; PAM sequence: TTC
tgctgggagctcaccataga

SEQ ID NO: 74886 - DNA, 20 bp, Artificial Sequence
  Description of Artificial Sequence: Synthetic oligonucleotide
  Target: SCN10A; (+) strand; PAM type: YTN; PAM sequence: CTG
ctgggagctcaccatagaac

SEQ ID NO: 74887 - DNA, 20 bp, Artificial Sequence
  Description of Artificial Sequence: Synthetic oligonucleotide
  Target: SCN10A; (+) strand; PAM type: YTN; PAM sequence: CTG
ggagctcaccatagaacttg

SEQ ID NO: 74888 - DNA, 20 bp, Artificial Sequence
  Description of Artificial Sequence: Synthetic oligonucleotide
  Target: SCN10A; (+) strand; PAM type: YTN; PAM sequence: CTC
accatagaacttgggcagct

SEQ ID NO: 74889 - DNA, 20 bp, Artificial Sequence
  Description of Artificial Sequence: Synthetic oligonucleotide
  Target: SCN10A; (+) strand; PAM type: YTN; PAM sequence: CTT
gggcagctggttgcaggctt

SEQ ID NO: 74890 - DNA, 20 bp, Artificial Sequence
  Description of Artificial Sequence: Synthetic oligonucleotide
  Target: SCN10A; (+) strand; PAM type: YTN; PAM sequence: TTG
ggcagctggttgcaggcttt

SEQ ID NO: 74891 - DNA, 20 bp, Artificial Sequence
  Description of Artificial Sequence: Synthetic oligonucleotide
  Target: SCN10A; (+) strand; PAM type: YTN; PAM sequence: CTG
gttgcaggctttcaagtcca

SEQ ID NO: 74892 - DNA, 20 bp, Artificial Sequence
  Description of Artificial Sequence: Synthetic oligonucleotide
  Target: SCN10A; (+) strand; PAM type: YTN; PAM sequence: TTG
caggctttcaagtccagctg

SEQ ID NO: 74893 - DNA, 20 bp, Artificial Sequence
  Description of Artificial Sequence: Synthetic oligonucleotide
  Target: SCN10A; (+) strand; PAM type: YTN; PAM sequence: CTT
tcaagtccagctggggccga

SEQ ID NO: 74894 - DNA, 20 bp, Artificial Sequence
  Description of Artificial Sequence: Synthetic oligonucleotide
  Target: SCN10A; (+) strand; PAM type: YTN; PAM sequence: TTT
caagtccagctggggccgag

SEQ ID NO: 74895 - DNA, 20 bp, Artificial Sequence
  Description of Artificial Sequence: Synthetic oligonucleotide
  Target: SCN10A; (+) strand; PAM type: YTN; PAM sequence: TTC
aagtccagctggggccgagg

SEQ ID NO: 74896 - DNA, 20 bp, Artificial Sequence
  Description of Artificial Sequence: Synthetic oligonucleotide
  Target: SCN10A; (+) strand; PAM type: YTN; PAM sequence: CTG
gggccgaggcttctcttctt

SEQ ID NO: 74897 - DNA, 20 bp, Artificial Sequence
  Description of Artificial Sequence: Synthetic oligonucleotide
  Target: SCN10A; (+) strand; PAM type: YTN; PAM sequence: CTT
ctcttcttggtccttctgct

SEQ ID NO: 74898 - DNA, 20 bp, Artificial Sequence
  Description of Artificial Sequence: Synthetic oligonucleotide
  Target: SCN10A; (+) strand; PAM type: YTN; PAM sequence: TTC
tcttcttggtccttctgctc

SEQ ID NO: 74899 - DNA, 20 bp, Artificial Sequence
  Description of Artificial Sequence: Synthetic oligonucleotide
  Target: SCN10A; (+) strand; PAM type: YTN; PAM sequence: CTC
ttcttggtccttctgctccc

SEQ ID NO: 74900 - DNA, 20 bp, Artificial Sequence
  Description of Artificial Sequence: Synthetic oligonucleotide
  Target: SCN10A; (+) strand; PAM type: YTN; PAM sequence: CTT
cttggtccttctgctcccta

SEQ ID NO: 74901 - DNA, 20 bp, Artificial Sequence
  Description of Artificial Sequence: Synthetic oligonucleotide
  Target: SCN10A; (+) strand; PAM type: YTN; PAM sequence: TTC
ttggtccttctgctccctat

SEQ ID NO: 74902 - DNA, 20 bp, Artificial Sequence
  Description of Artificial Sequence: Synthetic oligonucleotide
  Target: SCN10A; (+) strand; PAM type: YTN; PAM sequence: CTT
ggtccttctgctccctatgc

SEQ ID NO: 74903 - DNA, 20 bp, Artificial Sequence
  Description of Artificial Sequence: Synthetic oligonucleotide
  Target: SCN10A; (+) strand; PAM type: YTN; PAM sequence: TTG
gtccttctgctccctatgct

SEQ ID NO: 74904 - DNA, 20 bp, Artificial Sequence
  Description of Artificial Sequence: Synthetic oligonucleotide
  Target: SCN10A; (+) strand; PAM type: YTN; PAM sequence: CTT
ctgctccctatgcttctctc

SEQ ID NO: 74905 - DNA, 20 bp, Artificial Sequence
  Description of Artificial Sequence: Synthetic oligonucleotide
  Target: SCN10A; (+) strand; PAM type: YTN; PAM sequence: TTC
tgctccctatgcttctctct

SEQ ID NO: 74906 - DNA, 20 bp, Artificial Sequence
  Description of Artificial Sequence: Synthetic oligonucleotide
  Target: SCN10A; (+) strand; PAM type: YTN; PAM sequence: CTG
ctccctatgcttctctctgg

SEQ ID NO: 74907 - DNA, 20 bp, Artificial Sequence
  Description of Artificial Sequence: Synthetic oligonucleotide
  Target: SCN10A; (+) strand; PAM type: YTN; PAM sequence: CTC
cctatgcttctctctggctt

SEQ ID NO: 74908 - DNA, 20 bp, Artificial Sequence
  Description of Artificial Sequence: Synthetic oligonucleotide
  Target: SCN10A; (+) strand; PAM type: YTN; PAM sequence: CTA
tgcttctctctggctttctt

SEQ ID NO: 74909 - DNA, 20 bp, Artificial Sequence
  Description of Artificial Sequence: Synthetic oligonucleotide
  Target: SCN10A; (+) strand; PAM type: YTN; PAM sequence: CTT
ctctctggctttctttgttc

SEQ ID NO: 74910 - DNA, 20 bp, Artificial Sequence
  Description of Artificial Sequence: Synthetic oligonucleotide
  Target: SCN10A; (+) strand; PAM type: YTN; PAM sequence: TTC
tctctggctttctttgttcc

SEQ ID NO: 74911 - DNA, 20 bp, Artificial Sequence
  Description of Artificial Sequence: Synthetic oligonucleotide
  Target: SCN10A; (+) strand; PAM type: YTN; PAM sequence: CTC
tctggctttctttgttccct

SEQ ID NO: 74912 - DNA, 20 bp, Artificial Sequence
  Description of Artificial Sequence: Synthetic oligonucleotide
  Target: SCN10A; (+) strand; PAM type: YTN; PAM sequence: CTC
tggctttctttgttccctgc

SEQ ID NO: 74913 - DNA, 20 bp, Artificial Sequence
  Description of Artificial Sequence: Synthetic oligonucleotide
  Target: SCN10A; (+) strand; PAM type: YTN; PAM sequence: CTG
gctttctttgttccctgctt

SEQ ID NO: 74914 - DNA, 20 bp, Artificial Sequence
  Description of Artificial Sequence: Synthetic oligonucleotide
  Target: SCN10A; (+) strand; PAM type: YTN; PAM sequence: CTT
tctttgttccctgcttggca

SEQ ID NO: 74915 - DNA, 20 bp, Artificial Sequence
  Description of Artificial Sequence: Synthetic oligonucleotide
  Target: SCN10A; (+) strand; PAM type: YTN; PAM sequence: TTT
ctttgttccctgcttggcag

SEQ ID NO: 74916 - DNA, 20 bp, Artificial Sequence
  Description of Artificial Sequence: Synthetic oligonucleotide
  Target: SCN10A; (+) strand; PAM type: YTN; PAM sequence: TTC
tttgttccctgcttggcagc

SEQ ID NO: 74917 - DNA, 20 bp, Artificial Sequence
  Description of Artificial Sequence: Synthetic oligonucleotide
  Target: SCN10A; (+) strand; PAM type: YTN; PAM sequence: CTT
tgttccctgcttggcagcaa

SEQ ID NO: 74918 - DNA, 20 bp, Artificial Sequence
  Description of Artificial Sequence: Synthetic oligonucleotide
  Target: SCN10A; (+) strand; PAM type: YTN; PAM sequence: TTT
gttccctgcttggcagcaat

SEQ ID NO: 74919 - DNA, 20 bp, Artificial Sequence
  Description of Artificial Sequence: Synthetic oligonucleotide
  Target: SCN10A; (+) strand; PAM type: YTN; PAM sequence: TTG
ttccctgcttggcagcaatt

SEQ ID NO: 74920 - DNA, 20 bp, Artificial Sequence
  Description of Artificial Sequence: Synthetic oligonucleotide
  Target: SCN10A; (+) strand; PAM type: YTN; PAM sequence: TTC
cctgcttggcagcaatttgc

SEQ ID NO: 74921 - DNA, 20 bp, Artificial Sequence
  Description of Artificial Sequence: Synthetic oligonucleotide
  Target: SCN10A; (+) strand; PAM type: YTN; PAM sequence: CTG
cttggcagcaatttgcttct

SEQ ID NO: 74922 - DNA, 20 bp, Artificial Sequence
  Description of Artificial Sequence: Synthetic oligonucleotide
  Target: SCN10A; (+) strand; PAM type: YTN; PAM sequence: CTT
ggcagcaatttgcttctcta

SEQ ID NO: 74923 - DNA, 20 bp, Artificial Sequence
  Description of Artificial Sequence: Synthetic oligonucleotide
  Target: SCN10A; (+) strand; PAM type: YTN; PAM sequence: TTG
gcagcaatttgcttctctat

SEQ ID NO: 74924 - DNA, 20 bp, Artificial Sequence
  Description of Artificial Sequence: Synthetic oligonucleotide
  Target: SCN10A; (+) strand; PAM type: YTN; PAM sequence: TTT
gcttctctatctccaccagt

SEQ ID NO: 74925 - DNA, 20 bp, Artificial Sequence
  Description of Artificial Sequence: Synthetic oligonucleotide
  Target: SCN10A; (+) strand; PAM type: YTN; PAM sequence: TTG
cttctctatctccaccagtg

SEQ ID NO: 74926 - DNA, 20 bp, Artificial Sequence
  Description of Artificial Sequence: Synthetic oligonucleotide
  Target: SCN10A; (+) strand; PAM type: YTN; PAM sequence: CTT
ctctatctccaccagtgact

SEQ ID NO: 74927 - DNA, 20 bp, Artificial Sequence
  Description of Artificial Sequence: Synthetic oligonucleotide
  Target: SCN10A; (+) strand; PAM type: YTN; PAM sequence: TTC
tctatctccaccagtgactc

SEQ ID NO: 74928 - DNA, 20 bp, Artificial Sequence
  Description of Artificial Sequence: Synthetic oligonucleotide
  Target: SCN10A; (+) strand; PAM type: YTN; PAM sequence: CTC
tatctccaccagtgactccg

SEQ ID NO: 74929 - DNA, 20 bp, Artificial Sequence
  Description of Artificial Sequence: Synthetic oligonucleotide
  Target: SCN10A; (+) strand; PAM type: YTN; PAM sequence: CTA
tctccaccagtgactccgga

SEQ ID NO: 74930 - DNA, 20 bp, Artificial Sequence
  Description of Artificial Sequence: Synthetic oligonucleotide
  Target: SCN10A; (+) strand; PAM type: YTN; PAM sequence: CTC
caccagtgactccggagtaa

SEQ ID NO: 74931 - DNA, 20 bp, Artificial Sequence
  Description of Artificial Sequence: Synthetic oligonucleotide
  Target: SCN10A; (+) strand; PAM type: YTN; PAM sequence: CTC
cggagtaaagcgacggaagt

SEQ ID NO: 74932 - DNA, 20 bp, Artificial Sequence
  Description of Artificial Sequence: Synthetic oligonucleotide
  Target: SCN10A; (+) strand; PAM type: YTN; PAM sequence: TTG
ttagtttcgagggatccaat

SEQ ID NO: 74933 - DNA, 20 bp, Artificial Sequence
  Description of Artificial Sequence: Synthetic oligonucleotide
  Target: SCN10A; (+) strand; PAM type: YTN; PAM sequence: TTA
gtttcgagggatccaatggg

SEQ ID NO: 74934 - DNA, 20 bp, Artificial Sequence
  Description of Artificial Sequence: Synthetic oligonucleotide
  Target: SCN10A; (+) strand; PAM type: YTN; PAM sequence: TTT
cgagggatccaatggggaat

SEQ ID NO: 74935 - DNA, 20 bp, Artificial Sequence
  Description of Artificial Sequence: Synthetic oligonucleotide
  Target: SCN10A; (+) strand; PAM type: YTN; PAM sequence: TTC
gagggatccaatggggaatt

SEQ ID NO: 74936 - DNA, 20 bp, Artificial Sequence
  Description of Artificial Sequence: Synthetic oligonucleotide
  Target: SCN10A; (+) strand; PAM type: YTN; PAM sequence: TTC
catcttctcattcttcttca

SEQ ID NO: 74937 - DNA, 20 bp, Artificial Sequence
  Description of Artificial Sequence: Synthetic oligonucleotide
  Target: SCN10A; (+) strand; PAM type: YTN; PAM sequence: CTT
ctcattcttcttcaggaagt

SEQ ID NO: 74938 - DNA, 20 bp, Artificial Sequence
  Description of Artificial Sequence: Synthetic oligonucleotide
  Target: SCN10A; (+) strand; PAM type: YTN; PAM sequence: TTC
tcattcttcttcaggaagta

SEQ ID NO: 74939 - DNA, 20 bp, Artificial Sequence
  Description of Artificial Sequence: Synthetic oligonucleotide
  Target: SCN10A; (+) strand; PAM type: YTN; PAM sequence: CTC
attcttcttcaggaagtatt

SEQ ID NO: 74940 - DNA, 20 bp, Artificial Sequence
  Description of Artificial Sequence: Synthetic oligonucleotide
  Target: SCN10A; (+) strand; PAM type: YTN; PAM sequence: TTC
ttcttcaggaagtatttata

SEQ ID NO: 74941 - DNA, 20 bp, Artificial Sequence
  Description of Artificial Sequence: Synthetic oligonucleotide
  Target: SCN10A; (+) strand; PAM type: YTN; PAM sequence: CTT
cttcaggaagtatttatact

SEQ ID NO: 74942 - DNA, 20 bp, Artificial Sequence
  Description of Artificial Sequence: Synthetic oligonucleotide
  Target: SCN10A; (+) strand; PAM type: YTN; PAM sequence: TTC
ttcaggaagtatttatactc

SEQ ID NO: 74943 - DNA, 20 bp, Artificial Sequence
  Description of Artificial Sequence: Synthetic oligonucleotide
  Target: SCN10A; (+) strand; PAM type: YTN; PAM sequence: CTT
caggaagtatttatactctt

SEQ ID NO: 74944 - DNA, 20 bp, Artificial Sequence
  Description of Artificial Sequence: Synthetic oligonucleotide
  Target: SCN10A; (+) strand; PAM type: YTN; PAM sequence: TTC
aggaagtatttatactctta

SEQ ID NO: 74945 - DNA, 20 bp, Artificial Sequence
  Description of Artificial Sequence: Synthetic oligonucleotide
  Target: SCN10A; (+) strand; PAM type: YTN; PAM sequence: TTT
atactcttataagagtggac

SEQ ID NO: 74946 - DNA, 20 bp, Artificial Sequence
  Description of Artificial Sequence: Synthetic oligonucleotide
  Target: SCN10A; (+) strand; PAM type: YTN; PAM sequence: TTA
tactcttataagagtggaca

SEQ ID NO: 74947 - DNA, 20 bp, Artificial Sequence
  Description of Artificial Sequence: Synthetic oligonucleotide
  Target: SCN10A; (+) strand; PAM type: YTN; PAM sequence: CTC
ttataagagtggacataacc

SEQ ID NO: 74948 - DNA, 20 bp, Artificial Sequence
  Description of Artificial Sequence: Synthetic oligonucleotide
  Target: SCN10A; (+) strand; PAM type: YTN; PAM sequence: CTT
ataagagtggacataaccac

SEQ ID NO: 74949 - DNA, 20 bp, Artificial Sequence
  Description of Artificial Sequence: Synthetic oligonucleotide
  Target: SCN10A; (+) strand; PAM type: YTN; PAM sequence: TTA
taagagtggacataaccaca

SEQ ID NO: 74950 - DNA, 20 bp, Artificial Sequence
  Description of Artificial Sequence: Synthetic oligonucleotide
  Target: SCN10A; (+) strand; PAM type: YTN; PAM sequence: CTT
gcccactggccctgtccctc

SEQ ID NO: 74951 - DNA, 20 bp, Artificial Sequence
  Description of Artificial Sequence: Synthetic oligonucleotide
  Target: SCN10A; (+) strand; PAM type: YTN; PAM sequence: TTG
cccactggccctgtccctct

SEQ ID NO: 74952 - DNA, 20 bp, Artificial Sequence
  Description of Artificial Sequence: Synthetic oligonucleotide
  Target: SCN10A; (+) strand; PAM type: YTN; PAM sequence: CTG
gccctgtccctctcatctgt

SEQ ID NO: 74953 - DNA, 20 bp, Artificial Sequence
  Description of Artificial Sequence: Synthetic oligonucleotide
  Target: SCN10A; (+) strand; PAM type: YTN; PAM sequence: CTG
tccctctcatctgtcccatc

SEQ ID NO: 74954 - DNA, 20 bp, Artificial Sequence
  Description of Artificial Sequence: Synthetic oligonucleotide
  Target: SCN10A; (+) strand; PAM type: YTN; PAM sequence: CTC
tcatctgtcccatcttgatt

SEQ ID NO: 74955 - DNA, 20 bp, Artificial Sequence
  Description of Artificial Sequence: Synthetic oligonucleotide
  Target: SCN10A; (+) strand; PAM type: YTN; PAM sequence: CTC
atctgtcccatcttgattgt

SEQ ID NO: 74956 - DNA, 20 bp, Artificial Sequence
  Description of Artificial Sequence: Synthetic oligonucleotide
  Target: SCN10A; (+) strand; PAM type: YTN; PAM sequence: CTG
tcccatcttgattgtcagaa

SEQ ID NO: 74957 - DNA, 20 bp, Artificial Sequence
  Description of Artificial Sequence: Synthetic oligonucleotide
  Target: SCN10A; (+) strand; PAM type: YTN; PAM sequence: CTT
gattgtcagaacagcccttc

SEQ ID NO: 74958 - DNA, 20 bp, Artificial Sequence
  Description of Artificial Sequence: Synthetic oligonucleotide
  Target: SCN10A; (+) strand; PAM type: YTN; PAM sequence: TTG
attgtcagaacagcccttct

SEQ ID NO: 74959 - DNA, 20 bp, Artificial Sequence
  Description of Artificial Sequence: Synthetic oligonucleotide
  Target: SCN10A; (+) strand; PAM type: YTN; PAM sequence: TTG
tcagaacagcccttctccca

SEQ ID NO: 74960 - DNA, 20 bp, Artificial Sequence
  Description of Artificial Sequence: Synthetic oligonucleotide
  Target: SCN10A; (+) strand; PAM type: YTN; PAM sequence: CTT
ctcccaccctcatatctggc

SEQ ID NO: 74961 - DNA, 20 bp, Artificial Sequence
  Description of Artificial Sequence: Synthetic oligonucleotide
  Target: SCN10A; (+) strand; PAM type: YTN; PAM sequence: TTC
tcccaccctcatatctggcc

SEQ ID NO: 74962 - DNA, 20 bp, Artificial Sequence
  Description of Artificial Sequence: Synthetic oligonucleotide
  Target: SCN10A; (+) strand; PAM type: YTN; PAM sequence: CTC
ccaccctcatatctggcccc

SEQ ID NO: 74963 - DNA, 20 bp, Artificial Sequence
  Description of Artificial Sequence: Synthetic oligonucleotide
  Target: SCN10A; (+) strand; PAM type: YTN; PAM sequence: CTC
atatctggcccctccctgaa

SEQ ID NO: 74964 - DNA, 20 bp, Artificial Sequence
  Description of Artificial Sequence: Synthetic oligonucleotide
  Target: SCN10A; (+) strand; PAM type: YTN; PAM sequence: CTG
gcccctccctgaactcacac

SEQ ID NO: 74965 - DNA, 20 bp, Artificial Sequence
  Description of Artificial Sequence: Synthetic oligonucleotide
  Target: SCN10A; (+) strand; PAM type: YTN; PAM sequence: CTC
cctgaactcacacttggctc

SEQ ID NO: 74966 - DNA, 20 bp, Artificial Sequence
  Description of Artificial Sequence: Synthetic oligonucleotide
  Target: SCN10A; (+) strand; PAM type: YTN; PAM sequence: CTG
aactcacacttggctcctcc

SEQ ID NO: 74967 - DNA, 20 bp, Artificial Sequence
  Description of Artificial Sequence: Synthetic oligonucleotide
  Target: SCN10A; (+) strand; PAM type: YTN; PAM sequence: CTC
acacttggctcctcccagga

SEQ ID NO: 74968 - DNA, 20 bp, Artificial Sequence
  Description of Artificial Sequence: Synthetic oligonucleotide
  Target: SCN10A; (+) strand; PAM type: YTN; PAM sequence: CTT
ggctcctcccaggaacccat

SEQ ID NO: 74969 - DNA, 20 bp, Artificial Sequence
  Description of Artificial Sequence: Synthetic oligonucleotide
  Target: SCN10A; (+) strand; PAM type: YTN; PAM sequence: TTG
gctcctcccaggaacccatt

SEQ ID NO: 74970 - DNA, 20 bp, Artificial Sequence
  Description of Artificial Sequence: Synthetic oligonucleotide
  Target: SCN10A; (+) strand; PAM type: YTN; PAM sequence: CTC
ctcccaggaacccattcccc

SEQ ID NO: 74971 - DNA, 20 bp, Artificial Sequence
  Description of Artificial Sequence: Synthetic oligonucleotide
  Target: SCN10A; (+) strand; PAM type: YTN; PAM sequence: CTC
ccaggaacccattcccctgc

SEQ ID NO: 74972 - DNA, 20 bp, Artificial Sequence
  Description of Artificial Sequence: Synthetic oligonucleotide
  Target: SCN10A; (+) strand; PAM type: YTN; PAM sequence: TTC
ccctgcaaggcattcagggg

SEQ ID NO: 74973 - DNA, 20 bp, Artificial Sequence
  Description of Artificial Sequence: Synthetic oligonucleotide
  Target: SCN10A; (+) strand; PAM type: YTN; PAM sequence: CTG
caaggcattcaggggaggct

SEQ ID NO: 74974 - DNA, 20 bp, Artificial Sequence
  Description of Artificial Sequence: Synthetic oligonucleotide
  Target: SCN10A; (+) strand; PAM type: YTN; PAM sequence: TTC
aggggaggctgtttattcaa

SEQ ID NO: 74975 - DNA, 20 bp, Artificial Sequence
  Description of Artificial Sequence: Synthetic oligonucleotide
  Target: SCN10A; (+) strand; PAM type: YTN; PAM sequence: CTG
tttattcaaccctcctccag

SEQ ID NO: 74976 - DNA, 20 bp, Artificial Sequence
  Description of Artificial Sequence: Synthetic oligonucleotide
  Target: SCN10A; (+) strand; PAM type: YTN; PAM sequence: TTT
attcaaccctcctccaggtg

SEQ ID NO: 74977 - DNA, 20 bp, Artificial Sequence
  Description of Artificial Sequence: Synthetic oligonucleotide
  Target: SCN10A; (+) strand; PAM type: YTN; PAM sequence: TTA
ttcaaccctcctccaggtgc

SEQ ID NO: 74978 - DNA, 20 bp, Artificial Sequence
  Description of Artificial Sequence: Synthetic oligonucleotide
  Target: SCN10A; (+) strand; PAM type: YTN; PAM sequence: TTC
aaccctcctccaggtgcctc

SEQ ID NO: 74979 - DNA, 20 bp, Artificial Sequence
  Description of Artificial Sequence: Synthetic oligonucleotide
  Target: SCN10A; (+) strand; PAM type: YTN; PAM sequence: CTC
ctccaggtgcctcagggtta

SEQ ID NO: 74980 - DNA, 20 bp, Artificial Sequence
  Description of Artificial Sequence: Synthetic oligonucleotide
  Target: SCN10A; (+) strand; PAM type: YTN; PAM sequence: CTC
caggtgcctcagggttatgt

SEQ ID NO: 74981 - DNA, 20 bp, Artificial Sequence
  Description of Artificial Sequence: Synthetic oligonucleotide
  Target: SCN10A; (+) strand; PAM type: YTN; PAM sequence: CTC
agggttatgtctttgctccc

SEQ ID NO: 74982 - DNA, 20 bp, Artificial Sequence
  Description of Artificial Sequence: Synthetic oligonucleotide
  Target: SCN10A; (+) strand; PAM type: YTN; PAM sequence: TTA
tgtctttgctccccatgtgc

SEQ ID NO: 74983 - DNA, 20 bp, Artificial Sequence
  Description of Artificial Sequence: Synthetic oligonucleotide
  Target: SCN10A; (+) strand; PAM type: YTN; PAM sequence: CTT
tgctccccatgtgcttctat

SEQ ID NO: 74984 - DNA, 20 bp, Artificial Sequence
  Description of Artificial Sequence: Synthetic oligonucleotide
  Target: SCN10A; (+) strand; PAM type: YTN; PAM sequence: TTT
gctccccatgtgcttctatg

SEQ ID NO: 74985 - DNA, 20 bp, Artificial Sequence
  Description of Artificial Sequence: Synthetic oligonucleotide
  Target: SCN10A; (+) strand; PAM type: YTN; PAM sequence: TTG
ctccccatgtgcttctatgt

SEQ ID NO: 74986 - DNA, 20 bp, Artificial Sequence
  Description of Artificial Sequence: Synthetic oligonucleotide
  Target: SCN10A; (+) strand; PAM type: YTN; PAM sequence: CTC
cccatgtgcttctatgtcat

SEQ ID NO: 74987 - DNA, 20 bp, Artificial Sequence
  Description of Artificial Sequence: Synthetic oligonucleotide
  Target: SCN10A; (+) strand; PAM type: YTN; PAM sequence: CTT
ctatgtcattgcttcttcac

SEQ ID NO: 74988 - DNA, 20 bp, Artificial Sequence
  Description of Artificial Sequence: Synthetic oligonucleotide
  Target: SCN10A; (+) strand; PAM type: YTN; PAM sequence: TTC
tatgtcattgcttcttcacc

SEQ ID NO: 74989 - DNA, 20 bp, Artificial Sequence
  Description of Artificial Sequence: Synthetic oligonucleotide
  Target: SCN10A; (+) strand; PAM type: YTN; PAM sequence: CTA
tgtcattgcttcttcaccac

SEQ ID NO: 74990 - DNA, 20 bp, Artificial Sequence
  Description of Artificial Sequence: Synthetic oligonucleotide
  Target: SCN10A; (+) strand; PAM type: YTN; PAM sequence: TTG
cttcttcaccactttgtacc

SEQ ID NO: 74991 - DNA, 20 bp, Artificial Sequence
  Description of Artificial Sequence: Synthetic oligonucleotide
  Target: SCN10A; (+) strand; PAM type: YTN; PAM sequence: CTT
cttcaccactttgtaccatc

SEQ ID NO: 74992 - DNA, 20 bp, Artificial Sequence
  Description of Artificial Sequence: Synthetic oligonucleotide
  Target: SCN10A; (+) strand; PAM type: YTN; PAM sequence: TTC
ttcaccactttgtaccatcc

SEQ ID NO: 74993 - DNA, 20 bp, Artificial Sequence
  Description of Artificial Sequence: Synthetic oligonucleotide
  Target: SCN10A; (+) strand; PAM type: YTN; PAM sequence: CTT
caccactttgtaccatccta

SEQ ID NO: 74994 - DNA, 20 bp, Artificial Sequence
  Description of Artificial Sequence: Synthetic oligonucleotide
  Target: SCN10A; (+) strand; PAM type: YTN; PAM sequence: TTC
accactttgtaccatcctac

SEQ ID NO: 74995 - DNA, 20 bp, Artificial Sequence
  Description of Artificial Sequence: Synthetic oligonucleotide
  Target: SCN10A; (+) strand; PAM type: YTN; PAM sequence: CTT
tgtaccatcctaccaccacc

SEQ ID NO: 74996 - DNA, 20 bp, Artificial Sequence
  Description of Artificial Sequence: Synthetic oligonucleotide
  Target: SCN10A; (+) strand; PAM type: YTN; PAM sequence: TTT
gtaccatcctaccaccacca

SEQ ID NO: 74997 - DNA, 20 bp, Artificial Sequence
  Description of Artificial Sequence: Synthetic oligonucleotide
  Target: SCN10A; (+) strand; PAM type: YTN; PAM sequence: TTG
taccatcctaccaccaccac

SEQ ID NO: 74998 - DNA, 20 bp, Artificial Sequence
  Description of Artificial Sequence: Synthetic oligonucleotide
  Target: SCN10A; (+) strand; PAM type: YTN; PAM sequence: CTA
ccaccaccaccagatttagc

SEQ ID NO: 74999 - DNA, 20 bp, Artificial Sequence
  Description of Artificial Sequence: Synthetic oligonucleotide
  Target: SCN10A; (+) strand; PAM type: YTN; PAM sequence: TTT
agccatgctgccctctctcc

SEQ ID NO: 75000 - DNA, 20 bp, Artificial Sequence
  Description of Artificial Sequence: Synthetic oligonucleotide
  Target: SCN10A; (+) strand; PAM type: YTN; PAM sequence: TTA
gccatgctgccctctctcct

SEQ ID NO: 75001 - DNA, 20 bp, Artificial Sequence
  Description of Artificial Sequence: Synthetic oligonucleotide
  Target: SCN10A; (+) strand; PAM type: YTN; PAM sequence: CTG
ccctctctcctcatttccag

SEQ ID NO: 75002 - DNA, 20 bp, Artificial Sequence
  Description of Artificial Sequence: Synthetic oligonucleotide
  Target: SCN10A; (+) strand; PAM type: YTN; PAM sequence: CTC
tctcctcatttccaggacca

SEQ ID NO: 75003 - DNA, 20 bp, Artificial Sequence
  Description of Artificial Sequence: Synthetic oligonucleotide
  Target: SCN10A; (+) strand; PAM type: YTN; PAM sequence: CTC
tcctcatttccaggaccact

SEQ ID NO: 75004 - DNA, 20 bp, Artificial Sequence
  Description of Artificial Sequence: Synthetic oligonucleotide
  Target: SCN10A; (+) strand; PAM type: YTN; PAM sequence: CTC
ctcatttccaggaccactga

SEQ ID NO: 75005 - DNA, 20 bp, Artificial Sequence
  Description of Artificial Sequence: Synthetic oligonucleotide
  Target: SCN10A; (+) strand; PAM type: YTN; PAM sequence: CTC
atttccaggaccactgagtt

SEQ ID NO: 75006 - DNA, 20 bp, Artificial Sequence
  Description of Artificial Sequence: Synthetic oligonucleotide
  Target: SCN10A; (+) strand; PAM type: YTN; PAM sequence: TTT
ccaggaccactgagttccag

SEQ ID NO: 75007 - DNA, 20 bp, Artificial Sequence
  Description of Artificial Sequence: Synthetic oligonucleotide
  Target: SCN10A; (+) strand; PAM type: YTN; PAM sequence: TTC
caggaccactgagttccagg

SEQ ID NO: 75008 - DNA, 20 bp, Artificial Sequence
  Description of Artificial Sequence: Synthetic oligonucleotide
  Target: SCN10A; (+) strand; PAM type: YTN; PAM sequence: CTG
agttccaggcactctcccat

SEQ ID NO: 75009 - DNA, 20 bp, Artificial Sequence
  Description of Artificial Sequence: Synthetic oligonucleotide
  Target: SCN10A; (+) strand; PAM type: YTN; PAM sequence: TTC
caggcactctcccatattca

SEQ ID NO: 75010 - DNA, 20 bp, Artificial Sequence
  Description of Artificial Sequence: Synthetic oligonucleotide
  Target: SCN10A; (+) strand; PAM type: YTN; PAM sequence: CTC
tcccatattcatcaaagact

SEQ ID NO: 75011 - DNA, 20 bp, Artificial Sequence
  Description of Artificial Sequence: Synthetic oligonucleotide
  Target: SCN10A; (+) strand; PAM type: YTN; PAM sequence: CTC
ccatattcatcaaagacttt

SEQ ID NO: 75012 - DNA, 20 bp, Artificial Sequence
  Description of Artificial Sequence: Synthetic oligonucleotide
  Target: SCN10A; (+) strand; PAM type: YTN; PAM sequence: TTC
atcaaagactttggtttata

SEQ ID NO: 75013 - DNA, 20 bp, Artificial Sequence
  Description of Artificial Sequence: Synthetic oligonucleotide
  Target: SCN10A; (+) strand; PAM type: YTN; PAM sequence: CTT
tggtttatagtctactttat

SEQ ID NO: 75014 - DNA, 20 bp, Artificial Sequence
  Description of Artificial Sequence: Synthetic oligonucleotide
  Target: SCN10A; (+) strand; PAM type: YTN; PAM sequence: TTT
ggtttatagtctactttatc

SEQ ID NO: 75015 - DNA, 20 bp, Artificial Sequence
  Description of Artificial Sequence: Synthetic oligonucleotide
  Target: SCN10A; (+) strand; PAM type: YTN; PAM sequence: TTG
gtttatagtctactttatct

SEQ ID NO: 75016 - DNA, 20 bp, Artificial Sequence
  Description of Artificial Sequence: Synthetic oligonucleotide
  Target: SCN10A; (+) strand; PAM type: YTN; PAM sequence: TTT
atagtctactttatcttaag

SEQ ID NO: 75017 - DNA, 20 bp, Artificial Sequence
  Description of Artificial Sequence: Synthetic oligonucleotide
  Target: SCN10A; (+) strand; PAM type: YTN; PAM sequence: TTA
tagtctactttatcttaagt

SEQ ID NO: 75018 - DNA, 20 bp, Artificial Sequence
  Description of Artificial Sequence: Synthetic oligonucleotide
  Target: SCN10A; (+) strand; PAM type: YTN; PAM sequence: CTA
ctttatcttaagtctcatgc

SEQ ID NO: 75019 - DNA, 20 bp, Artificial Sequence
  Description of Artificial Sequence: Synthetic oligonucleotide
  Target: SCN10A; (+) strand; PAM type: YTN; PAM sequence: CTT
tatcttaagtctcatgctac

SEQ ID NO: 75020 - DNA, 20 bp, Artificial Sequence
  Description of Artificial Sequence: Synthetic oligonucleotide
  Target: SCN10A; (+) strand; PAM type: YTN; PAM sequence: TTT
atcttaagtctcatgctact

SEQ ID NO: 75021 - DNA, 20 bp, Artificial Sequence
  Description of Artificial Sequence: Synthetic oligonucleotide
  Target: SCN10A; (+) strand; PAM type: YTN; PAM sequence: TTA
tcttaagtctcatgctactt

SEQ ID NO: 75022 - DNA, 20 bp, Artificial Sequence
  Description of Artificial Sequence: Synthetic oligonucleotide
  Target: SCN10A; (+) strand; PAM type: YTN; PAM sequence: CTT
aagtctcatgctactttctt

SEQ ID NO: 75023 - DNA, 20 bp, Artificial Sequence
  Description of Artificial Sequence: Synthetic oligonucleotide
  Target: SCN10A; (+) strand; PAM type: YTN; PAM sequence: TTA
agtctcatgctactttctta

SEQ ID NO: 75024 - DNA, 20 bp, Artificial Sequence
  Description of Artificial Sequence: Synthetic oligonucleotide
  Target: SCN10A; (+) strand; PAM type: YTN; PAM sequence: CTC
atgctactttcttatcacaa

SEQ ID NO: 75025 - DNA, 20 bp, Artificial Sequence
  Description of Artificial Sequence: Synthetic oligonucleotide
  Target: SCN10A; (+) strand; PAM type: YTN; PAM sequence: CTA
ctttcttatcacaatctttt

SEQ ID NO: 75026 - DNA, 20 bp, Artificial Sequence
  Description of Artificial Sequence: Synthetic oligonucleotide
  Target: SCN10A; (+) strand; PAM type: YTN; PAM sequence: CTT
tcttatcacaatcttttatt

SEQ ID NO: 75027 - DNA, 20 bp, Artificial Sequence
  Description of Artificial Sequence: Synthetic oligonucleotide
  Target: SCN10A; (+) strand; PAM type: YTN; PAM sequence: TTT
cttatcacaatcttttattt

SEQ ID NO: 75028 - DNA, 20 bp, Artificial Sequence
  Description of Artificial Sequence: Synthetic oligonucleotide
  Target: SCN10A; (+) strand; PAM type: YTN; PAM sequence: TTC
ttatcacaatcttttattta

SEQ ID NO: 75029 - DNA, 20 bp, Artificial Sequence
  Description of Artificial Sequence: Synthetic oligonucleotide
  Target: SCN10A; (+) strand; PAM type: YTN; PAM sequence: CTT
atcacaatcttttatttatt

SEQ ID NO: 75030 - DNA, 20 bp, Artificial Sequence
  Description of Artificial Sequence: Synthetic oligonucleotide
  Target: SCN10A; (+) strand; PAM type: YTN; PAM sequence: TTA
tcacaatcttttatttattg

SEQ ID NO: 75031 - DNA, 20 bp, Artificial Sequence
  Description of Artificial Sequence: Synthetic oligonucleotide
  Target: SCN10A; (+) strand; PAM type: YTN; PAM sequence: CTT
ttatttattgacattgtcaa

SEQ ID NO: 75032 - DNA, 20 bp, Artificial Sequence
  Description of Artificial Sequence: Synthetic oligonucleotide
  Target: SCN10A; (+) strand; PAM type: YTN; PAM sequence: TTT
tatttattgacattgtcaac

SEQ ID NO: 75033 - DNA, 20 bp, Artificial Sequence
  Description of Artificial Sequence: Synthetic oligonucleotide
  Target: SCN10A; (+) strand; PAM type: YTN; PAM sequence: TTT
atttattgacattgtcaaca

SEQ ID NO: 75034 - DNA, 20 bp, Artificial Sequence
  Description of Artificial Sequence: Synthetic oligonucleotide
  Target: SCN10A; (+) strand; PAM type: YTN; PAM sequence: TTA
tttattgacattgtcaacat

SEQ ID NO: 75035 - DNA, 20 bp, Artificial Sequence
  Description of Artificial Sequence: Synthetic oligonucleotide
  Target: SCN10A; (+) strand; PAM type: YTN; PAM sequence: TTT
attgacattgtcaacatttc

SEQ ID NO: 75036 - DNA, 20 bp, Artificial Sequence
  Description of Artificial Sequence: Synthetic oligonucleotide
  Target: SCN10A; (+) strand; PAM type: YTN; PAM sequence: TTA
ttgacattgtcaacatttct

SEQ ID NO: 75037 - DNA, 20 bp, Artificial Sequence
  Description of Artificial Sequence: Synthetic oligonucleotide
  Target: SCN10A; (+) strand; PAM type: YTN; PAM sequence: TTG
acattgtcaacatttctcca

SEQ ID NO: 75038 - DNA, 20 bp, Artificial Sequence
  Description of Artificial Sequence: Synthetic oligonucleotide
  Target: SCN10A; (+) strand; PAM type: YTN; PAM sequence: TTG
tcaacatttctccacctgtt

SEQ ID NO: 75039 - DNA, 20 bp, Artificial Sequence
  Description of Artificial Sequence: Synthetic oligonucleotide
  Target: SCN10A; (+) strand; PAM type: YTN; PAM sequence: TTT
ctccacctgtttgaatttca

SEQ ID NO: 75040 - DNA, 20 bp, Artificial Sequence
  Description of Artificial Sequence: Synthetic oligonucleotide
  Target: SCN10A; (+) strand; PAM type: YTN; PAM sequence: TTC
tccacctgtttgaatttcat

SEQ ID NO: 75041 - DNA, 20 bp, Artificial Sequence
  Description of Artificial Sequence: Synthetic oligonucleotide
  Target: SCN10A; (+) strand; PAM type: YTN; PAM sequence: CTC
cacctgtttgaatttcattt

SEQ ID NO: 75042 - DNA, 20 bp, Artificial Sequence
  Description of Artificial Sequence: Synthetic oligonucleotide
  Target: SCN10A; (+) strand; PAM type: YTN; PAM sequence: CTG
tttgaatttcatttggacct

SEQ ID NO: 75043 - DNA, 20 bp, Artificial Sequence
  Description of Artificial Sequence: Synthetic oligonucleotide
  Target: SCN10A; (+) strand; PAM type: YTN; PAM sequence: TTT
gaatttcatttggacctcca

SEQ ID NO: 75044 - DNA, 20 bp, Artificial Sequence
  Description of Artificial Sequence: Synthetic oligonucleotide
  Target: SCN10A; (+) strand; PAM type: YTN; PAM sequence: TTG
aatttcatttggacctccaa

SEQ ID NO: 75045 - DNA, 20 bp, Artificial Sequence
  Description of Artificial Sequence: Synthetic oligonucleotide
  Target: SCN10A; (+) strand; PAM type: YTN; PAM sequence: TTT
catttggacctccaagttac

SEQ ID NO: 75046 - DNA, 20 bp, Artificial Sequence
  Description of Artificial Sequence: Synthetic oligonucleotide
  Target: SCN10A; (+) strand; PAM type: YTN; PAM sequence: TTC
atttggacctccaagttact

SEQ ID NO: 75047 - DNA, 20 bp, Artificial Sequence
  Description of Artificial Sequence: Synthetic oligonucleotide
  Target: SCN10A; (+) strand; PAM type: YTN; PAM sequence: TTT
ggacctccaagttactggag

SEQ ID NO: 75048 - DNA, 20 bp, Artificial Sequence
  Description of Artificial Sequence: Synthetic oligonucleotide
  Target: SCN10A; (+) strand; PAM type: YTN; PAM sequence: TTG
gacctccaagttactggaga

SEQ ID NO: 75049 - DNA, 20 bp, Artificial Sequence
  Description of Artificial Sequence: Synthetic oligonucleotide
  Target: SCN10A; (+) strand; PAM type: YTN; PAM sequence: CTC
caagttactggagaactcca

SEQ ID NO: 75050 - DNA, 20 bp, Artificial Sequence
  Description of Artificial Sequence: Synthetic oligonucleotide
  Target: SCN10A; (+) strand; PAM type: YTN; PAM sequence: TTA
ctggagaactccagattatt

SEQ ID NO: 75051 - DNA, 20 bp, Artificial Sequence
  Description of Artificial Sequence: Synthetic oligonucleotide
  Target: SCN10A; (+) strand; PAM type: YTN; PAM sequence: CTG
gagaactccagattattgga

SEQ ID NO: 75052 - DNA, 20 bp, Artificial Sequence
  Description of Artificial Sequence: Synthetic oligonucleotide
  Target: SCN10A; (+) strand; PAM type: YTN; PAM sequence: CTC
cagattattggagaatttca

SEQ ID NO: 75053 - DNA, 20 bp, Artificial Sequence
  Description of Artificial Sequence: Synthetic oligonucleotide
  Target: SCN10A; (+) strand; PAM type: YTN; PAM sequence: TTA
ttggagaatttcattgggac

SEQ ID NO: 75054 - DNA, 20 bp, Artificial Sequence
  Description of Artificial Sequence: Synthetic oligonucleotide
  Target: SCN10A; (+) strand; PAM type: YTN; PAM sequence: TTG
gagaatttcattgggacctc

SEQ ID NO: 75055 - DNA, 20 bp, Artificial Sequence
  Description of Artificial Sequence: Synthetic oligonucleotide
  Target: SCN10A; (+) strand; PAM type: YTN; PAM sequence: TTT
cattgggacctccaatttct

SEQ ID NO: 75056 - DNA, 20 bp, Artificial Sequence
  Description of Artificial Sequence: Synthetic oligonucleotide
  Target: SCN10A; (+) strand; PAM type: YTN; PAM sequence: TTC
attgggacctccaatttctc

SEQ ID NO: 75057 - DNA, 20 bp, Artificial Sequence
  Description of Artificial Sequence: Synthetic oligonucleotide
  Target: SCN10A; (+) strand; PAM type: YTN; PAM sequence: TTG
ggacctccaatttctctggg

SEQ ID NO: 75058 - DNA, 20 bp, Artificial Sequence
  Description of Artificial Sequence: Synthetic oligonucleotide
  Target: SCN10A; (+) strand; PAM type: YTN; PAM sequence: CTC
caatttctctgggacctcca

SEQ ID NO: 75059 - DNA, 20 bp, Artificial Sequence
  Description of Artificial Sequence: Synthetic oligonucleotide
  Target: SCN10A; (+) strand; PAM type: YTN; PAM sequence: TTT
ctctgggacctccaggttca

SEQ ID NO: 75060 - DNA, 20 bp, Artificial Sequence
  Description of Artificial Sequence: Synthetic oligonucleotide
  Target: SCN10A; (+) strand; PAM type: YTN; PAM sequence: TTC
tctgggacctccaggttcag

SEQ ID NO: 75061 - DNA, 20 bp, Artificial Sequence
  Description of Artificial Sequence: Synthetic oligonucleotide
  Target: SCN10A; (+) strand; PAM type: YTN; PAM sequence: CTC
tgggacctccaggttcagtc

SEQ ID NO: 75062 - DNA, 20 bp, Artificial Sequence
  Description of Artificial Sequence: Synthetic oligonucleotide
  Target: SCN10A; (+) strand; PAM type: YTN; PAM sequence: CTG
ggacctccaggttcagtctg

SEQ ID NO: 75063 - DNA, 20 bp, Artificial Sequence
  Description of Artificial Sequence: Synthetic oligonucleotide
  Target: SCN10A; (+) strand; PAM type: YTN; PAM sequence: CTC
caggttcagtctgtggctga

SEQ ID NO: 75064 - DNA, 20 bp, Artificial Sequence
  Description of Artificial Sequence: Synthetic oligonucleotide
  Target: SCN10A; (+) strand; PAM type: YTN; PAM sequence: TTC
agtctgtggctgaacacttt

SEQ ID NO: 75065 - DNA, 20 bp, Artificial Sequence
  Description of Artificial Sequence: Synthetic oligonucleotide
  Target: SCN10A; (+) strand; PAM type: YTN; PAM sequence: CTG
tggctgaacacttttcccca

SEQ ID NO: 75066 - DNA, 20 bp, Artificial Sequence
  Description of Artificial Sequence: Synthetic oligonucleotide
  Target: SCN10A; (+) strand; PAM type: YTN; PAM sequence: CTG
aacacttttccccataacca

SEQ ID NO: 75067 - DNA, 20 bp, Artificial Sequence
  Description of Artificial Sequence: Synthetic oligonucleotide
  Target: SCN10A; (+) strand; PAM type: YTN; PAM sequence: CTT
ttccccataaccagattaga

SEQ ID NO: 75068 - DNA, 20 bp, Artificial Sequence
  Description of Artificial Sequence: Synthetic oligonucleotide
  Target: SCN10A; (+) strand; PAM type: YTN; PAM sequence: TTT
tccccataaccagattagac

SEQ ID NO: 75069 - DNA, 20 bp, Artificial Sequence
  Description of Artificial Sequence: Synthetic oligonucleotide
  Target: SCN10A; (+) strand; PAM type: YTN; PAM sequence: TTT
ccccataaccagattagacc

SEQ ID NO: 75070 - DNA, 20 bp, Artificial Sequence
  Description of Artificial Sequence: Synthetic oligonucleotide
  Target: SCN10A; (+) strand; PAM type: YTN; PAM sequence: TTC
cccataaccagattagacct

SEQ ID NO: 75071 - DNA, 20 bp, Artificial Sequence
  Description of Artificial Sequence: Synthetic oligonucleotide
  Target: SCN10A; (+) strand; PAM type: YTN; PAM sequence: TTA
gacctgtggtccacaatttt

SEQ ID NO: 75072 - DNA, 20 bp, Artificial Sequence
  Description of Artificial Sequence: Synthetic oligonucleotide
  Target: SCN10A; (+) strand; PAM type: YTN; PAM sequence: CTG
tggtccacaattttgccact

SEQ ID NO: 75073 - DNA, 20 bp, Artificial Sequence
  Description of Artificial Sequence: Synthetic oligonucleotide
  Target: SCN10A; (+) strand; PAM type: YTN; PAM sequence: TTT
tgccactccctcacccttat

SEQ ID NO: 75074 - DNA, 20 bp, Artificial Sequence
  Description of Artificial Sequence: Synthetic oligonucleotide
  Target: SCN10A; (+) strand; PAM type: YTN; PAM sequence: TTT
gccactccctcacccttatc

SEQ ID NO: 75075 - DNA, 20 bp, Artificial Sequence
  Description of Artificial Sequence: Synthetic oligonucleotide
  Target: SCN10A; (+) strand; PAM type: YTN; PAM sequence: TTG
ccactccctcacccttatcc

SEQ ID NO: 75076 - DNA, 20 bp, Artificial Sequence
  Description of Artificial Sequence: Synthetic oligonucleotide
  Target: SCN10A; (+) strand; PAM type: YTN; PAM sequence: CTC
cctcacccttatcctaaatc

SEQ ID NO: 75077 - DNA, 20 bp, Artificial Sequence
  Description of Artificial Sequence: Synthetic oligonucleotide
  Target: SCN10A; (+) strand; PAM type: YTN; PAM sequence: CTC
acccttatcctaaatcccaa

SEQ ID NO: 75078 - DNA, 20 bp, Artificial Sequence
  Description of Artificial Sequence: Synthetic oligonucleotide
  Target: SCN10A; (+) strand; PAM type: YTN; PAM sequence: CTT
atcctaaatcccaaggctaa

SEQ ID NO: 75079 - DNA, 20 bp, Artificial Sequence
  Description of Artificial Sequence: Synthetic oligonucleotide
  Target: SCN10A; (+) strand; PAM type: YTN; PAM sequence: TTA
tcctaaatcccaaggctaag

SEQ ID NO: 75080 - DNA, 20 bp, Artificial Sequence
  Description of Artificial Sequence: Synthetic oligonucleotide
  Target: SCN10A; (+) strand; PAM type: YTN; PAM sequence: CTA
aatcccaaggctaagtcaat

SEQ ID NO: 75081 - DNA, 20 bp, Artificial Sequence
  Description of Artificial Sequence: Synthetic oligonucleotide
  Target: SCN10A; (+) strand; PAM type: YTN; PAM sequence: CTA
agtcaatctagaacagttcc

SEQ ID NO: 75082 - DNA, 20 bp, Artificial Sequence
  Description of Artificial Sequence: Synthetic oligonucleotide
  Target: SCN10A; (+) strand; PAM type: YTN; PAM sequence: CTA
gaacagttcccctgaactgc

SEQ ID NO: 75083 - DNA, 20 bp, Artificial Sequence
  Description of Artificial Sequence: Synthetic oligonucleotide
  Target: SCN10A; (+) strand; PAM type: YTN; PAM sequence: TTC
ccctgaactgctgaggggtt

SEQ ID NO: 75084 - DNA, 20 bp, Artificial Sequence
  Description of Artificial Sequence: Synthetic oligonucleotide
  Target: SCN10A; (+) strand; PAM type: YTN; PAM sequence: CTG
aactgctgaggggttatggg

SEQ ID NO: 75085 - DNA, 20 bp, Artificial Sequence
  Description of Artificial Sequence: Synthetic oligonucleotide
  Target: SCN10A; (+) strand; PAM type: YTN; PAM sequence: CTG
ctgaggggttatggggaacc

SEQ ID NO: 75086 - DNA, 20 bp, Artificial Sequence
  Description of Artificial Sequence: Synthetic oligonucleotide
  Target: SCN10A; (+) strand; PAM type: YTN; PAM sequence: CTG
aggggttatggggaacctca

SEQ ID NO: 75087 - DNA, 20 bp, Artificial Sequence
  Description of Artificial Sequence: Synthetic oligonucleotide
  Target: SCN10A; (+) strand; PAM type: YTN; PAM sequence: TTA
tggggaacctcagtattgcc

SEQ ID NO: 75088 - DNA, 20 bp, Artificial Sequence
  Description of Artificial Sequence: Synthetic oligonucleotide
  Target: SCN10A; (+) strand; PAM type: YTN; PAM sequence: CTC
agtattgcctgggaatcata

SEQ ID NO: 75089 - DNA, 20 bp, Artificial Sequence
  Description of Artificial Sequence: Synthetic oligonucleotide
  Target: SCN10A; (+) strand; PAM type: YTN; PAM sequence: TTG
cctgggaatcatatggtatc

SEQ ID NO: 75090 - DNA, 20 bp, Artificial Sequence
  Description of Artificial Sequence: Synthetic oligonucleotide
  Target: SCN10A; (+) strand; PAM type: YTN; PAM sequence: CTG
ggaatcatatggtatcccta

SEQ ID NO: 75091 - DNA, 20 bp, Artificial Sequence
  Description of Artificial Sequence: Synthetic oligonucleotide
  Target: SCN10A; (+) strand; PAM type: YTN; PAM sequence: CTA
gtcagcagtttcttctagtc

SEQ ID NO: 75092 - DNA, 20 bp, Artificial Sequence
  Description of Artificial Sequence: Synthetic oligonucleotide
  Target: SCN10A; (+) strand; PAM type: YTN; PAM sequence: TTT
cttctagtctgaggtttcaa

SEQ ID NO: 75093 - DNA, 20 bp, Artificial Sequence
  Description of Artificial Sequence: Synthetic oligonucleotide
  Target: SCN10A; (+) strand; PAM type: YTN; PAM sequence: TTC
ttctagtctgaggtttcaaa

SEQ ID NO: 75094 - DNA, 20 bp, Artificial Sequence
  Description of Artificial Sequence: Synthetic oligonucleotide
  Target: SCN10A; (+) strand; PAM type: YTN; PAM sequence: CTT
ctagtctgaggtttcaaata

SEQ ID NO: 75095 - DNA, 20 bp, Artificial Sequence
  Description of Artificial Sequence: Synthetic oligonucleotide
  Target: SCN10A; (+) strand; PAM type: YTN; PAM sequence: TTC
tagtctgaggtttcaaatac

SEQ ID NO: 75096 - DNA, 20 bp, Artificial Sequence
  Description of Artificial Sequence: Synthetic oligonucleotide
  Target: SCN10A; (+) strand; PAM type: YTN; PAM sequence: CTA
gtctgaggtttcaaatacac

SEQ ID NO: 75097 - DNA, 20 bp, Artificial Sequence
  Description of Artificial Sequence: Synthetic oligonucleotide
  Target: SCN10A; (+) strand; PAM type: YTN; PAM sequence: CTG
aggtttcaaatacactcttt

SEQ ID NO: 75098 - DNA, 20 bp, Artificial Sequence
  Description of Artificial Sequence: Synthetic oligonucleotide
  Target: SCN10A; (+) strand; PAM type: YTN; PAM sequence: TTT
caaatacactcttttctcac

SEQ ID NO: 75099 - DNA, 20 bp, Artificial Sequence
  Description of Artificial Sequence: Synthetic oligonucleotide
  Target: SCN10A; (+) strand; PAM type: YTN; PAM sequence: TTC
aaatacactcttttctcact

SEQ ID NO: 75100 - DNA, 20 bp, Artificial Sequence
  Description of Artificial Sequence: Synthetic oligonucleotide
  Target: SCN10A; (+) strand; PAM type: YTN; PAM sequence: CTC
ttttctcactattccctgtc

SEQ ID NO: 75101 - DNA, 20 bp, Artificial Sequence
  Description of Artificial Sequence: Synthetic oligonucleotide
  Target: SCN10A; (+) strand; PAM type: YTN; PAM sequence: CTT
ttctcactattccctgtctt

SEQ ID NO: 75102 - DNA, 20 bp, Artificial Sequence
  Description of Artificial Sequence: Synthetic oligonucleotide
  Target: SCN10A; (+) strand; PAM type: YTN; PAM sequence: TTT
tctcactattccctgtcttc

SEQ ID NO: 75103 - DNA, 20 bp, Artificial Sequence
  Description of Artificial Sequence: Synthetic oligonucleotide
  Target: SCN10A; (+) strand; PAM type: YTN; PAM sequence: TTT
ctcactattccctgtcttcc

SEQ ID NO: 75104 - DNA, 20 bp, Artificial Sequence
  Description of Artificial Sequence: Synthetic oligonucleotide
  Target: SCN10A; (+) strand; PAM type: YTN; PAM sequence: TTC
tcactattccctgtcttccc

SEQ ID NO: 75105 - DNA, 20 bp, Artificial Sequence
  Description of Artificial Sequence: Synthetic oligonucleotide
  Target: SCN10A; (+) strand; PAM type: YTN; PAM sequence: CTC
actattccctgtcttccctt

SEQ ID NO: 75106 - DNA, 20 bp, Artificial Sequence
  Description of Artificial Sequence: Synthetic oligonucleotide
  Target: SCN10A; (+) strand; PAM type: YTN; PAM sequence: CTA
ttccctgtcttcccttgcag

SEQ ID NO: 75107 - DNA, 20 bp, Artificial Sequence
  Description of Artificial Sequence: Synthetic oligonucleotide
  Target: SCN10A; (+) strand; PAM type: YTN; PAM sequence: TTC
cctgtcttcccttgcagtaa

SEQ ID NO: 75108 - DNA, 20 bp, Artificial Sequence
  Description of Artificial Sequence: Synthetic oligonucleotide
  Target: SCN10A; (+) strand; PAM type: YTN; PAM sequence: CTG
tcttcccttgcagtaagcca

SEQ ID NO: 75109 - DNA, 20 bp, Artificial Sequence
  Description of Artificial Sequence: Synthetic oligonucleotide
  Target: SCN10A; (+) strand; PAM type: YTN; PAM sequence: CTT
cccttgcagtaagccaatga

SEQ ID NO: 75110 - DNA, 20 bp, Artificial Sequence
  Description of Artificial Sequence: Synthetic oligonucleotide
  Target: SCN10A; (+) strand; PAM type: YTN; PAM sequence: TTC
ccttgcagtaagccaatgac

SEQ ID NO: 75111 - DNA, 20 bp, Artificial Sequence
  Description of Artificial Sequence: Synthetic oligonucleotide
  Target: SCN10A; (+) strand; PAM type: YTN; PAM sequence: CTT
gcagtaagccaatgaccata

SEQ ID NO: 75112 - DNA, 20 bp, Artificial Sequence
  Description of Artificial Sequence: Synthetic oligonucleotide
  Target: SCN10A; (+) strand; PAM type: YTN; PAM sequence: TTG
cagtaagccaatgaccatat

SEQ ID NO: 75113 - DNA, 20 bp, Artificial Sequence
  Description of Artificial Sequence: Synthetic oligonucleotide
  Target: SCN10A; (+) strand; PAM type: YTN; PAM sequence: TTT
cctagttcatggagaaaaac

SEQ ID NO: 75114 - DNA, 20 bp, Artificial Sequence
  Description of Artificial Sequence: Synthetic oligonucleotide
  Target: SCN10A; (+) strand; PAM type: YTN; PAM sequence: TTC
ctagttcatggagaaaaaca

SEQ ID NO: 75115 - DNA, 20 bp, Artificial Sequence
  Description of Artificial Sequence: Synthetic oligonucleotide
  Target: SCN10A; (+) strand; PAM type: YTN; PAM sequence: CTA
gttcatggagaaaaacagaa

SEQ ID NO: 75116 - DNA, 20 bp, Artificial Sequence
  Description of Artificial Sequence: Synthetic oligonucleotide
  Target: SCN10A; (+) strand; PAM type: YTN; PAM sequence: TTC
atggagaaaaacagaactct

SEQ ID NO: 75117 - DNA, 20 bp, Artificial Sequence
  Description of Artificial Sequence: Synthetic oligonucleotide
  Target: SCN10A; (+) strand; PAM type: YTN; PAM sequence: CTC
tgccaacttcataccatcaa

SEQ ID NO: 75118 - DNA, 20 bp, Artificial Sequence
  Description of Artificial Sequence: Synthetic oligonucleotide
  Target: SCN10A; (+) strand; PAM type: YTN; PAM sequence: CTG
ccaacttcataccatcaaac

SEQ ID NO: 75119 - DNA, 20 bp, Artificial Sequence
  Description of Artificial Sequence: Synthetic oligonucleotide
  Target: SCN10A; (+) strand; PAM type: YTN; PAM sequence: CTT
cataccatcaaacctccaac

SEQ ID NO: 75120 - DNA, 20 bp, Artificial Sequence
  Description of Artificial Sequence: Synthetic oligonucleotide
  Target: SCN10A; (+) strand; PAM type: YTN; PAM sequence: TTC
ataccatcaaacctccaact

SEQ ID NO: 75121 - DNA, 20 bp, Artificial Sequence
  Description of Artificial Sequence: Synthetic oligonucleotide
  Target: SCN10A; (+) strand; PAM type: YTN; PAM sequence: CTC
caactcacctgtgtctgcag

SEQ ID NO: 75122 - DNA, 20 bp, Artificial Sequence
  Description of Artificial Sequence: Synthetic oligonucleotide
  Target: SCN10A; (+) strand; PAM type: YTN; PAM sequence: CTC
acctgtgtctgcagccttct

SEQ ID NO: 75123 - DNA, 20 bp, Artificial Sequence
  Description of Artificial Sequence: Synthetic oligonucleotide
  Target: SCN10A; (+) strand; PAM type: YTN; PAM sequence: CTG
tgtctgcagccttctttcct

SEQ ID NO: 75124 - DNA, 20 bp, Artificial Sequence
  Description of Artificial Sequence: Synthetic oligonucleotide
  Target: SCN10A; (+) strand; PAM type: YTN; PAM sequence: CTG
cagccttctttcctccttcc

SEQ ID NO: 75125 - DNA, 20 bp, Artificial Sequence
  Description of Artificial Sequence: Synthetic oligonucleotide
  Target: SCN10A; (+) strand; PAM type: YTN; PAM sequence: CTT
ctttcctccttcccttctct

SEQ ID NO: 75126 - DNA, 20 bp, Artificial Sequence
  Description of Artificial Sequence: Synthetic oligonucleotide
  Target: SCN10A; (+) strand; PAM type: YTN; PAM sequence: TTC
tttcctccttcccttctctt

SEQ ID NO: 75127 - DNA, 20 bp, Artificial Sequence
  Description of Artificial Sequence: Synthetic oligonucleotide
  Target: SCN10A; (+) strand; PAM type: YTN; PAM sequence: CTT
tcctccttcccttctcttac

SEQ ID NO: 75128 - DNA, 20 bp, Artificial Sequence
  Description of Artificial Sequence: Synthetic oligonucleotide
  Target: SCN10A; (+) strand; PAM type: YTN; PAM sequence: TTT
cctccttcccttctcttaca

SEQ ID NO: 75129 - DNA, 20 bp, Artificial Sequence
  Description of Artificial Sequence: Synthetic oligonucleotide
  Target: SCN10A; (+) strand; PAM type: YTN; PAM sequence: TTC
ctccttcccttctcttacaa

SEQ ID NO: 75130 - DNA, 20 bp, Artificial Sequence
  Description of Artificial Sequence: Synthetic oligonucleotide
  Target: SCN10A; (+) strand; PAM type: YTN; PAM sequence: CTC
cttcccttctcttacaacat

SEQ ID NO: 75131 - DNA, 20 bp, Artificial Sequence
  Description of Artificial Sequence: Synthetic oligonucleotide
  Target: SCN10A; (+) strand; PAM type: YTN; PAM sequence: CTT
cccttctcttacaacatgag

SEQ ID NO: 75132 - DNA, 20 bp, Artificial Sequence
  Description of Artificial Sequence: Synthetic oligonucleotide
  Target: SCN10A; (+) strand; PAM type: YTN; PAM sequence: TTC
ccttctcttacaacatgaga

SEQ ID NO: 75133 - DNA, 20 bp, Artificial Sequence
  Description of Artificial Sequence: Synthetic oligonucleotide
  Target: SCN10A; (+) strand; PAM type: YTN; PAM sequence: CTT
ctcttacaacatgagaggta

SEQ ID NO: 75134 - DNA, 20 bp, Artificial Sequence
  Description of Artificial Sequence: Synthetic oligonucleotide
  Target: SCN10A; (+) strand; PAM type: YTN; PAM sequence: TTC
tcttacaacatgagaggtat

SEQ ID NO: 75135 - DNA, 20 bp, Artificial Sequence
  Description of Artificial Sequence: Synthetic oligonucleotide
  Target: SCN10A; (+) strand; PAM type: YTN; PAM sequence: CTC
ttacaacatgagaggtatct

SEQ ID NO: 75136 - DNA, 20 bp, Artificial Sequence
  Description of Artificial Sequence: Synthetic oligonucleotide
  Target: SCN10A; (+) strand; PAM type: YTN; PAM sequence: CTT
acaacatgagaggtatcttc

SEQ ID NO: 75137 - DNA, 20 bp, Artificial Sequence
  Description of Artificial Sequence: Synthetic oligonucleotide
  Target: SCN10A; (+) strand; PAM type: YTN; PAM sequence: TTA
caacatgagaggtatcttcc

SEQ ID NO: 75138 - DNA, 20 bp, Artificial Sequence
  Description of Artificial Sequence: Synthetic oligonucleotide
  Target: SCN10A; (+) strand; PAM type: YTN; PAM sequence: CTT
cctacattctaaggaccatt

SEQ ID NO: 75139 - DNA, 20 bp, Artificial Sequence
  Description of Artificial Sequence: Synthetic oligonucleotide
  Target: SCN10A; (+) strand; PAM type: YTN; PAM sequence: TTC
ctacattctaaggaccattc

SEQ ID NO: 75140 - DNA, 20 bp, Artificial Sequence
  Description of Artificial Sequence: Synthetic oligonucleotide
  Target: SCN10A; (+) strand; PAM type: YTN; PAM sequence: CTA
cattctaaggaccattcctt

SEQ ID NO: 75141 - DNA, 20 bp, Artificial Sequence
  Description of Artificial Sequence: Synthetic oligonucleotide
  Target: SCN10A; (+) strand; PAM type: YTN; PAM sequence: TTC
taaggaccattcctttccct

SEQ ID NO: 75142 - DNA, 20 bp, Artificial Sequence
  Description of Artificial Sequence: Synthetic oligonucleotide
  Target: SCN10A; (+) strand; PAM type: YTN; PAM sequence: CTA
aggaccattcctttccctct

SEQ ID NO: 75143 - DNA, 20 bp, Artificial Sequence
  Description of Artificial Sequence: Synthetic oligonucleotide
  Target: SCN10A; (+) strand; PAM type: YTN; PAM sequence: TTC
ctttccctctgcttaggatc

SEQ ID NO: 75144 - DNA, 20 bp, Artificial Sequence
  Description of Artificial Sequence: Synthetic oligonucleotide
  Target: SCN10A; (+) strand; PAM type: YTN; PAM sequence: CTT
tccctctgcttaggatctta

SEQ ID NO: 75145 - DNA, 20 bp, Artificial Sequence
  Description of Artificial Sequence: Synthetic oligonucleotide
  Target: SCN10A; (+) strand; PAM type: YTN; PAM sequence: TTT
ccctctgcttaggatcttat

SEQ ID NO: 75146 - DNA, 20 bp, Artificial Sequence
  Description of Artificial Sequence: Synthetic oligonucleotide
  Target: SCN10A; (+) strand; PAM type: YTN; PAM sequence: TTC
cctctgcttaggatcttatc

SEQ ID NO: 75147 - DNA, 20 bp, Artificial Sequence
  Description of Artificial Sequence: Synthetic oligonucleotide
  Target: SCN10A; (+) strand; PAM type: YTN; PAM sequence: CTC
tgcttaggatcttatctcat

SEQ ID NO: 75148 - DNA, 20 bp, Artificial Sequence
  Description of Artificial Sequence: Synthetic oligonucleotide
  Target: SCN10A; (+) strand; PAM type: YTN; PAM sequence: CTG
cttaggatcttatctcatat

SEQ ID NO: 75149 - DNA, 20 bp, Artificial Sequence
  Description of Artificial Sequence: Synthetic oligonucleotide
  Target: SCN10A; (+) strand; PAM type: YTN; PAM sequence: CTT
aggatcttatctcatatcta

SEQ ID NO: 75150 - DNA, 20 bp, Artificial Sequence
  Description of Artificial Sequence: Synthetic oligonucleotide
  Target: SCN10A; (+) strand; PAM type: YTN; PAM sequence: TTA
ggatcttatctcatatctac

SEQ ID NO: 75151 - DNA, 20 bp, Artificial Sequence
  Description of Artificial Sequence: Synthetic oligonucleotide
  Target: SCN10A; (+) strand; PAM type: YTN; PAM sequence: CTT
atctcatatctacctcattt

SEQ ID NO: 75152 - DNA, 20 bp, Artificial Sequence
  Description of Artificial Sequence: Synthetic oligonucleotide
  Target: SCN10A; (+) strand; PAM type: YTN; PAM sequence: TTA
tctcatatctacctcatttt

SEQ ID NO: 75153 - DNA, 20 bp, Artificial Sequence
  Description of Artificial Sequence: Synthetic oligonucleotide
  Target: SCN10A; (+) strand; PAM type: YTN; PAM sequence: CTC
atatctacctcatttttttc

SEQ ID NO: 75154 - DNA, 20 bp, Artificial Sequence
  Description of Artificial Sequence: Synthetic oligonucleotide
  Target: SCN10A; (+) strand; PAM type: YTN; PAM sequence: CTA
cctcatttttttctctctcc

SEQ ID NO: 75155 - DNA, 20 bp, Artificial Sequence
  Description of Artificial Sequence: Synthetic oligonucleotide
  Target: SCN10A; (+) strand; PAM type: YTN; PAM sequence: CTC
atttttttctctctccttgt

SEQ ID NO: 75156 - DNA, 20 bp, Artificial Sequence
  Description of Artificial Sequence: Synthetic oligonucleotide
  Target: SCN10A; (+) strand; PAM type: YTN; PAM sequence: TTT
ttttctctctccttgtctgc

SEQ ID NO: 75157 - DNA, 20 bp, Artificial Sequence
  Description of Artificial Sequence: Synthetic oligonucleotide
  Target: SCN10A; (+) strand; PAM type: YTN; PAM sequence: TTT
tttctctctccttgtctgcc

SEQ ID NO: 75158 - DNA, 20 bp, Artificial Sequence
  Description of Artificial Sequence: Synthetic oligonucleotide
  Target: SCN10A; (+) strand; PAM type: YTN; PAM sequence: TTT
ttctctctccttgtctgcca

SEQ ID NO: 75159 - DNA, 20 bp, Artificial Sequence
  Description of Artificial Sequence: Synthetic oligonucleotide
  Target: SCN10A; (+) strand; PAM type: YTN; PAM sequence: TTT
tctctctccttgtctgccag

SEQ ID NO: 75160 - DNA, 20 bp, Artificial Sequence
  Description of Artificial Sequence: Synthetic oligonucleotide
  Target: SCN10A; (+) strand; PAM type: YTN; PAM sequence: TTT
ctctctccttgtctgccagc

SEQ ID NO: 75161 - DNA, 20 bp, Artificial Sequence
  Description of Artificial Sequence: Synthetic oligonucleotide
  Target: SCN10A; (+) strand; PAM type: YTN; PAM sequence: TTC
tctctccttgtctgccagct

SEQ ID NO: 75162 - DNA, 20 bp, Artificial Sequence
  Description of Artificial Sequence: Synthetic oligonucleotide
  Target: SCN10A; (+) strand; PAM type: YTN; PAM sequence: CTC
tctccttgtctgccagctct

SEQ ID NO: 75163 - DNA, 20 bp, Artificial Sequence
  Description of Artificial Sequence: Synthetic oligonucleotide
  Target: SCN10A; (+) strand; PAM type: YTN; PAM sequence: CTC
tccttgtctgccagctcttt

SEQ ID NO: 75164 - DNA, 20 bp, Artificial Sequence
  Description of Artificial Sequence: Synthetic oligonucleotide
  Target: SCN10A; (+) strand; PAM type: YTN; PAM sequence: CTC
cttgtctgccagctctttcc

SEQ ID NO: 75165 - DNA, 20 bp, Artificial Sequence
  Description of Artificial Sequence: Synthetic oligonucleotide
  Target: SCN10A; (+) strand; PAM type: YTN; PAM sequence: CTT
gtctgccagctctttcctat

SEQ ID NO: 75166 - DNA, 20 bp, Artificial Sequence
  Description of Artificial Sequence: Synthetic oligonucleotide
  Target: SCN10A; (+) strand; PAM type: YTN; PAM sequence: TTG
tctgccagctctttcctatc

SEQ ID NO: 75167 - DNA, 20 bp, Artificial Sequence
  Description of Artificial Sequence: Synthetic oligonucleotide
  Target: SCN10A; (+) strand; PAM type: YTN; PAM sequence: CTG
ccagctctttcctatcagca

SEQ ID NO: 75168 - DNA, 20 bp, Artificial Sequence
  Description of Artificial Sequence: Synthetic oligonucleotide
  Target: SCN10A; (+) strand; PAM type: YTN; PAM sequence: CTC
tttcctatcagcatttaaag

SEQ ID NO: 75169 - DNA, 20 bp, Artificial Sequence
  Description of Artificial Sequence: Synthetic oligonucleotide
  Target: SCN10A; (+) strand; PAM type: YTN; PAM sequence: CTT
tcctatcagcatttaaagat

SEQ ID NO: 75170 - DNA, 20 bp, Artificial Sequence
  Description of Artificial Sequence: Synthetic oligonucleotide
  Target: SCN10A; (+) strand; PAM type: YTN; PAM sequence: TTT
cctatcagcatttaaagatg

SEQ ID NO: 75171 - DNA, 20 bp, Artificial Sequence
  Description of Artificial Sequence: Synthetic oligonucleotide
  Target: SCN10A; (+) strand; PAM type: YTN; PAM sequence: TTC
ctatcagcatttaaagatgc

SEQ ID NO: 75172 - DNA, 20 bp, Artificial Sequence
  Description of Artificial Sequence: Synthetic oligonucleotide
  Target: SCN10A; (+) strand; PAM type: YTN; PAM sequence: CTA
tcagcatttaaagatgctta

SEQ ID NO: 75173 - DNA, 20 bp, Artificial Sequence
  Description of Artificial Sequence: Synthetic oligonucleotide
  Target: SCN10A; (+) strand; PAM type: YTN; PAM sequence: TTT
aaagatgcttaactttcctc

SEQ ID NO: 75174 - DNA, 20 bp, Artificial Sequence
  Description of Artificial Sequence: Synthetic oligonucleotide
  Target: SCN10A; (+) strand; PAM type: YTN; PAM sequence: TTA
aagatgcttaactttcctcc

SEQ ID NO: 75175 - DNA, 20 bp, Artificial Sequence
  Description of Artificial Sequence: Synthetic oligonucleotide
  Target: SCN10A; (+) strand; PAM type: YTN; PAM sequence: CTT
aactttcctccaactttaaa

SEQ ID NO: 75176 - DNA, 20 bp, Artificial Sequence
  Description of Artificial Sequence: Synthetic oligonucleotide
  Target: SCN10A; (+) strand; PAM type: YTN; PAM sequence: TTA
actttcctccaactttaaaa

SEQ ID NO: 75177 - DNA, 20 bp, Artificial Sequence
  Description of Artificial Sequence: Synthetic oligonucleotide
  Target: SCN10A; (+) strand; PAM type: YTN; PAM sequence: CTT
tcctccaactttaaaaactt

SEQ ID NO: 75178 - DNA, 20 bp, Artificial Sequence
  Description of Artificial Sequence: Synthetic oligonucleotide
  Target: SCN10A; (+) strand; PAM type: YTN; PAM sequence: TTT
cctccaactttaaaaacttt

SEQ ID NO: 75179 - DNA, 20 bp, Artificial Sequence
  Description of Artificial Sequence: Synthetic oligonucleotide
  Target: SCN10A; (+) strand; PAM type: YTN; PAM sequence: TTC
ctccaactttaaaaactttc

SEQ ID NO: 75180 - DNA, 20 bp, Artificial Sequence
  Description of Artificial Sequence: Synthetic oligonucleotide
  Target: SCN10A; (+) strand; PAM type: YTN; PAM sequence: CTC
caactttaaaaactttccct

SEQ ID NO: 75181 - DNA, 20 bp, Artificial Sequence
  Description of Artificial Sequence: Synthetic oligonucleotide
  Target: SCN10A; (+) strand; PAM type: YTN; PAM sequence: CTT
taaaaactttcccttgatgc

SEQ ID NO: 75182 - DNA, 20 bp, Artificial Sequence
  Description of Artificial Sequence: Synthetic oligonucleotide
  Target: SCN10A; (+) strand; PAM type: YTN; PAM sequence: TTT
aaaaactttcccttgatgca

SEQ ID NO: 75183 - DNA, 20 bp, Artificial Sequence
  Description of Artificial Sequence: Synthetic oligonucleotide
  Target: SCN10A; (+) strand; PAM type: YTN; PAM sequence: TTA
aaaactttcccttgatgcag

SEQ ID NO: 75184 - DNA, 20 bp, Artificial Sequence
  Description of Artificial Sequence: Synthetic oligonucleotide
  Target: SCN10A; (+) strand; PAM type: YTN; PAM sequence: CTT
tcccttgatgcagagcccat

SEQ ID NO: 75185 - DNA, 20 bp, Artificial Sequence
  Description of Artificial Sequence: Synthetic oligonucleotide
  Target: SCN10A; (+) strand; PAM type: YTN; PAM sequence: TTT
cccttgatgcagagcccatc

SEQ ID NO: 75186 - DNA, 20 bp, Artificial Sequence
  Description of Artificial Sequence: Synthetic oligonucleotide
  Target: SCN10A; (+) strand; PAM type: YTN; PAM sequence: TTC
ccttgatgcagagcccatcc

SEQ ID NO: 75187 - DNA, 20 bp, Artificial Sequence
  Description of Artificial Sequence: Synthetic oligonucleotide
  Target: SCN10A; (+) strand; PAM type: YTN; PAM sequence: CTT
gatgcagagcccatccaggt

SEQ ID NO: 75188 - DNA, 20 bp, Artificial Sequence
  Description of Artificial Sequence: Synthetic oligonucleotide
  Target: SCN10A; (+) strand; PAM type: YTN; PAM sequence: TTG
atgcagagcccatccaggtc

SEQ ID NO: 75189 - DNA, 20 bp, Artificial Sequence
  Description of Artificial Sequence: Synthetic oligonucleotide
  Target: SCN10A; (+) strand; PAM type: YTN; PAM sequence: CTT
ccctcctctctcctgttctc

SEQ ID NO: 75190 - DNA, 20 bp, Artificial Sequence
  Description of Artificial Sequence: Synthetic oligonucleotide
  Target: SCN10A; (+) strand; PAM type: YTN; PAM sequence: TTC
cctcctctctcctgttctct

SEQ ID NO: 75191 - DNA, 20 bp, Artificial Sequence
  Description of Artificial Sequence: Synthetic oligonucleotide
  Target: SCN10A; (+) strand; PAM type: YTN; PAM sequence: CTC
ctctctcctgttctctattg

SEQ ID NO: 75192 - DNA, 20 bp, Artificial Sequence
  Description of Artificial Sequence: Synthetic oligonucleotide
  Target: SCN10A; (+) strand; PAM type: YTN; PAM sequence: CTC
tctcctgttctctattggct

SEQ ID NO: 75193 - DNA, 20 bp, Artificial Sequence
  Description of Artificial Sequence: Synthetic oligonucleotide
  Target: SCN10A; (+) strand; PAM type: YTN; PAM sequence: CTC
tcctgttctctattggcttt

SEQ ID NO: 75194 - DNA, 20 bp, Artificial Sequence
  Description of Artificial Sequence: Synthetic oligonucleotide
  Target: SCN10A; (+) strand; PAM type: YTN; PAM sequence: CTC
ctgttctctattggctttta

SEQ ID NO: 75195 - DNA, 20 bp, Artificial Sequence
  Description of Artificial Sequence: Synthetic oligonucleotide
  Target: SCN10A; (+) strand; PAM type: YTN; PAM sequence: CTG
ttctctattggcttttaata

SEQ ID NO: 75196 - DNA, 20 bp, Artificial Sequence
  Description of Artificial Sequence: Synthetic oligonucleotide
  Target: SCN10A; (+) strand; PAM type: YTN; PAM sequence: TTC
tctattggcttttaataaag

SEQ ID NO: 75197 - DNA, 20 bp, Artificial Sequence
  Description of Artificial Sequence: Synthetic oligonucleotide
  Target: SCN10A; (+) strand; PAM type: YTN; PAM sequence: CTC
tattggcttttaataaagga

SEQ ID NO: 75198 - DNA, 20 bp, Artificial Sequence
  Description of Artificial Sequence: Synthetic oligonucleotide
  Target: SCN10A; (+) strand; PAM type: YTN; PAM sequence: CTA
ttggcttttaataaaggact

SEQ ID NO: 75199 - DNA, 20 bp, Artificial Sequence
  Description of Artificial Sequence: Synthetic oligonucleotide
  Target: SCN10A; (+) strand; PAM type: YTN; PAM sequence: TTG
gcttttaataaaggacttac

SEQ ID NO: 75200 - DNA, 20 bp, Artificial Sequence
  Description of Artificial Sequence: Synthetic oligonucleotide
  Target: SCN10A; (+) strand; PAM type: YTN; PAM sequence: CTT
ttaataaaggacttacttct

SEQ ID NO: 75201 - DNA, 20 bp, Artificial Sequence
  Description of Artificial Sequence: Synthetic oligonucleotide
  Target: SCN10A; (+) strand; PAM type: YTN; PAM sequence: TTT
taataaaggacttacttcta

SEQ ID NO: 75202 - DNA, 20 bp, Artificial Sequence
  Description of Artificial Sequence: Synthetic oligonucleotide
  Target: SCN10A; (+) strand; PAM type: YTN; PAM sequence: TTT
aataaaggacttacttctac

SEQ ID NO: 75203 - DNA, 20 bp, Artificial Sequence
  Description of Artificial Sequence: Synthetic oligonucleotide
  Target: SCN10A; (+) strand; PAM type: YTN; PAM sequence: TTA
ataaaggacttacttctact

SEQ ID NO: 75204 - DNA, 20 bp, Artificial Sequence
  Description of Artificial Sequence: Synthetic oligonucleotide
  Target: SCN10A; (+) strand; PAM type: YTN; PAM sequence: CTT
acttctactcactgtttcca

SEQ ID NO: 75205 - DNA, 20 bp, Artificial Sequence
  Description of Artificial Sequence: Synthetic oligonucleotide
  Target: SCN10A; (+) strand; PAM type: YTN; PAM sequence: TTA
cttctactcactgtttccag

SEQ ID NO: 75206 - DNA, 20 bp, Artificial Sequence
  Description of Artificial Sequence: Synthetic oligonucleotide
  Target: SCN10A; (+) strand; PAM type: YTN; PAM sequence: CTT
ctactcactgtttccagtca

SEQ ID NO: 75207 - DNA, 20 bp, Artificial Sequence
  Description of Artificial Sequence: Synthetic oligonucleotide
  Target: SCN10A; (+) strand; PAM type: YTN; PAM sequence: TTC
tactcactgtttccagtcac

SEQ ID NO: 75208 - DNA, 20 bp, Artificial Sequence
  Description of Artificial Sequence: Synthetic oligonucleotide
  Target: SCN10A; (+) strand; PAM type: YTN; PAM sequence: CTA
ctcactgtttccagtcactt

SEQ ID NO: 75209 - DNA, 20 bp, Artificial Sequence
  Description of Artificial Sequence: Synthetic oligonucleotide
  Target: SCN10A; (+) strand; PAM type: YTN; PAM sequence: CTC
actgtttccagtcacttttc

SEQ ID NO: 75210 - DNA, 20 bp, Artificial Sequence
  Description of Artificial Sequence: Synthetic oligonucleotide
  Target: SCN10A; (+) strand; PAM type: YTN; PAM sequence: CTG
tttccagtcacttttcagtc

SEQ ID NO: 75211 - DNA, 20 bp, Artificial Sequence
  Description of Artificial Sequence: Synthetic oligonucleotide
  Target: SCN10A; (+) strand; PAM type: YTN; PAM sequence: TTT
ccagtcacttttcagtcttt

SEQ ID NO: 75212 - DNA, 20 bp, Artificial Sequence
  Description of Artificial Sequence: Synthetic oligonucleotide
  Target: SCN10A; (+) strand; PAM type: YTN; PAM sequence: TTC
cagtcacttttcagtctttg

SEQ ID NO: 75213 - DNA, 20 bp, Artificial Sequence
  Description of Artificial Sequence: Synthetic oligonucleotide
  Target: SCN10A; (+) strand; PAM type: YTN; PAM sequence: CTT
ttcagtctttgaagcttgga

SEQ ID NO: 75214 - DNA, 20 bp, Artificial Sequence
  Description of Artificial Sequence: Synthetic oligonucleotide
  Target: SCN10A; (+) strand; PAM type: YTN; PAM sequence: TTT
tcagtctttgaagcttggat

SEQ ID NO: 75215 - DNA, 20 bp, Artificial Sequence
  Description of Artificial Sequence: Synthetic oligonucleotide
  Target: SCN10A; (+) strand; PAM type: YTN; PAM sequence: TTT
cagtctttgaagcttggatt

SEQ ID NO: 75216 - DNA, 20 bp, Artificial Sequence
  Description of Artificial Sequence: Synthetic oligonucleotide
  Target: SCN10A; (+) strand; PAM type: YTN; PAM sequence: TTC
agtctttgaagcttggattt

SEQ ID NO: 75217 - DNA, 20 bp, Artificial Sequence
  Description of Artificial Sequence: Synthetic oligonucleotide
  Target: SCN10A; (+) strand; PAM type: YTN; PAM sequence: CTT
tgaagcttggattttgccct

SEQ ID NO: 75218 - DNA, 20 bp, Artificial Sequence
  Description of Artificial Sequence: Synthetic oligonucleotide
  Target: SCN10A; (+) strand; PAM type: YTN; PAM sequence: TTT
gaagcttggattttgccctc

SEQ ID NO: 75219 - DNA, 20 bp, Artificial Sequence
  Description of Artificial Sequence: Synthetic oligonucleotide
  Target: SCN10A; (+) strand; PAM type: YTN; PAM sequence: TTG
aagcttggattttgccctcc

SEQ ID NO: 75220 - DNA, 20 bp, Artificial Sequence
  Description of Artificial Sequence: Synthetic oligonucleotide
  Target: SCN10A; (+) strand; PAM type: YTN; PAM sequence: CTT
ggattttgccctcctatctc

SEQ ID NO: 75221 - DNA, 20 bp, Artificial Sequence
  Description of Artificial Sequence: Synthetic oligonucleotide
  Target: SCN10A; (+) strand; PAM type: YTN; PAM sequence: TTG
gattttgccctcctatctca

SEQ ID NO: 75222 - DNA, 20 bp, Artificial Sequence
  Description of Artificial Sequence: Synthetic oligonucleotide
  Target: SCN10A; (+) strand; PAM type: YTN; PAM sequence: TTT
tgccctcctatctcactaaa

SEQ ID NO: 75223 - DNA, 20 bp, Artificial Sequence
  Description of Artificial Sequence: Synthetic oligonucleotide
  Target: SCN10A; (+) strand; PAM type: YTN; PAM sequence: TTT
gccctcctatctcactaaaa

SEQ ID NO: 75224 - DNA, 20 bp, Artificial Sequence
  Description of Artificial Sequence: Synthetic oligonucleotide
  Target: SCN10A; (+) strand; PAM type: YTN; PAM sequence: TTG
ccctcctatctcactaaaat

SEQ ID NO: 75225 - DNA, 20 bp, Artificial Sequence
  Description of Artificial Sequence: Synthetic oligonucleotide
  Target: SCN10A; (+) strand; PAM type: YTN; PAM sequence: CTC
ctatctcactaaaatgcttc

SEQ ID NO: 75226 - DNA, 20 bp, Artificial Sequence
  Description of Artificial Sequence: Synthetic oligonucleotide
  Target: SCN10A; (+) strand; PAM type: YTN; PAM sequence: CTA
tctcactaaaatgcttcctt

SEQ ID NO: 75227 - DNA, 20 bp, Artificial Sequence
  Description of Artificial Sequence: Synthetic oligonucleotide
  Target: SCN10A; (+) strand; PAM type: YTN; PAM sequence: CTC
actaaaatgcttccttgcag

SEQ ID NO: 75228 - DNA, 20 bp, Artificial Sequence
  Description of Artificial Sequence: Synthetic oligonucleotide
  Target: SCN10A; (+) strand; PAM type: YTN; PAM sequence: CTA
aaatgcttccttgcagggat

SEQ ID NO: 75229 - DNA, 20 bp, Artificial Sequence
  Description of Artificial Sequence: Synthetic oligonucleotide
  Target: SCN10A; (+) strand; PAM type: YTN; PAM sequence: CTT
ccttgcagggatacaagaga

SEQ ID NO: 75230 - DNA, 20 bp, Artificial Sequence
  Description of Artificial Sequence: Synthetic oligonucleotide
  Target: SCN10A; (+) strand; PAM type: YTN; PAM sequence: TTC
cttgcagggatacaagagat

SEQ ID NO: 75231 - DNA, 20 bp, Artificial Sequence
  Description of Artificial Sequence: Synthetic oligonucleotide
  Target: SCN10A; (+) strand; PAM type: YTN; PAM sequence: CTT
gcagggatacaagagattgc

SEQ ID NO: 75232 - DNA, 20 bp, Artificial Sequence
  Description of Artificial Sequence: Synthetic oligonucleotide
  Target: SCN10A; (+) strand; PAM type: YTN; PAM sequence: TTG
cagggatacaagagattgcc

SEQ ID NO: 75233 - DNA, 20 bp, Artificial Sequence
  Description of Artificial Sequence: Synthetic oligonucleotide
  Target: SCN10A; (+) strand; PAM type: YTN; PAM sequence: TTG
ccttgtggctaaagtcaggg

SEQ ID NO: 75234 - DNA, 20 bp, Artificial Sequence
  Description of Artificial Sequence: Synthetic oligonucleotide
  Target: SCN10A; (+) strand; PAM type: YTN; PAM sequence: CTT
gtggctaaagtcagggggcc

SEQ ID NO: 75235 - DNA, 20 bp, Artificial Sequence
  Description of Artificial Sequence: Synthetic oligonucleotide
  Target: SCN10A; (+) strand; PAM type: YTN; PAM sequence: TTG
tggctaaagtcagggggccc

SEQ ID NO: 75236 - DNA, 20 bp, Artificial Sequence
  Description of Artificial Sequence: Synthetic oligonucleotide
  Target: SCN10A; (+) strand; PAM type: YTN; PAM sequence: CTA
aagtcagggggcccttctca

SEQ ID NO: 75237 - DNA, 20 bp, Artificial Sequence
  Description of Artificial Sequence: Synthetic oligonucleotide
  Target: SCN10A; (+) strand; PAM type: YTN; PAM sequence: CTT
ctcagttcttgtcttttttg

SEQ ID NO: 75238 - DNA, 20 bp, Artificial Sequence
  Description of Artificial Sequence: Synthetic oligonucleotide
  Target: SCN10A; (+) strand; PAM type: YTN; PAM sequence: TTC
tcagttcttgtcttttttgt

SEQ ID NO: 75239 - DNA, 20 bp, Artificial Sequence
  Description of Artificial Sequence: Synthetic oligonucleotide
  Target: SCN10A; (+) strand; PAM type: YTN; PAM sequence: CTC
agttcttgtcttttttgttt

SEQ ID NO: 75240 - DNA, 20 bp, Artificial Sequence
  Description of Artificial Sequence: Synthetic oligonucleotide
  Target: SCN10A; (+) strand; PAM type: YTN; PAM sequence: TTC
ttgtcttttttgtttttttc

SEQ ID NO: 75241 - DNA, 20 bp, Artificial Sequence
  Description of Artificial Sequence: Synthetic oligonucleotide
  Target: SCN10A; (+) strand; PAM type: YTN; PAM sequence: CTT
gtcttttttgtttttttctt

SEQ ID NO: 75242 - DNA, 20 bp, Artificial Sequence
  Description of Artificial Sequence: Synthetic oligonucleotide
  Target: SCN10A; (+) strand; PAM type: YTN; PAM sequence: TTG
tcttttttgtttttttcttt

SEQ ID NO: 75243 - DNA, 20 bp, Artificial Sequence
  Description of Artificial Sequence: Synthetic oligonucleotide
  Target: SCN10A; (+) strand; PAM type: YTN; PAM sequence: CTT
ttttgtttttttctttttct

SEQ ID NO: 75244 - DNA, 20 bp, Artificial Sequence
  Description of Artificial Sequence: Synthetic oligonucleotide
  Target: SCN10A; (+) strand; PAM type: YTN; PAM sequence: TTT
tttgtttttttctttttctt

SEQ ID NO: 75245 - DNA, 20 bp, Artificial Sequence
  Description of Artificial Sequence: Synthetic oligonucleotide
  Target: SCN10A; (+) strand; PAM type: YTN; PAM sequence: TTT
ttgtttttttctttttcttt

SEQ ID NO: 75246 - DNA, 20 bp, Artificial Sequence
  Description of Artificial Sequence: Synthetic oligonucleotide
  Target: SCN10A; (+) strand; PAM type: YTN; PAM sequence: TTT
tgtttttttctttttctttt

SEQ ID NO: 75247 - DNA, 20 bp, Artificial Sequence
  Description of Artificial Sequence: Synthetic oligonucleotide
  Target: SCN10A; (+) strand; PAM type: YTN; PAM sequence: TTT
gtttttttctttttcttttt

SEQ ID NO: 75248 - DNA, 20 bp, Artificial Sequence
  Description of Artificial Sequence: Synthetic oligonucleotide
  Target: SCN10A; (+) strand; PAM type: YTN; PAM sequence: TTG
tttttttctttttctttttc

SEQ ID NO: 75249 - DNA, 20 bp, Artificial Sequence
  Description of Artificial Sequence: Synthetic oligonucleotide
  Target: SCN10A; (+) strand; PAM type: YTN; PAM sequence: TTT
ttttctttttctttttcttt

SEQ ID NO: 75250 - DNA, 20 bp, Artificial Sequence
  Description of Artificial Sequence: Synthetic oligonucleotide
  Target: SCN10A; (+) strand; PAM type: YTN; PAM sequence: TTT
tttctttttctttttctttt

SEQ ID NO: 75251 - DNA, 20 bp, Artificial Sequence
  Description of Artificial Sequence: Synthetic oligonucleotide
  Target: SCN10A; (+) strand; PAM type: YTN; PAM sequence: TTT
ttctttttctttttcttttt

SEQ ID NO: 75252 - DNA, 20 bp, Artificial Sequence
  Description of Artificial Sequence: Synthetic oligonucleotide
  Target: SCN10A; (+) strand; PAM type: YTN; PAM sequence: TTT
tctttttctttttctttttt

SEQ ID NO: 75253 - DNA, 20 bp, Artificial Sequence
  Description of Artificial Sequence: Synthetic oligonucleotide
  Target: SCN10A; (+) strand; PAM type: YTN; PAM sequence: TTT
ctttttctttttcttttttt

SEQ ID NO: 75254 - DNA, 20 bp, Artificial Sequence
  Description of Artificial Sequence: Synthetic oligonucleotide
  Target: SCN10A; (+) strand; PAM type: YTN; PAM sequence: TTC
tttttctttttctttttttt

SEQ ID NO: 75255 - DNA, 20 bp, Artificial Sequence
  Description of Artificial Sequence: Synthetic oligonucleotide
  Target: SCN10A; (+) strand; PAM type: YTN; PAM sequence: CTT
tttctttttctttttttttt

SEQ ID NO: 75256 - DNA, 20 bp, Artificial Sequence
  Description of Artificial Sequence: Synthetic oligonucleotide
  Target: SCN10A; (+) strand; PAM type: YTN; PAM sequence: TTT
ttctttttcttttttttttt

SEQ ID NO: 75257 - DNA, 20 bp, Artificial Sequence
  Description of Artificial Sequence: Synthetic oligonucleotide
  Target: SCN10A; (+) strand; PAM type: YTN; PAM sequence: TTT
tctttttctttttttttttt

SEQ ID NO: 75258 - DNA, 20 bp, Artificial Sequence
  Description of Artificial Sequence: Synthetic oligonucleotide
  Target: SCN10A; (+) strand; PAM type: YTN; PAM sequence: TTT
ctttttcttttttttttttt

SEQ ID NO: 75259 - DNA, 20 bp, Artificial Sequence
  Description of Artificial Sequence: Synthetic oligonucleotide
  Target: SCN10A; (+) strand; PAM type: YTN; PAM sequence: TTC
tttttctttttttttttttg

SEQ ID NO: 75260 - DNA, 20 bp, Artificial Sequence
  Description of Artificial Sequence: Synthetic oligonucleotide
  Target: SCN10A; (+) strand; PAM type: YTN; PAM sequence: CTT
tttctttttttttttttgag

SEQ ID NO: 75261 - DNA, 20 bp, Artificial Sequence
  Description of Artificial Sequence: Synthetic oligonucleotide
  Target: SCN10A; (+) strand; PAM type: YTN; PAM sequence: TTT
ttctttttttttttttgaga

SEQ ID NO: 75262 - DNA, 20 bp, Artificial Sequence
  Description of Artificial Sequence: Synthetic oligonucleotide
  Target: SCN10A; (+) strand; PAM type: YTN; PAM sequence: TTT
tctttttttttttttgagac

SEQ ID NO: 75263 - DNA, 20 bp, Artificial Sequence
  Description of Artificial Sequence: Synthetic oligonucleotide
  Target: SCN10A; (+) strand; PAM type: YTN; PAM sequence: TTT
ctttttttttttttgagaca

SEQ ID NO: 75264 - DNA, 20 bp, Artificial Sequence
  Description of Artificial Sequence: Synthetic oligonucleotide
  Target: SCN10A; (+) strand; PAM type: YTN; PAM sequence: TTC
tttttttttttttgagacag

SEQ ID NO: 75265 - DNA, 20 bp, Artificial Sequence
  Description of Artificial Sequence: Synthetic oligonucleotide
  Target: SCN10A; (+) strand; PAM type: YTN; PAM sequence: CTT
tttttttttttgagacaggg

SEQ ID NO: 75266 - DNA, 20 bp, Artificial Sequence
  Description of Artificial Sequence: Synthetic oligonucleotide
  Target: SCN10A; (+) strand; PAM type: YTN; PAM sequence: TTT
ttttttttttgagacagggt

SEQ ID NO: 75267 - DNA, 20 bp, Artificial Sequence
  Description of Artificial Sequence: Synthetic oligonucleotide
  Target: SCN10A; (+) strand; PAM type: YTN; PAM sequence: TTT
tttttttttgagacagggta

SEQ ID NO: 75268 - DNA, 20 bp, Artificial Sequence
  Description of Artificial Sequence: Synthetic oligonucleotide
  Target: SCN10A; (+) strand; PAM type: YTN; PAM sequence: TTT
ttttttttgagacagggtat

SEQ ID NO: 75269 - DNA, 20 bp, Artificial Sequence
  Description of Artificial Sequence: Synthetic oligonucleotide
  Target: SCN10A; (+) strand; PAM type: YTN; PAM sequence: TTT
tttttttgagacagggtatc

SEQ ID NO: 75270 - DNA, 20 bp, Artificial Sequence
  Description of Artificial Sequence: Synthetic oligonucleotide
  Target: SCN10A; (+) strand; PAM type: YTN; PAM sequence: TTT
ttttttgagacagggtatca

SEQ ID NO: 75271 - DNA, 20 bp, Artificial Sequence
  Description of Artificial Sequence: Synthetic oligonucleotide
  Target: SCN10A; (+) strand; PAM type: YTN; PAM sequence: TTT
tttttgagacagggtatcac

SEQ ID NO: 75272 - DNA, 20 bp, Artificial Sequence
  Description of Artificial Sequence: Synthetic oligonucleotide
  Target: SCN10A; (+) strand; PAM type: YTN; PAM sequence: TTT
ttttgagacagggtatcact

SEQ ID NO: 75273 - DNA, 20 bp, Artificial Sequence
  Description of Artificial Sequence: Synthetic oligonucleotide
  Target: SCN10A; (+) strand; PAM type: YTN; PAM sequence: TTT
tttgagacagggtatcactg

SEQ ID NO: 75274 - DNA, 20 bp, Artificial Sequence
  Description of Artificial Sequence: Synthetic oligonucleotide
  Target: SCN10A; (+) strand; PAM type: YTN; PAM sequence: TTT
ttgagacagggtatcactgt

SEQ ID NO: 75275 - DNA, 20 bp, Artificial Sequence
  Description of Artificial Sequence: Synthetic oligonucleotide
  Target: SCN10A; (+) strand; PAM type: YTN; PAM sequence: TTT
tgagacagggtatcactgtc

SEQ ID NO: 75276 - DNA, 20 bp, Artificial Sequence
  Description of Artificial Sequence: Synthetic oligonucleotide
  Target: SCN10A; (+) strand; PAM type: YTN; PAM sequence: TTT
gagacagggtatcactgtca

SEQ ID NO: 75277 - DNA, 20 bp, Artificial Sequence
  Description of Artificial Sequence: Synthetic oligonucleotide
  Target: SCN10A; (+) strand; PAM type: YTN; PAM sequence: TTG
agacagggtatcactgtcac

SEQ ID NO: 75278 - DNA, 20 bp, Artificial Sequence
  Description of Artificial Sequence: Synthetic oligonucleotide
  Target: SCN10A; (+) strand; PAM type: YTN; PAM sequence: CTG
tcacccggactagagtgcag

SEQ ID NO: 75279 - DNA, 20 bp, Artificial Sequence
  Description of Artificial Sequence: Synthetic oligonucleotide
  Target: SCN10A; (+) strand; PAM type: YTN; PAM sequence: CTA
gagtgcagtggtgcaatctc

SEQ ID NO: 75280 - DNA, 20 bp, Artificial Sequence
  Description of Artificial Sequence: Synthetic oligonucleotide
  Target: SCN10A; (+) strand; PAM type: YTN; PAM sequence: CTC
tgctcactgcaacctctgtc

SEQ ID NO: 75281 - DNA, 20 bp, Artificial Sequence
  Description of Artificial Sequence: Synthetic oligonucleotide
  Target: SCN10A; (+) strand; PAM type: YTN; PAM sequence: CTG
ctcactgcaacctctgtctc

SEQ ID NO: 75282 - DNA, 20 bp, Artificial Sequence
  Description of Artificial Sequence: Synthetic oligonucleotide
  Target: SCN10A; (+) strand; PAM type: YTN; PAM sequence: CTC
actgcaacctctgtctcctg

SEQ ID NO: 75283 - DNA, 20 bp, Artificial Sequence
  Description of Artificial Sequence: Synthetic oligonucleotide
  Target: SCN10A; (+) strand; PAM type: YTN; PAM sequence: CTG
caacctctgtctcctgggct

SEQ ID NO: 75284 - DNA, 20 bp, Artificial Sequence
  Description of Artificial Sequence: Synthetic oligonucleotide
  Target: SCN10A; (+) strand; PAM type: YTN; PAM sequence: CTC
tgtctcctgggctcaagcaa

SEQ ID NO: 75285 - DNA, 20 bp, Artificial Sequence
  Description of Artificial Sequence: Synthetic oligonucleotide
  Target: SCN10A; (+) strand; PAM type: YTN; PAM sequence: CTG
tctcctgggctcaagcaatt

SEQ ID NO: 75286 - DNA, 20 bp, Artificial Sequence
  Description of Artificial Sequence: Synthetic oligonucleotide
  Target: SCN10A; (+) strand; PAM type: YTN; PAM sequence: CTC
ctgggctcaagcaattctcc

SEQ ID NO: 75287 - DNA, 20 bp, Artificial Sequence
  Description of Artificial Sequence: Synthetic oligonucleotide
  Target: SCN10A; (+) strand; PAM type: YTN; PAM sequence: CTG
ggctcaagcaattctcccac

SEQ ID NO: 75288 - DNA, 20 bp, Artificial Sequence
  Description of Artificial Sequence: Synthetic oligonucleotide
  Target: SCN10A; (+) strand; PAM type: YTN; PAM sequence: CTC
aagcaattctcccacctcag

SEQ ID NO: 75289 - DNA, 20 bp, Artificial Sequence
  Description of Artificial Sequence: Synthetic oligonucleotide
  Target: SCN10A; (+) strand; PAM type: YTN; PAM sequence: TTC
tcccacctcagcctcccgaa

SEQ ID NO: 75290 - DNA, 20 bp, Artificial Sequence
  Description of Artificial Sequence: Synthetic oligonucleotide
  Target: SCN10A; (+) strand; PAM type: YTN; PAM sequence: CTC
ccacctcagcctcccgaata

SEQ ID NO: 75291 - DNA, 20 bp, Artificial Sequence
  Description of Artificial Sequence: Synthetic oligonucleotide
  Target: SCN10A; (+) strand; PAM type: YTN; PAM sequence: CTC
agcctcccgaatagctgggc

SEQ ID NO: 75292 - DNA, 20 bp, Artificial Sequence
  Description of Artificial Sequence: Synthetic oligonucleotide
  Target: SCN10A; (+) strand; PAM type: YTN; PAM sequence: CTC
ccgaatagctgggctatagg

SEQ ID NO: 75293 - DNA, 20 bp, Artificial Sequence
  Description of Artificial Sequence: Synthetic oligonucleotide
  Target: SCN10A; (+) strand; PAM type: YTN; PAM sequence: CTG
ggctataggcacatgtcacc

SEQ ID NO: 75294 - DNA, 20 bp, Artificial Sequence
  Description of Artificial Sequence: Synthetic oligonucleotide
  Target: SCN10A; (+) strand; PAM type: YTN; PAM sequence: CTA
taggcacatgtcaccacact

SEQ ID NO: 75295 - DNA, 20 bp, Artificial Sequence
  Description of Artificial Sequence: Synthetic oligonucleotide
  Target: SCN10A; (+) strand; PAM type: YTN; PAM sequence: CTC
ggctagttttgaaaaaattt

SEQ ID NO: 75296 - DNA, 20 bp, Artificial Sequence
  Description of Artificial Sequence: Synthetic oligonucleotide
  Target: SCN10A; (+) strand; PAM type: YTN; PAM sequence: CTA
gttttgaaaaaatttttttg

SEQ ID NO: 75297 - DNA, 20 bp, Artificial Sequence
  Description of Artificial Sequence: Synthetic oligonucleotide
  Target: SCN10A; (+) strand; PAM type: YTN; PAM sequence: TTT
tgaaaaaatttttttgtagg

SEQ ID NO: 75298 - DNA, 20 bp, Artificial Sequence
  Description of Artificial Sequence: Synthetic oligonucleotide
  Target: SCN10A; (+) strand; PAM type: YTN; PAM sequence: TTT
gaaaaaatttttttgtaggc

SEQ ID NO: 75299 - DNA, 20 bp, Artificial Sequence
  Description of Artificial Sequence: Synthetic oligonucleotide
  Target: SCN10A; (+) strand; PAM type: YTN; PAM sequence: TTG
aaaaaatttttttgtaggca

SEQ ID NO: 75300 - DNA, 20 bp, Artificial Sequence
  Description of Artificial Sequence: Synthetic oligonucleotide
  Target: SCN10A; (+) strand; PAM type: YTN; PAM sequence: TTT
ttttgtaggcagtgtaccac

SEQ ID NO: 75301 - DNA, 20 bp, Artificial Sequence
  Description of Artificial Sequence: Synthetic oligonucleotide
  Target: SCN10A; (+) strand; PAM type: YTN; PAM sequence: TTT
tttgtaggcagtgtaccact

SEQ ID NO: 75302 - DNA, 20 bp, Artificial Sequence
  Description of Artificial Sequence: Synthetic oligonucleotide
  Target: SCN10A; (+) strand; PAM type: YTN; PAM sequence: TTT
ttgtaggcagtgtaccacta

SEQ ID NO: 75303 - DNA, 20 bp, Artificial Sequence
  Description of Artificial Sequence: Synthetic oligonucleotide
  Target: SCN10A; (+) strand; PAM type: YTN; PAM sequence: TTT
tgtaggcagtgtaccactat

SEQ ID NO: 75304 - DNA, 20 bp, Artificial Sequence
  Description of Artificial Sequence: Synthetic oligonucleotide
  Target: SCN10A; (+) strand; PAM type: YTN; PAM sequence: TTT
gtaggcagtgtaccactata

SEQ ID NO: 75305 - DNA, 20 bp, Artificial Sequence
  Description of Artificial Sequence: Synthetic oligonucleotide
  Target: SCN10A; (+) strand; PAM type: YTN; PAM sequence: TTG
taggcagtgtaccactatat

SEQ ID NO: 75306 - DNA, 20 bp, Artificial Sequence
  Description of Artificial Sequence: Synthetic oligonucleotide
  Target: SCN10A; (+) strand; PAM type: YTN; PAM sequence: CTA
tattgtccaggcccatctca

SEQ ID NO: 75307 - DNA, 20 bp, Artificial Sequence
  Description of Artificial Sequence: Synthetic oligonucleotide
  Target: SCN10A; (+) strand; PAM type: YTN; PAM sequence: TTG
tccaggcccatctcagttct

SEQ ID NO: 75308 - DNA, 20 bp, Artificial Sequence
  Description of Artificial Sequence: Synthetic oligonucleotide
  Target: SCN10A; (+) strand; PAM type: YTN; PAM sequence: CTC
agttcttatcttgatggtcc

SEQ ID NO: 75309 - DNA, 20 bp, Artificial Sequence
  Description of Artificial Sequence: Synthetic oligonucleotide
  Target: SCN10A; (+) strand; PAM type: YTN; PAM sequence: TTC
ttatcttgatggtcctattg

SEQ ID NO: 75310 - DNA, 20 bp, Artificial Sequence
  Description of Artificial Sequence: Synthetic oligonucleotide
  Target: SCN10A; (+) strand; PAM type: YTN; PAM sequence: CTT
atcttgatggtcctattggc

SEQ ID NO: 75311 - DNA, 20 bp, Artificial Sequence
  Description of Artificial Sequence: Synthetic oligonucleotide
  Target: SCN10A; (+) strand; PAM type: YTN; PAM sequence: TTA
tcttgatggtcctattggct

SEQ ID NO: 75312 - DNA, 20 bp, Artificial Sequence
  Description of Artificial Sequence: Synthetic oligonucleotide
  Target: SCN10A; (+) strand; PAM type: YTN; PAM sequence: CTT
gatggtcctattggctgttt

SEQ ID NO: 75313 - DNA, 20 bp, Artificial Sequence
  Description of Artificial Sequence: Synthetic oligonucleotide
  Target: SCN10A; (+) strand; PAM type: YTN; PAM sequence: TTG
atggtcctattggctgtttt

SEQ ID NO: 75314 - DNA, 20 bp, Artificial Sequence
  Description of Artificial Sequence: Synthetic oligonucleotide
  Target: SCN10A; (+) strand; PAM type: YTN; PAM sequence: CTA
ttggctgttttgacaatttc

SEQ ID NO: 75315 - DNA, 20 bp, Artificial Sequence
  Description of Artificial Sequence: Synthetic oligonucleotide
  Target: SCN10A; (+) strand; PAM type: YTN; PAM sequence: TTG
gctgttttgacaatttcctc

SEQ ID NO: 75316 - DNA, 20 bp, Artificial Sequence
  Description of Artificial Sequence: Synthetic oligonucleotide
  Target: SCN10A; (+) strand; PAM type: YTN; PAM sequence: CTG
ttttgacaatttcctcctta

SEQ ID NO: 75317 - DNA, 20 bp, Artificial Sequence
  Description of Artificial Sequence: Synthetic oligonucleotide
  Target: SCN10A; (+) strand; PAM type: YTN; PAM sequence: TTT
tgacaatttcctccttaaaa

SEQ ID NO: 75318 - DNA, 20 bp, Artificial Sequence
  Description of Artificial Sequence: Synthetic oligonucleotide
  Target: SCN10A; (+) strand; PAM type: YTN; PAM sequence: TTT
gacaatttcctccttaaaat

SEQ ID NO: 75319 - DNA, 20 bp, Artificial Sequence
  Description of Artificial Sequence: Synthetic oligonucleotide
  Target: SCN10A; (+) strand; PAM type: YTN; PAM sequence: TTG
acaatttcctccttaaaata

SEQ ID NO: 75320 - DNA, 20 bp, Artificial Sequence
  Description of Artificial Sequence: Synthetic oligonucleotide
  Target: SCN10A; (+) strand; PAM type: YTN; PAM sequence: TTT
cctccttaaaatactgtata

SEQ ID NO: 75321 - DNA, 20 bp, Artificial Sequence
  Description of Artificial Sequence: Synthetic oligonucleotide
  Target: SCN10A; (+) strand; PAM type: YTN; PAM sequence: TTC
ctccttaaaatactgtatat

SEQ ID NO: 75322 - DNA, 20 bp, Artificial Sequence
  Description of Artificial Sequence: Synthetic oligonucleotide
  Target: SCN10A; (+) strand; PAM type: YTN; PAM sequence: CTC
cttaaaatactgtatatttt

SEQ ID NO: 75323 - DNA, 20 bp, Artificial Sequence
  Description of Artificial Sequence: Synthetic oligonucleotide
  Target: SCN10A; (+) strand; PAM type: YTN; PAM sequence: CTT
aaaatactgtatattttggc

SEQ ID NO: 75324 - DNA, 20 bp, Artificial Sequence
  Description of Artificial Sequence: Synthetic oligonucleotide
  Target: SCN10A; (+) strand; PAM type: YTN; PAM sequence: TTA
aaatactgtatattttggct

SEQ ID NO: 75325 - DNA, 20 bp, Artificial Sequence
  Description of Artificial Sequence: Synthetic oligonucleotide
  Target: SCN10A; (+) strand; PAM type: YTN; PAM sequence: CTG
tatattttggctaccatgac

SEQ ID NO: 75326 - DNA, 20 bp, Artificial Sequence
  Description of Artificial Sequence: Synthetic oligonucleotide
  Target: SCN10A; (+) strand; PAM type: YTN; PAM sequence: TTT
tggctaccatgacactctct

SEQ ID NO: 75327 - DNA, 20 bp, Artificial Sequence
  Description of Artificial Sequence: Synthetic oligonucleotide
  Target: SCN10A; (+) strand; PAM type: YTN; PAM sequence: TTT
ggctaccatgacactctctt

SEQ ID NO: 75328 - DNA, 20 bp, Artificial Sequence
  Description of Artificial Sequence: Synthetic oligonucleotide
  Target: SCN10A; (+) strand; PAM type: YTN; PAM sequence: TTG
gctaccatgacactctcttg

SEQ ID NO: 75329 - DNA, 20 bp, Artificial Sequence
  Description of Artificial Sequence: Synthetic oligonucleotide
  Target: SCN10A; (+) strand; PAM type: YTN; PAM sequence: CTA
ccatgacactctcttggttt

SEQ ID NO: 75330 - DNA, 20 bp, Artificial Sequence
  Description of Artificial Sequence: Synthetic oligonucleotide
  Target: SCN10A; (+) strand; PAM type: YTN; PAM sequence: CTC
tcttggttttcctaactttc

SEQ ID NO: 75331 - DNA, 20 bp, Artificial Sequence
  Description of Artificial Sequence: Synthetic oligonucleotide
  Target: SCN10A; (+) strand; PAM type: YTN; PAM sequence: CTC
ttggttttcctaactttctc

SEQ ID NO: 75332 - DNA, 20 bp, Artificial Sequence
  Description of Artificial Sequence: Synthetic oligonucleotide
  Target: SCN10A; (+) strand; PAM type: YTN; PAM sequence: CTT
ggttttcctaactttctctc

SEQ ID NO: 75333 - DNA, 20 bp, Artificial Sequence
  Description of Artificial Sequence: Synthetic oligonucleotide
  Target: SCN10A; (+) strand; PAM type: YTN; PAM sequence: TTG
gttttcctaactttctctct

SEQ ID NO: 75334 - DNA, 20 bp, Artificial Sequence
  Description of Artificial Sequence: Synthetic oligonucleotide
  Target: SCN10A; (+) strand; PAM type: YTN; PAM sequence: TTT
tcctaactttctctcttctc

SEQ ID NO: 75335 - DNA, 20 bp, Artificial Sequence
  Description of Artificial Sequence: Synthetic oligonucleotide
  Target: SCN10A; (+) strand; PAM type: YTN; PAM sequence: TTT
cctaactttctctcttctcc

SEQ ID NO: 75336 - DNA, 20 bp, Artificial Sequence
  Description of Artificial Sequence: Synthetic oligonucleotide
  Target: SCN10A; (+) strand; PAM type: YTN; PAM sequence: TTC
ctaactttctctcttctcct

SEQ ID NO: 75337 - DNA, 20 bp, Artificial Sequence
  Description of Artificial Sequence: Synthetic oligonucleotide
  Target: SCN10A; (+) strand; PAM type: YTN; PAM sequence: CTA
actttctctcttctccttct

SEQ ID NO: 75338 - DNA, 20 bp, Artificial Sequence
  Description of Artificial Sequence: Synthetic oligonucleotide
  Target: SCN10A; (+) strand; PAM type: YTN; PAM sequence: CTT
tctctcttctccttctcagt

SEQ ID NO: 75339 - DNA, 20 bp, Artificial Sequence
  Description of Artificial Sequence: Synthetic oligonucleotide
  Target: SCN10A; (+) strand; PAM type: YTN; PAM sequence: TTT
ctctcttctccttctcagtc

SEQ ID NO: 75340 - DNA, 20 bp, Artificial Sequence
  Description of Artificial Sequence: Synthetic oligonucleotide
  Target: SCN10A; (+) strand; PAM type: YTN; PAM sequence: TTC
tctcttctccttctcagtct

SEQ ID NO: 75341 - DNA, 20 bp, Artificial Sequence
  Description of Artificial Sequence: Synthetic oligonucleotide
  Target: SCN10A; (+) strand; PAM type: YTN; PAM sequence: CTC
tcttctccttctcagtctct

SEQ ID NO: 75342 - DNA, 20 bp, Artificial Sequence
  Description of Artificial Sequence: Synthetic oligonucleotide
  Target: SCN10A; (+) strand; PAM type: YTN; PAM sequence: CTC
ttctccttctcagtctctcc

SEQ ID NO: 75343 - DNA, 20 bp, Artificial Sequence
  Description of Artificial Sequence: Synthetic oligonucleotide
  Target: SCN10A; (+) strand; PAM type: YTN; PAM sequence: CTT
ctccttctcagtctctcctt

SEQ ID NO: 75344 - DNA, 20 bp, Artificial Sequence
  Description of Artificial Sequence: Synthetic oligonucleotide
  Target: SCN10A; (+) strand; PAM type: YTN; PAM sequence: TTC
tccttctcagtctctccttt

SEQ ID NO: 75345 - DNA, 20 bp, Artificial Sequence
  Description of Artificial Sequence: Synthetic oligonucleotide
  Target: SCN10A; (+) strand; PAM type: YTN; PAM sequence: CTC
cttctcagtctctcctttct

SEQ ID NO: 75346 - DNA, 20 bp, Artificial Sequence
  Description of Artificial Sequence: Synthetic oligonucleotide
  Target: SCN10A; (+) strand; PAM type: YTN; PAM sequence: CTT
ctcagtctctcctttctcag

SEQ ID NO: 75347 - DNA, 20 bp, Artificial Sequence
  Description of Artificial Sequence: Synthetic oligonucleotide
  Target: SCN10A; (+) strand; PAM type: YTN; PAM sequence: TTC
tcagtctctcctttctcagc

SEQ ID NO: 75348 - DNA, 20 bp, Artificial Sequence
  Description of Artificial Sequence: Synthetic oligonucleotide
  Target: SCN10A; (+) strand; PAM type: YTN; PAM sequence: CTC
agtctctcctttctcagctt

SEQ ID NO: 75349 - DNA, 20 bp, Artificial Sequence
  Description of Artificial Sequence: Synthetic oligonucleotide
  Target: SCN10A; (+) strand; PAM type: YTN; PAM sequence: CTC
tcctttctcagcttttccca

SEQ ID NO: 75350 - DNA, 20 bp, Artificial Sequence
  Description of Artificial Sequence: Synthetic oligonucleotide
  Target: SCN10A; (+) strand; PAM type: YTN; PAM sequence: CTC
ctttctcagcttttcccata

SEQ ID NO: 75351 - DNA, 20 bp, Artificial Sequence
  Description of Artificial Sequence: Synthetic oligonucleotide
  Target: SCN10A; (+) strand; PAM type: YTN; PAM sequence: CTT
tctcagcttttcccatacat

SEQ ID NO: 75352 - DNA, 20 bp, Artificial Sequence
  Description of Artificial Sequence: Synthetic oligonucleotide
  Target: SCN10A; (+) strand; PAM type: YTN; PAM sequence: TTT
ctcagcttttcccatacatg

SEQ ID NO: 75353 - DNA, 20 bp, Artificial Sequence
  Description of Artificial Sequence: Synthetic oligonucleotide
  Target: SCN10A; (+) strand; PAM type: YTN; PAM sequence: TTC
tcagcttttcccatacatga

SEQ ID NO: 75354 - DNA, 20 bp, Artificial Sequence
  Description of Artificial Sequence: Synthetic oligonucleotide
  Target: SCN10A; (+) strand; PAM type: YTN; PAM sequence: CTC
agcttttcccatacatgatt

SEQ ID NO: 75355 - DNA, 20 bp, Artificial Sequence
  Description of Artificial Sequence: Synthetic oligonucleotide
  Target: SCN10A; (+) strand; PAM type: YTN; PAM sequence: CTT
ttcccatacatgattgtgaa

SEQ ID NO: 75356 - DNA, 20 bp, Artificial Sequence
  Description of Artificial Sequence: Synthetic oligonucleotide
  Target: SCN10A; (+) strand; PAM type: YTN; PAM sequence: TTT
tcccatacatgattgtgaat

SEQ ID NO: 75357 - DNA, 20 bp, Artificial Sequence
  Description of Artificial Sequence: Synthetic oligonucleotide
  Target: SCN10A; (+) strand; PAM type: YTN; PAM sequence: TTT
cccatacatgattgtgaata

SEQ ID NO: 75358 - DNA, 20 bp, Artificial Sequence
  Description of Artificial Sequence: Synthetic oligonucleotide
  Target: SCN10A; (+) strand; PAM type: YTN; PAM sequence: TTC
ccatacatgattgtgaataa

SEQ ID NO: 75359 - DNA, 20 bp, Artificial Sequence
  Description of Artificial Sequence: Synthetic oligonucleotide
  Target: SCN10A; (+) strand; PAM type: YTN; PAM sequence: TTG
tgaataatggcactctatct

SEQ ID NO: 75360 - DNA, 20 bp, Artificial Sequence
  Description of Artificial Sequence: Synthetic oligonucleotide
  Target: SCN10A; (+) strand; PAM type: YTN; PAM sequence: CTC
tatcttttgttttcagaata

SEQ ID NO: 75361 - DNA, 20 bp, Artificial Sequence
  Description of Artificial Sequence: Synthetic oligonucleotide
  Target: SCN10A; (+) strand; PAM type: YTN; PAM sequence: CTA
tcttttgttttcagaataat

SEQ ID NO: 75362 - DNA, 20 bp, Artificial Sequence
  Description of Artificial Sequence: Synthetic oligonucleotide
  Target: SCN10A; (+) strand; PAM type: YTN; PAM sequence: CTT
ttgttttcagaataataaca

SEQ ID NO: 75363 - DNA, 20 bp, Artificial Sequence
  Description of Artificial Sequence: Synthetic oligonucleotide
  Target: SCN10A; (+) strand; PAM type: YTN; PAM sequence: TTT
tgttttcagaataataacaa

SEQ ID NO: 75364 - DNA, 20 bp, Artificial Sequence
  Description of Artificial Sequence: Synthetic oligonucleotide
  Target: SCN10A; (+) strand; PAM type: YTN; PAM sequence: TTT
gttttcagaataataacaat

SEQ ID NO: 75365 - DNA, 20 bp, Artificial Sequence
  Description of Artificial Sequence: Synthetic oligonucleotide
  Target: SCN10A; (+) strand; PAM type: YTN; PAM sequence: TTG
ttttcagaataataacaata

SEQ ID NO: 75366 - DNA, 20 bp, Artificial Sequence
  Description of Artificial Sequence: Synthetic oligonucleotide
  Target: SCN10A; (+) strand; PAM type: YTN; PAM sequence: TTT
tcagaataataacaatagta

SEQ ID NO: 75367 - DNA, 20 bp, Artificial Sequence
  Description of Artificial Sequence: Synthetic oligonucleotide
  Target: SCN10A; (+) strand; PAM type: YTN; PAM sequence: TTT
cagaataataacaatagtaa

SEQ ID NO: 75368 - DNA, 20 bp, Artificial Sequence
  Description of Artificial Sequence: Synthetic oligonucleotide
  Target: SCN10A; (+) strand; PAM type: YTN; PAM sequence: TTC
agaataataacaatagtaac

SEQ ID NO: 75369 - DNA, 20 bp, Artificial Sequence
  Description of Artificial Sequence: Synthetic oligonucleotide
  Target: SCN10A; (+) strand; PAM type: YTN; PAM sequence: CTT
caacagcgctagcatttact

SEQ ID NO: 75370 - DNA, 20 bp, Artificial Sequence
  Description of Artificial Sequence: Synthetic oligonucleotide
  Target: SCN10A; (+) strand; PAM type: YTN; PAM sequence: TTC
aacagcgctagcatttactg

SEQ ID NO: 75371 - DNA, 20 bp, Artificial Sequence
  Description of Artificial Sequence: Synthetic oligonucleotide
  Target: SCN10A; (+) strand; PAM type: YTN; PAM sequence: CTA
gcatttactgagattccact

SEQ ID NO: 75372 - DNA, 20 bp, Artificial Sequence
  Description of Artificial Sequence: Synthetic oligonucleotide
  Target: SCN10A; (+) strand; PAM type: YTN; PAM sequence: TTT
actgagattccactgtattt

SEQ ID NO: 75373 - DNA, 20 bp, Artificial Sequence
  Description of Artificial Sequence: Synthetic oligonucleotide
  Target: SCN10A; (+) strand; PAM type: YTN; PAM sequence: TTA
ctgagattccactgtatttc

SEQ ID NO: 75374 - DNA, 20 bp, Artificial Sequence
  Description of Artificial Sequence: Synthetic oligonucleotide
  Target: SCN10A; (+) strand; PAM type: YTN; PAM sequence: CTG
agattccactgtatttcaga

SEQ ID NO: 75375 - DNA, 20 bp, Artificial Sequence
  Description of Artificial Sequence: Synthetic oligonucleotide
  Target: SCN10A; (+) strand; PAM type: YTN; PAM sequence: TTC
cactgtatttcagactctgg

SEQ ID NO: 75376 - DNA, 20 bp, Artificial Sequence
  Description of Artificial Sequence: Synthetic oligonucleotide
  Target: SCN10A; (+) strand; PAM type: YTN; PAM sequence: CTG
tatttcagactctggattaa

SEQ ID NO: 75377 - DNA, 20 bp, Artificial Sequence
  Description of Artificial Sequence: Synthetic oligonucleotide
  Target: SCN10A; (+) strand; PAM type: YTN; PAM sequence: TTT
cagactctggattaagcaat

SEQ ID NO: 75378 - DNA, 20 bp, Artificial Sequence
  Description of Artificial Sequence: Synthetic oligonucleotide
  Target: SCN10A; (+) strand; PAM type: YTN; PAM sequence: TTC
agactctggattaagcaatt

SEQ ID NO: 75379 - DNA, 20 bp, Artificial Sequence
  Description of Artificial Sequence: Synthetic oligonucleotide
  Target: SCN10A; (+) strand; PAM type: YTN; PAM sequence: CTC
tggattaagcaattttcatg

SEQ ID NO: 75380 - DNA, 20 bp, Artificial Sequence
  Description of Artificial Sequence: Synthetic oligonucleotide
  Target: SCN10A; (+) strand; PAM type: YTN; PAM sequence: CTG
gattaagcaattttcatgca

SEQ ID NO: 75381 - DNA, 20 bp, Artificial Sequence
  Description of Artificial Sequence: Synthetic oligonucleotide
  Target: SCN10A; (+) strand; PAM type: YTN; PAM sequence: TTA
agcaattttcatgcattatt

SEQ ID NO: 75382 - DNA, 20 bp, Artificial Sequence
  Description of Artificial Sequence: Synthetic oligonucleotide
  Target: SCN10A; (+) strand; PAM type: YTN; PAM sequence: TTT
tcatgcattattacattaac

SEQ ID NO: 75383 - DNA, 20 bp, Artificial Sequence
  Description of Artificial Sequence: Synthetic oligonucleotide
  Target: SCN10A; (+) strand; PAM type: YTN; PAM sequence: TTT
catgcattattacattaact

SEQ ID NO: 75384 - DNA, 20 bp, Artificial Sequence
  Description of Artificial Sequence: Synthetic oligonucleotide
  Target: SCN10A; (+) strand; PAM type: YTN; PAM sequence: TTC
atgcattattacattaacta

SEQ ID NO: 75385 - DNA, 20 bp, Artificial Sequence
  Description of Artificial Sequence: Synthetic oligonucleotide
  Target: SCN10A; (+) strand; PAM type: YTN; PAM sequence: TTA
ttacattaactatcactgta

SEQ ID NO: 75386 - DNA, 20 bp, Artificial Sequence
  Description of Artificial Sequence: Synthetic oligonucleotide
  Target: SCN10A; (+) strand; PAM type: YTN; PAM sequence: TTA
cattaactatcactgtacct

SEQ ID NO: 75387 - DNA, 20 bp, Artificial Sequence
  Description of Artificial Sequence: Synthetic oligonucleotide
  Target: SCN10A; (+) strand; PAM type: YTN; PAM sequence: TTA
actatcactgtacctgtgaa

SEQ ID NO: 75388 - DNA, 20 bp, Artificial Sequence
  Description of Artificial Sequence: Synthetic oligonucleotide
  Target: SCN10A; (+) strand; PAM type: YTN; PAM sequence: CTA
tcactgtacctgtgaagtat

SEQ ID NO: 75389 - DNA, 20 bp, Artificial Sequence
  Description of Artificial Sequence: Synthetic oligonucleotide
  Target: SCN10A; (+) strand; PAM type: YTN; PAM sequence: CTG
tacctgtgaagtattatctc

SEQ ID NO: 75390 - DNA, 20 bp, Artificial Sequence
  Description of Artificial Sequence: Synthetic oligonucleotide
  Target: SCN10A; (+) strand; PAM type: YTN; PAM sequence: CTG
tgaagtattatctctaatat

SEQ ID NO: 75391 - DNA, 20 bp, Artificial Sequence
  Description of Artificial Sequence: Synthetic oligonucleotide
  Target: SCN10A; (+) strand; PAM type: YTN; PAM sequence: TTA
tctctaatatataaataaga

SEQ ID NO: 75392 - DNA, 20 bp, Artificial Sequence
  Description of Artificial Sequence: Synthetic oligonucleotide
  Target: SCN10A; (+) strand; PAM type: YTN; PAM sequence: CTC
taatatataaataagatacc

SEQ ID NO: 75393 - DNA, 20 bp, Artificial Sequence
  Description of Artificial Sequence: Synthetic oligonucleotide
  Target: SCN10A; (+) strand; PAM type: YTN; PAM sequence: CTA
atatataaataagataccag

SEQ ID NO: 75394 - DNA, 20 bp, Artificial Sequence
  Description of Artificial Sequence: Synthetic oligonucleotide
  Target: SCN10A; (+) strand; PAM type: YTN; PAM sequence: TTA
aaatttccaagatcacatta

SEQ ID NO: 75395 - DNA, 20 bp, Artificial Sequence
  Description of Artificial Sequence: Synthetic oligonucleotide
  Target: SCN10A; (+) strand; PAM type: YTN; PAM sequence: TTT
ccaagatcacattactaatg

SEQ ID NO: 75396 - DNA, 20 bp, Artificial Sequence
  Description of Artificial Sequence: Synthetic oligonucleotide
  Target: SCN10A; (+) strand; PAM type: YTN; PAM sequence: TTC
caagatcacattactaatga

SEQ ID NO: 75397 - DNA, 20 bp, Artificial Sequence
  Description of Artificial Sequence: Synthetic oligonucleotide
  Target: SCN10A; (+) strand; PAM type: YTN; PAM sequence: TTA
ctaatgagtggcagaacggt

SEQ ID NO: 75398 - DNA, 20 bp, Artificial Sequence
  Description of Artificial Sequence: Synthetic oligonucleotide
  Target: SCN10A; (+) strand; PAM type: YTN; PAM sequence: CTA
atgagtggcagaacggtact

SEQ ID NO: 75399 - DNA, 20 bp, Artificial Sequence
  Description of Artificial Sequence: Synthetic oligonucleotide
  Target: SCN10A; (+) strand; PAM type: YTN; PAM sequence: CTT
aaactcaggtatgtttgcca

SEQ ID NO: 75400 - DNA, 20 bp, Artificial Sequence
  Description of Artificial Sequence: Synthetic oligonucleotide
  Target: SCN10A; (+) strand; PAM type: YTN; PAM sequence: TTA
aactcaggtatgtttgccac

SEQ ID NO: 75401 - DNA, 20 bp, Artificial Sequence
  Description of Artificial Sequence: Synthetic oligonucleotide
  Target: SCN10A; (+) strand; PAM type: YTN; PAM sequence: CTC
aggtatgtttgccacaatct

SEQ ID NO: 75402 - DNA, 20 bp, Artificial Sequence
  Description of Artificial Sequence: Synthetic oligonucleotide
  Target: SCN10A; (+) strand; PAM type: YTN; PAM sequence: TTT
gccacaatctcttggaaaca

SEQ ID NO: 75403 - DNA, 20 bp, Artificial Sequence
  Description of Artificial Sequence: Synthetic oligonucleotide
  Target: SCN10A; (+) strand; PAM type: YTN; PAM sequence: TTG
ccacaatctcttggaaacat

SEQ ID NO: 75404 - DNA, 20 bp, Artificial Sequence
  Description of Artificial Sequence: Synthetic oligonucleotide
  Target: SCN10A; (+) strand; PAM type: YTN; PAM sequence: CTC
ttggaaacatctcatcattc

SEQ ID NO: 75405 - DNA, 20 bp, Artificial Sequence
  Description of Artificial Sequence: Synthetic oligonucleotide
  Target: SCN10A; (+) strand; PAM type: YTN; PAM sequence: CTT
ggaaacatctcatcattccc

SEQ ID NO: 75406 - DNA, 20 bp, Artificial Sequence
  Description of Artificial Sequence: Synthetic oligonucleotide
  Target: SCN10A; (+) strand; PAM type: YTN; PAM sequence: TTG
gaaacatctcatcattccca

SEQ ID NO: 75407 - DNA, 20 bp, Artificial Sequence
  Description of Artificial Sequence: Synthetic oligonucleotide
  Target: SCN10A; (+) strand; PAM type: YTN; PAM sequence: CTC
atcattcccatatcttcact

SEQ ID NO: 75408 - DNA, 20 bp, Artificial Sequence
  Description of Artificial Sequence: Synthetic oligonucleotide
  Target: SCN10A; (+) strand; PAM type: YTN; PAM sequence: TTC
ccatatcttcacttctcatt

SEQ ID NO: 75409 - DNA, 20 bp, Artificial Sequence
  Description of Artificial Sequence: Synthetic oligonucleotide
  Target: SCN10A; (+) strand; PAM type: YTN; PAM sequence: CTT
cacttctcatttatatgcag

SEQ ID NO: 75410 - DNA, 20 bp, Artificial Sequence
  Description of Artificial Sequence: Synthetic oligonucleotide
  Target: SCN10A; (+) strand; PAM type: YTN; PAM sequence: TTC
acttctcatttatatgcaga

SEQ ID NO: 75411 - DNA, 20 bp, Artificial Sequence
  Description of Artificial Sequence: Synthetic oligonucleotide
  Target: SCN10A; (+) strand; PAM type: YTN; PAM sequence: CTT
ctcatttatatgcagatgac

SEQ ID NO: 75412 - DNA, 20 bp, Artificial Sequence
  Description of Artificial Sequence: Synthetic oligonucleotide
  Target: SCN10A; (+) strand; PAM type: YTN; PAM sequence: TTC
tcatttatatgcagatgact

SEQ ID NO: 75413 - DNA, 20 bp, Artificial Sequence
  Description of Artificial Sequence: Synthetic oligonucleotide
  Target: SCN10A; (+) strand; PAM type: YTN; PAM sequence: CTC
atttatatgcagatgactga

SEQ ID NO: 75414 - DNA, 20 bp, Artificial Sequence
  Description of Artificial Sequence: Synthetic oligonucleotide
  Target: SCN10A; (+) strand; PAM type: YTN; PAM sequence: TTT
atatgcagatgactgagtct

SEQ ID NO: 75415 - DNA, 20 bp, Artificial Sequence
  Description of Artificial Sequence: Synthetic oligonucleotide
  Target: SCN10A; (+) strand; PAM type: YTN; PAM sequence: TTA
tatgcagatgactgagtctt

SEQ ID NO: 75416 - DNA, 20 bp, Artificial Sequence
  Description of Artificial Sequence: Synthetic oligonucleotide
  Target: SCN10A; (+) strand; PAM type: YTN; PAM sequence: CTG
agtctttatctgtagctctc

SEQ ID NO: 75417 - DNA, 20 bp, Artificial Sequence
  Description of Artificial Sequence: Synthetic oligonucleotide
  Target: SCN10A; (+) strand; PAM type: YTN; PAM sequence: CTT
tatctgtagctctcagaagt

SEQ ID NO: 75418 - DNA, 20 bp, Artificial Sequence
  Description of Artificial Sequence: Synthetic oligonucleotide
  Target: SCN10A; (+) strand; PAM type: YTN; PAM sequence: TTT
atctgtagctctcagaagtc

SEQ ID NO: 75419 - DNA, 20 bp, Artificial Sequence
  Description of Artificial Sequence: Synthetic oligonucleotide
  Target: SCN10A; (+) strand; PAM type: YTN; PAM sequence: TTA
tctgtagctctcagaagtcc

SEQ ID NO: 75420 - DNA, 20 bp, Artificial Sequence
  Description of Artificial Sequence: Synthetic oligonucleotide
  Target: SCN10A; (+) strand; PAM type: YTN; PAM sequence: CTG
tagctctcagaagtccatgg

SEQ ID NO: 75421 - DNA, 20 bp, Artificial Sequence
  Description of Artificial Sequence: Synthetic oligonucleotide
  Target: SCN10A; (+) strand; PAM type: YTN; PAM sequence: CTC
tcagaagtccatggggctca

SEQ ID NO: 75422 - DNA, 20 bp, Artificial Sequence
  Description of Artificial Sequence: Synthetic oligonucleotide
  Target: SCN10A; (+) strand; PAM type: YTN; PAM sequence: CTC
agaagtccatggggctcaga

SEQ ID NO: 75423 - DNA, 20 bp, Artificial Sequence
  Description of Artificial Sequence: Synthetic oligonucleotide
  Target: SCN10A; (+) strand; PAM type: YTN; PAM sequence: CTC
agatcttcatttgatctctc

SEQ ID NO: 75424 - DNA, 20 bp, Artificial Sequence
  Description of Artificial Sequence: Synthetic oligonucleotide
  Target: SCN10A; (+) strand; PAM type: YTN; PAM sequence: CTT
catttgatctctccacttca

SEQ ID NO: 75425 - DNA, 20 bp, Artificial Sequence
  Description of Artificial Sequence: Synthetic oligonucleotide
  Target: SCN10A; (+) strand; PAM type: YTN; PAM sequence: TTC
atttgatctctccacttcag

SEQ ID NO: 75426 - DNA, 20 bp, Artificial Sequence
  Description of Artificial Sequence: Synthetic oligonucleotide
  Target: SCN10A; (+) strand; PAM type: YTN; PAM sequence: TTT
gatctctccacttcagtgtc

SEQ ID NO: 75427 - DNA, 20 bp, Artificial Sequence
  Description of Artificial Sequence: Synthetic oligonucleotide
  Target: SCN10A; (+) strand; PAM type: YTN; PAM sequence: TTG
atctctccacttcagtgtct

SEQ ID NO: 75428 - DNA, 20 bp, Artificial Sequence
  Description of Artificial Sequence: Synthetic oligonucleotide
  Target: SCN10A; (+) strand; PAM type: YTN; PAM sequence: CTC
tccacttcagtgtctcatga

SEQ ID NO: 75429 - DNA, 20 bp, Artificial Sequence
  Description of Artificial Sequence: Synthetic oligonucleotide
  Target: SCN10A; (+) strand; PAM type: YTN; PAM sequence: CTC
cacttcagtgtctcatgagc

SEQ ID NO: 75430 - DNA, 20 bp, Artificial Sequence
  Description of Artificial Sequence: Synthetic oligonucleotide
  Target: SCN10A; (+) strand; PAM type: YTN; PAM sequence: CTT
cagtgtctcatgagcacctc

SEQ ID NO: 75431 - DNA, 20 bp, Artificial Sequence
  Description of Artificial Sequence: Synthetic oligonucleotide
  Target: SCN10A; (+) strand; PAM type: YTN; PAM sequence: TTC
agtgtctcatgagcacctca

SEQ ID NO: 75432 - DNA, 20 bp, Artificial Sequence
  Description of Artificial Sequence: Synthetic oligonucleotide
  Target: SCN10A; (+) strand; PAM type: YTN; PAM sequence: CTC
atgagcacctcaagctcagc

SEQ ID NO: 75433 - DNA, 20 bp, Artificial Sequence
  Description of Artificial Sequence: Synthetic oligonucleotide
  Target: SCN10A; (+) strand; PAM type: YTN; PAM sequence: CTC
aagctcagcatgccccaaac

SEQ ID NO: 75434 - DNA, 20 bp, Artificial Sequence
  Description of Artificial Sequence: Synthetic oligonucleotide
  Target: SCN10A; (+) strand; PAM type: YTN; PAM sequence: CTC
agcatgccccaaactaaact

SEQ ID NO: 75435 - DNA, 20 bp, Artificial Sequence
  Description of Artificial Sequence: Synthetic oligonucleotide
  Target: SCN10A; (+) strand; PAM type: YTN; PAM sequence: CTA
aactcataattatctcctca

SEQ ID NO: 75436 - DNA, 20 bp, Artificial Sequence
  Description of Artificial Sequence: Synthetic oligonucleotide
  Target: SCN10A; (+) strand; PAM type: YTN; PAM sequence: CTC
ataattatctcctcacttct

SEQ ID NO: 75437 - DNA, 20 bp, Artificial Sequence
  Description of Artificial Sequence: Synthetic oligonucleotide
  Target: SCN10A; (+) strand; PAM type: YTN; PAM sequence: TTA
tctcctcacttctttctaat

SEQ ID NO: 75438 - DNA, 20 bp, Artificial Sequence
  Description of Artificial Sequence: Synthetic oligonucleotide
  Target: SCN10A; (+) strand; PAM type: YTN; PAM sequence: CTC
ctcacttctttctaatacct

SEQ ID NO: 75439 - DNA, 20 bp, Artificial Sequence
  Description of Artificial Sequence: Synthetic oligonucleotide
  Target: SCN10A; (+) strand; PAM type: YTN; PAM sequence: CTC
acttctttctaatacctgcc

SEQ ID NO: 75440 - DNA, 20 bp, Artificial Sequence
  Description of Artificial Sequence: Synthetic oligonucleotide
  Target: SCN10A; (+) strand; PAM type: YTN; PAM sequence: CTT
ctttctaatacctgcctctc

SEQ ID NO: 75441 - DNA, 20 bp, Artificial Sequence
  Description of Artificial Sequence: Synthetic oligonucleotide
  Target: SCN10A; (+) strand; PAM type: YTN; PAM sequence: TTC
tttctaatacctgcctctct

SEQ ID NO: 75442 - DNA, 20 bp, Artificial Sequence
  Description of Artificial Sequence: Synthetic oligonucleotide
  Target: SCN10A; (+) strand; PAM type: YTN; PAM sequence: CTT
tctaatacctgcctctcttc

SEQ ID NO: 75443 - DNA, 20 bp, Artificial Sequence
  Description of Artificial Sequence: Synthetic oligonucleotide
  Target: SCN10A; (+) strand; PAM type: YTN; PAM sequence: TTT
ctaatacctgcctctcttct

SEQ ID NO: 75444 - DNA, 20 bp, Artificial Sequence
  Description of Artificial Sequence: Synthetic oligonucleotide
  Target: SCN10A; (+) strand; PAM type: YTN; PAM sequence: TTC
taatacctgcctctcttcta

SEQ ID NO: 75445 - DNA, 20 bp, Artificial Sequence
  Description of Artificial Sequence: Synthetic oligonucleotide
  Target: SCN10A; (+) strand; PAM type: YTN; PAM sequence: CTA
atacctgcctctcttctatg

SEQ ID NO: 75446 - DNA, 20 bp, Artificial Sequence
  Description of Artificial Sequence: Synthetic oligonucleotide
  Target: SCN10A; (+) strand; PAM type: YTN; PAM sequence: CTG
cctctcttctatgtcttttt

SEQ ID NO: 75447 - DNA, 20 bp, Artificial Sequence
  Description of Artificial Sequence: Synthetic oligonucleotide
  Target: SCN10A; (+) strand; PAM type: YTN; PAM sequence: CTC
tcttctatgtctttttactg

SEQ ID NO: 75448 - DNA, 20 bp, Artificial Sequence
  Description of Artificial Sequence: Synthetic oligonucleotide
  Target: SCN10A; (+) strand; PAM type: YTN; PAM sequence: CTC
ttctatgtctttttactgcc

SEQ ID NO: 75449 - DNA, 20 bp, Artificial Sequence
  Description of Artificial Sequence: Synthetic oligonucleotide
  Target: SCN10A; (+) strand; PAM type: YTN; PAM sequence: CTT
ctatgtctttttactgccat

SEQ ID NO: 75450 - DNA, 20 bp, Artificial Sequence
  Description of Artificial Sequence: Synthetic oligonucleotide
  Target: SCN10A; (+) strand; PAM type: YTN; PAM sequence: TTC
tatgtctttttactgccatt

SEQ ID NO: 75451 - DNA, 20 bp, Artificial Sequence
  Description of Artificial Sequence: Synthetic oligonucleotide
  Target: SCN10A; (+) strand; PAM type: YTN; PAM sequence: CTA
tgtctttttactgccattag

SEQ ID NO: 75452 - DNA, 20 bp, Artificial Sequence
  Description of Artificial Sequence: Synthetic oligonucleotide
  Target: SCN10A; (+) strand; PAM type: YTN; PAM sequence: CTT
tttactgccattagccccaa

SEQ ID NO: 75453 - DNA, 20 bp, Artificial Sequence
  Description of Artificial Sequence: Synthetic oligonucleotide
  Target: SCN10A; (+) strand; PAM type: YTN; PAM sequence: TTT
ttactgccattagccccaaa

SEQ ID NO: 75454 - DNA, 20 bp, Artificial Sequence
  Description of Artificial Sequence: Synthetic oligonucleotide
  Target: SCN10A; (+) strand; PAM type: YTN; PAM sequence: TTT
tactgccattagccccaaat

SEQ ID NO: 75455 - DNA, 20 bp, Artificial Sequence
  Description of Artificial Sequence: Synthetic oligonucleotide
  Target: SCN10A; (+) strand; PAM type: YTN; PAM sequence: TTT
actgccattagccccaaata

SEQ ID NO: 75456 - DNA, 20 bp, Artificial Sequence
  Description of Artificial Sequence: Synthetic oligonucleotide
  Target: SCN10A; (+) strand; PAM type: YTN; PAM sequence: TTA
ctgccattagccccaaatag

SEQ ID NO: 75457 - DNA, 20 bp, Artificial Sequence
  Description of Artificial Sequence: Synthetic oligonucleotide
  Target: SCN10A; (+) strand; PAM type: YTN; PAM sequence: CTG
ccattagccccaaatagcct

SEQ ID NO: 75458 - DNA, 20 bp, Artificial Sequence
  Description of Artificial Sequence: Synthetic oligonucleotide
  Target: SCN10A; (+) strand; PAM type: YTN; PAM sequence: TTA
gccccaaatagcctgtttct

SEQ ID NO: 75459 - DNA, 20 bp, Artificial Sequence
  Description of Artificial Sequence: Synthetic oligonucleotide
  Target: SCN10A; (+) strand; PAM type: YTN; PAM sequence: CTG
tttctgtgtctgtccacaac

SEQ ID NO: 75460 - DNA, 20 bp, Artificial Sequence
  Description of Artificial Sequence: Synthetic oligonucleotide
  Target: SCN10A; (+) strand; PAM type: YTN; PAM sequence: TTT
ctgtgtctgtccacaacctg

SEQ ID NO: 75461 - DNA, 20 bp, Artificial Sequence
  Description of Artificial Sequence: Synthetic oligonucleotide
  Target: SCN10A; (+) strand; PAM type: YTN; PAM sequence: TTC
tgtgtctgtccacaacctgg

SEQ ID NO: 75462 - DNA, 20 bp, Artificial Sequence
  Description of Artificial Sequence: Synthetic oligonucleotide
  Target: SCN10A; (+) strand; PAM type: YTN; PAM sequence: CTG
tgtctgtccacaacctgggt

SEQ ID NO: 75463 - DNA, 20 bp, Artificial Sequence
  Description of Artificial Sequence: Synthetic oligonucleotide
  Target: SCN10A; (+) strand; PAM type: YTN; PAM sequence: CTG
tccacaacctgggtaccata

SEQ ID NO: 75464 - DNA, 20 bp, Artificial Sequence
  Description of Artificial Sequence: Synthetic oligonucleotide
  Target: SCN10A; (+) strand; PAM type: YTN; PAM sequence: CTG
ggtaccataattatgctctt

SEQ ID NO: 75465 - DNA, 20 bp, Artificial Sequence
  Description of Artificial Sequence: Synthetic oligonucleotide
  Target: SCN10A; (+) strand; PAM type: YTN; PAM sequence: TTA
tgctctttctatttcattcc

SEQ ID NO: 75466 - DNA, 20 bp, Artificial Sequence
  Description of Artificial Sequence: Synthetic oligonucleotide
  Target: SCN10A; (+) strand; PAM type: YTN; PAM sequence: CTC
tttctatttcattccacata

SEQ ID NO: 75467 - DNA, 20 bp, Artificial Sequence
  Description of Artificial Sequence: Synthetic oligonucleotide
  Target: SCN10A; (+) strand; PAM type: YTN; PAM sequence: CTT
tctatttcattccacataca

SEQ ID NO: 75468 - DNA, 20 bp, Artificial Sequence
  Description of Artificial Sequence: Synthetic oligonucleotide
  Target: SCN10A; (+) strand; PAM type: YTN; PAM sequence: TTT
ctatttcattccacatacaa

SEQ ID NO: 75469 - DNA, 20 bp, Artificial Sequence
  Description of Artificial Sequence: Synthetic oligonucleotide
  Target: SCN10A; (+) strand; PAM type: YTN; PAM sequence: TTC
tatttcattccacatacaat

SEQ ID NO: 75470 - DNA, 20 bp, Artificial Sequence
  Description of Artificial Sequence: Synthetic oligonucleotide
  Target: SCN10A; (+) strand; PAM type: YTN; PAM sequence: CTA
tttcattccacatacaatca

SEQ ID NO: 75471 - DNA, 20 bp, Artificial Sequence
  Description of Artificial Sequence: Synthetic oligonucleotide
  Target: SCN10A; (+) strand; PAM type: YTN; PAM sequence: TTT
cattccacatacaatcaaac

SEQ ID NO: 75472 - DNA, 20 bp, Artificial Sequence
  Description of Artificial Sequence: Synthetic oligonucleotide
  Target: SCN10A; (+) strand; PAM type: YTN; PAM sequence: TTC
attccacatacaatcaaaca

SEQ ID NO: 75473 - DNA, 20 bp, Artificial Sequence
  Description of Artificial Sequence: Synthetic oligonucleotide
  Target: SCN10A; (+) strand; PAM type: YTN; PAM sequence: TTC
cacatacaatcaaacatcta

SEQ ID NO: 75474 - DNA, 20 bp, Artificial Sequence
  Description of Artificial Sequence: Synthetic oligonucleotide
  Target: SCN10A; (+) strand; PAM type: YTN; PAM sequence: CTA
gtgctgttgcttctgcctcc

SEQ ID NO: 75475 - DNA, 20 bp, Artificial Sequence
  Description of Artificial Sequence: Synthetic oligonucleotide
  Target: SCN10A; (+) strand; PAM type: YTN; PAM sequence: CTG
ttgcttctgcctccttaata

SEQ ID NO: 75476 - DNA, 20 bp, Artificial Sequence
  Description of Artificial Sequence: Synthetic oligonucleotide
  Target: SCN10A; (+) strand; PAM type: YTN; PAM sequence: TTG
cttctgcctccttaatatct

SEQ ID NO: 75477 - DNA, 20 bp, Artificial Sequence
  Description of Artificial Sequence: Synthetic oligonucleotide
  Target: SCN10A; (+) strand; PAM type: YTN; PAM sequence: CTT
ctgcctccttaatatcttct

SEQ ID NO: 75478 - DNA, 20 bp, Artificial Sequence
  Description of Artificial Sequence: Synthetic oligonucleotide
  Target: SCN10A; (+) strand; PAM type: YTN; PAM sequence: TTC
tgcctccttaatatcttctc

SEQ ID NO: 75479 - DNA, 20 bp, Artificial Sequence
  Description of Artificial Sequence: Synthetic oligonucleotide
  Target: SCN10A; (+) strand; PAM type: YTN; PAM sequence: CTG
cctccttaatatcttctctt

SEQ ID NO: 75480 - DNA, 20 bp, Artificial Sequence
  Description of Artificial Sequence: Synthetic oligonucleotide
  Target: SCN10A; (+) strand; PAM type: YTN; PAM sequence: CTC
cttaatatcttctcttcata

SEQ ID NO: 75481 - DNA, 20 bp, Artificial Sequence
  Description of Artificial Sequence: Synthetic oligonucleotide
  Target: SCN10A; (+) strand; PAM type: YTN; PAM sequence: CTT
aatatcttctcttcatatct

SEQ ID NO: 75482 - DNA, 20 bp, Artificial Sequence
  Description of Artificial Sequence: Synthetic oligonucleotide
  Target: SCN10A; (+) strand; PAM type: YTN; PAM sequence: TTA
atatcttctcttcatatctc

SEQ ID NO: 75483 - DNA, 20 bp, Artificial Sequence
  Description of Artificial Sequence: Synthetic oligonucleotide
  Target: SCN10A; (+) strand; PAM type: YTN; PAM sequence: CTT
ctcttcatatctctctaacc

SEQ ID NO: 75484 - DNA, 20 bp, Artificial Sequence
  Description of Artificial Sequence: Synthetic oligonucleotide
  Target: SCN10A; (+) strand; PAM type: YTN; PAM sequence: TTC
tcttcatatctctctaacct

SEQ ID NO: 75485 - DNA, 20 bp, Artificial Sequence
  Description of Artificial Sequence: Synthetic oligonucleotide
  Target: SCN10A; (+) strand; PAM type: YTN; PAM sequence: CTC
ttcatatctctctaacctct

SEQ ID NO: 75486 - DNA, 20 bp, Artificial Sequence
  Description of Artificial Sequence: Synthetic oligonucleotide
  Target: SCN10A; (+) strand; PAM type: YTN; PAM sequence: CTT
catatctctctaacctctcc

SEQ ID NO: 75487 - DNA, 20 bp, Artificial Sequence
  Description of Artificial Sequence: Synthetic oligonucleotide
  Target: SCN10A; (+) strand; PAM type: YTN; PAM sequence: TTC
atatctctctaacctctcca

SEQ ID NO: 75488 - DNA, 20 bp, Artificial Sequence
  Description of Artificial Sequence: Synthetic oligonucleotide
  Target: SCN10A; (+) strand; PAM type: YTN; PAM sequence: CTC
tctaacctctccatcatact

SEQ ID NO: 75489 - DNA, 20 bp, Artificial Sequence
  Description of Artificial Sequence: Synthetic oligonucleotide
  Target: SCN10A; (+) strand; PAM type: YTN; PAM sequence: CTC
taacctctccatcatactgc

SEQ ID NO: 75490 - DNA, 20 bp, Artificial Sequence
  Description of Artificial Sequence: Synthetic oligonucleotide
  Target: SCN10A; (+) strand; PAM type: YTN; PAM sequence: CTA
acctctccatcatactgctg

SEQ ID NO: 75491 - DNA, 20 bp, Artificial Sequence
  Description of Artificial Sequence: Synthetic oligonucleotide
  Target: SCN10A; (+) strand; PAM type: YTN; PAM sequence: CTC
tccatcatactgctggtcca

SEQ ID NO: 75492 - DNA, 20 bp, Artificial Sequence
  Description of Artificial Sequence: Synthetic oligonucleotide
  Target: SCN10A; (+) strand; PAM type: YTN; PAM sequence: CTC
catcatactgctggtccaat

SEQ ID NO: 75493 - DNA, 20 bp, Artificial Sequence
  Description of Artificial Sequence: Synthetic oligonucleotide
  Target: SCN10A; (+) strand; PAM type: YTN; PAM sequence: CTG
ctggtccaatcactgtcatc

SEQ ID NO: 75494 - DNA, 20 bp, Artificial Sequence
  Description of Artificial Sequence: Synthetic oligonucleotide
  Target: SCN10A; (+) strand; PAM type: YTN; PAM sequence: CTG
gtccaatcactgtcatctca

SEQ ID NO: 75495 - DNA, 20 bp, Artificial Sequence
  Description of Artificial Sequence: Synthetic oligonucleotide
  Target: SCN10A; (+) strand; PAM type: YTN; PAM sequence: CTG
tcatctcactggcctcgtat

SEQ ID NO: 75496 - DNA, 20 bp, Artificial Sequence
  Description of Artificial Sequence: Synthetic oligonucleotide
  Target: SCN10A; (+) strand; PAM type: YTN; PAM sequence: CTC
actggcctcgtatgtgtcat

SEQ ID NO: 75497 - DNA, 20 bp, Artificial Sequence
  Description of Artificial Sequence: Synthetic oligonucleotide
  Target: SCN10A; (+) strand; PAM type: YTN; PAM sequence: CTG
gcctcgtatgtgtcattttg

SEQ ID NO: 75498 - DNA, 20 bp, Artificial Sequence
  Description of Artificial Sequence: Synthetic oligonucleotide
  Target: SCN10A; (+) strand; PAM type: YTN; PAM sequence: CTC
gtatgtgtcattttgattcc

SEQ ID NO: 75499 - DNA, 20 bp, Artificial Sequence
  Description of Artificial Sequence: Synthetic oligonucleotide
  Target: SCN10A; (+) strand; PAM type: YTN; PAM sequence: TTT
tgattcccctttagtccttt

SEQ ID NO: 75500 - DNA, 20 bp, Artificial Sequence
  Description of Artificial Sequence: Synthetic oligonucleotide
  Target: SCN10A; (+) strand; PAM type: YTN; PAM sequence: TTT
gattcccctttagtcctttc

SEQ ID NO: 75501 - DNA, 20 bp, Artificial Sequence
  Description of Artificial Sequence: Synthetic oligonucleotide
  Target: SCN10A; (+) strand; PAM type: YTN; PAM sequence: TTG
attcccctttagtcctttct

SEQ ID NO: 75502 - DNA, 20 bp, Artificial Sequence
  Description of Artificial Sequence: Synthetic oligonucleotide
  Target: SCN10A; (+) strand; PAM type: YTN; PAM sequence: TTC
ccctttagtcctttctaacc

SEQ ID NO: 75503 - DNA, 20 bp, Artificial Sequence
  Description of Artificial Sequence: Synthetic oligonucleotide
  Target: SCN10A; (+) strand; PAM type: YTN; PAM sequence: CTT
tagtcctttctaacctattc

SEQ ID NO: 75504 - DNA, 20 bp, Artificial Sequence
  Description of Artificial Sequence: Synthetic oligonucleotide
  Target: SCN10A; (+) strand; PAM type: YTN; PAM sequence: TTT
agtcctttctaacctattct

SEQ ID NO: 75505 - DNA, 20 bp, Artificial Sequence
  Description of Artificial Sequence: Synthetic oligonucleotide
  Target: SCN10A; (+) strand; PAM type: YTN; PAM sequence: TTA
gtcctttctaacctattctc

SEQ ID NO: 75506 - DNA, 20 bp, Artificial Sequence
  Description of Artificial Sequence: Synthetic oligonucleotide
  Target: SCN10A; (+) strand; PAM type: YTN; PAM sequence: CTT
tctaacctattctccaacag

SEQ ID NO: 75507 - DNA, 20 bp, Artificial Sequence
  Description of Artificial Sequence: Synthetic oligonucleotide
  Target: SCN10A; (+) strand; PAM type: YTN; PAM sequence: TTT
ctaacctattctccaacagt

SEQ ID NO: 75508 - DNA, 20 bp, Artificial Sequence
  Description of Artificial Sequence: Synthetic oligonucleotide
  Target: SCN10A; (+) strand; PAM type: YTN; PAM sequence: TTC
taacctattctccaacagtg

SEQ ID NO: 75509 - DNA, 20 bp, Artificial Sequence
  Description of Artificial Sequence: Synthetic oligonucleotide
  Target: SCN10A; (+) strand; PAM type: YTN; PAM sequence: CTA
acctattctccaacagtggc

SEQ ID NO: 75510 - DNA, 20 bp, Artificial Sequence
  Description of Artificial Sequence: Synthetic oligonucleotide
  Target: SCN10A; (+) strand; PAM type: YTN; PAM sequence: CTA
ttctccaacagtggccaaat

SEQ ID NO: 75511 - DNA, 20 bp, Artificial Sequence
  Description of Artificial Sequence: Synthetic oligonucleotide
  Target: SCN10A; (+) strand; PAM type: YTN; PAM sequence: TTC
tccaacagtggccaaatgat

SEQ ID NO: 75512 - DNA, 20 bp, Artificial Sequence
  Description of Artificial Sequence: Synthetic oligonucleotide
  Target: SCN10A; (+) strand; PAM type: YTN; PAM sequence: CTC
caacagtggccaaatgatat

SEQ ID NO: 75513 - DNA, 20 bp, Artificial Sequence
  Description of Artificial Sequence: Synthetic oligonucleotide
  Target: SCN10A; (+) strand; PAM type: YTN; PAM sequence: TTT
ctaaaatgaaaatctggtta

SEQ ID NO: 75514 - DNA, 20 bp, Artificial Sequence
  Description of Artificial Sequence: Synthetic oligonucleotide
  Target: SCN10A; (+) strand; PAM type: YTN; PAM sequence: TTC
taaaatgaaaatctggttat

SEQ ID NO: 75515 - DNA, 20 bp, Artificial Sequence
  Description of Artificial Sequence: Synthetic oligonucleotide
  Target: SCN10A; (+) strand; PAM type: YTN; PAM sequence: CTA
aaatgaaaatctggttatgt

SEQ ID NO: 75516 - DNA, 20 bp, Artificial Sequence
  Description of Artificial Sequence: Synthetic oligonucleotide
  Target: SCN10A; (+) strand; PAM type: YTN; PAM sequence: CTG
gttatgtgatatctttattt

SEQ ID NO: 75517 - DNA, 20 bp, Artificial Sequence
  Description of Artificial Sequence: Synthetic oligonucleotide
  Target: SCN10A; (+) strand; PAM type: YTN; PAM sequence: TTA
tgtgatatctttatttaaaa

SEQ ID NO: 75518 - DNA, 20 bp, Artificial Sequence
  Description of Artificial Sequence: Synthetic oligonucleotide
  Target: SCN10A; (+) strand; PAM type: YTN; PAM sequence: CTT
tatttaaaatcattctaaag

SEQ ID NO: 75519 - DNA, 20 bp, Artificial Sequence
  Description of Artificial Sequence: Synthetic oligonucleotide
  Target: SCN10A; (+) strand; PAM type: YTN; PAM sequence: TTT
atttaaaatcattctaaagc

SEQ ID NO: 75520 - DNA, 20 bp, Artificial Sequence
  Description of Artificial Sequence: Synthetic oligonucleotide
  Target: SCN10A; (+) strand; PAM type: YTN; PAM sequence: TTA
tttaaaatcattctaaagct

SEQ ID NO: 75521 - DNA, 20 bp, Artificial Sequence
  Description of Artificial Sequence: Synthetic oligonucleotide
  Target: SCN10A; (+) strand; PAM type: YTN; PAM sequence: TTT
aaaatcattctaaagctctc

SEQ ID NO: 75522 - DNA, 20 bp, Artificial Sequence
  Description of Artificial Sequence: Synthetic oligonucleotide
  Target: SCN10A; (+) strand; PAM type: YTN; PAM sequence: TTA
aaatcattctaaagctctcc

SEQ ID NO: 75523 - DNA, 20 bp, Artificial Sequence
  Description of Artificial Sequence: Synthetic oligonucleotide
  Target: SCN10A; (+) strand; PAM type: YTN; PAM sequence: TTC
taaagctctccatagcactc

SEQ ID NO: 75524 - DNA, 20 bp, Artificial Sequence
  Description of Artificial Sequence: Synthetic oligonucleotide
  Target: SCN10A; (+) strand; PAM type: YTN; PAM sequence: CTA
aagctctccatagcactcaa

SEQ ID NO: 75525 - DNA, 20 bp, Artificial Sequence
  Description of Artificial Sequence: Synthetic oligonucleotide
  Target: SCN10A; (+) strand; PAM type: YTN; PAM sequence: CTC
tccatagcactcaagataac

SEQ ID NO: 75526 - DNA, 20 bp, Artificial Sequence
  Description of Artificial Sequence: Synthetic oligonucleotide
  Target: SCN10A; (+) strand; PAM type: YTN; PAM sequence: CTC
catagcactcaagataaccc

SEQ ID NO: 75527 - DNA, 20 bp, Artificial Sequence
  Description of Artificial Sequence: Synthetic oligonucleotide
  Target: SCN10A; (+) strand; PAM type: YTN; PAM sequence: CTC
aagataacccaaactgtgcg

SEQ ID NO: 75528 - DNA, 20 bp, Artificial Sequence
  Description of Artificial Sequence: Synthetic oligonucleotide
  Target: SCN10A; (+) strand; PAM type: YTN; PAM sequence: CTG
tgcgctgacctctccagcat

SEQ ID NO: 75529 - DNA, 20 bp, Artificial Sequence
  Description of Artificial Sequence: Synthetic oligonucleotide
  Target: SCN10A; (+) strand; PAM type: YTN; PAM sequence: CTG
acctctccagcatggtagtc

SEQ ID NO: 75530 - DNA, 20 bp, Artificial Sequence
  Description of Artificial Sequence: Synthetic oligonucleotide
  Target: SCN10A; (+) strand; PAM type: YTN; PAM sequence: CTC
tccagcatggtagtccccag

SEQ ID NO: 75531 - DNA, 20 bp, Artificial Sequence
  Description of Artificial Sequence: Synthetic oligonucleotide
  Target: SCN10A; (+) strand; PAM type: YTN; PAM sequence: CTC
cagcatggtagtccccagcc

SEQ ID NO: 75532 - DNA, 20 bp, Artificial Sequence
  Description of Artificial Sequence: Synthetic oligonucleotide
  Target: SCN10A; (+) strand; PAM type: YTN; PAM sequence: CTA
cttttataagtttatccttg

SEQ ID NO: 75533 - DNA, 20 bp, Artificial Sequence
  Description of Artificial Sequence: Synthetic oligonucleotide
  Target: SCN10A; (+) strand; PAM type: YTN; PAM sequence: CTT
ttataagtttatccttgaat

SEQ ID NO: 75534 - DNA, 20 bp, Artificial Sequence
  Description of Artificial Sequence: Synthetic oligonucleotide
  Target: SCN10A; (+) strand; PAM type: YTN; PAM sequence: TTT
tataagtttatccttgaatt

SEQ ID NO: 75535 - DNA, 20 bp, Artificial Sequence
  Description of Artificial Sequence: Synthetic oligonucleotide
  Target: SCN10A; (+) strand; PAM type: YTN; PAM sequence: TTT
ataagtttatccttgaattt

SEQ ID NO: 75536 - DNA, 20 bp, Artificial Sequence
  Description of Artificial Sequence: Synthetic oligonucleotide
  Target: SCN10A; (+) strand; PAM type: YTN; PAM sequence: TTA
taagtttatccttgaatttg

SEQ ID NO: 75537 - DNA, 20 bp, Artificial Sequence
  Description of Artificial Sequence: Synthetic oligonucleotide
  Target: SCN10A; (+) strand; PAM type: YTN; PAM sequence: TTT
atccttgaatttgacccatt

SEQ ID NO: 75538 - DNA, 20 bp, Artificial Sequence
  Description of Artificial Sequence: Synthetic oligonucleotide
  Target: SCN10A; (+) strand; PAM type: YTN; PAM sequence: TTA
tccttgaatttgacccattc

SEQ ID NO: 75539 - DNA, 20 bp, Artificial Sequence
  Description of Artificial Sequence: Synthetic oligonucleotide
  Target: SCN10A; (+) strand; PAM type: YTN; PAM sequence: CTT
gaatttgacccattcttttt

SEQ ID NO: 75540 - DNA, 20 bp, Artificial Sequence
  Description of Artificial Sequence: Synthetic oligonucleotide
  Target: SCN10A; (+) strand; PAM type: YTN; PAM sequence: TTG
aatttgacccattctttttt

SEQ ID NO: 75541 - DNA, 20 bp, Artificial Sequence
  Description of Artificial Sequence: Synthetic oligonucleotide
  Target: SCN10A; (+) strand; PAM type: YTN; PAM sequence: TTT
gacccattcttttttatgtt

SEQ ID NO: 75542 - DNA, 20 bp, Artificial Sequence
  Description of Artificial Sequence: Synthetic oligonucleotide
  Target: SCN10A; (+) strand; PAM type: YTN; PAM sequence: TTG
acccattcttttttatgtta

SEQ ID NO: 75543 - DNA, 20 bp, Artificial Sequence
  Description of Artificial Sequence: Synthetic oligonucleotide
  Target: SCN10A; (+) strand; PAM type: YTN; PAM sequence: TTC
ttttttatgttaaggctttt

SEQ ID NO: 75544 - DNA, 20 bp, Artificial Sequence
  Description of Artificial Sequence: Synthetic oligonucleotide
  Target: SCN10A; (+) strand; PAM type: YTN; PAM sequence: CTT
ttttatgttaaggcttttcc

SEQ ID NO: 75545 - DNA, 20 bp, Artificial Sequence
  Description of Artificial Sequence: Synthetic oligonucleotide
  Target: SCN10A; (+) strand; PAM type: YTN; PAM sequence: TTT
tttatgttaaggcttttcca

SEQ ID NO: 75546 - DNA, 20 bp, Artificial Sequence
  Description of Artificial Sequence: Synthetic oligonucleotide
  Target: SCN10A; (+) strand; PAM type: YTN; PAM sequence: TTT
ttatgttaaggcttttccat

SEQ ID NO: 75547 - DNA, 20 bp, Artificial Sequence
  Description of Artificial Sequence: Synthetic oligonucleotide
  Target: SCN10A; (+) strand; PAM type: YTN; PAM sequence: TTT
tatgttaaggcttttccata

SEQ ID NO: 75548 - DNA, 20 bp, Artificial Sequence
  Description of Artificial Sequence: Synthetic oligonucleotide
  Target: SCN10A; (+) strand; PAM type: YTN; PAM sequence: TTT
atgttaaggcttttccatat

SEQ ID NO: 75549 - DNA, 20 bp, Artificial Sequence
  Description of Artificial Sequence: Synthetic oligonucleotide
  Target: SCN10A; (+) strand; PAM type: YTN; PAM sequence: TTA
tgttaaggcttttccatatt

SEQ ID NO: 75550 - DNA, 20 bp, Artificial Sequence
  Description of Artificial Sequence: Synthetic oligonucleotide
  Target: SCN10A; (+) strand; PAM type: YTN; PAM sequence: TTA
aggcttttccatattcccct

SEQ ID NO: 75551 - DNA, 20 bp, Artificial Sequence
  Description of Artificial Sequence: Synthetic oligonucleotide
  Target: SCN10A; (+) strand; PAM type: YTN; PAM sequence: CTT
ttccatattccccttccttt

SEQ ID NO: 75552 - DNA, 20 bp, Artificial Sequence
  Description of Artificial Sequence: Synthetic oligonucleotide
  Target: SCN10A; (+) strand; PAM type: YTN; PAM sequence: TTT
tccatattccccttcctttg

SEQ ID NO: 75553 - DNA, 20 bp, Artificial Sequence
  Description of Artificial Sequence: Synthetic oligonucleotide
  Target: SCN10A; (+) strand; PAM type: YTN; PAM sequence: TTT
ccatattccccttcctttgc

SEQ ID NO: 75554 - DNA, 20 bp, Artificial Sequence
  Description of Artificial Sequence: Synthetic oligonucleotide
  Target: SCN10A; (+) strand; PAM type: YTN; PAM sequence: TTC
catattccccttcctttgcc

SEQ ID NO: 75555 - DNA, 20 bp, Artificial Sequence
  Description of Artificial Sequence: Synthetic oligonucleotide
  Target: SCN10A; (+) strand; PAM type: YTN; PAM sequence: TTC
cccttcctttgcctaaaatt

SEQ ID NO: 75556 - DNA, 20 bp, Artificial Sequence
  Description of Artificial Sequence: Synthetic oligonucleotide
  Target: SCN10A; (+) strand; PAM type: YTN; PAM sequence: CTT
cctttgcctaaaattatctt

SEQ ID NO: 75557 - DNA, 20 bp, Artificial Sequence
  Description of Artificial Sequence: Synthetic oligonucleotide
  Target: SCN10A; (+) strand; PAM type: YTN; PAM sequence: TTC
ctttgcctaaaattatcttt

SEQ ID NO: 75558 - DNA, 20 bp, Artificial Sequence
  Description of Artificial Sequence: Synthetic oligonucleotide
  Target: SCN10A; (+) strand; PAM type: YTN; PAM sequence: CTT
tgcctaaaattatctttcca

SEQ ID NO: 75559 - DNA, 20 bp, Artificial Sequence
  Description of Artificial Sequence: Synthetic oligonucleotide
  Target: SCN10A; (+) strand; PAM type: YTN; PAM sequence: TTT
gcctaaaattatctttccac

SEQ ID NO: 75560 - DNA, 20 bp, Artificial Sequence
  Description of Artificial Sequence: Synthetic oligonucleotide
  Target: SCN10A; (+) strand; PAM type: YTN; PAM sequence: TTG
cctaaaattatctttccact

SEQ ID NO: 75561 - DNA, 20 bp, Artificial Sequence
  Description of Artificial Sequence: Synthetic oligonucleotide
  Target: SCN10A; (+) strand; PAM type: YTN; PAM sequence: CTA
aaattatctttccactttat

SEQ ID NO: 75562 - DNA, 20 bp, Artificial Sequence
  Description of Artificial Sequence: Synthetic oligonucleotide
  Target: SCN10A; (+) strand; PAM type: YTN; PAM sequence: TTA
tctttccactttattttgtc

SEQ ID NO: 75563 - DNA, 20 bp, Artificial Sequence
  Description of Artificial Sequence: Synthetic oligonucleotide
  Target: SCN10A; (+) strand; PAM type: YTN; PAM sequence: CTT
tccactttattttgtctggc

SEQ ID NO: 75564 - DNA, 20 bp, Artificial Sequence
  Description of Artificial Sequence: Synthetic oligonucleotide
  Target: SCN10A; (+) strand; PAM type: YTN; PAM sequence: TTT
ccactttattttgtctggct

SEQ ID NO: 75565 - DNA, 20 bp, Artificial Sequence
  Description of Artificial Sequence: Synthetic oligonucleotide
  Target: SCN10A; (+) strand; PAM type: YTN; PAM sequence: TTC
cactttattttgtctggcta

SEQ ID NO: 75566 - DNA, 20 bp, Artificial Sequence
  Description of Artificial Sequence: Synthetic oligonucleotide
  Target: SCN10A; (+) strand; PAM type: YTN; PAM sequence: CTT
tattttgtctggctaatcct

SEQ ID NO: 75567 - DNA, 20 bp, Artificial Sequence
  Description of Artificial Sequence: Synthetic oligonucleotide
  Target: SCN10A; (+) strand; PAM type: YTN; PAM sequence: TTT
attttgtctggctaatcctc

SEQ ID NO: 75568 - DNA, 20 bp, Artificial Sequence
  Description of Artificial Sequence: Synthetic oligonucleotide
  Target: SCN10A; (+) strand; PAM type: YTN; PAM sequence: TTA
ttttgtctggctaatcctct

SEQ ID NO: 75569 - DNA, 20 bp, Artificial Sequence
  Description of Artificial Sequence: Synthetic oligonucleotide
  Target: SCN10A; (+) strand; PAM type: YTN; PAM sequence: TTT
tgtctggctaatcctctctt

SEQ ID NO: 75570 - DNA, 20 bp, Artificial Sequence
  Description of Artificial Sequence: Synthetic oligonucleotide
  Target: SCN10A; (+) strand; PAM type: YTN; PAM sequence: TTT
gtctggctaatcctctctta

SEQ ID NO: 75571 - DNA, 20 bp, Artificial Sequence
  Description of Artificial Sequence: Synthetic oligonucleotide
  Target: SCN10A; (+) strand; PAM type: YTN; PAM sequence: TTG
tctggctaatcctctcttat

SEQ ID NO: 75572 - DNA, 20 bp, Artificial Sequence
  Description of Artificial Sequence: Synthetic oligonucleotide
  Target: SCN10A; (+) strand; PAM type: YTN; PAM sequence: CTG
gctaatcctctcttattctt

SEQ ID NO: 75573 - DNA, 20 bp, Artificial Sequence
  Description of Artificial Sequence: Synthetic oligonucleotide
  Target: SCN10A; (+) strand; PAM type: YTN; PAM sequence: CTA
atcctctcttattcttgtac

SEQ ID NO: 75574 - DNA, 20 bp, Artificial Sequence
  Description of Artificial Sequence: Synthetic oligonucleotide
  Target: SCN10A; (+) strand; PAM type: YTN; PAM sequence: CTC
tcttattcttgtactcttgg

SEQ ID NO: 75575 - DNA, 20 bp, Artificial Sequence
  Description of Artificial Sequence: Synthetic oligonucleotide
  Target: SCN10A; (+) strand; PAM type: YTN; PAM sequence: CTC
ttattcttgtactcttggct

SEQ ID NO: 75576 - DNA, 20 bp, Artificial Sequence
  Description of Artificial Sequence: Synthetic oligonucleotide
  Target: SCN10A; (+) strand; PAM type: YTN; PAM sequence: CTT
attcttgtactcttggcttt

SEQ ID NO: 75577 - DNA, 20 bp, Artificial Sequence
  Description of Artificial Sequence: Synthetic oligonucleotide
  Target: SCN10A; (+) strand; PAM type: YTN; PAM sequence: TTA
ttcttgtactcttggctttg

SEQ ID NO: 75578 - DNA, 20 bp, Artificial Sequence
  Description of Artificial Sequence: Synthetic oligonucleotide
  Target: SCN10A; (+) strand; PAM type: YTN; PAM sequence: TTC
ttgtactcttggctttgaga

SEQ ID NO: 75579 - DNA, 20 bp, Artificial Sequence
  Description of Artificial Sequence: Synthetic oligonucleotide
  Target: SCN10A; (+) strand; PAM type: YTN; PAM sequence: CTT
gtactcttggctttgagaca

SEQ ID NO: 75580 - DNA, 20 bp, Artificial Sequence
  Description of Artificial Sequence: Synthetic oligonucleotide
  Target: SCN10A; (+) strand; PAM type: YTN; PAM sequence: TTG
tactcttggctttgagacaa

SEQ ID NO: 75581 - DNA, 20 bp, Artificial Sequence
  Description of Artificial Sequence: Synthetic oligonucleotide
  Target: SCN10A; (+) strand; PAM type: YTN; PAM sequence: CTC
ttggctttgagacaatttct

SEQ ID NO: 75582 - DNA, 20 bp, Artificial Sequence
  Description of Artificial Sequence: Synthetic oligonucleotide
  Target: SCN10A; (+) strand; PAM type: YTN; PAM sequence: CTT
ggctttgagacaatttcttc

SEQ ID NO: 75583 - DNA, 20 bp, Artificial Sequence
  Description of Artificial Sequence: Synthetic oligonucleotide
  Target: SCN10A; (+) strand; PAM type: YTN; PAM sequence: TTG
gctttgagacaatttcttcc

SEQ ID NO: 75584 - DNA, 20 bp, Artificial Sequence
  Description of Artificial Sequence: Synthetic oligonucleotide
  Target: SCN10A; (+) strand; PAM type: YTN; PAM sequence: CTT
tgagacaatttcttccattt

SEQ ID NO: 75585 - DNA, 20 bp, Artificial Sequence
  Description of Artificial Sequence: Synthetic oligonucleotide
  Target: SCN10A; (+) strand; PAM type: YTN; PAM sequence: TTT
gagacaatttcttccatttc

SEQ ID NO: 75586 - DNA, 20 bp, Artificial Sequence
  Description of Artificial Sequence: Synthetic oligonucleotide
  Target: SCN10A; (+) strand; PAM type: YTN; PAM sequence: TTG
agacaatttcttccatttct

SEQ ID NO: 75587 - DNA, 20 bp, Artificial Sequence
  Description of Artificial Sequence: Synthetic oligonucleotide
  Target: SCN10A; (+) strand; PAM type: YTN; PAM sequence: TTT
cttccatttctgacctatat

SEQ ID NO: 75588 - DNA, 20 bp, Artificial Sequence
  Description of Artificial Sequence: Synthetic oligonucleotide
  Target: SCN10A; (+) strand; PAM type: YTN; PAM sequence: TTC
ttccatttctgacctatatg

SEQ ID NO: 75589 - DNA, 20 bp, Artificial Sequence
  Description of Artificial Sequence: Synthetic oligonucleotide
  Target: SCN10A; (+) strand; PAM type: YTN; PAM sequence: CTT
ccatttctgacctatatgaa

SEQ ID NO: 75590 - DNA, 20 bp, Artificial Sequence
  Description of Artificial Sequence: Synthetic oligonucleotide
  Target: SCN10A; (+) strand; PAM type: YTN; PAM sequence: TTC
catttctgacctatatgaag

SEQ ID NO: 75591 - DNA, 20 bp, Artificial Sequence
  Description of Artificial Sequence: Synthetic oligonucleotide
  Target: SCN10A; (+) strand; PAM type: YTN; PAM sequence: TTT
ctgacctatatgaagtctat

SEQ ID NO: 75592 - DNA, 20 bp, Artificial Sequence
  Description of Artificial Sequence: Synthetic oligonucleotide
  Target: SCN10A; (+) strand; PAM type: YTN; PAM sequence: TTC
tgacctatatgaagtctatg

SEQ ID NO: 75593 - DNA, 20 bp, Artificial Sequence
  Description of Artificial Sequence: Synthetic oligonucleotide
  Target: SCN10A; (+) strand; PAM type: YTN; PAM sequence: CTG
acctatatgaagtctatgtt

SEQ ID NO: 75594 - DNA, 20 bp, Artificial Sequence
  Description of Artificial Sequence: Synthetic oligonucleotide
  Target: SCN10A; (+) strand; PAM type: YTN; PAM sequence: CTA
tatgaagtctatgttaggat

SEQ ID NO: 75595 - DNA, 20 bp, Artificial Sequence
  Description of Artificial Sequence: Synthetic oligonucleotide
  Target: SCN10A; (+) strand; PAM type: YTN; PAM sequence: CTA
tgttaggattcctgtttcat

SEQ ID NO: 75596 - DNA, 20 bp, Artificial Sequence
  Description of Artificial Sequence: Synthetic oligonucleotide
  Target: SCN10A; (+) strand; PAM type: YTN; PAM sequence: TTA
ggattcctgtttcatgttcc

SEQ ID NO: 75597 - DNA, 20 bp, Artificial Sequence
  Description of Artificial Sequence: Synthetic oligonucleotide
  Target: SCN10A; (+) strand; PAM type: YTN; PAM sequence: TTC
ctgtttcatgttcccataac

SEQ ID NO: 75598 - DNA, 20 bp, Artificial Sequence
  Description of Artificial Sequence: Synthetic oligonucleotide
  Target: SCN10A; (+) strand; PAM type: YTN; PAM sequence: CTG
tttcatgttcccataactct

SEQ ID NO: 75599 - DNA, 20 bp, Artificial Sequence
  Description of Artificial Sequence: Synthetic oligonucleotide
  Target: SCN10A; (+) strand; PAM type: YTN; PAM sequence: TTT
catgttcccataactctctg

SEQ ID NO: 75600 - DNA, 20 bp, Artificial Sequence
  Description of Artificial Sequence: Synthetic oligonucleotide
  Target: SCN10A; (+) strand; PAM type: YTN; PAM sequence: TTC
atgttcccataactctctgc

SEQ ID NO: 75601 - DNA, 20 bp, Artificial Sequence
  Description of Artificial Sequence: Synthetic oligonucleotide
  Target: SCN10A; (+) strand; PAM type: YTN; PAM sequence: TTC
ccataactctctgcactttc

SEQ ID NO: 75602 - DNA, 20 bp, Artificial Sequence
  Description of Artificial Sequence: Synthetic oligonucleotide
  Target: SCN10A; (+) strand; PAM type: YTN; PAM sequence: CTC
tctgcactttctctataaac

SEQ ID NO: 75603 - DNA, 20 bp, Artificial Sequence
  Description of Artificial Sequence: Synthetic oligonucleotide
  Target: SCN10A; (+) strand; PAM type: YTN; PAM sequence: CTC
tgcactttctctataaacat

SEQ ID NO: 75604 - DNA, 20 bp, Artificial Sequence
  Description of Artificial Sequence: Synthetic oligonucleotide
  Target: SCN10A; (+) strand; PAM type: YTN; PAM sequence: CTG
cactttctctataaacatct

SEQ ID NO: 75605 - DNA, 20 bp, Artificial Sequence
  Description of Artificial Sequence: Synthetic oligonucleotide
  Target: SCN10A; (+) strand; PAM type: YTN; PAM sequence: CTT
tctctataaacatctgattt

SEQ ID NO: 75606 - DNA, 20 bp, Artificial Sequence
  Description of Artificial Sequence: Synthetic oligonucleotide
  Target: SCN10A; (+) strand; PAM type: YTN; PAM sequence: TTT
ctctataaacatctgatttg

SEQ ID NO: 75607 - DNA, 20 bp, Artificial Sequence
  Description of Artificial Sequence: Synthetic oligonucleotide
  Target: SCN10A; (+) strand; PAM type: YTN; PAM sequence: TTC
tctataaacatctgatttgt

SEQ ID NO: 75608 - DNA, 20 bp, Artificial Sequence
  Description of Artificial Sequence: Synthetic oligonucleotide
  Target: SCN10A; (+) strand; PAM type: YTN; PAM sequence: CTC
tataaacatctgatttgtaa

SEQ ID NO: 75609 - DNA, 20 bp, Artificial Sequence
  Description of Artificial Sequence: Synthetic oligonucleotide
  Target: SCN10A; (+) strand; PAM type: YTN; PAM sequence: CTA
taaacatctgatttgtaatt

SEQ ID NO: 75610 - DNA, 20 bp, Artificial Sequence
  Description of Artificial Sequence: Synthetic oligonucleotide
  Target: SCN10A; (+) strand; PAM type: YTN; PAM sequence: CTG
atttgtaatttctgtttgcc

SEQ ID NO: 75611 - DNA, 20 bp, Artificial Sequence
  Description of Artificial Sequence: Synthetic oligonucleotide
  Target: SCN10A; (+) strand; PAM type: YTN; PAM sequence: TTT
gtaatttctgtttgcctttc

SEQ ID NO: 75612 - DNA, 20 bp, Artificial Sequence
  Description of Artificial Sequence: Synthetic oligonucleotide
  Target: SCN10A; (+) strand; PAM type: YTN; PAM sequence: TTG
taatttctgtttgcctttct

SEQ ID NO: 75613 - DNA, 20 bp, Artificial Sequence
  Description of Artificial Sequence: Synthetic oligonucleotide
  Target: SCN10A; (+) strand; PAM type: YTN; PAM sequence: TTT
ctgtttgcctttctattgtt

SEQ ID NO: 75614 - DNA, 20 bp, Artificial Sequence
  Description of Artificial Sequence: Synthetic oligonucleotide
  Target: SCN10A; (+) strand; PAM type: YTN; PAM sequence: TTC
tgtttgcctttctattgttt

SEQ ID NO: 75615 - DNA, 20 bp, Artificial Sequence
  Description of Artificial Sequence: Synthetic oligonucleotide
  Target: SCN10A; (+) strand; PAM type: YTN; PAM sequence: CTG
tttgcctttctattgtttct

SEQ ID NO: 75616 - DNA, 20 bp, Artificial Sequence
  Description of Artificial Sequence: Synthetic oligonucleotide
  Target: SCN10A; (+) strand; PAM type: YTN; PAM sequence: TTT
gcctttctattgtttctacc

SEQ ID NO: 75617 - DNA, 20 bp, Artificial Sequence
  Description of Artificial Sequence: Synthetic oligonucleotide
  Target: SCN10A; (+) strand; PAM type: YTN; PAM sequence: TTG
cctttctattgtttctacca

SEQ ID NO: 75618 - DNA, 20 bp, Artificial Sequence
  Description of Artificial Sequence: Synthetic oligonucleotide
  Target: SCN10A; (+) strand; PAM type: YTN; PAM sequence: CTT
tctattgtttctaccaaatt

SEQ ID NO: 75619 - DNA, 20 bp, Artificial Sequence
  Description of Artificial Sequence: Synthetic oligonucleotide
  Target: SCN10A; (+) strand; PAM type: YTN; PAM sequence: TTT
ctattgtttctaccaaattg

SEQ ID NO: 75620 - DNA, 20 bp, Artificial Sequence
  Description of Artificial Sequence: Synthetic oligonucleotide
  Target: SCN10A; (+) strand; PAM type: YTN; PAM sequence: TTC
tattgtttctaccaaattgt

SEQ ID NO: 75621 - DNA, 20 bp, Artificial Sequence
  Description of Artificial Sequence: Synthetic oligonucleotide
  Target: SCN10A; (+) strand; PAM type: YTN; PAM sequence: CTA
ttgtttctaccaaattgtaa

SEQ ID NO: 75622 - DNA, 20 bp, Artificial Sequence
  Description of Artificial Sequence: Synthetic oligonucleotide
  Target: SCN10A; (+) strand; PAM type: YTN; PAM sequence: TTG
tttctaccaaattgtaagct

SEQ ID NO: 75623 - DNA, 20 bp, Artificial Sequence
  Description of Artificial Sequence: Synthetic oligonucleotide
  Target: SCN10A; (+) strand; PAM type: YTN; PAM sequence: TTT
ctaccaaattgtaagctcag

SEQ ID NO: 75624 - DNA, 20 bp, Artificial Sequence
  Description of Artificial Sequence: Synthetic oligonucleotide
  Target: SCN10A; (+) strand; PAM type: YTN; PAM sequence: TTC
taccaaattgtaagctcagt

SEQ ID NO: 75625 - DNA, 20 bp, Artificial Sequence
  Description of Artificial Sequence: Synthetic oligonucleotide
  Target: SCN10A; (+) strand; PAM type: YTN; PAM sequence: CTA
ccaaattgtaagctcagtga

SEQ ID NO: 75626 - DNA, 20 bp, Artificial Sequence
  Description of Artificial Sequence: Synthetic oligonucleotide
  Target: SCN10A; (+) strand; PAM type: YTN; PAM sequence: TTG
taagctcagtgagagctgga

SEQ ID NO: 75627 - DNA, 20 bp, Artificial Sequence
  Description of Artificial Sequence: Synthetic oligonucleotide
  Target: SCN10A; (+) strand; PAM type: YTN; PAM sequence: CTC
agtgagagctggactcacat

SEQ ID NO: 75628 - DNA, 20 bp, Artificial Sequence
  Description of Artificial Sequence: Synthetic oligonucleotide
  Target: SCN10A; (+) strand; PAM type: YTN; PAM sequence: CTG
gactcacatctattttgttc

SEQ ID NO: 75629 - DNA, 20 bp, Artificial Sequence
  Description of Artificial Sequence: Synthetic oligonucleotide
  Target: SCN10A; (+) strand; PAM type: YTN; PAM sequence: CTC
acatctattttgttcagcat

SEQ ID NO: 75630 - DNA, 20 bp, Artificial Sequence
  Description of Artificial Sequence: Synthetic oligonucleotide
  Target: SCN10A; (+) strand; PAM type: YTN; PAM sequence: CTA
ttttgttcagcattgatttt

SEQ ID NO: 75631 - DNA, 20 bp, Artificial Sequence
  Description of Artificial Sequence: Synthetic oligonucleotide
  Target: SCN10A; (+) strand; PAM type: YTN; PAM sequence: TTT
tgttcagcattgattttcca

SEQ ID NO: 75632 - DNA, 20 bp, Artificial Sequence
  Description of Artificial Sequence: Synthetic oligonucleotide
  Target: SCN10A; (+) strand; PAM type: YTN; PAM sequence: TTT
gttcagcattgattttccag

SEQ ID NO: 75633 - DNA, 20 bp, Artificial Sequence
  Description of Artificial Sequence: Synthetic oligonucleotide
  Target: SCN10A; (+) strand; PAM type: YTN; PAM sequence: TTG
ttcagcattgattttccaga

SEQ ID NO: 75634 - DNA, 20 bp, Artificial Sequence
  Description of Artificial Sequence: Synthetic oligonucleotide
  Target: SCN10A; (+) strand; PAM type: YTN; PAM sequence: TTC
agcattgattttccagaacc

SEQ ID NO: 75635 - DNA, 20 bp, Artificial Sequence
  Description of Artificial Sequence: Synthetic oligonucleotide
  Target: SCN10A; (+) strand; PAM type: YTN; PAM sequence: TTG
attttccagaacctagtaca

SEQ ID NO: 75636 - DNA, 20 bp, Artificial Sequence
  Description of Artificial Sequence: Synthetic oligonucleotide
  Target: SCN10A; (+) strand; PAM type: YTN; PAM sequence: TTT
tccagaacctagtacagtgc

SEQ ID NO: 75637 - DNA, 20 bp, Artificial Sequence
  Description of Artificial Sequence: Synthetic oligonucleotide
  Target: SCN10A; (+) strand; PAM type: YTN; PAM sequence: TTT
ccagaacctagtacagtgcc

SEQ ID NO: 75638 - DNA, 20 bp, Artificial Sequence
  Description of Artificial Sequence: Synthetic oligonucleotide
  Target: SCN10A; (+) strand; PAM type: YTN; PAM sequence: TTC
cagaacctagtacagtgcct

SEQ ID NO: 75639 - DNA, 20 bp, Artificial Sequence
  Description of Artificial Sequence: Synthetic oligonucleotide
  Target: SCN10A; (+) strand; PAM type: YTN; PAM sequence: CTA
gtacagtgcctggaactaac

SEQ ID NO: 75640 - DNA, 20 bp, Artificial Sequence
  Description of Artificial Sequence: Synthetic oligonucleotide
  Target: SCN10A; (+) strand; PAM type: YTN; PAM sequence: CTG
gaactaactagatacagaat

SEQ ID NO: 75641 - DNA, 20 bp, Artificial Sequence
  Description of Artificial Sequence: Synthetic oligonucleotide
  Target: SCN10A; (+) strand; PAM type: YTN; PAM sequence: CTA
actagatacagaatagatag

SEQ ID NO: 75642 - DNA, 20 bp, Artificial Sequence
  Description of Artificial Sequence: Synthetic oligonucleotide
  Target: SCN10A; (+) strand; PAM type: YTN; PAM sequence: CTA
gatacagaatagatagttgt

SEQ ID NO: 75643 - DNA, 20 bp, Artificial Sequence
  Description of Artificial Sequence: Synthetic oligonucleotide
  Target: SCN10A; (+) strand; PAM type: YTN; PAM sequence: TTG
ttgcatgaatagagataatg

SEQ ID NO: 75644 - DNA, 20 bp, Artificial Sequence
  Description of Artificial Sequence: Synthetic oligonucleotide
  Target: SCN10A; (+) strand; PAM type: YTN; PAM sequence: TTG
catgaatagagataatggcg

SEQ ID NO: 75645 - DNA, 20 bp, Artificial Sequence
  Description of Artificial Sequence: Synthetic oligonucleotide
  Target: SCN10A; (+) strand; PAM type: YTN; PAM sequence: CTT
aatagctgaaaaactaaaga

SEQ ID NO: 75646 - DNA, 20 bp, Artificial Sequence
  Description of Artificial Sequence: Synthetic oligonucleotide
  Target: SCN10A; (+) strand; PAM type: YTN; PAM sequence: TTA
atagctgaaaaactaaagaa

SEQ ID NO: 75647 - DNA, 20 bp, Artificial Sequence
  Description of Artificial Sequence: Synthetic oligonucleotide
  Target: SCN10A; (+) strand; PAM type: YTN; PAM sequence: CTG
aaaaactaaagaacattttg

SEQ ID NO: 75648 - DNA, 20 bp, Artificial Sequence
  Description of Artificial Sequence: Synthetic oligonucleotide
  Target: SCN10A; (+) strand; PAM type: YTN; PAM sequence: CTA
aagaacattttgttcagaaa

SEQ ID NO: 75649 - DNA, 20 bp, Artificial Sequence
  Description of Artificial Sequence: Synthetic oligonucleotide
  Target: SCN10A; (+) strand; PAM type: YTN; PAM sequence: TTT
tgttcagaaaaatgcagcaa

SEQ ID NO: 75650 - DNA, 20 bp, Artificial Sequence
  Description of Artificial Sequence: Synthetic oligonucleotide
  Target: SCN10A; (+) strand; PAM type: YTN; PAM sequence: TTT
gttcagaaaaatgcagcaaa

SEQ ID NO: 75651 - DNA, 20 bp, Artificial Sequence
  Description of Artificial Sequence: Synthetic oligonucleotide
  Target: SCN10A; (+) strand; PAM type: YTN; PAM sequence: TTG
ttcagaaaaatgcagcaaaa

SEQ ID NO: 75652 - DNA, 20 bp, Artificial Sequence
  Description of Artificial Sequence: Synthetic oligonucleotide
  Target: SCN10A; (+) strand; PAM type: YTN; PAM sequence: TTC
agaaaaatgcagcaaaaatc

SEQ ID NO: 75653 - DNA, 20 bp, Artificial Sequence
  Description of Artificial Sequence: Synthetic oligonucleotide
  Target: SCN10A; (+) strand; PAM type: YTN; PAM sequence: TTA
ttgagtctattgacatttta

SEQ ID NO: 75654 - DNA, 20 bp, Artificial Sequence
  Description of Artificial Sequence: Synthetic oligonucleotide
  Target: SCN10A; (+) strand; PAM type: YTN; PAM sequence: TTG
agtctattgacattttaaag

SEQ ID NO: 75655 - DNA, 20 bp, Artificial Sequence
  Description of Artificial Sequence: Synthetic oligonucleotide
  Target: SCN10A; (+) strand; PAM type: YTN; PAM sequence: CTA
ttgacattttaaagctcaca

SEQ ID NO: 75656 - DNA, 20 bp, Artificial Sequence
  Description of Artificial Sequence: Synthetic oligonucleotide
  Target: SCN10A; (+) strand; PAM type: YTN; PAM sequence: TTG
acattttaaagctcacacac

SEQ ID NO: 75657 - DNA, 20 bp, Artificial Sequence
  Description of Artificial Sequence: Synthetic oligonucleotide
  Target: SCN10A; (+) strand; PAM type: YTN; PAM sequence: TTT
taaagctcacacaccccaaa

SEQ ID NO: 75658 - DNA, 20 bp, Artificial Sequence
  Description of Artificial Sequence: Synthetic oligonucleotide
  Target: SCN10A; (+) strand; PAM type: YTN; PAM sequence: TTT
aaagctcacacaccccaaag

SEQ ID NO: 75659 - DNA, 20 bp, Artificial Sequence
  Description of Artificial Sequence: Synthetic oligonucleotide
  Target: SCN10A; (+) strand; PAM type: YTN; PAM sequence: TTA
aagctcacacaccccaaagt

SEQ ID NO: 75660 - DNA, 20 bp, Artificial Sequence
  Description of Artificial Sequence: Synthetic oligonucleotide
  Target: SCN10A; (+) strand; PAM type: YTN; PAM sequence: CTC
acacaccccaaagtcaagca

SEQ ID NO: 75661 - DNA, 20 bp, Artificial Sequence
  Description of Artificial Sequence: Synthetic oligonucleotide
  Target: SCN10A; (+) strand; PAM type: YTN; PAM sequence: CTT
aaatcaaatacccctatgat

SEQ ID NO: 75662 - DNA, 20 bp, Artificial Sequence
  Description of Artificial Sequence: Synthetic oligonucleotide
  Target: SCN10A; (+) strand; PAM type: YTN; PAM sequence: TTA
aatcaaatacccctatgatg

SEQ ID NO: 75663 - DNA, 20 bp, Artificial Sequence
  Description of Artificial Sequence: Synthetic oligonucleotide
  Target: SCN10A; (+) strand; PAM type: YTN; PAM sequence: CTA
tgatggagatcctgcttgct

SEQ ID NO: 75664 - DNA, 20 bp, Artificial Sequence
  Description of Artificial Sequence: Synthetic oligonucleotide
  Target: SCN10A; (+) strand; PAM type: YTN; PAM sequence: CTG
cttgctcccaccatacctag

SEQ ID NO: 75665 - DNA, 20 bp, Artificial Sequence
  Description of Artificial Sequence: Synthetic oligonucleotide
  Target: SCN10A; (+) strand; PAM type: YTN; PAM sequence: CTT
gctcccaccatacctagagg

SEQ ID NO: 75666 - DNA, 20 bp, Artificial Sequence
  Description of Artificial Sequence: Synthetic oligonucleotide
  Target: SCN10A; (+) strand; PAM type: YTN; PAM sequence: TTG
ctcccaccatacctagaggt

SEQ ID NO: 75667 - DNA, 20 bp, Artificial Sequence
  Description of Artificial Sequence: Synthetic oligonucleotide
  Target: SCN10A; (+) strand; PAM type: YTN; PAM sequence: CTC
ccaccatacctagaggtatt

SEQ ID NO: 75668 - DNA, 20 bp, Artificial Sequence
  Description of Artificial Sequence: Synthetic oligonucleotide
  Target: SCN10A; (+) strand; PAM type: YTN; PAM sequence: CTA
gaggtatttcttgaatccaa

SEQ ID NO: 75669 - DNA, 20 bp, Artificial Sequence
  Description of Artificial Sequence: Synthetic oligonucleotide
  Target: SCN10A; (+) strand; PAM type: YTN; PAM sequence: TTT
cttgaatccaatacctctgt

SEQ ID NO: 75670 - DNA, 20 bp, Artificial Sequence
  Description of Artificial Sequence: Synthetic oligonucleotide
  Target: SCN10A; (+) strand; PAM type: YTN; PAM sequence: TTC
ttgaatccaatacctctgtg

SEQ ID NO: 75671 - DNA, 20 bp, Artificial Sequence
  Description of Artificial Sequence: Synthetic oligonucleotide
  Target: SCN10A; (+) strand; PAM type: YTN; PAM sequence: CTT
gaatccaatacctctgtgat

SEQ ID NO: 75672 - DNA, 20 bp, Artificial Sequence
  Description of Artificial Sequence: Synthetic oligonucleotide
  Target: SCN10A; (+) strand; PAM type: YTN; PAM sequence: TTG
aatccaatacctctgtgata

SEQ ID NO: 75673 - DNA, 20 bp, Artificial Sequence
  Description of Artificial Sequence: Synthetic oligonucleotide
  Target: SCN10A; (+) strand; PAM type: YTN; PAM sequence: CTC
tgtgatatagacactgctta

SEQ ID NO: 75674 - DNA, 20 bp, Artificial Sequence
  Description of Artificial Sequence: Synthetic oligonucleotide
  Target: SCN10A; (+) strand; PAM type: YTN; PAM sequence: CTG
tgatatagacactgcttatt

SEQ ID NO: 75675 - DNA, 20 bp, Artificial Sequence
  Description of Artificial Sequence: Synthetic oligonucleotide
  Target: SCN10A; (+) strand; PAM type: YTN; PAM sequence: CTG
cttattgtcaccagccctag

SEQ ID NO: 75676 - DNA, 20 bp, Artificial Sequence
  Description of Artificial Sequence: Synthetic oligonucleotide
  Target: SCN10A; (+) strand; PAM type: YTN; PAM sequence: CTT
attgtcaccagccctagagg

SEQ ID NO: 75677 - DNA, 20 bp, Artificial Sequence
  Description of Artificial Sequence: Synthetic oligonucleotide
  Target: SCN10A; (+) strand; PAM type: YTN; PAM sequence: TTA
ttgtcaccagccctagaggc

SEQ ID NO: 75678 - DNA, 20 bp, Artificial Sequence
  Description of Artificial Sequence: Synthetic oligonucleotide
  Target: SCN10A; (+) strand; PAM type: YTN; PAM sequence: TTG
tcaccagccctagaggcagc

SEQ ID NO: 75679 - DNA, 20 bp, Artificial Sequence
  Description of Artificial Sequence: Synthetic oligonucleotide
  Target: SCN10A; (+) strand; PAM type: YTN; PAM sequence: CTA
gaggcagctctggtacccaa

SEQ ID NO: 75680 - DNA, 20 bp, Artificial Sequence
  Description of Artificial Sequence: Synthetic oligonucleotide
  Target: SCN10A; (+) strand; PAM type: YTN; PAM sequence: CTC
tggtacccaatacccatatg

SEQ ID NO: 75681 - DNA, 20 bp, Artificial Sequence
  Description of Artificial Sequence: Synthetic oligonucleotide
  Target: SCN10A; (+) strand; PAM type: YTN; PAM sequence: CTG
gtacccaatacccatatgta

SEQ ID NO: 75682 - DNA, 20 bp, Artificial Sequence
  Description of Artificial Sequence: Synthetic oligonucleotide
  Target: SCN10A; (+) strand; PAM type: YTN; PAM sequence: CTC
tgctggttgtcaccagtcct

SEQ ID NO: 75683 - DNA, 20 bp, Artificial Sequence
  Description of Artificial Sequence: Synthetic oligonucleotide
  Target: SCN10A; (+) strand; PAM type: YTN; PAM sequence: CTG
ctggttgtcaccagtccttc

SEQ ID NO: 75684 - DNA, 20 bp, Artificial Sequence
  Description of Artificial Sequence: Synthetic oligonucleotide
  Target: SCN10A; (+) strand; PAM type: YTN; PAM sequence: CTG
gttgtcaccagtccttccat

SEQ ID NO: 75685 - DNA, 20 bp, Artificial Sequence
  Description of Artificial Sequence: Synthetic oligonucleotide
  Target: SCN10A; (+) strand; PAM type: YTN; PAM sequence: TTG
tcaccagtccttccatgcat

SEQ ID NO: 75686 - DNA, 20 bp, Artificial Sequence
  Description of Artificial Sequence: Synthetic oligonucleotide
  Target: SCN10A; (+) strand; PAM type: YTN; PAM sequence: CTT
ccatgcattgaagtcctggg

SEQ ID NO: 75687 - DNA, 20 bp, Artificial Sequence
  Description of Artificial Sequence: Synthetic oligonucleotide
  Target: SCN10A; (+) strand; PAM type: YTN; PAM sequence: TTC
catgcattgaagtcctggga

SEQ ID NO: 75688 - DNA, 20 bp, Artificial Sequence
  Description of Artificial Sequence: Synthetic oligonucleotide
  Target: SCN10A; (+) strand; PAM type: YTN; PAM sequence: TTG
aagtcctgggaggagcactc

SEQ ID NO: 75689 - DNA, 20 bp, Artificial Sequence
  Description of Artificial Sequence: Synthetic oligonucleotide
  Target: SCN10A; (+) strand; PAM type: YTN; PAM sequence: CTG
ggaggagcactcactgctct

SEQ ID NO: 75690 - DNA, 20 bp, Artificial Sequence
  Description of Artificial Sequence: Synthetic oligonucleotide
  Target: SCN10A; (+) strand; PAM type: YTN; PAM sequence: CTC
actgctctgacaccattcct

SEQ ID NO: 75691 - DNA, 20 bp, Artificial Sequence
  Description of Artificial Sequence: Synthetic oligonucleotide
  Target: SCN10A; (+) strand; PAM type: YTN; PAM sequence: CTG
ctctgacaccattcctcttc

SEQ ID NO: 75692 - DNA, 20 bp, Artificial Sequence
  Description of Artificial Sequence: Synthetic oligonucleotide
  Target: SCN10A; (+) strand; PAM type: YTN; PAM sequence: CTC
tgacaccattcctcttcctt

SEQ ID NO: 75693 - DNA, 20 bp, Artificial Sequence
  Description of Artificial Sequence: Synthetic oligonucleotide
  Target: SCN10A; (+) strand; PAM type: YTN; PAM sequence: CTG
acaccattcctcttccttaa

SEQ ID NO: 75694 - DNA, 20 bp, Artificial Sequence
  Description of Artificial Sequence: Synthetic oligonucleotide
  Target: SCN10A; (+) strand; PAM type: YTN; PAM sequence: TTC
ctcttccttaatgtcctcca

SEQ ID NO: 75695 - DNA, 20 bp, Artificial Sequence
  Description of Artificial Sequence: Synthetic oligonucleotide
  Target: SCN10A; (+) strand; PAM type: YTN; PAM sequence: CTC
ttccttaatgtcctccatta

SEQ ID NO: 75696 - DNA, 20 bp, Artificial Sequence
  Description of Artificial Sequence: Synthetic oligonucleotide
  Target: SCN10A; (+) strand; PAM type: YTN; PAM sequence: CTT
ccttaatgtcctccattact

SEQ ID NO: 75697 - DNA, 20 bp, Artificial Sequence
  Description of Artificial Sequence: Synthetic oligonucleotide
  Target: SCN10A; (+) strand; PAM type: YTN; PAM sequence: TTC
cttaatgtcctccattactt

SEQ ID NO: 75698 - DNA, 20 bp, Artificial Sequence
  Description of Artificial Sequence: Synthetic oligonucleotide
  Target: SCN10A; (+) strand; PAM type: YTN; PAM sequence: CTT
aatgtcctccattactttct

SEQ ID NO: 75699 - DNA, 20 bp, Artificial Sequence
  Description of Artificial Sequence: Synthetic oligonucleotide
  Target: SCN10A; (+) strand; PAM type: YTN; PAM sequence: TTA
atgtcctccattactttctt

SEQ ID NO: 75700 - DNA, 20 bp, Artificial Sequence
  Description of Artificial Sequence: Synthetic oligonucleotide
  Target: SCN10A; (+) strand; PAM type: YTN; PAM sequence: CTC
cattactttcttctgagagc

SEQ ID NO: 75701 - DNA, 20 bp, Artificial Sequence
  Description of Artificial Sequence: Synthetic oligonucleotide
  Target: SCN10A; (+) strand; PAM type: YTN; PAM sequence: TTA
ctttcttctgagagctttcc

SEQ ID NO: 75702 - DNA, 20 bp, Artificial Sequence
  Description of Artificial Sequence: Synthetic oligonucleotide
  Target: SCN10A; (+) strand; PAM type: YTN; PAM sequence: CTT
tcttctgagagctttccctc

SEQ ID NO: 75703 - DNA, 20 bp, Artificial Sequence
  Description of Artificial Sequence: Synthetic oligonucleotide
  Target: SCN10A; (+) strand; PAM type: YTN; PAM sequence: TTT
cttctgagagctttccctca

SEQ ID NO: 75704 - DNA, 20 bp, Artificial Sequence
  Description of Artificial Sequence: Synthetic oligonucleotide
  Target: SCN10A; (+) strand; PAM type: YTN; PAM sequence: TTC
ttctgagagctttccctcac

SEQ ID NO: 75705 - DNA, 20 bp, Artificial Sequence
  Description of Artificial Sequence: Synthetic oligonucleotide
  Target: SCN10A; (+) strand; PAM type: YTN; PAM sequence: CTT
ctgagagctttccctcaccc

SEQ ID NO: 75706 - DNA, 20 bp, Artificial Sequence
  Description of Artificial Sequence: Synthetic oligonucleotide
  Target: SCN10A; (+) strand; PAM type: YTN; PAM sequence: TTC
tgagagctttccctcaccct

SEQ ID NO: 75707 - DNA, 20 bp, Artificial Sequence
  Description of Artificial Sequence: Synthetic oligonucleotide
  Target: SCN10A; (+) strand; PAM type: YTN; PAM sequence: CTG
agagctttccctcaccctct

SEQ ID NO: 75708 - DNA, 20 bp, Artificial Sequence
  Description of Artificial Sequence: Synthetic oligonucleotide
  Target: SCN10A; (+) strand; PAM type: YTN; PAM sequence: CTT
tccctcaccctcttcctctc

SEQ ID NO: 75709 - DNA, 20 bp, Artificial Sequence
  Description of Artificial Sequence: Synthetic oligonucleotide
  Target: SCN10A; (+) strand; PAM type: YTN; PAM sequence: TTT
ccctcaccctcttcctctcc

SEQ ID NO: 75710 - DNA, 20 bp, Artificial Sequence
  Description of Artificial Sequence: Synthetic oligonucleotide
  Target: SCN10A; (+) strand; PAM type: YTN; PAM sequence: TTC
cctcaccctcttcctctcct

SEQ ID NO: 75711 - DNA, 20 bp, Artificial Sequence
  Description of Artificial Sequence: Synthetic oligonucleotide
  Target: SCN10A; (+) strand; PAM type: YTN; PAM sequence: CTC
accctcttcctctcctcctg

SEQ ID NO: 75712 - DNA, 20 bp, Artificial Sequence
  Description of Artificial Sequence: Synthetic oligonucleotide
  Target: SCN10A; (+) strand; PAM type: YTN; PAM sequence: CTC
ttcctctcctcctgcctatt

SEQ ID NO: 75713 - DNA, 20 bp, Artificial Sequence
  Description of Artificial Sequence: Synthetic oligonucleotide
  Target: SCN10A; (+) strand; PAM type: YTN; PAM sequence: CTT
cctctcctcctgcctatttg

SEQ ID NO: 75714 - DNA, 20 bp, Artificial Sequence
  Description of Artificial Sequence: Synthetic oligonucleotide
  Target: SCN10A; (+) strand; PAM type: YTN; PAM sequence: TTC
ctctcctcctgcctatttgt

SEQ ID NO: 75715 - DNA, 20 bp, Artificial Sequence
  Description of Artificial Sequence: Synthetic oligonucleotide
  Target: SCN10A; (+) strand; PAM type: YTN; PAM sequence: CTC
tcctcctgcctatttgtagt

SEQ ID NO: 75716 - DNA, 20 bp, Artificial Sequence
  Description of Artificial Sequence: Synthetic oligonucleotide
  Target: SCN10A; (+) strand; PAM type: YTN; PAM sequence: CTC
ctcctgcctatttgtagttg

SEQ ID NO: 75717 - DNA, 20 bp, Artificial Sequence
  Description of Artificial Sequence: Synthetic oligonucleotide
  Target: SCN10A; (+) strand; PAM type: YTN; PAM sequence: CTC
ctgcctatttgtagttgatc

SEQ ID NO: 75718 - DNA, 20 bp, Artificial Sequence
  Description of Artificial Sequence: Synthetic oligonucleotide
  Target: SCN10A; (+) strand; PAM type: YTN; PAM sequence: CTG
cctatttgtagttgatctgt

SEQ ID NO: 75719 - DNA, 20 bp, Artificial Sequence
  Description of Artificial Sequence: Synthetic oligonucleotide
  Target: SCN10A; (+) strand; PAM type: YTN; PAM sequence: CTA
tttgtagttgatctgtttct

SEQ ID NO: 75720 - DNA, 20 bp, Artificial Sequence
  Description of Artificial Sequence: Synthetic oligonucleotide
  Target: SCN10A; (+) strand; PAM type: YTN; PAM sequence: TTT
gtagttgatctgtttcttac

SEQ ID NO: 75721 - DNA, 20 bp, Artificial Sequence
  Description of Artificial Sequence: Synthetic oligonucleotide
  Target: SCN10A; (+) strand; PAM type: YTN; PAM sequence: TTG
tagttgatctgtttcttacg

SEQ ID NO: 75722 - DNA, 20 bp, Artificial Sequence
  Description of Artificial Sequence: Synthetic oligonucleotide
  Target: SCN10A; (+) strand; PAM type: YTN; PAM sequence: TTG
atctgtttcttacggaactt

SEQ ID NO: 75723 - DNA, 20 bp, Artificial Sequence
  Description of Artificial Sequence: Synthetic oligonucleotide
  Target: SCN10A; (+) strand; PAM type: YTN; PAM sequence: CTG
tttcttacggaacttttcaa

SEQ ID NO: 75724 - DNA, 20 bp, Artificial Sequence
  Description of Artificial Sequence: Synthetic oligonucleotide
  Target: SCN10A; (+) strand; PAM type: YTN; PAM sequence: TTT
cttacggaacttttcaaagt

SEQ ID NO: 75725 - DNA, 20 bp, Artificial Sequence
  Description of Artificial Sequence: Synthetic oligonucleotide
  Target: SCN10A; (+) strand; PAM type: YTN; PAM sequence: TTC
ttacggaacttttcaaagtc

SEQ ID NO: 75726 - DNA, 20 bp, Artificial Sequence
  Description of Artificial Sequence: Synthetic oligonucleotide
  Target: SCN10A; (+) strand; PAM type: YTN; PAM sequence: CTT
acggaacttttcaaagtcaa

SEQ ID NO: 75727 - DNA, 20 bp, Artificial Sequence
  Description of Artificial Sequence: Synthetic oligonucleotide
  Target: SCN10A; (+) strand; PAM type: YTN; PAM sequence: TTA
cggaacttttcaaagtcaac

SEQ ID NO: 75728 - DNA, 20 bp, Artificial Sequence
  Description of Artificial Sequence: Synthetic oligonucleotide
  Target: SCN10A; (+) strand; PAM type: YTN; PAM sequence: CTT
ttcaaagtcaacctacatta

SEQ ID NO: 75729 - DNA, 20 bp, Artificial Sequence
  Description of Artificial Sequence: Synthetic oligonucleotide
  Target: SCN10A; (+) strand; PAM type: YTN; PAM sequence: TTT
tcaaagtcaacctacattac

SEQ ID NO: 75730 - DNA, 20 bp, Artificial Sequence
  Description of Artificial Sequence: Synthetic oligonucleotide
  Target: SCN10A; (+) strand; PAM type: YTN; PAM sequence: TTT
caaagtcaacctacattaca

SEQ ID NO: 75731 - DNA, 20 bp, Artificial Sequence
  Description of Artificial Sequence: Synthetic oligonucleotide
  Target: SCN10A; (+) strand; PAM type: YTN; PAM sequence: TTC
aaagtcaacctacattacat

SEQ ID NO: 75732 - DNA, 20 bp, Artificial Sequence
  Description of Artificial Sequence: Synthetic oligonucleotide
  Target: SCN10A; (+) strand; PAM type: YTN; PAM sequence: CTA
cattacataattgaacatct

SEQ ID NO: 75733 - DNA, 20 bp, Artificial Sequence
  Description of Artificial Sequence: Synthetic oligonucleotide
  Target: SCN10A; (+) strand; PAM type: YTN; PAM sequence: TTA
cataattgaacatctgtctt

SEQ ID NO: 75734 - DNA, 20 bp, Artificial Sequence
  Description of Artificial Sequence: Synthetic oligonucleotide
  Target: SCN10A; (+) strand; PAM type: YTN; PAM sequence: TTG
aacatctgtcttctattttc

SEQ ID NO: 75735 - DNA, 20 bp, Artificial Sequence
  Description of Artificial Sequence: Synthetic oligonucleotide
  Target: SCN10A; (+) strand; PAM type: YTN; PAM sequence: CTG
tcttctattttcttctaact

SEQ ID NO: 75736 - DNA, 20 bp, Artificial Sequence
  Description of Artificial Sequence: Synthetic oligonucleotide
  Target: SCN10A; (+) strand; PAM type: YTN; PAM sequence: CTT
ctattttcttctaacttaga

SEQ ID NO: 75737 - DNA, 20 bp, Artificial Sequence
  Description of Artificial Sequence: Synthetic oligonucleotide
  Target: SCN10A; (+) strand; PAM type: YTN; PAM sequence: TTC
tattttcttctaacttagaa

SEQ ID NO: 75738 - DNA, 20 bp, Artificial Sequence
  Description of Artificial Sequence: Synthetic oligonucleotide
  Target: SCN10A; (+) strand; PAM type: YTN; PAM sequence: CTA
ttttcttctaacttagaagt

SEQ ID NO: 75739 - DNA, 20 bp, Artificial Sequence
  Description of Artificial Sequence: Synthetic oligonucleotide
  Target: SCN10A; (+) strand; PAM type: YTN; PAM sequence: TTT
tcttctaacttagaagttct

SEQ ID NO: 75740 - DNA, 20 bp, Artificial Sequence
  Description of Artificial Sequence: Synthetic oligonucleotide
  Target: SCN10A; (+) strand; PAM type: YTN; PAM sequence: TTT
cttctaacttagaagttcta

SEQ ID NO: 75741 - DNA, 20 bp, Artificial Sequence
  Description of Artificial Sequence: Synthetic oligonucleotide
  Target: SCN10A; (+) strand; PAM type: YTN; PAM sequence: TTC
ttctaacttagaagttctat

SEQ ID NO: 75742 - DNA, 20 bp, Artificial Sequence
  Description of Artificial Sequence: Synthetic oligonucleotide
  Target: SCN10A; (+) strand; PAM type: YTN; PAM sequence: CTT
ctaacttagaagttctatgt

SEQ ID NO: 75743 - DNA, 20 bp, Artificial Sequence
  Description of Artificial Sequence: Synthetic oligonucleotide
  Target: SCN10A; (+) strand; PAM type: YTN; PAM sequence: TTC
taacttagaagttctatgtg

SEQ ID NO: 75744 - DNA, 20 bp, Artificial Sequence
  Description of Artificial Sequence: Synthetic oligonucleotide
  Target: SCN10A; (+) strand; PAM type: YTN; PAM sequence: CTA
acttagaagttctatgtgtt

SEQ ID NO: 75745 - DNA, 20 bp, Artificial Sequence
  Description of Artificial Sequence: Synthetic oligonucleotide
  Target: SCN10A; (+) strand; PAM type: YTN; PAM sequence: CTT
agaagttctatgtgttgtgt

SEQ ID NO: 75746 - DNA, 20 bp, Artificial Sequence
  Description of Artificial Sequence: Synthetic oligonucleotide
  Target: SCN10A; (+) strand; PAM type: YTN; PAM sequence: TTA
gaagttctatgtgttgtgtg

SEQ ID NO: 75747 - DNA, 20 bp, Artificial Sequence
  Description of Artificial Sequence: Synthetic oligonucleotide
  Target: SCN10A; (+) strand; PAM type: YTN; PAM sequence: TTC
tatgtgttgtgtgcccaaat

SEQ ID NO: 75748 - DNA, 20 bp, Artificial Sequence
  Description of Artificial Sequence: Synthetic oligonucleotide
  Target: SCN10A; (+) strand; PAM type: YTN; PAM sequence: CTA
tgtgttgtgtgcccaaattc

SEQ ID NO: 75749 - DNA, 20 bp, Artificial Sequence
  Description of Artificial Sequence: Synthetic oligonucleotide
  Target: SCN10A; (+) strand; PAM type: YTN; PAM sequence: TTG
tgtgcccaaattctgattaa

SEQ ID NO: 75750 - DNA, 20 bp, Artificial Sequence
  Description of Artificial Sequence: Synthetic oligonucleotide
  Target: SCN10A; (+) strand; PAM type: YTN; PAM sequence: TTC
tgattaacatggtgtattta

SEQ ID NO: 75751 - DNA, 20 bp, Artificial Sequence
  Description of Artificial Sequence: Synthetic oligonucleotide
  Target: SCN10A; (+) strand; PAM type: YTN; PAM sequence: CTG
attaacatggtgtatttatg

SEQ ID NO: 75752 - DNA, 20 bp, Artificial Sequence
  Description of Artificial Sequence: Synthetic oligonucleotide
  Target: SCN10A; (+) strand; PAM type: YTN; PAM sequence: TTA
acatggtgtatttatgcaat

SEQ ID NO: 75753 - DNA, 20 bp, Artificial Sequence
  Description of Artificial Sequence: Synthetic oligonucleotide
  Target: SCN10A; (+) strand; PAM type: YTN; PAM sequence: TTT
atgcaatgaccattcaaaca

SEQ ID NO: 75754 - DNA, 20 bp, Artificial Sequence
  Description of Artificial Sequence: Synthetic oligonucleotide
  Target: SCN10A; (+) strand; PAM type: YTN; PAM sequence: TTA
tgcaatgaccattcaaacac

SEQ ID NO: 75755 - DNA, 20 bp, Artificial Sequence
  Description of Artificial Sequence: Synthetic oligonucleotide
  Target: SCN10A; (+) strand; PAM type: YTN; PAM sequence: TTC
aaacactgttgacttcagtg

SEQ ID NO: 75756 - DNA, 20 bp, Artificial Sequence
  Description of Artificial Sequence: Synthetic oligonucleotide
  Target: SCN10A; (+) strand; PAM type: YTN; PAM sequence: CTG
ttgacttcagtgtctttaat

SEQ ID NO: 75757 - DNA, 20 bp, Artificial Sequence
  Description of Artificial Sequence: Synthetic oligonucleotide
  Target: SCN10A; (+) strand; PAM type: YTN; PAM sequence: TTG
acttcagtgtctttaattct

SEQ ID NO: 75758 - DNA, 20 bp, Artificial Sequence
  Description of Artificial Sequence: Synthetic oligonucleotide
  Target: SCN10A; (+) strand; PAM type: YTN; PAM sequence: CTT
cagtgtctttaattcttccc

SEQ ID NO: 75759 - DNA, 20 bp, Artificial Sequence
  Description of Artificial Sequence: Synthetic oligonucleotide
  Target: SCN10A; (+) strand; PAM type: YTN; PAM sequence: TTC
agtgtctttaattcttccct

SEQ ID NO: 75760 - DNA, 20 bp, Artificial Sequence
  Description of Artificial Sequence: Synthetic oligonucleotide
  Target: SCN10A; (+) strand; PAM type: YTN; PAM sequence: CTT
taattcttcccttctgagaa

SEQ ID NO: 75761 - DNA, 20 bp, Artificial Sequence
  Description of Artificial Sequence: Synthetic oligonucleotide
  Target: SCN10A; (+) strand; PAM type: YTN; PAM sequence: TTT
aattcttcccttctgagaaa

SEQ ID NO: 75762 - DNA, 20 bp, Artificial Sequence
  Description of Artificial Sequence: Synthetic oligonucleotide
  Target: SCN10A; (+) strand; PAM type: YTN; PAM sequence: TTA
attcttcccttctgagaaac

SEQ ID NO: 75763 - DNA, 20 bp, Artificial Sequence
  Description of Artificial Sequence: Synthetic oligonucleotide
  Target: SCN10A; (+) strand; PAM type: YTN; PAM sequence: TTC
ttcccttctgagaaacaaag

SEQ ID NO: 75764 - DNA, 20 bp, Artificial Sequence
  Description of Artificial Sequence: Synthetic oligonucleotide
  Target: SCN10A; (+) strand; PAM type: YTN; PAM sequence: CTT
cccttctgagaaacaaagat

SEQ ID NO: 75765 - DNA, 20 bp, Artificial Sequence
  Description of Artificial Sequence: Synthetic oligonucleotide
  Target: SCN10A; (+) strand; PAM type: YTN; PAM sequence: TTC
ccttctgagaaacaaagatt

SEQ ID NO: 75766 - DNA, 20 bp, Artificial Sequence
  Description of Artificial Sequence: Synthetic oligonucleotide
  Target: SCN10A; (+) strand; PAM type: YTN; PAM sequence: CTT
ctgagaaacaaagattaagt

SEQ ID NO: 75767 - DNA, 20 bp, Artificial Sequence
  Description of Artificial Sequence: Synthetic oligonucleotide
  Target: SCN10A; (+) strand; PAM type: YTN; PAM sequence: TTC
tgagaaacaaagattaagtt

SEQ ID NO: 75768 - DNA, 20 bp, Artificial Sequence
  Description of Artificial Sequence: Synthetic oligonucleotide
  Target: SCN10A; (+) strand; PAM type: YTN; PAM sequence: CTG
agaaacaaagattaagttaa

SEQ ID NO: 75769 - DNA, 20 bp, Artificial Sequence
  Description of Artificial Sequence: Synthetic oligonucleotide
  Target: SCN10A; (+) strand; PAM type: YTN; PAM sequence: TTA
agttaactttctcttccttg

SEQ ID NO: 75770 - DNA, 20 bp, Artificial Sequence
  Description of Artificial Sequence: Synthetic oligonucleotide
  Target: SCN10A; (+) strand; PAM type: YTN; PAM sequence: TTA
actttctcttccttgtctag

SEQ ID NO: 75771 - DNA, 20 bp, Artificial Sequence
  Description of Artificial Sequence: Synthetic oligonucleotide
  Target: SCN10A; (+) strand; PAM type: YTN; PAM sequence: CTT
tctcttccttgtctagggga

SEQ ID NO: 75772 - DNA, 20 bp, Artificial Sequence
  Description of Artificial Sequence: Synthetic oligonucleotide
  Target: SCN10A; (+) strand; PAM type: YTN; PAM sequence: TTT
ctcttccttgtctaggggag

SEQ ID NO: 75773 - DNA, 20 bp, Artificial Sequence
  Description of Artificial Sequence: Synthetic oligonucleotide
  Target: SCN10A; (+) strand; PAM type: YTN; PAM sequence: TTC
tcttccttgtctaggggaga

SEQ ID NO: 75774 - DNA, 20 bp, Artificial Sequence
  Description of Artificial Sequence: Synthetic oligonucleotide
  Target: SCN10A; (+) strand; PAM type: YTN; PAM sequence: CTC
ttccttgtctaggggagaag

SEQ ID NO: 75775 - DNA, 20 bp, Artificial Sequence
  Description of Artificial Sequence: Synthetic oligonucleotide
  Target: SCN10A; (+) strand; PAM type: YTN; PAM sequence: CTT
ccttgtctaggggagaagag

SEQ ID NO: 75776 - DNA, 20 bp, Artificial Sequence
  Description of Artificial Sequence: Synthetic oligonucleotide
  Target: SCN10A; (+) strand; PAM type: YTN; PAM sequence: TTC
cttgtctaggggagaagaga

SEQ ID NO: 75777 - DNA, 20 bp, Artificial Sequence
  Description of Artificial Sequence: Synthetic oligonucleotide
  Target: SCN10A; (+) strand; PAM type: YTN; PAM sequence: CTT
gtctaggggagaagagatac

SEQ ID NO: 75778 - DNA, 20 bp, Artificial Sequence
  Description of Artificial Sequence: Synthetic oligonucleotide
  Target: SCN10A; (+) strand; PAM type: YTN; PAM sequence: TTG
tctaggggagaagagatact

SEQ ID NO: 75779 - DNA, 20 bp, Artificial Sequence
  Description of Artificial Sequence: Synthetic oligonucleotide
  Target: SCN10A; (+) strand; PAM type: YTN; PAM sequence: CTA
ggggagaagagatacttata

SEQ ID NO: 75780 - DNA, 20 bp, Artificial Sequence
  Description of Artificial Sequence: Synthetic oligonucleotide
  Target: SCN10A; (+) strand; PAM type: YTN; PAM sequence: CTT
atagtttggaaccaaatttg

SEQ ID NO: 75781 - DNA, 20 bp, Artificial Sequence
  Description of Artificial Sequence: Synthetic oligonucleotide
  Target: SCN10A; (+) strand; PAM type: YTN; PAM sequence: TTA
tagtttggaaccaaatttga

SEQ ID NO: 75782 - DNA, 20 bp, Artificial Sequence
  Description of Artificial Sequence: Synthetic oligonucleotide
  Target: SCN10A; (+) strand; PAM type: YTN; PAM sequence: TTT
ggaaccaaatttgaatccca

SEQ ID NO: 75783 - DNA, 20 bp, Artificial Sequence
  Description of Artificial Sequence: Synthetic oligonucleotide
  Target: SCN10A; (+) strand; PAM type: YTN; PAM sequence: TTG
gaaccaaatttgaatcccag

SEQ ID NO: 75784 - DNA, 20 bp, Artificial Sequence
  Description of Artificial Sequence: Synthetic oligonucleotide
  Target: SCN10A; (+) strand; PAM type: YTN; PAM sequence: TTT
gaatcccaggactcagttgt

SEQ ID NO: 75785 - DNA, 20 bp, Artificial Sequence
  Description of Artificial Sequence: Synthetic oligonucleotide
  Target: SCN10A; (+) strand; PAM type: YTN; PAM sequence: TTG
aatcccaggactcagttgtt

SEQ ID NO: 75786 - DNA, 20 bp, Artificial Sequence
  Description of Artificial Sequence: Synthetic oligonucleotide
  Target: SCN10A; (+) strand; PAM type: YTN; PAM sequence: CTC
agttgtttagtaacaatgca

SEQ ID NO: 75787 - DNA, 20 bp, Artificial Sequence
  Description of Artificial Sequence: Synthetic oligonucleotide
  Target: SCN10A; (+) strand; PAM type: YTN; PAM sequence: TTG
tttagtaacaatgcaagaat

SEQ ID NO: 75788 - DNA, 20 bp, Artificial Sequence
  Description of Artificial Sequence: Synthetic oligonucleotide
  Target: SCN10A; (+) strand; PAM type: YTN; PAM sequence: TTT
agtaacaatgcaagaattct

SEQ ID NO: 75789 - DNA, 20 bp, Artificial Sequence
  Description of Artificial Sequence: Synthetic oligonucleotide
  Target: SCN10A; (+) strand; PAM type: YTN; PAM sequence: TTA
gtaacaatgcaagaattctc

SEQ ID NO: 75790 - DNA, 20 bp, Artificial Sequence
  Description of Artificial Sequence: Synthetic oligonucleotide
  Target: SCN10A; (+) strand; PAM type: YTN; PAM sequence: TTC
tctcagtgacactggaatgc

SEQ ID NO: 75791 - DNA, 20 bp, Artificial Sequence
  Description of Artificial Sequence: Synthetic oligonucleotide
  Target: SCN10A; (+) strand; PAM type: YTN; PAM sequence: CTC
tcagtgacactggaatgcaa

SEQ ID NO: 75792 - DNA, 20 bp, Artificial Sequence
  Description of Artificial Sequence: Synthetic oligonucleotide
  Target: SCN10A; (+) strand; PAM type: YTN; PAM sequence: CTC
agtgacactggaatgcaatg

SEQ ID NO: 75793 - DNA, 20 bp, Artificial Sequence
  Description of Artificial Sequence: Synthetic oligonucleotide
  Target: SCN10A; (+) strand; PAM type: YTN; PAM sequence: CTG
gaatgcaatgttgaggattg

SEQ ID NO: 75794 - DNA, 20 bp, Artificial Sequence
  Description of Artificial Sequence: Synthetic oligonucleotide
  Target: SCN10A; (+) strand; PAM type: YTN; PAM sequence: TTG
aggattgagaacaggactaa

SEQ ID NO: 75795 - DNA, 20 bp, Artificial Sequence
  Description of Artificial Sequence: Synthetic oligonucleotide
  Target: SCN10A; (+) strand; PAM type: YTN; PAM sequence: TTG
agaacaggactaagccagaa

SEQ ID NO: 75796 - DNA, 20 bp, Artificial Sequence
  Description of Artificial Sequence: Synthetic oligonucleotide
  Target: SCN10A; (+) strand; PAM type: YTN; PAM sequence: CTA
agccagaattccaggtcctg

SEQ ID NO: 75797 - DNA, 20 bp, Artificial Sequence
  Description of Artificial Sequence: Synthetic oligonucleotide
  Target: SCN10A; (+) strand; PAM type: YTN; PAM sequence: TTC
caggtcctggagctggagct

SEQ ID NO: 75798 - DNA, 20 bp, Artificial Sequence
  Description of Artificial Sequence: Synthetic oligonucleotide
  Target: SCN10A; (+) strand; PAM type: YTN; PAM sequence: CTG
gagctggagcttgaggtcaa

SEQ ID NO: 75799 - DNA, 20 bp, Artificial Sequence
  Description of Artificial Sequence: Synthetic oligonucleotide
  Target: SCN10A; (+) strand; PAM type: YTN; PAM sequence: CTG
gagcttgaggtcaaagcaga

SEQ ID NO: 75800 - DNA, 20 bp, Artificial Sequence
  Description of Artificial Sequence: Synthetic oligonucleotide
  Target: SCN10A; (+) strand; PAM type: YTN; PAM sequence: CTT
gaggtcaaagcagactcagc

SEQ ID NO: 75801 - DNA, 20 bp, Artificial Sequence
  Description of Artificial Sequence: Synthetic oligonucleotide
  Target: SCN10A; (+) strand; PAM type: YTN; PAM sequence: TTG
aggtcaaagcagactcagct

SEQ ID NO: 75802 - DNA, 20 bp, Artificial Sequence
  Description of Artificial Sequence: Synthetic oligonucleotide
  Target: SCN10A; (+) strand; PAM type: YTN; PAM sequence: CTC
agctatgagactgacttcat

SEQ ID NO: 75803 - DNA, 20 bp, Artificial Sequence
  Description of Artificial Sequence: Synthetic oligonucleotide
  Target: SCN10A; (+) strand; PAM type: YTN; PAM sequence: CTA
tgagactgacttcatgccaa

SEQ ID NO: 75804 - DNA, 20 bp, Artificial Sequence
  Description of Artificial Sequence: Synthetic oligonucleotide
  Target: SCN10A; (+) strand; PAM type: YTN; PAM sequence: CTG
acttcatgccaaatgaccat

SEQ ID NO: 75805 - DNA, 20 bp, Artificial Sequence
  Description of Artificial Sequence: Synthetic oligonucleotide
  Target: SCN10A; (+) strand; PAM type: YTN; PAM sequence: CTT
catgccaaatgaccataatt

SEQ ID NO: 75806 - DNA, 20 bp, Artificial Sequence
  Description of Artificial Sequence: Synthetic oligonucleotide
  Target: SCN10A; (+) strand; PAM type: YTN; PAM sequence: TTC
atgccaaatgaccataatta

SEQ ID NO: 75807 - DNA, 20 bp, Artificial Sequence
  Description of Artificial Sequence: Synthetic oligonucleotide
  Target: SCN10A; (+) strand; PAM type: YTN; PAM sequence: TTA
ttctgggctaccataaatcc

SEQ ID NO: 75808 - DNA, 20 bp, Artificial Sequence
  Description of Artificial Sequence: Synthetic oligonucleotide
  Target: SCN10A; (+) strand; PAM type: YTN; PAM sequence: TTC
tgggctaccataaatccctc

SEQ ID NO: 75809 - DNA, 20 bp, Artificial Sequence
  Description of Artificial Sequence: Synthetic oligonucleotide
  Target: SCN10A; (+) strand; PAM type: YTN; PAM sequence: CTG
ggctaccataaatccctcca

SEQ ID NO: 75810 - DNA, 20 bp, Artificial Sequence
  Description of Artificial Sequence: Synthetic oligonucleotide
  Target: SCN10A; (+) strand; PAM type: YTN; PAM sequence: CTA
ccataaatccctccagctaa

SEQ ID NO: 75811 - DNA, 20 bp, Artificial Sequence
  Description of Artificial Sequence: Synthetic oligonucleotide
  Target: SCN10A; (+) strand; PAM type: YTN; PAM sequence: CTC
cagctaaggacaaaattgtt

SEQ ID NO: 75812 - DNA, 20 bp, Artificial Sequence
  Description of Artificial Sequence: Synthetic oligonucleotide
  Target: SCN10A; (+) strand; PAM type: YTN; PAM sequence: CTA
aggacaaaattgttttcaac

SEQ ID NO: 75813 - DNA, 20 bp, Artificial Sequence
  Description of Artificial Sequence: Synthetic oligonucleotide
  Target: SCN10A; (+) strand; PAM type: YTN; PAM sequence: TTG
ttttcaacattggggtggga

SEQ ID NO: 75814 - DNA, 20 bp, Artificial Sequence
  Description of Artificial Sequence: Synthetic oligonucleotide
  Target: SCN10A; (+) strand; PAM type: YTN; PAM sequence: TTT
tcaacattggggtgggaatt

SEQ ID NO: 75815 - DNA, 20 bp, Artificial Sequence
  Description of Artificial Sequence: Synthetic oligonucleotide
  Target: SCN10A; (+) strand; PAM type: YTN; PAM sequence: TTT
caacattggggtgggaattt

SEQ ID NO: 75816 - DNA, 20 bp, Artificial Sequence
  Description of Artificial Sequence: Synthetic oligonucleotide
  Target: SCN10A; (+) strand; PAM type: YTN; PAM sequence: TTC
aacattggggtgggaatttg

SEQ ID NO: 75817 - DNA, 20 bp, Artificial Sequence
  Description of Artificial Sequence: Synthetic oligonucleotide
  Target: SCN10A; (+) strand; PAM type: YTN; PAM sequence: TTG
gggtgggaatttgtagtgat

SEQ ID NO: 75818 - DNA, 20 bp, Artificial Sequence
  Description of Artificial Sequence: Synthetic oligonucleotide
  Target: SCN10A; (+) strand; PAM type: YTN; PAM sequence: TTT
gtagtgatgtgatgtaggta

SEQ ID NO: 75819 - DNA, 20 bp, Artificial Sequence
  Description of Artificial Sequence: Synthetic oligonucleotide
  Target: SCN10A; (+) strand; PAM type: YTN; PAM sequence: TTG
tagtgatgtgatgtaggtat

SEQ ID NO: 75820 - DNA, 20 bp, Artificial Sequence
  Description of Artificial Sequence: Synthetic oligonucleotide
  Target: SCN10A; (+) strand; PAM type: YTN; PAM sequence: CTT
cttttaagactttcccatca

SEQ ID NO: 75821 - DNA, 20 bp, Artificial Sequence
  Description of Artificial Sequence: Synthetic oligonucleotide
  Target: SCN10A; (+) strand; PAM type: YTN; PAM sequence: TTC
ttttaagactttcccatcag

SEQ ID NO: 75822 - DNA, 20 bp, Artificial Sequence
  Description of Artificial Sequence: Synthetic oligonucleotide
  Target: SCN10A; (+) strand; PAM type: YTN; PAM sequence: CTT
ttaagactttcccatcagaa

SEQ ID NO: 75823 - DNA, 20 bp, Artificial Sequence
  Description of Artificial Sequence: Synthetic oligonucleotide
  Target: SCN10A; (+) strand; PAM type: YTN; PAM sequence: TTT
taagactttcccatcagaag

SEQ ID NO: 75824 - DNA, 20 bp, Artificial Sequence
  Description of Artificial Sequence: Synthetic oligonucleotide
  Target: SCN10A; (+) strand; PAM type: YTN; PAM sequence: TTT
aagactttcccatcagaagt

SEQ ID NO: 75825 - DNA, 20 bp, Artificial Sequence
  Description of Artificial Sequence: Synthetic oligonucleotide
  Target: SCN10A; (+) strand; PAM type: YTN; PAM sequence: TTA
agactttcccatcagaagtg

SEQ ID NO: 75826 - DNA, 20 bp, Artificial Sequence
  Description of Artificial Sequence: Synthetic oligonucleotide
  Target: SCN10A; (+) strand; PAM type: YTN; PAM sequence: CTT
tcccatcagaagtgatagct

SEQ ID NO: 75827 - DNA, 20 bp, Artificial Sequence
  Description of Artificial Sequence: Synthetic oligonucleotide
  Target: SCN10A; (+) strand; PAM type: YTN; PAM sequence: TTT
cccatcagaagtgatagctc

SEQ ID NO: 75828 - DNA, 20 bp, Artificial Sequence
  Description of Artificial Sequence: Synthetic oligonucleotide
  Target: SCN10A; (+) strand; PAM type: YTN; PAM sequence: TTC
ccatcagaagtgatagctct

SEQ ID NO: 75829 - DNA, 20 bp, Artificial Sequence
  Description of Artificial Sequence: Synthetic oligonucleotide
  Target: SCN10A; (+) strand; PAM type: YTN; PAM sequence: CTC
tggacttgggatcccttgat

SEQ ID NO: 75830 - DNA, 20 bp, Artificial Sequence
  Description of Artificial Sequence: Synthetic oligonucleotide
  Target: SCN10A; (+) strand; PAM type: YTN; PAM sequence: CTG
gacttgggatcccttgattg

SEQ ID NO: 75831 - DNA, 20 bp, Artificial Sequence
  Description of Artificial Sequence: Synthetic oligonucleotide
  Target: SCN10A; (+) strand; PAM type: YTN; PAM sequence: CTT
gggatcccttgattgaagtg

SEQ ID NO: 75832 - DNA, 20 bp, Artificial Sequence
  Description of Artificial Sequence: Synthetic oligonucleotide
  Target: SCN10A; (+) strand; PAM type: YTN; PAM sequence: TTG
ggatcccttgattgaagtgg

SEQ ID NO: 75833 - DNA, 20 bp, Artificial Sequence
  Description of Artificial Sequence: Synthetic oligonucleotide
  Target: SCN10A; (+) strand; PAM type: YTN; PAM sequence: CTT
gattgaagtggttctctata

SEQ ID NO: 75834 - DNA, 20 bp, Artificial Sequence
  Description of Artificial Sequence: Synthetic oligonucleotide
  Target: SCN10A; (+) strand; PAM type: YTN; PAM sequence: TTG
attgaagtggttctctatat

SEQ ID NO: 75835 - DNA, 20 bp, Artificial Sequence
  Description of Artificial Sequence: Synthetic oligonucleotide
  Target: SCN10A; (+) strand; PAM type: YTN; PAM sequence: TTG
aagtggttctctatattccc

SEQ ID NO: 75836 - DNA, 20 bp, Artificial Sequence
  Description of Artificial Sequence: Synthetic oligonucleotide
  Target: SCN10A; (+) strand; PAM type: YTN; PAM sequence: TTC
tctatattcccatctattac

SEQ ID NO: 75837 - DNA, 20 bp, Artificial Sequence
  Description of Artificial Sequence: Synthetic oligonucleotide
  Target: SCN10A; (+) strand; PAM type: YTN; PAM sequence: CTC
tatattcccatctattaccc

SEQ ID NO: 75838 - DNA, 20 bp, Artificial Sequence
  Description of Artificial Sequence: Synthetic oligonucleotide
  Target: SCN10A; (+) strand; PAM type: YTN; PAM sequence: CTA
tattcccatctattacccag

SEQ ID NO: 75839 - DNA, 20 bp, Artificial Sequence
  Description of Artificial Sequence: Synthetic oligonucleotide
  Target: SCN10A; (+) strand; PAM type: YTN; PAM sequence: TTC
ccatctattacccagtgtct

SEQ ID NO: 75840 - DNA, 20 bp, Artificial Sequence
  Description of Artificial Sequence: Synthetic oligonucleotide
  Target: SCN10A; (+) strand; PAM type: YTN; PAM sequence: CTA
ttacccagtgtctttacatg

SEQ ID NO: 75841 - DNA, 20 bp, Artificial Sequence
  Description of Artificial Sequence: Synthetic oligonucleotide
  Target: SCN10A; (+) strand; PAM type: YTN; PAM sequence: TTA
cccagtgtctttacatgaca

SEQ ID NO: 75842 - DNA, 20 bp, Artificial Sequence
  Description of Artificial Sequence: Synthetic oligonucleotide
  Target: SCN10A; (+) strand; PAM type: YTN; PAM sequence: CTT
tacatgacattctgagaaaa

SEQ ID NO: 75843 - DNA, 20 bp, Artificial Sequence
  Description of Artificial Sequence: Synthetic oligonucleotide
  Target: SCN10A; (+) strand; PAM type: YTN; PAM sequence: TTT
acatgacattctgagaaaac

SEQ ID NO: 75844 - DNA, 20 bp, Artificial Sequence
  Description of Artificial Sequence: Synthetic oligonucleotide
  Target: SCN10A; (+) strand; PAM type: YTN; PAM sequence: TTA
catgacattctgagaaaact

SEQ ID NO: 75845 - DNA, 20 bp, Artificial Sequence
  Description of Artificial Sequence: Synthetic oligonucleotide
  Target: SCN10A; (+) strand; PAM type: YTN; PAM sequence: TTC
tgagaaaactattggggtgc

SEQ ID NO: 75846 - DNA, 20 bp, Artificial Sequence
  Description of Artificial Sequence: Synthetic oligonucleotide
  Target: SCN10A; (+) strand; PAM type: YTN; PAM sequence: CTG
agaaaactattggggtgcaa

SEQ ID NO: 75847 - DNA, 20 bp, Artificial Sequence
  Description of Artificial Sequence: Synthetic oligonucleotide
  Target: SCN10A; (+) strand; PAM type: YTN; PAM sequence: CTA
ttggggtgcaagtagtttat

SEQ ID NO: 75848 - DNA, 20 bp, Artificial Sequence
  Description of Artificial Sequence: Synthetic oligonucleotide
  Target: SCN10A; (+) strand; PAM type: YTN; PAM sequence: TTG
gggtgcaagtagtttatctg

SEQ ID NO: 75849 - DNA, 20 bp, Artificial Sequence
  Description of Artificial Sequence: Synthetic oligonucleotide
  Target: SCN10A; (+) strand; PAM type: YTN; PAM sequence: TTT
atctgagagctatttctagg

SEQ ID NO: 75850 - DNA, 20 bp, Artificial Sequence
  Description of Artificial Sequence: Synthetic oligonucleotide
  Target: SCN10A; (+) strand; PAM type: YTN; PAM sequence: TTA
tctgagagctatttctagga

SEQ ID NO: 75851 - DNA, 20 bp, Artificial Sequence
  Description of Artificial Sequence: Synthetic oligonucleotide
  Target: SCN10A; (+) strand; PAM type: YTN; PAM sequence: CTG
agagctatttctaggaatgt

SEQ ID NO: 75852 - DNA, 20 bp, Artificial Sequence
  Description of Artificial Sequence: Synthetic oligonucleotide
  Target: SCN10A; (+) strand; PAM type: YTN; PAM sequence: CTA
tttctaggaatgtcatagaa

SEQ ID NO: 75853 - DNA, 20 bp, Artificial Sequence
  Description of Artificial Sequence: Synthetic oligonucleotide
  Target: SCN10A; (+) strand; PAM type: YTN; PAM sequence: TTT
ctaggaatgtcatagaagag

SEQ ID NO: 75854 - DNA, 20 bp, Artificial Sequence
  Description of Artificial Sequence: Synthetic oligonucleotide
  Target: SCN10A; (+) strand; PAM type: YTN; PAM sequence: TTC
taggaatgtcatagaagaga

SEQ ID NO: 75855 - DNA, 20 bp, Artificial Sequence
  Description of Artificial Sequence: Synthetic oligonucleotide
  Target: SCN10A; (+) strand; PAM type: YTN; PAM sequence: CTA
ggaatgtcatagaagagagg

SEQ ID NO: 75856 - DNA, 20 bp, Artificial Sequence
  Description of Artificial Sequence: Synthetic oligonucleotide
  Target: SCN10A; (+) strand; PAM type: YTN; PAM sequence: TTT
ttatgagccatttactctta

SEQ ID NO: 75857 - DNA, 20 bp, Artificial Sequence
  Description of Artificial Sequence: Synthetic oligonucleotide
  Target: SCN10A; (+) strand; PAM type: YTN; PAM sequence: TTT
tatgagccatttactcttat

SEQ ID NO: 75858 - DNA, 20 bp, Artificial Sequence
  Description of Artificial Sequence: Synthetic oligonucleotide
  Target: SCN10A; (+) strand; PAM type: YTN; PAM sequence: TTT
atgagccatttactcttatg

SEQ ID NO: 75859 - DNA, 20 bp, Artificial Sequence
  Description of Artificial Sequence: Synthetic oligonucleotide
  Target: SCN10A; (+) strand; PAM type: YTN; PAM sequence: TTA
tgagccatttactcttatgg

SEQ ID NO: 75860 - DNA, 20 bp, Artificial Sequence
  Description of Artificial Sequence: Synthetic oligonucleotide
  Target: SCN10A; (+) strand; PAM type: YTN; PAM sequence: TTT
actcttatgggcaaactggg

SEQ ID NO: 75861 - DNA, 20 bp, Artificial Sequence
  Description of Artificial Sequence: Synthetic oligonucleotide
  Target: SCN10A; (+) strand; PAM type: YTN; PAM sequence: TTA
ctcttatgggcaaactgggc

SEQ ID NO: 75862 - DNA, 20 bp, Artificial Sequence
  Description of Artificial Sequence: Synthetic oligonucleotide
  Target: SCN10A; (+) strand; PAM type: YTN; PAM sequence: CTC
ttatgggcaaactgggctca

SEQ ID NO: 75863 - DNA, 20 bp, Artificial Sequence
  Description of Artificial Sequence: Synthetic oligonucleotide
  Target: SCN10A; (+) strand; PAM type: YTN; PAM sequence: CTT
atgggcaaactgggctcaga

SEQ ID NO: 75864 - DNA, 20 bp, Artificial Sequence
  Description of Artificial Sequence: Synthetic oligonucleotide
  Target: SCN10A; (+) strand; PAM type: YTN; PAM sequence: TTA
tgggcaaactgggctcagaa

SEQ ID NO: 75865 - DNA, 20 bp, Artificial Sequence
  Description of Artificial Sequence: Synthetic oligonucleotide
  Target: SCN10A; (+) strand; PAM type: YTN; PAM sequence: CTG
ggctcagaattgtttcactg

SEQ ID NO: 75866 - DNA, 20 bp, Artificial Sequence
  Description of Artificial Sequence: Synthetic oligonucleotide
  Target: SCN10A; (+) strand; PAM type: YTN; PAM sequence: CTC
agaattgtttcactgagggg

SEQ ID NO: 75867 - DNA, 20 bp, Artificial Sequence
  Description of Artificial Sequence: Synthetic oligonucleotide
  Target: SCN10A; (+) strand; PAM type: YTN; PAM sequence: TTG
tttcactgaggggtaaggat

SEQ ID NO: 75868 - DNA, 20 bp, Artificial Sequence
  Description of Artificial Sequence: Synthetic oligonucleotide
  Target: SCN10A; (+) strand; PAM type: YTN; PAM sequence: TTT
cactgaggggtaaggatact

SEQ ID NO: 75869 - DNA, 20 bp, Artificial Sequence
  Description of Artificial Sequence: Synthetic oligonucleotide
  Target: SCN10A; (+) strand; PAM type: YTN; PAM sequence: TTC
actgaggggtaaggatacta

SEQ ID NO: 75870 - DNA, 20 bp, Artificial Sequence
  Description of Artificial Sequence: Synthetic oligonucleotide
  Target: SCN10A; (+) strand; PAM type: YTN; PAM sequence: CTG
aggggtaaggatactagggt

SEQ ID NO: 75871 - DNA, 20 bp, Artificial Sequence
  Description of Artificial Sequence: Synthetic oligonucleotide
  Target: SCN10A; (+) strand; PAM type: YTN; PAM sequence: CTA
gggttttatctaccagtcct

SEQ ID NO: 75872 - DNA, 20 bp, Artificial Sequence
  Description of Artificial Sequence: Synthetic oligonucleotide
  Target: SCN10A; (+) strand; PAM type: YTN; PAM sequence: TTT
tatctaccagtcctgtccct

SEQ ID NO: 75873 - DNA, 20 bp, Artificial Sequence
  Description of Artificial Sequence: Synthetic oligonucleotide
  Target: SCN10A; (+) strand; PAM type: YTN; PAM sequence: TTT
atctaccagtcctgtccctt

SEQ ID NO: 75874 - DNA, 20 bp, Artificial Sequence
  Description of Artificial Sequence: Synthetic oligonucleotide
  Target: SCN10A; (+) strand; PAM type: YTN; PAM sequence: TTA
tctaccagtcctgtccctta

SEQ ID NO: 75875 - DNA, 20 bp, Artificial Sequence
  Description of Artificial Sequence: Synthetic oligonucleotide
  Target: SCN10A; (+) strand; PAM type: YTN; PAM sequence: CTA
ccagtcctgtcccttattgg

SEQ ID NO: 75876 - DNA, 20 bp, Artificial Sequence
  Description of Artificial Sequence: Synthetic oligonucleotide
  Target: SCN10A; (+) strand; PAM type: YTN; PAM sequence: CTG
tcccttattggttgacggtt

SEQ ID NO: 75877 - DNA, 20 bp, Artificial Sequence
  Description of Artificial Sequence: Synthetic oligonucleotide
  Target: SCN10A; (+) strand; PAM type: YTN; PAM sequence: CTT
attggttgacggttgtcctg

SEQ ID NO: 75878 - DNA, 20 bp, Artificial Sequence
  Description of Artificial Sequence: Synthetic oligonucleotide
  Target: SCN10A; (+) strand; PAM type: YTN; PAM sequence: TTA
ttggttgacggttgtcctgg

SEQ ID NO: 75879 - DNA, 20 bp, Artificial Sequence
  Description of Artificial Sequence: Synthetic oligonucleotide
  Target: SCN10A; (+) strand; PAM type: YTN; PAM sequence: TTG
gttgacggttgtcctgggat

SEQ ID NO: 75880 - DNA, 20 bp, Artificial Sequence
  Description of Artificial Sequence: Synthetic oligonucleotide
  Target: SCN10A; (+) strand; PAM type: YTN; PAM sequence: TTG
acggttgtcctgggatttta

SEQ ID NO: 75881 - DNA, 20 bp, Artificial Sequence
  Description of Artificial Sequence: Synthetic oligonucleotide
  Target: SCN10A; (+) strand; PAM type: YTN; PAM sequence: TTG
tcctgggattttaactctac

SEQ ID NO: 75882 - DNA, 20 bp, Artificial Sequence
  Description of Artificial Sequence: Synthetic oligonucleotide
  Target: SCN10A; (+) strand; PAM type: YTN; PAM sequence: CTG
ggattttaactctacagaac

SEQ ID NO: 75883 - DNA, 20 bp, Artificial Sequence
  Description of Artificial Sequence: Synthetic oligonucleotide
  Target: SCN10A; (+) strand; PAM type: YTN; PAM sequence: TTT
taactctacagaacttactt

SEQ ID NO: 75884 - DNA, 20 bp, Artificial Sequence
  Description of Artificial Sequence: Synthetic oligonucleotide
  Target: SCN10A; (+) strand; PAM type: YTN; PAM sequence: TTT
aactctacagaacttacttc

SEQ ID NO: 75885 - DNA, 20 bp, Artificial Sequence
  Description of Artificial Sequence: Synthetic oligonucleotide
  Target: SCN10A; (+) strand; PAM type: YTN; PAM sequence: TTA
actctacagaacttacttca

SEQ ID NO: 75886 - DNA, 20 bp, Artificial Sequence
  Description of Artificial Sequence: Synthetic oligonucleotide
  Target: SCN10A; (+) strand; PAM type: YTN; PAM sequence: CTC
tacagaacttacttcagtgg

SEQ ID NO: 75887 - DNA, 20 bp, Artificial Sequence
  Description of Artificial Sequence: Synthetic oligonucleotide
  Target: SCN10A; (+) strand; PAM type: YTN; PAM sequence: CTA
cagaacttacttcagtggcc

SEQ ID NO: 75888 - DNA, 20 bp, Artificial Sequence
  Description of Artificial Sequence: Synthetic oligonucleotide
  Target: SCN10A; (+) strand; PAM type: YTN; PAM sequence: CTT
acttcagtggccagagaaag

SEQ ID NO: 75889 - DNA, 20 bp, Artificial Sequence
  Description of Artificial Sequence: Synthetic oligonucleotide
  Target: SCN10A; (+) strand; PAM type: YTN; PAM sequence: TTA
cttcagtggccagagaaagc

SEQ ID NO: 75890 - DNA, 20 bp, Artificial Sequence
  Description of Artificial Sequence: Synthetic oligonucleotide
  Target: SCN10A; (+) strand; PAM type: YTN; PAM sequence: CTT
cagtggccagagaaagccct

SEQ ID NO: 75891 - DNA, 20 bp, Artificial Sequence
  Description of Artificial Sequence: Synthetic oligonucleotide
  Target: SCN10A; (+) strand; PAM type: YTN; PAM sequence: TTC
agtggccagagaaagccctg

SEQ ID NO: 75892 - DNA, 20 bp, Artificial Sequence
  Description of Artificial Sequence: Synthetic oligonucleotide
  Target: SCN10A; (+) strand; PAM type: YTN; PAM sequence: CTG
ggcagacagaggcaggaagt

SEQ ID NO: 75893 - DNA, 20 bp, Artificial Sequence
  Description of Artificial Sequence: Synthetic oligonucleotide
  Target: SCN10A; (+) strand; PAM type: YTN; PAM sequence: CTG
ctggtgacctctggtctaga

SEQ ID NO: 75894 - DNA, 20 bp, Artificial Sequence
  Description of Artificial Sequence: Synthetic oligonucleotide
  Target: SCN10A; (+) strand; PAM type: YTN; PAM sequence: CTG
gtgacctctggtctagatcc

SEQ ID NO: 75895 - DNA, 20 bp, Artificial Sequence
  Description of Artificial Sequence: Synthetic oligonucleotide
  Target: SCN10A; (+) strand; PAM type: YTN; PAM sequence: CTC
tggtctagatccctgggaaa

SEQ ID NO: 75896 - DNA, 20 bp, Artificial Sequence
  Description of Artificial Sequence: Synthetic oligonucleotide
  Target: SCN10A; (+) strand; PAM type: YTN; PAM sequence: CTG
gtctagatccctgggaaatg

SEQ ID NO: 75897 - DNA, 20 bp, Artificial Sequence
  Description of Artificial Sequence: Synthetic oligonucleotide
  Target: SCN10A; (+) strand; PAM type: YTN; PAM sequence: CTA
gatccctgggaaatgagcaa

SEQ ID NO: 75898 - DNA, 20 bp, Artificial Sequence
  Description of Artificial Sequence: Synthetic oligonucleotide
  Target: SCN10A; (+) strand; PAM type: YTN; PAM sequence: CTG
ggaaatgagcaaggtgcaga

SEQ ID NO: 75899 - DNA, 20 bp, Artificial Sequence
  Description of Artificial Sequence: Synthetic oligonucleotide
  Target: SCN10A; (+) strand; PAM type: YTN; PAM sequence: CTA
tagtccttgcaaccttaatt

SEQ ID NO: 75900 - DNA, 20 bp, Artificial Sequence
  Description of Artificial Sequence: Synthetic oligonucleotide
  Target: SCN10A; (+) strand; PAM type: YTN; PAM sequence: CTT
gcaaccttaattgggaatcc

SEQ ID NO: 75901 - DNA, 20 bp, Artificial Sequence
  Description of Artificial Sequence: Synthetic oligonucleotide
  Target: SCN10A; (+) strand; PAM type: YTN; PAM sequence: TTG
caaccttaattgggaatccc

SEQ ID NO: 75902 - DNA, 20 bp, Artificial Sequence
  Description of Artificial Sequence: Synthetic oligonucleotide
  Target: SCN10A; (+) strand; PAM type: YTN; PAM sequence: CTT
aattgggaatccctatttta

SEQ ID NO: 75903 - DNA, 20 bp, Artificial Sequence
  Description of Artificial Sequence: Synthetic oligonucleotide
  Target: SCN10A; (+) strand; PAM type: YTN; PAM sequence: TTA
attgggaatccctattttag

SEQ ID NO: 75904 - DNA, 20 bp, Artificial Sequence
  Description of Artificial Sequence: Synthetic oligonucleotide
  Target: SCN10A; (+) strand; PAM type: YTN; PAM sequence: TTG
ggaatccctattttagagtc

SEQ ID NO: 75905 - DNA, 20 bp, Artificial Sequence
  Description of Artificial Sequence: Synthetic oligonucleotide
  Target: SCN10A; (+) strand; PAM type: YTN; PAM sequence: CTA
ttttagagtctagttgaatg

SEQ ID NO: 75906 - DNA, 20 bp, Artificial Sequence
  Description of Artificial Sequence: Synthetic oligonucleotide
  Target: SCN10A; (+) strand; PAM type: YTN; PAM sequence: TTT
tagagtctagttgaatgtag

SEQ ID NO: 75907 - DNA, 20 bp, Artificial Sequence
  Description of Artificial Sequence: Synthetic oligonucleotide
  Target: SCN10A; (+) strand; PAM type: YTN; PAM sequence: TTT
agagtctagttgaatgtagt

SEQ ID NO: 75908 - DNA, 20 bp, Artificial Sequence
  Description of Artificial Sequence: Synthetic oligonucleotide
  Target: SCN10A; (+) strand; PAM type: YTN; PAM sequence: TTA
gagtctagttgaatgtagtg

SEQ ID NO: 75909 - DNA, 20 bp, Artificial Sequence
  Description of Artificial Sequence: Synthetic oligonucleotide
  Target: SCN10A; (+) strand; PAM type: YTN; PAM sequence: CTA
gttgaatgtagtggggaaag

SEQ ID NO: 75910 - DNA, 20 bp, Artificial Sequence
  Description of Artificial Sequence: Synthetic oligonucleotide
  Target: SCN10A; (+) strand; PAM type: YTN; PAM sequence: TTG
aatgtagtggggaaagcaca

SEQ ID NO: 75911 - DNA, 20 bp, Artificial Sequence
  Description of Artificial Sequence: Synthetic oligonucleotide
  Target: SCN10A; (+) strand; PAM type: YTN; PAM sequence: CTT
tgtgaggtagccatatcaaa

SEQ ID NO: 75912 - DNA, 20 bp, Artificial Sequence
  Description of Artificial Sequence: Synthetic oligonucleotide
  Target: SCN10A; (+) strand; PAM type: YTN; PAM sequence: TTT
gtgaggtagccatatcaaat

SEQ ID NO: 75913 - DNA, 20 bp, Artificial Sequence
  Description of Artificial Sequence: Synthetic oligonucleotide
  Target: SCN10A; (+) strand; PAM type: YTN; PAM sequence: TTG
tgaggtagccatatcaaatg

SEQ ID NO: 75914 - DNA, 20 bp, Artificial Sequence
  Description of Artificial Sequence: Synthetic oligonucleotide
  Target: SCN10A; (+) strand; PAM type: YTN; PAM sequence: TTA
taggattagtctgggcctga

SEQ ID NO: 75915 - DNA, 20 bp, Artificial Sequence
  Description of Artificial Sequence: Synthetic oligonucleotide
  Target: SCN10A; (+) strand; PAM type: YTN; PAM sequence: TTA
gtctgggcctgatactcact

SEQ ID NO: 75916 - DNA, 20 bp, Artificial Sequence
  Description of Artificial Sequence: Synthetic oligonucleotide
  Target: SCN10A; (+) strand; PAM type: YTN; PAM sequence: CTG
ggcctgatactcacttcttg

SEQ ID NO: 75917 - DNA, 20 bp, Artificial Sequence
  Description of Artificial Sequence: Synthetic oligonucleotide
  Target: SCN10A; (+) strand; PAM type: YTN; PAM sequence: CTG
atactcacttcttggattaa

SEQ ID NO: 75918 - DNA, 20 bp, Artificial Sequence
  Description of Artificial Sequence: Synthetic oligonucleotide
  Target: SCN10A; (+) strand; PAM type: YTN; PAM sequence: CTC
acttcttggattaatggctg

SEQ ID NO: 75919 - DNA, 20 bp, Artificial Sequence
  Description of Artificial Sequence: Synthetic oligonucleotide
  Target: SCN10A; (+) strand; PAM type: YTN; PAM sequence: CTT
cttggattaatggctgagga

SEQ ID NO: 75920 - DNA, 20 bp, Artificial Sequence
  Description of Artificial Sequence: Synthetic oligonucleotide
  Target: SCN10A; (+) strand; PAM type: YTN; PAM sequence: TTC
ttggattaatggctgaggag

SEQ ID NO: 75921 - DNA, 20 bp, Artificial Sequence
  Description of Artificial Sequence: Synthetic oligonucleotide
  Target: SCN10A; (+) strand; PAM type: YTN; PAM sequence: CTT
ggattaatggctgaggagga

SEQ ID NO: 75922 - DNA, 20 bp, Artificial Sequence
  Description of Artificial Sequence: Synthetic oligonucleotide
  Target: SCN10A; (+) strand; PAM type: YTN; PAM sequence: TTG
gattaatggctgaggaggag

SEQ ID NO: 75923 - DNA, 20 bp, Artificial Sequence
  Description of Artificial Sequence: Synthetic oligonucleotide
  Target: SCN10A; (+) strand; PAM type: YTN; PAM sequence: TTA
atggctgaggaggagacaat

SEQ ID NO: 75924 - DNA, 20 bp, Artificial Sequence
  Description of Artificial Sequence: Synthetic oligonucleotide
  Target: SCN10A; (+) strand; PAM type: YTN; PAM sequence: CTG
aggaggagacaatccaagaa

SEQ ID NO: 75925 - DNA, 20 bp, Artificial Sequence
  Description of Artificial Sequence: Synthetic oligonucleotide
  Target: SCN10A; (+) strand; PAM type: YTN; PAM sequence: CTA
ttctagtttagctccaagct

SEQ ID NO: 75926 - DNA, 20 bp, Artificial Sequence
  Description of Artificial Sequence: Synthetic oligonucleotide
  Target: SCN10A; (+) strand; PAM type: YTN; PAM sequence: TTC
tagtttagctccaagctcgg

SEQ ID NO: 75927 - DNA, 20 bp, Artificial Sequence
  Description of Artificial Sequence: Synthetic oligonucleotide
  Target: SCN10A; (+) strand; PAM type: YTN; PAM sequence: CTA
gtttagctccaagctcggcc

SEQ ID NO: 75928 - DNA, 20 bp, Artificial Sequence
  Description of Artificial Sequence: Synthetic oligonucleotide
  Target: SCN10A; (+) strand; PAM type: YTN; PAM sequence: TTT
agctccaagctcggccctgg

SEQ ID NO: 75929 - DNA, 20 bp, Artificial Sequence
  Description of Artificial Sequence: Synthetic oligonucleotide
  Target: SCN10A; (+) strand; PAM type: YTN; PAM sequence: TTA
gctccaagctcggccctggc

SEQ ID NO: 75930 - DNA, 20 bp, Artificial Sequence
  Description of Artificial Sequence: Synthetic oligonucleotide
  Target: SCN10A; (+) strand; PAM type: YTN; PAM sequence: CTC
caagctcggccctggctttc

SEQ ID NO: 75931 - DNA, 20 bp, Artificial Sequence
  Description of Artificial Sequence: Synthetic oligonucleotide
  Target: SCN10A; (+) strand; PAM type: YTN; PAM sequence: CTC
ggccctggctttcaaacagt

SEQ ID NO: 75932 - DNA, 20 bp, Artificial Sequence
  Description of Artificial Sequence: Synthetic oligonucleotide
  Target: SCN10A; (+) strand; PAM type: YTN; PAM sequence: CTG
gctttcaaacagtctgcatg

SEQ ID NO: 75933 - DNA, 20 bp, Artificial Sequence
  Description of Artificial Sequence: Synthetic oligonucleotide
  Target: SCN10A; (+) strand; PAM type: YTN; PAM sequence: CTT
tcaaacagtctgcatgagtt

SEQ ID NO: 75934 - DNA, 20 bp, Artificial Sequence
  Description of Artificial Sequence: Synthetic oligonucleotide
  Target: SCN10A; (+) strand; PAM type: YTN; PAM sequence: TTT
caaacagtctgcatgagttt

SEQ ID NO: 75935 - DNA, 20 bp, Artificial Sequence
  Description of Artificial Sequence: Synthetic oligonucleotide
  Target: SCN10A; (+) strand; PAM type: YTN; PAM sequence: TTC
aaacagtctgcatgagtttt

SEQ ID NO: 75936 - DNA, 20 bp, Artificial Sequence
  Description of Artificial Sequence: Synthetic oligonucleotide
  Target: SCN10A; (+) strand; PAM type: YTN; PAM sequence: CTG
catgagtttttgcaggtata

SEQ ID NO: 75937 - DNA, 20 bp, Artificial Sequence
  Description of Artificial Sequence: Synthetic oligonucleotide
  Target: SCN10A; (+) strand; PAM type: YTN; PAM sequence: TTT
ttgcaggtatattcccttaa

SEQ ID NO: 75938 - DNA, 20 bp, Artificial Sequence
  Description of Artificial Sequence: Synthetic oligonucleotide
  Target: SCN10A; (+) strand; PAM type: YTN; PAM sequence: TTT
tgcaggtatattcccttaag

SEQ ID NO: 75939 - DNA, 20 bp, Artificial Sequence
  Description of Artificial Sequence: Synthetic oligonucleotide
  Target: SCN10A; (+) strand; PAM type: YTN; PAM sequence: TTT
gcaggtatattcccttaagt

SEQ ID NO: 75940 - DNA, 20 bp, Artificial Sequence
  Description of Artificial Sequence: Synthetic oligonucleotide
  Target: SCN10A; (+) strand; PAM type: YTN; PAM sequence: TTG
caggtatattcccttaagtt

SEQ ID NO: 75941 - DNA, 20 bp, Artificial Sequence
  Description of Artificial Sequence: Synthetic oligonucleotide
  Target: SCN10A; (+) strand; PAM type: YTN; PAM sequence: TTC
ccttaagtttaatagctgtt

SEQ ID NO: 75942 - DNA, 20 bp, Artificial Sequence
  Description of Artificial Sequence: Synthetic oligonucleotide
  Target: SCN10A; (+) strand; PAM type: YTN; PAM sequence: CTT
aagtttaatagctgttcctg

SEQ ID NO: 75943 - DNA, 20 bp, Artificial Sequence
  Description of Artificial Sequence: Synthetic oligonucleotide
  Target: SCN10A; (+) strand; PAM type: YTN; PAM sequence: TTA
agtttaatagctgttcctgc

SEQ ID NO: 75944 - DNA, 20 bp, Artificial Sequence
  Description of Artificial Sequence: Synthetic oligonucleotide
  Target: SCN10A; (+) strand; PAM type: YTN; PAM sequence: TTT
aatagctgttcctgctaagc

SEQ ID NO: 75945 - DNA, 20 bp, Artificial Sequence
  Description of Artificial Sequence: Synthetic oligonucleotide
  Target: SCN10A; (+) strand; PAM type: YTN; PAM sequence: TTA
atagctgttcctgctaagca

SEQ ID NO: 75946 - DNA, 20 bp, Artificial Sequence
  Description of Artificial Sequence: Synthetic oligonucleotide
  Target: SCN10A; (+) strand; PAM type: YTN; PAM sequence: CTG
ttcctgctaagcaagccttt

SEQ ID NO: 75947 - DNA, 20 bp, Artificial Sequence
  Description of Artificial Sequence: Synthetic oligonucleotide
  Target: SCN10A; (+) strand; PAM type: YTN; PAM sequence: TTC
ctgctaagcaagcctttcta

SEQ ID NO: 75948 - DNA, 20 bp, Artificial Sequence
  Description of Artificial Sequence: Synthetic oligonucleotide
  Target: SCN10A; (+) strand; PAM type: YTN; PAM sequence: CTG
ctaagcaagcctttctattc

SEQ ID NO: 75949 - DNA, 20 bp, Artificial Sequence
  Description of Artificial Sequence: Synthetic oligonucleotide
  Target: SCN10A; (+) strand; PAM type: YTN; PAM sequence: CTA
agcaagcctttctattcggt

SEQ ID NO: 75950 - DNA, 20 bp, Artificial Sequence
  Description of Artificial Sequence: Synthetic oligonucleotide
  Target: SCN10A; (+) strand; PAM type: YTN; PAM sequence: CTT
tctattcggtgggcattcag

SEQ ID NO: 75951 - DNA, 20 bp, Artificial Sequence
  Description of Artificial Sequence: Synthetic oligonucleotide
  Target: SCN10A; (+) strand; PAM type: YTN; PAM sequence: TTT
ctattcggtgggcattcagc

SEQ ID NO: 75952 - DNA, 20 bp, Artificial Sequence
  Description of Artificial Sequence: Synthetic oligonucleotide
  Target: SCN10A; (+) strand; PAM type: YTN; PAM sequence: TTC
tattcggtgggcattcagcc

SEQ ID NO: 75953 - DNA, 20 bp, Artificial Sequence
  Description of Artificial Sequence: Synthetic oligonucleotide
  Target: SCN10A; (+) strand; PAM type: YTN; PAM sequence: CTA
ttcggtgggcattcagccct

SEQ ID NO: 75954 - DNA, 20 bp, Artificial Sequence
  Description of Artificial Sequence: Synthetic oligonucleotide
  Target: SCN10A; (+) strand; PAM type: YTN; PAM sequence: TTC
ggtgggcattcagccctccc

SEQ ID NO: 75955 - DNA, 20 bp, Artificial Sequence
  Description of Artificial Sequence: Synthetic oligonucleotide
  Target: SCN10A; (+) strand; PAM type: YTN; PAM sequence: TTC
agccctcccaagatgaacca

SEQ ID NO: 75956 - DNA, 20 bp, Artificial Sequence
  Description of Artificial Sequence: Synthetic oligonucleotide
  Target: SCN10A; (+) strand; PAM type: YTN; PAM sequence: CTC
ccaagatgaaccaacagcga

SEQ ID NO: 75957 - DNA, 20 bp, Artificial Sequence
  Description of Artificial Sequence: Synthetic oligonucleotide
  Target: SCN10A; (+) strand; PAM type: YTN; PAM sequence: TTT
ggttccccttgcctcctttt

SEQ ID NO: 75958 - DNA, 20 bp, Artificial Sequence
  Description of Artificial Sequence: Synthetic oligonucleotide
  Target: SCN10A; (+) strand; PAM type: YTN; PAM sequence: TTG
gttccccttgcctccttttt

SEQ ID NO: 75959 - DNA, 20 bp, Artificial Sequence
  Description of Artificial Sequence: Synthetic oligonucleotide
  Target: SCN10A; (+) strand; PAM type: YTN; PAM sequence: TTC
cccttgcctccttttttttt

SEQ ID NO: 75960 - DNA, 20 bp, Artificial Sequence
  Description of Artificial Sequence: Synthetic oligonucleotide
  Target: SCN10A; (+) strand; PAM type: YTN; PAM sequence: CTT
gcctcctttttttttttttt

SEQ ID NO: 75961 - DNA, 20 bp, Artificial Sequence
  Description of Artificial Sequence: Synthetic oligonucleotide
  Target: SCN10A; (+) strand; PAM type: YTN; PAM sequence: TTG
cctccttttttttttttttt

SEQ ID NO: 75962 - DNA, 20 bp, Artificial Sequence
  Description of Artificial Sequence: Synthetic oligonucleotide
  Target: SCN10A; (+) strand; PAM type: YTN; PAM sequence: CTC
cttttttttttttttttttt

SEQ ID NO: 75963 - DNA, 20 bp, Artificial Sequence
  Description of Artificial Sequence: Synthetic oligonucleotide
  Target: SCN10A; (+) strand; PAM type: YTN; PAM sequence: CTT
tttttttttttttttttttg

SEQ ID NO: 75964 - DNA, 20 bp, Artificial Sequence
  Description of Artificial Sequence: Synthetic oligonucleotide
  Target: SCN10A; (+) strand; PAM type: YTN; PAM sequence: TTT
ttttttttttttttttttga

SEQ ID NO: 75965 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttttgag

SEQ ID NO: 75966 - DNA, 20 bp, Artificial Sequence
  Description of Artificial Sequence: Synthetic oligonucleotide
  Target: SCN10A; (+) strand; PAM type: YTN; PAM sequence: TTT
ttttttttttttttttgaga

SEQ ID NO: 75967 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttgagac

SEQ ID NO: 75968 - DNA, 20 bp, Artificial Sequence
  Description of Artificial Sequence: Synthetic oligonucleotide
  Target: SCN10A; (+) strand; PAM type: YTN; PAM sequence: TTT
ttttttttttttttgagaca

SEQ ID NO: 75969 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttgagacaa

SEQ ID NO: 75970 - DNA, 20 bp, Artificial Sequence
  Description of Artificial Sequence: Synthetic oligonucleotide
  Target: SCN10A; (+) strand; PAM type: YTN; PAM sequence: TTT
ttttttttttttgagacaag

SEQ ID NO: 75971 - DNA, 20 bp, Artificial Sequence
  Description of Artificial Sequence: Synthetic oligonucleotide
  Target: SCN10A; (+) strand; PAM type: YTN; PAM sequence: TTT
tttttttttttgagacaagt

SEQ ID NO: 75972 - DNA, 20 bp, Artificial Sequence
  Description of Artificial Sequence: Synthetic oligonucleotide
  Target: SCN10A; (+) strand; PAM type: YTN; PAM sequence: TTT
ttttttttttgagacaagtt

SEQ ID NO: 75973 - DNA, 20 bp, Artificial Sequence
  Description of Artificial Sequence: Synthetic oligonucleotide
  Target: SCN10A; (+) strand; PAM type: YTN; PAM sequence: TTT
tttttttttgagacaagttc

SEQ ID NO: 75974 - DNA, 20 bp, Artificial Sequence
  Description of Artificial Sequence: Synthetic oligonucleotide
  Target: SCN10A; (+) strand; PAM type: YTN; PAM sequence: TTT
ttttttttgagacaagttct

SEQ ID NO: 75975 - DNA, 20 bp, Artificial Sequence
  Description of Artificial Sequence: Synthetic oligonucleotide
  Target: SCN10A; (+) strand; PAM type: YTN; PAM sequence: TTT
tttttttgagacaagttctc

SEQ ID NO: 75976 - DNA, 20 bp, Artificial Sequence
  Description of Artificial Sequence: Synthetic oligonucleotide
  Target: SCN10A; (+) strand; PAM type: YTN; PAM sequence: TTT
ttttttgagacaagttctca

SEQ ID NO: 75977 - DNA, 20 bp, Artificial Sequence
  Description of Artificial Sequence: Synthetic oligonucleotide
  Target: SCN10A; (+) strand; PAM type: YTN; PAM sequence: TTT
tttttgagacaagttctcac

SEQ ID NO: 75978 - DNA, 20 bp, Artificial Sequence
  Description of Artificial Sequence: Synthetic oligonucleotide
  Target: SCN10A; (+) strand; PAM type: YTN; PAM sequence: TTT
ttttgagacaagttctcact

SEQ ID NO: 75979 - DNA, 20 bp, Artificial Sequence
  Description of Artificial Sequence: Synthetic oligonucleotide
  Target: SCN10A; (+) strand; PAM type: YTN; PAM sequence: TTT
tttgagacaagttctcactc

SEQ ID NO: 75980 - DNA, 20 bp, Artificial Sequence
  Description of Artificial Sequence: Synthetic oligonucleotide
  Target: SCN10A; (+) strand; PAM type: YTN; PAM sequence: TTT
ttgagacaagttctcactct

SEQ ID NO: 75981 - DNA, 20 bp, Artificial Sequence
  Description of Artificial Sequence: Synthetic oligonucleotide
  Target: SCN10A; (+) strand; PAM type: YTN; PAM sequence: TTT
tgagacaagttctcactctg

SEQ ID NO: 75982 - DNA, 20 bp, Artificial Sequence
  Description of Artificial Sequence: Synthetic oligonucleotide
  Target: SCN10A; (+) strand; PAM type: YTN; PAM sequence: TTT
gagacaagttctcactctgt

SEQ ID NO: 75983 - DNA, 20 bp, Artificial Sequence
  Description of Artificial Sequence: Synthetic oligonucleotide
  Target: SCN10A; (+) strand; PAM type: YTN; PAM sequence: TTG
agacaagttctcactctgtt

SEQ ID NO: 75984 - DNA, 20 bp, Artificial Sequence
  Description of Artificial Sequence: Synthetic oligonucleotide
  Target: SCN10A; (+) strand; PAM type: YTN; PAM sequence: TTC
tcactctgttgtccaggctg

SEQ ID NO: 75985 - DNA, 20 bp, Artificial Sequence
  Description of Artificial Sequence: Synthetic oligonucleotide
  Target: SCN10A; (+) strand; PAM type: YTN; PAM sequence: CTC
actctgttgtccaggctgga

SEQ ID NO: 75986 - DNA, 20 bp, Artificial Sequence
  Description of Artificial Sequence: Synthetic oligonucleotide
  Target: SCN10A; (+) strand; PAM type: YTN; PAM sequence: CTC
tgttgtccaggctggagtgc

SEQ ID NO: 75987 - DNA, 20 bp, Artificial Sequence
  Description of Artificial Sequence: Synthetic oligonucleotide
  Target: SCN10A; (+) strand; PAM type: YTN; PAM sequence: CTG
ttgtccaggctggagtgcag

SEQ ID NO: 75988 - DNA, 20 bp, Artificial Sequence
  Description of Artificial Sequence: Synthetic oligonucleotide
  Target: SCN10A; (+) strand; PAM type: YTN; PAM sequence: TTG
tccaggctggagtgcagtgg

SEQ ID NO: 75989 - DNA, 20 bp, Artificial Sequence
  Description of Artificial Sequence: Synthetic oligonucleotide
  Target: SCN10A; (+) strand; PAM type: YTN; PAM sequence: CTG
gagtgcagtggcacaatcac

SEQ ID NO: 75990 - DNA, 20 bp, Artificial Sequence
  Description of Artificial Sequence: Synthetic oligonucleotide
  Target: SCN10A; (+) strand; PAM type: YTN; PAM sequence: CTC
attgcagccttgacctccca

SEQ ID NO: 75991 - DNA, 20 bp, Artificial Sequence
  Description of Artificial Sequence: Synthetic oligonucleotide
  Target: SCN10A; (+) strand; PAM type: YTN; PAM sequence: TTG
cagccttgacctcccatgtt

SEQ ID NO: 75992 - DNA, 20 bp, Artificial Sequence
  Description of Artificial Sequence: Synthetic oligonucleotide
  Target: SCN10A; (+) strand; PAM type: YTN; PAM sequence: CTT
gacctcccatgttcaagtga

SEQ ID NO: 75993 - DNA, 20 bp, Artificial Sequence
  Description of Artificial Sequence: Synthetic oligonucleotide
  Target: SCN10A; (+) strand; PAM type: YTN; PAM sequence: TTG
acctcccatgttcaagtgat

SEQ ID NO: 75994 - DNA, 20 bp, Artificial Sequence
  Description of Artificial Sequence: Synthetic oligonucleotide
  Target: SCN10A; (+) strand; PAM type: YTN; PAM sequence: CTC
ccatgttcaagtgatcctcc

SEQ ID NO: 75995 - DNA, 20 bp, Artificial Sequence
  Description of Artificial Sequence: Synthetic oligonucleotide
  Target: SCN10A; (+) strand; PAM type: YTN; PAM sequence: TTC
aagtgatcctcccacctcag

SEQ ID NO: 75996 - DNA, 20 bp, Artificial Sequence
  Description of Artificial Sequence: Synthetic oligonucleotide
  Target: SCN10A; (+) strand; PAM type: YTN; PAM sequence: CTC
ccacctcagcctcccaagta

SEQ ID NO: 75997 - DNA, 20 bp, Artificial Sequence
  Description of Artificial Sequence: Synthetic oligonucleotide
  Target: SCN10A; (+) strand; PAM type: YTN; PAM sequence: CTC
agcctcccaagtagtggaac

SEQ ID NO: 75998 - DNA, 20 bp, Artificial Sequence
  Description of Artificial Sequence: Synthetic oligonucleotide
  Target: SCN10A; (+) strand; PAM type: YTN; PAM sequence: CTC
ccaagtagtggaactacagg

SEQ ID NO: 75999 - DNA, 20 bp, Artificial Sequence
  Description of Artificial Sequence: Synthetic oligonucleotide
  Target: SCN10A; (+) strand; PAM type: YTN; PAM sequence: CTA
caggtatgtgccaccacgcc

SEQ ID NO: 76000 - DNA, 20 bp, Artificial Sequence
  Description of Artificial Sequence: Synthetic oligonucleotide
  Target: SCN10A; (+) strand; PAM type: YTN; PAM sequence: CTG
gctaatcttcatatttttga

SEQ ID NO: 76001 - DNA, 20 bp, Artificial Sequence
  Description of Artificial Sequence: Synthetic oligonucleotide
  Target: SCN10A; (+) strand; PAM type: YTN; PAM sequence: CTA
atcttcatatttttgatggg

SEQ ID NO: 76002 - DNA, 20 bp, Artificial Sequence
  Description of Artificial Sequence: Synthetic oligonucleotide
  Target: SCN10A; (+) strand; PAM type: YTN; PAM sequence: CTT
catatttttgatggggtttt

SEQ ID NO: 76003 - DNA, 20 bp, Artificial Sequence
  Description of Artificial Sequence: Synthetic oligonucleotide
  Target: SCN10A; (+) strand; PAM type: YTN; PAM sequence: TTC
atatttttgatggggttttt

SEQ ID NO: 76004 - DNA, 20 bp, Artificial Sequence
  Description of Artificial Sequence: Synthetic oligonucleotide
  Target: SCN10A; (+) strand; PAM type: YTN; PAM sequence: TTT
ttgatggggtttttccatgt

SEQ ID NO: 76005 - DNA, 20 bp, Artificial Sequence
  Description of Artificial Sequence: Synthetic oligonucleotide
  Target: SCN10A; (+) strand; PAM type: YTN; PAM sequence: TTT
tgatggggtttttccatgtt

SEQ ID NO: 76006 - DNA, 20 bp, Artificial Sequence
  Description of Artificial Sequence: Synthetic oligonucleotide
  Target: SCN10A; (+) strand; PAM type: YTN; PAM sequence: TTT
gatggggtttttccatgttc

SEQ ID NO: 76007 - DNA, 20 bp, Artificial Sequence
  Description of Artificial Sequence: Synthetic oligonucleotide
  Target: SCN10A; (+) strand; PAM type: YTN; PAM sequence: TTG
atggggtttttccatgttcc

SEQ ID NO: 76008 - DNA, 20 bp, Artificial Sequence
  Description of Artificial Sequence: Synthetic oligonucleotide
  Target: SCN10A; (+) strand; PAM type: YTN; PAM sequence: TTT
ttccatgttccccaggctgg

SEQ ID NO: 76009 - DNA, 20 bp, Artificial Sequence
  Description of Artificial Sequence: Synthetic oligonucleotide
  Target: SCN10A; (+) strand; PAM type: YTN; PAM sequence: TTT
tccatgttccccaggctggt

SEQ ID NO: 76010 - DNA, 20 bp, Artificial Sequence
  Description of Artificial Sequence: Synthetic oligonucleotide
  Target: SCN10A; (+) strand; PAM type: YTN; PAM sequence: TTT
ccatgttccccaggctggtc

SEQ ID NO: 76011 - DNA, 20 bp, Artificial Sequence
  Description of Artificial Sequence: Synthetic oligonucleotide
  Target: SCN10A; (+) strand; PAM type: YTN; PAM sequence: TTC
catgttccccaggctggtct

SEQ ID NO: 76012 - DNA, 20 bp, Artificial Sequence
  Description of Artificial Sequence: Synthetic oligonucleotide
  Target: SCN10A; (+) strand; PAM type: YTN; PAM sequence: TTC
cccaggctggtctcaaactc

SEQ ID NO: 76013-76042 - skipped (30 entries)

SEQ ID NO: 76043 - DNA, 23 bp, Artificial Sequence
  Description of Artificial Sequence: Synthetic oligonucleotide
  modified_base (1)..(21): a, c, t, g, unknown or other
nnnnnnnnnnnnnnnnnnnnnrg

SEQ ID NO: 76044 - RNA, 100 nt, Artificial Sequence
  chemically synthesized
  modified_base (1)..(20): n is a, c, g, u, or other
nnnnnnnnnnnnnnnnnnnnguuuuagagcuagaaauagcaaguuaaaauaaggcuaguccguuaucaacuugaaaaaguggcaccgagucggugcuuuu

SEQ ID NO: 76045 - RNA, 96 nt, Artificial Sequence
  chemically synthesized
  modified_base (1)..(20): n is a, c, g, u, or other
nnnnnnnnnnnnnnnnnnnnguuuuagagcuagaaauagcaaguuaaaauaaggcuaguccguuaucaacuugaaaaaguggcaccgagucggugc

SEQ ID NO: 76046 - RNA, 114 nt, Artificial Sequence
  chemically synthesized
  modified_base (1)..(30): n is a, c, g, u, or other and this region may encompass 17-30 nucleotides;
  modified_base (107)..(114): This region may encompass 1-8 urasil;
nnnnnnnnnnnnnnnnnnnnnnnnnnnnnnguuuuagagcuagaaauagcaaguuaaaauaaggcuaguccguuaucaacuugaaaaaguggcaccgagucggugcuuuuuuuu
